United States Patent 9,834,782 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 2

SEQ ID NO: 1491 - DNA, 751 bp, Valeriana officinalis
atggtcaagtattccagggaacccgacaaccataccaaatcctgcaaagccaggggatctgatctcagatgccattttaagaacacaagagaaacagcccatgctatccgcaagttgggtttgacaaaggccaaaaggtatttggaggatgttcttgtacacaagcaagccattccattcacaagattttgtcgtggagttgggcgaactgctcaggccaagaaccgtcactcaaatggtcaaggacgctggcccgtcaaatctgctaagtttattcttgatttgctcaagaatgctgaaagcaatgctgaagttaaagggttggatgtggattcgctcttcatttctcatatccaggtaaaccaagcacagaagcagaggcgtagaacttaccgtgcccatggaagaatcaatccttacatgtcatctccttgccatattgagttgatcttgtctgagaaggaagaatctgtcaagaaggaggctgagacccagttggcaccaaggaagaaggggaagagtcaagttttgcgcagcggtgcatcttcttgaatagcaagtctagctggtttctatgcgttttgaggattttttttttttgttgaactcttttactatttcgttttattgtctgggttaaggtgttactgcaatgttgtttttgtcagagattttgtggaattattgctatttttgaccaagtttaaagtattgtagtagtgtcttttgttaaaccaacaaattgaattta

SEQ ID NO: 1492 - DNA, 785 bp, Actinidia deliciosa
  misc_feature (573)..(573): n is a, c, g, or t
  misc_feature (586)..(586): n is a, c, g, or t
  misc_feature (613)..(613): n is a, c, g, or t
  misc_feature (619)..(619): n is a, c, g, or t
tggaaagctgcagcgaggaggagcagccacagccatggtgaagtactcgagagaaccggacaatcccaccaagtcttgcaaagctaggggctccgatctccgcgttcattttaagaatacaagagagacagcgcatgcaattcgaaagttgcctctaaccaaggccaaaaggtatttggaggatgttcttgctcacaaacaagccattccattcacacgcttctgtcgtggagttggacgaactgctcaggcaaagaaccgccattcaaatggacaaggacgttggcctgttaaatctgcaggatttattctggatttactcaagaatgccgagagtaatgcagaagtaaaaggcttggatgttgagtcactttacatatcgcacatccaagtaaaccaagcccagaagcagaggcgccgcacataccgggcacacggaagaatcaacccctatatgtcatctccctgccacattgagctgattttgtctgagaaggaagaaccagtcaagaaagagcctgagatgcaagtggcttcaagtaccaagaagggcagagctctacgcagtggcgnttctgcttgaacnacagagtgatagcccgatttgaggaanagcgcngtggattttcatttctttgtcttgtgttgtgggaacattttttgttttgggtcttgatcttttaagaaatgttcttatttgtgttgaattttgaattcttaaattgctataactggagagttggagtttctggatggaactagatggtttccttaaaaaaaaaaaa

SEQ ID NO: 1493 - DNA, 911 bp, Gossypium raimondii
aaattgcccaataaacccaaaaaaacattgggcgggaaaataagaaagcccaatagaaaatcgtaaaccctaaaaaaccatcccttttatttgccaaagaaaccctagctacgcacctcttctcttgcagcggtagggaaccaactgttacacacagcagcagcagcagccatggtgaagtactcaagagaaccggacaaccctactaaatcttgcaaagctaggggttctgaccttcgtgttcattttaagaatacacgagaaactgcctttgcaatccgaaagctacctttgacaaaggcaaaaaggtacttggaagatgttattgcccacaagcaagcaattccattcaggcgcttctgtggtggagttgggcgaaccgcacaggctaagaatcgccattctaatggacaaggccgttggcccgtgaaatctgcaaaattcattctcgatttgctcaagaatgccgagagcaatgctgaggtgaaaggcttggatgtagattcacttatcatatctcacatccaagtaaaccaagcacagaagcaaaggcgccgaacatatcgtgcacatggaagaattaacccctacatgtcttcaccgtgtcacattgaactaatcctgtctgagaaagaggaagccgtcaaaaaagagccggagactcagttggctccgaggaaatcaaagggtgcttcggcttaaactgctgagtgatggaattttctttttgttgtctctgtaatggggaacctttttgtttacttcacaatggggtgcttaagacttaaaagtttgtctatggagattcgtggtttctatttaaagctatgctcttaatacttaattaaatttatattgaaaaatccatcagattaattgaattaatcgagcgttaattattttattataaa

SEQ ID NO: 1494 - DNA, 862 bp, Gossypium raimondii
ctcctcttctctgttacacacagcagcagcaaccatggtgaagtattcaagagaaccggacaaccctactaaatcttgcaaagctaggggttctgaccttcgtgttcattttaagaatacacgagaaactgcctttgccatccgaaagctacctttgacaaaggcaaagagatacttggaggatgttattgcccacaagcaagcaattccgttccggcgcttctgtggtggagttgggcgaaccgcacaggctaagaatcgccattctaatggacaaggtcgctggcctgtgaaatctgcaaaattcattctcgatttgctcaagaacgctgagagcaatgccgaggtgaaaggtttggatgtagactcacttatcatatctcacatccaagtgaaccaagcacagaagcaaaggcgccgaacatatcgtgcacatggaaggattaacccctacatgtcttcacagtgtcacattgaactgatactgtcagagaaagaggaacctgtgaaaaaagagcctgagactcagttggctccgaggaaatcgaagggtgcttcatcttaaattgctgagcggtggattataacttggaaactattacatttttctttagttgtctctgtaatgagaacatttttgtttcccttcacaatgaggtgtttaagactcaaagtttgtctatggagattcttggttctatggtgattttgcttgtaatacttaagtagctcgtaaacctgattaagttctatatttgtattcttatttttatcgattctttaaaatattcaaacttaagcttgaaatctgttttaaataaataattctttgtattctttcaacgtcatttttatttattta

SEQ ID NO: 1495 - DNA, 973 bp, Catharanthus roseus
tacagcggtcttcttattcaatcgcagaagcagcagcaggaaaaaaatggtgaagtactctagggagccggacaatcccaccaagtcctgcaaggccaggggttctgacctccgtgttcatttcaagaacactagggagacagctcatgccatcaggaagctgcctctagtaaaagctaaaaggtatctggaggatgttttggcccataagcaggccatcccattcactcggtactgtggaggtgttggccgtactgctcaggctaagaacagacactccaacggacaaggtcgatggcccgtgaaatctgccaagttcattttggatctactacgaaatgctgaaagtaatgccgaggtcaaaggtttggacgtggattctttattcatctctcacatccaggtgaaccaggcccagaagcaaagacgccgcacataccgagcccacggaaggataaacccatatatgtcctctccgtgtcacattgaattaattttgtctgagaaagaagagccagtgaagaaggagcctgaatcacagttggcgaccagcaacaaatccaggaaggcttaaggtggtgtggagttttgggttataatattaggcacctggaagagtcgattaacgttgcaagttttgatttttttgtgtaattactttgtgccccttggattggagacaaagttattctggtgttgtcatattatatgaacctttggcaagcgagacacaattttgttaattgaggagtttttcatttctaaattcgaaggagttattgtggttcttctaactattttaaggattatcaaccacttgatgcagtttaatggatagttttggttgatcgctcgagtagtctacactgcatatgtagtagtagtagtggtagtatcttatttgtaatatataacggtgtattaaaaaatggagtttgtaaaagttaaaatggattacagatttttgtgaagg

SEQ ID NO: 1496 - DNA, 768 bp, Gossypium hirsutum
ttctcttgcagcggtagggaaccaactgttacacacagcagcagcagcagccatggtgaagtactcaagagaaccggacaaccctactaaatcttgcaaagctaggggttctgaccttcgtgttcattttaagaatacacgagaaactgcctttgcaatccgaaagctacctttgacaaaggcaaaaaggtacttggaagatgttattgcccacaagcaagcaattccattcaggcgcttctgtggtggagttgggcgaaccgcacaggctaagaatcgccattctaatggacaaggccgttggcccatgaaatctgcaaaattcattctcgatttgctcaagaatgccgagagcaatgctgaggtgaaaggcttggatgtagattcacttatcatatctcacatccaagtaaaccaagcacagaagcaaaggcgccgaacatatcgtgcacatggaagaattaacccctacatgtcttcaccgtgtcacattgaactgatcctgtctgagaaagaggaagccgtcaaaaaagagccggagactcagttggctccgaggaaatcaaagggtgcttcgtcttaaactgctgagtgatggattgttagtcggaagcttttaatttgttgtctctgtaatgagaacatttttgtttacttcacaatgaggtgcttaagactcaaaagtttgtctgtggagattcctggtttctatttaaagctatgctcatttcgcattgaatatcttaatacttaattaaatttatattg

SEQ ID NO: 1497 - DNA, 843 bp, Gossypium hirsutum
gtctaaagaaaccctaacacacacagcggcagcaaccatggtgaagtattcaagagaaccggacaaccctactaaatcttgcaaagctaggggttctgaccttcgtgttcattttaagaatacacgagaaactgcctttgccatccgaaagctacctttgacaaaggcaaagagatacttggaggatgttattgcccacaagcaagcaattccgttccggcgcttctgtggtggagttgggcgaaccgcacaggctaagaatcgccattctaatggacaaggtcgctggcctgtgaaatctgcaaaattcattctcgatttgctcaagaacgctgagagcaatgccgaggtgaaaggtttggatgtagactcacttatcatatctcacatccaagtgaaccaagcacagaagcaaaggcgccgaacatatcgtgcacatggaaggattaacccctacatgtcttcacagtgtcacattgaactgatactgtcagagaaagaggaacctgtgaaaaaagagcctgagactcagttggctccgaggaaatcgaagggtgcttcattttaaattgctgagcggtggattataacttggaaactattacatttttctttagttgtctctgtaatgagaacatttttgtttccttcacaatgaggtgtttaagactcaaagtttgtctatggagattcttggttctatggtgattttgcttgtaatacttacgtagctcgtaaacctgattaagttctatatttgtattcttatttttatcgattctttaaaatattcaaacttaagcttgaaatctgttttaaataagtaattctttgtattctttc

SEQ ID NO: 1498 - DNA, 596 bp, Gossypium hirsutum
tcttgcagcggtagggaaccaactgttacacacagcagcagcagcagccatggtgaagtactcaagagaaccggacaaccctactaaatcttgcaaagctaggggttctgaccttcgtgttcattttaagaatacacgagaaactgcctttgcaatccgaaagctacctttgacaaaggcaaaaaggtacttggaagatgttattgcccacaagcaagcaattccattcaggcgcttctgtggtggagttgggcgaaccgcacaggctaagaatcgccattctaatggacaaggccgttggcccgtgaaatctgcaaaattcattctcgatttgctcaagaatgccgagagcaatgctgaggtgaaaggcttggatgtagattcacttgtcatatctcacatccaagtaaaccaagcacagaagcaaaggcgccgaacatatcgtgcacatggaagaattaacccctacatgtcttcaccgtgtcacattgaactaatcctgtctgagaaagaggaagccgtcaaaaaagagccggagactcagttggctccgaggaaatcaaagggtgcttcagcttaaactgctgagtgatgga

SEQ ID NO: 1499 - DNA, 668 bp, Humulus lupulus
gccacttcgtcaaggaaaattttgagtcggaagcggaaggtcagaagaagccatggtgaagtattctaaagagcctgataaccctaccaagtcctgcaaatccagggggtctgatctcagagttcactttaagaatactagggagacagcgttcgcaattagaaagctgcctttgatcaaggctaaaaggtatttggaggatgttttggcacacaagcaagctatcccattccgtcgcttctgtagaggagtagggcgaactgcacaggctaaaaatcgccactcaaatggacaaggacgttggccagttaaatctgccaagtttattcttgacctactcaaaaatgctgagagcaatgctgaggtgaaaggtttggatgttgattcactttacatttctcacatccaagtgaaccaagctcaaaagcaaaggcgtcgtacataccgtgcccatggaagaattaatccttacatgtcatccccatgccatatcgagttgactttgtcagagaaagaagagcctgtcaagaaagagcctgaaagtcagttggcttctaggaaaccagagaagagtcgagcttagagagctctatgaggtggtgccgctgcttcttcaacagctgaaggtgtaggctagtagaaatccaaggcgactttgagtactcagt

SEQ ID NO: 1500 - DNA, 835 bp, Aquilegia formosa
gaaggtgaagggaggtgaaactaaaacccctccattagagtagctgtagtagaagaagaagatttcaccatggtgaagtattcaaaggaacctgataatccgactaagtcttgtaaggctagaggatcggatctgcgagttcattttaagaacacaagggagacagcccactccattaggaagatgtctttggtcaaggctaaaagatatctcgaggatgtgttagcccacaagcaggctattcctttcagacgtttttgtaggggtgttggacgcactgcccaggtgaaagatcgccatccaaatggacaaggacgctggccagttaaatcagcaaaatttgttcttgatttgctgaaaaatgcagagagcaatgctgatgttaaaggtttggatgtggatgctctatatgtttcacacattcaagtaaaccaagcccagaagcaaaggcgtaggacataccgtgcacatggaagaattaacccctacatgtcatctccttgtcatattgaattgaccttgtctgagaaagaagaacctgtcaagaaagaggctgagacccagttgactcaaagtaggccaaagaaaactcttcgaagtggtgcttcctcttaagctatgtgaagtttggatttgctgaaagtcttgagcttgttcagttgtttttagccagtccaaggcaattttaattttctagaatctatattctctgagatccttcatcatcttttttgttccaattatactatttgtgaattagtttggattaatagttacaggttttaaatttaatatggtcagcttaattaatcatttcaccattttgaaccaattt

SEQ ID NO: 1501 - DNA, 1110 bp, Abies balsamea
ttcttgactactattgtttcagtttaggaggaggggtggtgtgaggctaggcgaggcgaggtgggaagaagagaagagaagagcagaggttgtggaggccgcagccatggtgaaatactcaagggagcccggcaatcccaccaaatctgcaaaagctagggggtccgatttgcgtgttcattttaagaacacaagagaaactgcacaggcagttaaaaaactacaattagtcaaggctaagaggtatctggaggatgttatcgcccacaaacaagcaataccatttcgccgcttttgtggaggtgttggaagaactgcccaagcaaagtcacggaattcaaatggacagggtcgctggcccgtcaagtcagctgaattcttgttaggtttacttaaaaatgcagagagtaatgctgaggtaaaggggcttgatgtggatacactttatatttctcacattcaagtgaaccaggctcaaaagcagcggagacgcacctaccgtgcccatggaagaattaatccttacatgtcatcaccatgtcacattgagctgatattgtctgaaaaggaagcacctgtgaaaaaagaggctgaaactcaaattgcttcaaggaaaccaaggaaagctcaaacgcttcgaagtggtgcctcatcatgagatgctgaagcagtttgaatttcagcacaacaataccatatttttaacagaaaccttatccggtttatattttagtgactgtaggaaactacatctgtttttgtttcctggcatagtatggattgtagagaaacgttttactatttaaaactttagtttaattcatgttattgctgctttgtgtgatttaccggctgctgttagagtgagagtcagcctggtaaacatacaaaagtgtaggaaagctttgctccttatgtttttcatggcataaaactctggatggtttatgtgatccttaaggtaaggaaaatttaaagacttattttcatgcataccatgaggacttatctgcaaggctgtctggggaatgaaggttcaggttcagttgacaggtccaccagatgtgagttgtcaacattcgacttttgttagatagttcaccatattct

SEQ ID NO: 1502 - DNA, 888 bp, Citrullus lanatus
tttagggttttgtagagtttgtcccctctcttcttataaacctaattcaagcatttcccttcctccgttcacggccaaatccaacttttcttcacaaactcgaagttgcagccgtcgccatggtgaagtattccagggaaccagacaatcctaccaagtcctgcaaagcccgtggctcggacctcagagttcactttaagaacacaagggaaactgcacatgctatcagaaagttgccactggccaaggccaagaggtacctagaggatgtgcttgcccacaaacaggccattcctttccgtcgcttctgtggtggtgttggacgaactgctcaggcaaagaacaggcattccaatggtcaaggacgttggcctgtcaaatctgcaaagtttattctagatttgctgaagaatgctgagagcaatgctgaagttaagggtctggatgttgatttgctccacgtatctcacatccaagtaaaccaagctcagaaacaaaggcgtcgtacctaccgtgctcatggaagaatcaacccttacatgtcttctccttgccacattgagctgatcttgtctgaaaaggaagagcctgttaagaaggagccggagactcagctggcgactggcaaacctaagaaaggtcaagcaatccgtagtggcgcttcctcttgaatggcaaaagtataaattctgtttgtgggtttttgctgtgccaaatgtttttttgaagtgagtttaattattgatcactatatagaacgagggattactatttaggtgttttctgtgacatgttatatttggaaccttttctagttcaattttcttcaagttgcaatcacattctggtattttgcttttatttcttgatgaaatctcttgacccctt

SEQ ID NO: 1503 - DNA, 818 bp, Cynara scolymus
  misc_feature (42)..(42): n is a, c, g, or t
  misc_feature (48)..(48): n is a, c, g, or t
ggctggtccctccaaacatacacaattctgcagcagtcgcancggcgnaaccagcagcagcaatggtgaagtattcgaaggagccagagaaccctaccaaatcttgcaaagccagaggatccgatctcaggtgccatttcaagaacactagagaaactgcacatgctattcgtaagttgcctttaatcaaggctaagagatacttggaggatgttcttgttcataaacaagcaattccattcacacgtttctgtcgtggagttggacgtactgcacaggcaaagaatcgccactcaaatgggcaaggacgttggcctgctaaatccgcaaaattcattctggacttgctaaagaatgctgagagtaatgcagaagtcaaagggttggatgtggatgctctccatatctcccacattcaggtgaaccaagcacaaaagcagagacgtcgcacataccgtgctcatggaagaatcaatccttacatgtcttctccctgtcatatcgaactgactttgtccgagaaggaagaacctgtcaagaaagaggccgagactcagttggctcctagaaagaacaagaatcaagcttaacttgcggattttgcagccccgtctctttgtggtttgatgacagaacaagttcttttcatttttgcgatgcgtttttcatcttagatactcgtaatgaatgttcgtttcgattacaagaacttcatagctgaagttgagtgaatcatttaaagttgtctcagaaattttatatgcttgcaatggttttgtacactattatgaagcttacttttgccctcatttttgtcg

SEQ ID NO: 1504 - DNA, 746 bp, Taraxacum officinale
cggggtagacattagctggtgtgacctccgcaaacgcctcccgattctgtagcagtcgcaccggcgaaacgagcagcagccatggtgaagtattccaaggagccagaaaaccctaccaagtcctgcaaagcaagaggatcggatctcaggtgtcatttcaagaacacaagagaaaccgcacatgctcttcgcaagatgtctttaatcaaggctaaaagttacctggaagatgttcttgttcacaaacaagccattccgttcactcgtttttgtcgtggagttggacgaactgcacaagcaaaaaaccgtcattcaaatgggcaaggacgttggcctgctaagtctgcaaaattcattcttgacttactaaagaatgctgaaagtaatgcagaagtcaagggtttggatgtggatgctctttatatctcccacattcaggtgaaccaagctcagaaacagaggaggcggacataccgtgctcatggaagaatcaatccttacatgtcatctccatgccatattgaactgacattatcagaaaaggaagaaccagtgaagaaagagcctgagagtcagttggctcctagaaagaccaagaatcaagcttaattttatggatccattatcaaaacaagtttttgatttctttttgttggtgtatttgaatttttggatacttgtattgaatttggtttaaagatttttcatagttgagtaatattaaatccaatatgaacttatgtttg

SEQ ID NO: 1505 - DNA, 811 bp, Lactuca sativa
gagcccactatggctcactttcttacgccctaggttttctttgtgtgccatatatatataaacgcggagtacacgagctgcgccggaaaccctcaaaccgaaaacccgttcccctcaccgcaggaggagtaacagcagccatggtcaaatactcaaaggagcctgataatcccaccaaatcctgcaaggccaggggttcagatctcagatgtcacttcaagaataccagagaaacagcacatgctctcaggaaaatgcctttaataaaggctaagaggtatttggaagatgtcctgatccataaacaggctattcccttcacccgattttgtaggggtgttggtcgtacagctcaggctaaaaacagacattccaacggtcaaggtaggtggcctgccaagtcagcaaagttcattttggatttgctcaagaatgctgaaagcaatgctgaggtgaaagggttggatgtggatgcccttttcatttctcatatacaagtcaaccaagcacaaaaacaaagaaggagaacttaccgtgctcatgggagaatcaacccttatatgtcatcaccttgccatattgagttgactttatctgagaaggaagaacctgtgaaaaaggaggctgaatctcaattggcaactagtggcaagtcgaagaaaccttgattaagttttcaagtacttttggattgattgatattttggtttttaaagactgaagttgttctctacatattttgattttgtaccaggatattggatattttttatggtagaaattgaaatctttattaagttttgtctttctt

SEQ ID NO: 1506 - DNA, 748 bp, Lactuca sativa
ttcccgtcaccgcaggaggagtagaagcagccatggtcaaatactcaaaggagcctgataaccccaccaaatcctgcaaggctaggggttcagacctcagatgtcacttcaagaataccagagaaacagcacatgcattgaggaaaatgcctttaataaaggctaagaggtatttggaagatgttctgatccataaacaggctattcccttcacccgattttgtaggggtgttggtcgtactgctcaggcaaaaaacagacattccaatggtcaaggaaggtggcccgccaagtcagcaaagttcattttggatttgcttaagaatgctgaaagcaatgctgaggtgaaagggttagatgtggatgcccttttcatttcccatattcaagtcaaccaagcacaaaaacaaagaaggaggacttaccgtgcccatgggagaatcaacccttatatgtcatcaccttgccatattgaattgactttatctgagaaggaagaacccgtgaaaaaggaggctgaatctcaattggcaaccagtggcaagtcgaagaaaccttgattaagttatcaagtgcttttggtttttgtaagactgaaattgttctactacatattttgattttgtaccaggatattggatatttttttatggtagaaattgaaatctggattaagttttgtatttcttttaatctagtgttgcatgaggatgctgttttggtaatattaaaacctattttgttgttt

SEQ ID NO: 1507 - DNA, 797 bp, Salvia sclarea
ctactagaccttggctgtcactcaaagaagggcaatcgacttccatcattttctgcagtaaggagccgccgcagcaacaatggtgaagtactcgagagagcccgataacatcaccaaatcctgcaaagccaggggatccgatctcagagtccatttcaagaacactagggagacagcgcacgccatcaggaagctgcctttgggcaaggccaagaggtacttggaggatgtgcttgcccacaagcaggccatacctttcactcgtttctgtggcggtgttggccgaactgctcaggctaagaatagacactctaacggacagggccgctggccagtgaaatctgccaagttcatcttggatttacttaagaatgctgagagtaatgctgaggtgaaaggtttggatgtggatgcgctattcatttcccacattcaggttaaccaggcccagaagcaaaggcgtcgcacataccgtgcccatggaaggattaatccccacatgtcgtccccatgccatattgagttgattttgtcagaaaaggaagagcctgtgaaaaaggagcccgaatcgcagttggcaacaagcaaacctaggaagtcttgagctattggctatttgttggatcatataatagttcaagttttgaagttgttttttggtttactacttttttctgaaccaatttcgttttattttaatccatgtttcggattttggagattaatcgaaattttcgtatgttttggctatgtattgtggatcctaaatagtagaattcttcttgaacttctcacgg

SEQ ID NO: 1508 - DNA, 847 bp, Nicotiana tabacum
agcgaaaagacatctgtatcagcagctgctggggagtagcagcataaacggcaaccatggtgaagtattcaagggaaccagagaaccccacaaaatcttgcaaagctaggggctcggatctcagagtccatttcaagaatactagagagacagcgcatgcccttaggaagatgcctttggacaaggcaaagagatacttggaggatgttattgcccacaagcaggccattcccttcacacgattttgtcgtggggttggtcgtactgctcaggcaaagaatcgccactcaaatggacaaggacgttggcctgtcaaatctgcagggtttattctagatttactcaagaatgctgagagtaatgctgaagttaaaggcttggacgtggattcactttacataactcacatccaagtaaaccaagcccagaaacagaggcgccgcacgtaccgtgctcatggaagaatcaatccctacatgtctaatccgtgccacatcgagttgacattgtctgagaaggaagaatctgtcaggaaggagcccgagactcaattggctcccacaaagacaaaggcatcctcttgatgagaggaatgaatctctgaattttcatagtataatctcaatgtccctatagccttagtatcaggagaattttgtgctgttcgaagtatttttttcataggaatgtggttttttgtaattttactatttcggagtttgaaggttgtcattttgaggcatgtttcgcttgaaattttgagttctatctttcaaagattgtattgggaatgtttattgtttgacggctgaggctacatgaaaattttaatttaatttgattgggt

SEQ ID NO: 1509 - DNA, 823 bp, Nicotiana tabacum
gggcaacgaagaagcgagctctaccagccgcagcaggagaaggggagtaaccgcagcatcgacagcagccatggtgaagtattcgagggaacccgacaaccctaccaagtcctgcaaagctaggggcgcaagtctcagagttcactttaagaatacacgagagacagcccatgcacttaggaaaatgcctttggacaaggccaagagatatctagaagatgttcttgctcacaaacaagccattcctttcacacgcttttgtggtggggttggtcgtactgctcaggtaaagcatcgccattcaaatggtcaaggacgttggccagtcaaatctgccaagattattctggatttactcaagaatgctgagagcaatgctgaggttaaaggcttggatgtggattcactttacatatctcacatccaagtaaatcaagcacaaaaacagaggcgccgcacgtaccgagctcatggaagaataaacccctacatgtctcacccctgccatgttgagttgacattatctgaaaaggaagagtctgtcaagaaggagcctgagacacaattggctcctaggaaggcaaaggcatcctcttaatccggacagtggctccaggaatgcagatggtggaatgttttccgtttcgttgtagtctgtcatgaaacaattttggcattttgaaccatttttatgtttctccagaaatttgtggtactatttagcatgcccttgctattctgaaacttgaattgaatgtttaccttattgcttattagtggctgaacccatgaaaattttgcgtttggttgatcaccaagtctt

SEQ ID NO: 1510 - DNA, 889 bp, Lactuca sativa
gagcccattacggctcactttattacgccctaggttttctttttgttccatatatataaacgcgggtacacgagctgcgccggaaacactcaaaccgaaaacccgttcccgtcaccgcaggaggagtagaagcagccatggtcaaatactcaaaggagcctgataaccccaccaaatcctgcaaggctaggggttcagacctcagatgtcacttcaagaataccagagaaacagcacatgcattgaggaaaatgcctttaataaaggctaagaggtatttggaagatgttctgatccataaacaggctattcccttcacccgattttgtaggggtgttggtcgtactgctcaggcaaaaaacagacattccaatggtcaaggaaggtggcccgccaagtcagcaaagttcattttggatttgcttaagaatgctgaaagcaatgctgaggtgaaagggttagatgtggatgcccttttcatttcccatattcaagtcaaccaagcacaaaaacaaagaaggaggacttaccgtgcccatgggagaatcaacccttatatgtcatcaccttgccatattgaattgactttatctgagaaggaagaacccgtgaaaaaggaggctgaatctcaattggcaaccagtggcaagtcgaagaaaccttgattaagttatcaagtgcttttggtttttgtaagactgaaattgttctactacatattttgattttgtaccaggatattggatattttttttatggtagaaattgaaatctggattaagttttgtatttcttttaatctagtgttgcatgaggatgctgttttggtaatattaaaacctattttgttgtttttagttcctgcttttaacagatatttgtgtctttg

SEQ ID NO: 1511 - DNA, 727 bp, Arnica chamissonis
ggcgacgcgatcgtcatcagcagtcatggtgaagtactcaaaggaaccagagaaccccaccaaatcttgcaaagccaggggatcggatctcaggtgtcatttcaagaacactcgtgaaaccgcccatgctatccgtaagttgcctctaatcaaggctaagagatacttagaagatgtattggcccacaagcaagccattccattcacccgtttttgtcgtggtgttgggcgtactgcacaagcaaaaaaccgtcactccaatggacaaggacgttggcctgctaagtctgcaaagtttatccttgatctgctgaaaaatgctgagagtaacgcagaagtcaaagggttggatgtggatgctcttcacatatctcacattcaggtgaaccaagcacagaaacagagacgtcgcacataccgtgcacatggaagaattaacccttacatgtcttctccttgtcacattgaactgactttgtctgagaaagaagaacctgttaaaaaggagcctgagacacagttggctcctagaaccaagaaccaggcttaagtcgacggtgcatcctcgtgagtgggactcgtagtttgttggtagaaagaattatgtttttgtttttgcgtgttatatcagaaccatgtgtctttgttatcaaagattcttatcctatattcagttatgaggtgattttgctttctgaaattaaaatgtcagaacaatattttattc

SEQ ID NO: 1512 - DNA, 806 bp, Nicotiana tabacum
ggccattacggccgggggctcaaatacaaaatccaaaactagctaacctattctcagccgaagcagcagcagccgccaccatggtgaagtactcccaagagcctgataatcccaccaaatcctgtaaagcccggggtgctgatctcagagttcatttcaagaacacaagggaaacagcccatgctatcaggaagcttccgctgaataaggccaaaaggtacttggaggatgtcttggcccacaagcaggccataccattcacacgcttctgtcgaggtgttggccgaactgctcaggccaagaataggcactcaaatggtcaaggacgttggccagtcaagtctgctggatttattctggatttgcttaagaacgcagagagcaatgctgaggtgaaaggattggatgtagattcactctatgtttctcatattcaggttaatcaggcacaaaagcaaagacgccgtacatatcgtgctcatggaaggattaacccttacatgtcttctccctgccatatcgagctaatattgtctgaaaaggaagagtccgtgaaaaaggaggctgaaacacagttggcagcaagcaaatctaggaaggcatagaaatagtttgccttggtcattcgagttttaagcagttattttataagatctcgaagtgttttatccctttttgtaattctttttcagcacaagtatcagtttggccctttggtatgattaacatatcaaacaacaatctagttgggaaaaggtctgctcttctatttagttatatatttgatgacttgcatcttgcaacaa

SEQ ID NO: 1513 - DNA, 1013 bp, Fagopyrum esculentum
tcgactctcccaagaacacacagcagctaacggaggtgccgaaaatggtgaagtactctcaagaaccggataatcctaccaagtcttgcaaggctcgtggatcagatctccgagttcatttcaagaacacaagggaaaccgcgttctctatcaggaagatgcagttagctaaggcaaagagatacttggaggatgttctaattcataagcaggccattccattccgtcgcttctgtagaggagttggaagaactgctcaagccaagaacgccggacatcccaatggtcagggaaggtggcctgctaaatctgcaaagttcatcctcgacttacttaagaatgctgagagtaatgccgagatgaaaggtttggatgtggattctctctacatctctcacattcaagttaacgaggctcagaagcagaggcgtcgtacttaccgtgctcatgggcgtatcaacccctacatgtcccacccatgtcacattgagttgatcttgtccgagaaagaggagccggtgaagaaggaaccagaggcacagattacaacaagcaagtctaagaagtctggtgttgtttcctcctaaatttccttgtgttttgcaaaattttattagatcttgatttagttcgagaggttatcacttgttttgcagacaagtcttattgcaagtttttatactttattgcgaggactgatttccttaactttgtttcattttaatttgcttgtgttttgcaaattcacattagatctttcttttgggttgtttaattatgttgtcacagtgctaagagaataatgccgtagcggtctctgttatctgtctgatggacctctccctagacatggtagaataaccttcacctctaggctgatcctagacagtatcaataattagtatcgattgtagccctctcattttagccatttgtcttactgtctgactagggctttgggtgaaaagagctttgcttttaatcgagttgctaatgaaataaatacgtaaagc

SEQ ID NO: 1514 - DNA, 912 bp, Fagopyrum esculentum
gaacccttgttttgaggcgccctcttcgttgtcagatcttcctcttcaatcacagttcagcggaagaggcagaaggaggccgaaaaatggtgaaatactctcaagaacccgataaccctaccaagtcttgcaaggctcggggatctgatcttcgagttcacttcaagaacacaagggaaaccgcgttttctatcagaaagatgcaattagctaaggcaaagaggtacttggaggatgttcttattcataagcaggcaattccattccgccgtttctgtagaggagtcggaagaactgctcaagcaaaaaacgctggtcatcccaatggtcagggaaggtggcctgccaaatctgcaaagttcatcctcgatttacttaagaatgctgagagtaatgctgagatgaaaggtttggatgtggattctctctacatctctcacattcaagttaacgaggctcagaagcagaggcgtcgtacttaccgtgctcatgggcggatcaacccttacatgtcacacccatgtcatatcgagttgatcttgtccgagaaagaggaaccagtcaagaaggaaccggaggctcagatcacaacaagcaagtcaaagaagtctggtgccgtttcctcctaaatttggttctctttcgcaaaatcacgttagatcttgaatcagtttgaggggttttgagtcttttgactagctcttgtttcctggtttgtagacaagcatttacgttttcttgcaattttgatactttatcgtgcctactgatttttgatggtcaatacgaaagtctatttagacaattttaaaaactggctactagtatgaaactgttatagttaccgtatttttacaagtgcgatgtagtgatccagttttgtaatttactttttatgaaaatcggtttaag

SEQ ID NO: 1515 - DNA, 782 bp, Fagopyrum esculentum
gaacccttgtttggaggcgccctcttcgttgtcagatcttcctcttcaatcacagttcagcggaagaggcagaaggaggccgaaaatggtgaaatactctcaagaacctgataaccctaccaagtcttgcaaggctcggggatctgatcttcgagttcacttcaagaacacaagggaaaccgcgttctctatcagaaagatgcaattagctaaggcgaagaggtacttggaggatgttcttattcataagcaggcaattccattccgccgtttctgtagaggagtcggaagaactgctcaagcaaaaaacgccggccatcccaatggtcagggaaggtggcctgctaagtctgcaaagttcatcctcgatttacttaagaatgctgagagtaatgccgagatgaaaggtttggatgtggattctctctacatctctcacattcaagttaacgaggctcagaagcagaggcgtcgtacttaccgtgctcatgggcggatcaacccttacatgtcacacccatgtcacattgagttgatcttgtccgagaaagaggaaccagtcaagaaggaaccggaggctcaaatcacaacaagcaagtctaagaagtctggcgttgtttcctcctaaattttgttgtcttttgcaaactcacattagttcttgattcagatcgggggacacttgttcttttcttgttttgcagtctgagtcttaaagttttctcgcaatctcacattagattttgatggtcaatctgagattctatttaaatattaaaaga

SEQ ID NO: 1516 - DNA, 851 bp, Fagopyrum esculentum
gggggccagtaatcattttacagccacaatctattataccctagcgcccttgctgctcctcttcttcccgaacccttgtttggaggcgccctcttcgttgccagatcttcctcttcaatcacagttcagcggaagaggcagaaggaggccgaaaatggtgaaatactctcaagaacccgataaccctaccaagtcttgcaaggctcgtggatccgatcttcgagttcacttcaagaacacaagggaaaccgcgttctctatcagaaagatgcagttagccaaggcaaagaggtacttggaggatgttcttattcacaagcaggccattccattccgccgtttctgtagaggagtcggaagaactgctcaagcgaaaaacgctggtcatcccaatggtcagggaaggtggcctgctaaatctgcaaagttcatcctcgatttacttaagaatgccgagagtaatgctgagatgaaaggtttggatgtggattctctctacatctctcacattcaagtcaatgaggctcaaaagcagaggcgtcgtacttaccgtgctcatgggcggatcaacccttacatgtcacacccatgtcacatcgagttgatcttgtccgagaaagaggaaccagtcaagaaggaacctgaggctcaaatcacaacaagcaagtcgaagaagtctggcgttgtttcctcctaaattttgttgtcttttgcaaaatcacattagttcttgattcagatcgagggacacttgttttttcttgttttgcagacgagtcttaaaagttttctcgcaattctcacattagattttgtcattttgatggtcaatctgaaattctatctagata

SEQ ID NO: 1517 - DNA, 734 bp, Fagopyrum esculentum
ccaaaggactaagggtttagcgtccacgatggtgaagtattcccaggaacccgataatcctaccaagtcttgcaaggctcgtggctctgatctccgtgttcatttcaagaacacaagggagactgcgttttccatcagaaagatgcctttggttaaggcaaagagatacctagaggatgttcttgtacacaaacaggccattccattccgtcgcttctgtagaggagtaggaagaactgctcaagcaaagaacgcaggccatcccaatggtcaggcaagatggcccgccaaatccgcgaaattcattcttgatttgctgaaaaacgcagagagcaatgccgagatgaagggtttggatgtggactccctttacgtatctcatgttcaggtcaaccaggcccagaagcaaaggcgtcgtacttaccgtgctcatgggagaatcaacccttacatgtcacacccatgccacatcgagttgattctgtccgagaaggaggaacccgtcaaaaaggagccggagactcaacttgcagcaagcaaatccaagaagtctgctgtttcctcttaattttgcctgcacaccgtttaggtttcattcaactgaggttctttgttttgccggtttagagagatttgaaagttttgttgcaattatcttactactatcattgacaatatatttttgattctcttacccgaaattctctttatggcttgggcttccttagttaacc

SEQ ID NO: 1518 - DNA, 812 bp, Fagopyrum esculentum
ggggactctcccaagaacacacagcagctgacggaggggccgaaaatggtgaaatactctcaagaacccgataatcctaccaagtcttgcaaggctcgtggatcagatcttcgagttcatttcaagaacacaagggaaaccgcgttctctatcaggaagatgcaattagcaaaggccaagaggtacttggaggatgttcttattcacaagcaggccattccattccgtcgcttctgtagaggagttggaagaactgctcaagccaagaacgccggacatcccaatggtcagggaaggtggcctgctaaatctgcaaagttcatcctcgatttacttaagaatgccgagagtaatgccgagatgaaaggtttggatgtggattctctctacatctctcacattcaagttaacgaggctcagaagcagaggcgtcgtacttaccgtgctcatgggcgtatcaacccctacatgtcccacccatgtcacattgagttgatcttgtccgagaaagaggagccagtgaagaaggaaccagaggcacagattacaacaagcaagtctaagaagtctggtgttgtttcctcctaaatttgcttgttttttgcaaaatcatattagatcttgatttagttcgagtgttttgcagacagtcttattgcaaattttcatactttattgcgaggactgatttccttaactttgtttcattttaatttatgtcttttgcaaaatcacattagatctttcttttgggttgtttaattatgttgtcacagtgctaagagaatatgccgtagcggtctctgttaacc

SEQ ID NO: 1519 - DNA, 944 bp, Linum usitatissimum
gagcgaattctaagcagctgccgccagccacactaccgctccggaaacagctgccgccatggtgaagtactcgcaagagccggtgaaccctaccaagtcatgcaaggctaggggctctgatctcagagtacatttcaagaacactagggaaacagcgttctccatcaggaagatggctttggtcaaggccaaggcatacctggaggatgtccttgctcacaagcaggccattcctttcaggagattctgccgtggagtcggtagaactgctcaggctaagaacgctgggcaccccaatggtcaggctcgctggcccgcaaagtctgccaagttcatccttgacctgttgaagaatgctgagagcaatgctgaggttaaaggtctggatgtcgatgccctcttcatctcccatatccaggttaaccaagctcagaagcaaaggcgtcgtacttaccgtgcccacggaaggatcaacccttacatgtccaacccttgccacattgagttgaccctatctgagaaggaagaacccgtcaagaaggagcccgagacccagcttgccgcctctagcaaatccaggaagggtcaagctttgagaagcggagcatcttcttagagaccggttcctaccattgtggtgtttcgaattttctgagagatctgttttgtgctcgctcttatattttaaaatttgcgataaggctacttagaggaaaggtttgaacttaatgatgttatctttctggactaatgttccttttgttatcagaatcagaattttgcttggttatgttttcttattgtcaacgtgatctcctccatcgttaggtgtttgtgatcgtgctgatttatacatgtcatgttagtgttcgattgtagtacttcttttcttgatgcattgttataatttcagtatctttcgagatctttgatgaatattgagt

SEQ ID NO: 1520 - DNA, 1217 bp, Zea mays
cgcgttgctaccaccgcggcttccttctctacccttccctcgcgtcgccatcgcaagagtatctcaactccgcctcgagacctcccccctcgctggtctcagccatggtgaaatattcgacggagccgaccaaccccaccaagtccgctaaggccatgggtcgtgacctacatgttcacttcaagaacacacgtgagacagcttttgcccttaggaagttgtcactcaccaaggccaaaagttaccttgaggatgtgatcgcccacaagcaggccatccctttccgtaggtattgtggtggtgttgggcgtactgctcaggctaagtctcgccactcaaatggtcagggacgctggcctgccaagtctgctaaattcattctagaccttctcaagaatgcagagagcaatgctgaggtgaaaggacttgatgtggataccatctatgtgtctcacattcaagttaatcaggcttagaagcagcgacgcaggacataccatgctcatggacgcatcaaccataacttacatgtcctccccatgccacatcgagctcatcttgtcggagaaggaagagccagtgaagaaagaggctgagtctcagatcgcaaccaggaaggcttagagaaggggctctatcttctgtgattggcttagtgagctgaagtcaactaaggtgtatgagaaatgggctaaaaagatctcagggatggagccaccaacaaatccgctagagaggagagcgaacgcagggttgagcggaaaaaacagttcaactccatcctctcgaacatcatgtccaagtgtgactccaaggcgagcagctcagagcccacgaaagaagagtttgagcaagcgcaacagaggctggagagcagaagggccaagaggcgcaagtgatgctgctgccagccttcttgccctatgctgaacattgtctgaaccttttggtgtgacctgaatttaccagcatgcaagtgatggttctaagacccagttttagcgtgtcaaggtgtgtgtcatatctcttgtcctctcacggtacactatgttgtatggttatcggcttatcaccttgtcgagagggaagctctatttgacttgaaagtatcatgacatattttaccgcgacaattatcattacacatttcttcaagttatgttgcaagaataaaaattggcttcagtttcaaaattactatgcttgtcttagttgac

SEQ ID NO: 1521 - DNA, 826 bp, Acacia harpophylla
ggcctcgaagctagggcagaagtagcagcacaatattatcgaaaaaaaaaagaaggagcagcacaaggcagccgccatggtgaagtactccagagaacctgacaatcctactaagtcctgcaaggccagaggctccgaccttagagttcattttaagaacactagggagacagcgtttgccatcaggaagttacccttggtaaaggcaaaaaggtatttggaggatgtgatagcccacaaacaggctattcccttcagaaggttctgtggcggtgttggtaggacagcccaggcaaagaacagacattctaatggacaaggacggtggcctgtgaagtcagctaaattcattcttgatttgctcaagaatgcagagagtaacgccgaagtgaaaggcttggatgtagatgctctccacgtttctcacatccaggttaatcaagcacagaagcaaagacgcagaacctaccgtgctcatggaagaatcaacccctatatgtcatctccatgccacatagagttgatactatctgaaaaagaagagtctgtgaggaaggagccggagacccagttggcaacaagcaagaaagcgtaagagcttcgtggtggcgctttatcacaaattgctgctgacgtaaatgatcgaagggttccttttctagttatcctcggatagttttgtgatttttccttgtttttgtatttggcatgggcttttcttggaagagttgagcataattatgttgtctcatgctttataagttgatcagatcttctttaaaacacaacgtacgaaaccatccagattggtcggttcattactctg

SEQ ID NO: 1522 - DNA, 708 bp, Centaurea maculosa
  misc_feature (7)..(7): n is a, c, g, or t
  misc_feature (9)..(9): n is a, c, g, or t
  misc_feature (347)..(347): n is a, c, g, or t
gggggcngnaacctctcaccagactcatcgtcgccggaaaacgcagtaaagatggtgaagtactcgaaagagcccgataatcctaccaaatcctgcaaggctaggggttctgatctccgagttcacttcaagaatactagagaaaccgcacacgccatcaggaaactgcctttaatcaaggcgaaaaggtacttggaggacgtccttgctcataagcaagccatacctttcactcgtttttgtaggggtgtcgggcgtactgctcaagccaaaaaccgacattccaatggtcaaggtcgatggcctgccaagtcagcaaagtacattttggatttactcaagaatgncgaaagcaatgccgaggtgaaaggattggatgtggatgcacttttcatttctcacatacaagtgaaccaagctcagaaacaaagacgtagaacataccgtgcccatggaagaatcaacccctatatgtcatctccttgccatattgagttgactttgtctgaaaaggaggagcctgtgaaaaaggaggctgaatctaggttggcaactagtggcaagtagaagaaaccatactgtttggaatatcagttttggattgattttatgcttcattgttgaagacaaattttgttctatatatttatgtttttgtacaatgatattgggttttctttaatcatgaagagagttattatggtttag

SEQ ID NO: 1523 - DNA, 962 bp, Citrus sinensis
ggtttcacatttcccttcctataaaaggaagcctcatcgcctgttttcgtctctgctgctcgttcaaaggaaagcaaaccaacttcactgatacagaggcagcatccaaaatcagccgccatggtgaagtactcaaaagagcctgacaatcccaccaagtcctgcaaagccaggggctctgatctcagggttcattttaagaacacgagagaaactgcccatgccatcaggaaattgcctttgacgaaggctaagaggtatttggaggatgttatggcccataaacaggccattcccttcacacgattctgcggtggtgttggacgtactgctcaggcaaagaataggcatccaaatggacagggacgatggcctgtcaaatcagcaaagttcattcttgacttgctcaagaatgctgagagtaatgctgaggtgaaaggtttagatgttgatgcactctacatttctcacatccaagtcaaccaggcacaaaagcaaaggcgccgcacataccgtgctcatggaagaattaatccttacatgtcctctccctgccatattgagttgaccttatctgaaaaggaagagccagtaaagaaagagcctgagacccagttggcaactagcaaatcaaagaagtaattgtctgaggtttagcatagcaattggagagtgccttgattttctattttgtgttcttgatgaagtgagtttttttacctttaatagtgactgagatgttatttagtcaaatcagacatcatattttgtttatttcatattaagtccagtttactgttttgttagaatcctcagtcatactgttggagctttatgaaaattaaagacttttcaagcttattttgaagcttagagatatgggtgtatgagttgtcattccaaaccaaattccattatcagctaatcgaatctgaatatcttgtaattgattggttcggttt

SEQ ID NO: 1524 - DNA, 923 bp, Tropaeolum majus
gggccgaaaacatttgggctcctccgaaaccgaaattaagcgtattgtaaaaccctagctcccagctttctcgctttatcttttgcaattcgtcttccctctcttcggtcgtaaagcaggggagcaaagcagcagcaggggagcagcagtagttatggtgaaatattcaagagaaccggataatcccaccaagtcctgcaaagctaggggctctgatctccgtgttcatttcaagaatactagggaaacagctcatgccattcgaaagatgcagttggctaaggccaagagctacttagaagatgttttggcccacaagcaagccattcctttccgtcgtttctgtcgtggagttggaagaactgcgcaagctaaaagccgccactcaaatggacaaggtcgctggcctgctaaatctgcaaattttattcttgacttacttaagaatgccgagagtaatgcagaggtgaaaggtttggatgttgattccctttacatatctcatatccaagtgaatcaagcccagagacaaagacgtcgcacataccgtgcccatggaagaattaacccatacatgtcttcaccgtgtcatattgaactgtgtttgtctgaaaaagaagaggccgtcaggaaagagcctgagagtcagctggcttctagaaaatcaaaggcgtaatggagacttggttgatggataaagtaccgaggatgcatgttttgactaagttagatgagaactattttatccttgcagacgttatgtacttctattgagtcgttcctttcaatttttctggttttactttgtcagtgacttgaaacattttttttagaatgggatatgcaagttcatcattgttggtaaaaaacatgatactacttatatgtttgtgtttatgaggcaattttctatatattgattt

SEQ ID NO: 1525 - DNA, 825 bp, Aquilegia formosa
tccgtcgtttgcactcgttgttagctaagaagagaagagaaggagaaaacagcgaagcagccatggttaagtactcgcaggaacctgataacattaccaaatcttgcaaggctaggggttctgatctccgatgtcatttcaagaacactagggaaactgcccatgcaatcaggaaaatgtctttgatcaaggctaagagatacttggaggatgttttggctcataagcaagctgtccccttccgtcgcttctgtaggggtgttggacgaactgctcaggtcaaagatcgccaccccaatggacaaggacgttggcctgttaaatctgtgaagtttattctggatttgctcaagaatgcagagagcaatgctgatgtgaaagggttggatgtggattcactttatgtttcacatattcaagtgaaccaagccgcaaagcagaggcgtaggacttaccgagcacatggaagaattaacccttacatgtcgtctccatgccatattgagttgattttgtctgaaaaggaagaagcagtcaagaaggaggctgaaactcagttggcccctaggaagacaaagggttccctccgcagtggtgcatcttcttaagttttcgtgagcagttagtattatgataatcgctagatgttggtatttttcgcttatgaccaaacatttttggttctattttaatggagtacttgttgtcagtggtgaatcttcaaacatgataattttgaatcagtttttggtgtatcataactgcttttttatgattattggtttaaaatgtattcagtttagatcatatttattggttaattga

SEQ ID NO: 1526 - DNA, 1227 bp, Cannabis sativa
tgggccgtcaacaaggctgtgtagcccataaacgatgatgggcttaaattaacttggccgaagttctggtcaagtgtctagggttttatctgttcttttactataagttcaaaccctaccgcctccattgatctctctgctgtggggagtttataaaacctttcactgaggtttgaagctgcacactgccggcagccatggtgaaatactcaaaagagcctgataatatcaccaagtcctgcaaggcaagaggttccgacctcagagttcacttcaagaacactagggaaacagcgttcgccatcagaaagttgcctttgatcaaggctaagagatatttggaagatgtcctagttcacaaacaagccattcccttccgtaggttctgtcggggtgttgggcgtactgcacaggctaaaaacaggcattccaatggacagggtcgttggccagtcaagtcagccaagttcattcttgatttgcttaagaatgccgagagcaacgccgaggtgaagggtttagatgtcgatgccctattcgtatctcacatacaggtcaaccaagcacagaagcaaagacgtcgtacttaccgtgctcatggaagaatcaacccctatatgtcatccccttgccatattgagttgactttgtctgagaaagaagaagctgtcaagaaagaggccgagacccagttggcaacaaacaaatcaaagaaaacccaacttcgcagcggtgcttcttcttaagagttgcattaatttacatctactttggagggtcaccagatttttctttttgttctcttgtggatttttgttgctttaaaatttttacaactaaatgttatctagacaattttcagacatcctgtgttcttccaatttgtgtttagctcaatgtcattgagaatttttgatgagtatttatttggttagcgtatctagatttacccaaatattttgcggcttttttggcattttcttttcggtttatattgttgtggttcattttcccaaatcagcattaaataagctaaaattgaagttgcagcttaaacgacgacgtgttcttgatttaagattaggctaccagactttaagatcatctgtggatgaaatttattgttttaattcgtagcagataaatatgtaatggaatttcgcaattctaagagcatctctaatgtataaaagtggtagcaattttaaaatagctttaatggtgcgt

SEQ ID NO: 1527 - DNA, 754 bp, Helianthus annuus
gggggttgttggggtggcctccgaagaacacacgccattttcacgcagcagcaatggtgaagtactcgaaggaaccagaaaaccctaccaaatcttgcaaagccagaggatctgatctcaggtgccattttaagaatacgcgtgaaacagcccatgctatccgtaagttgcctttaatcaaagctaagagatacttggaagatgttttggctcataagcaagccattccatttacccgtttttgtcgcggagttgggcgtactgcacaagcgaaaaaccgccattctaatggtcaagggcgttggcctgaaaagtctgcgaagtttatccttgatctactcaaaaatgccgagagtaacgcagaggtcaaggggttggatgaggacgcccttcacatctctcacatccaggtgaaccaagcccagaaacagagacgtcgtacataccgtgcacatggaagaattaacccttacatgtcatctccgtgtcacattgagctcactttgtctgagaaagaagaacctgttaaaaaggagcctgagactcaattggcccctagaaccaaaaagaatcaagcttaagtgaagggtgcatcctcttcggtcttagtgtggttttaagatatcatttgttataattccctttccaaagattcttattatatcaattatggagatcttgctttttggttttataaaatatttaaggaaaacttgtttcattcatggttgaatattcaattgtgatttggttc

SEQ ID NO: 1528 - DNA, 736 bp, Helianthus annuus
catatcctgcagtaactccattgaagcataagcagccgcagcaatgtgaaatactcgaaggagcctgataatcccacaaaatcctgcaaagctaggggttccgatctcagatgtcattttaaaaatacaagagaaaccgcacatgccataaggaagttgcctttgatcaaggcaaaaagatatctggaggatgttttggcccacaagcaagccattccgtttacccgtttttgtaggggtgttgggcgtacagctcaggccaaaaataggcactctaatggtcaaggtcggtggcctgccaagtcagctaaattcattttggatttactcaagaatgctgaaagcaatgctgaggttaaaggcttggatgttgatgcacttttcatttcacatattcaagtaaaccaagctcagaaacaaaggcgtagaacctaccgggctcatggaagaatcaacccctacatgtcatctccctgccacattgagttgactttgtctgaaaaggaagagcctgtgaaaaaagaggcggaatctcaattggcaaccagcggaaagtcaaagaagtcccaggcttagttcaagtcatagaaacgtttaggtttgatcggaaacagttttgaactactattgtcatttgtgttttgaagacgatctttgtttggctctcgtgtttttgtggcaagtataattggtattcggagtttttttgttatcaaatgaaagatgctttttatga

SEQ ID NO: 1529 - DNA, 773 bp, Helianthus annuus
caacgcatattacgcggggagagttcagacaccatatcctgcagtaactccattgaagcataagcagccgcagcaatggtgaaatactcgaaggagcctgataatcctacaaaatcctgcaaagctaggggttccgatctcagatatcactttaaaaatacaagagaaaccgcacatgccataaggaagttgccgttgatcaaggcaaaaagatatctggaggatgttttggcccacaagcaggccattccgtttacccgtttttgtaggggtgttgggcgtacagctcaggccaaaaataggcactctaatggtcaaggtcggtggcctgccaagtcagctaaactcattttggatttactcaaaaatgctgaaagcaatgctgaggttaaaggcttggatgttgatgcacttttcatttctcatattcaagtaaaccaagctcagaaacaaaggcgtagaacataccgagctcacggaagaatcaacccctacatgtcatctccttgccacattgagttgactttgtctgaaaaggaagagcctgtgaaaaaagaggcggaatctcaactggcaaccagtggaaagtcaaagaagtcccaggcttagttcatgccatagaaacgtttaggtttgaccagaaacagttttgaactactattgtcattcgtgttttgaagacgctctttgtttagcgctcgtgtttttgtggcaagtgtactttgttttggatgttctattaatttcaaaagaaagatggttcttatgattct

SEQ ID NO: 1530 - DNA, 649 bp, Ambrosia trifida
cagcagcagccatggtgaagtactctaaggaaccagaaaaccctaccaaatcttgcaaagccagaggatctgatctcaggtgccatttcaagaatactcgtgaaaccgcccatgctatccgtaagttgcctttgattaaggccaagaggtacttagaagatgtcttggctcataagcaagctattccattcactcgtttctgtcgtggagttgggcgtactgcgcaggcgaaaaaccgtcattctaatgggcaagggcgttggcctgcaaagtcggccaagtttatccttgatttactaaagaatgccgagagtaacgcagaagtcaaagggttggatgtggatgctcttcacatctctcacattcaggtgaaccaagcacagaaacagagacgtcgtacataccgtgctcatggaagaatcaacccttacatgtcatctccttgtcacattgagctcactttgtctgagaaagaagaagctgttacaaaggagcctgagactcagttggctcctagaaccaagaagaaccaagcttaagtcgggtgtggtggtttttgttttgatttgttatatttccatttctaaagattattgttatatgaattatggtgattttgctttttggttctaaatatttaaggaaactt

SEQ ID NO: 1531 - DNA, 814 bp, Ambrosia trifida
ttagcttatttgtgtggcggccttcgtataacttacagcatttcaccggtaacccaatcatcatcagcaacagcagccatggtgaaatactcaaaggaaccagaaaaccccaccaaatcttgcaaagccaggggatcagatctcaggtgtcacttcaagaacactcgtgaaaccgcccatgctatccgtaagttgcctttgattaaggctaagagatacttggaagatgtcttggcacacaagcaagctattccattcactcgtttttgccgtggtgttgggcgtactgcacaggcgaaaaaccgtcactccaatggacaaggacgttggcccgctaagtctgcaaagtttattcttgatctgttgaaaaatgccgagagtaacgctgaagtcaaagggttggatgtggatgctcttcacatttctcacattcaggtgaaccaagcacagaagcaaagacgtcgcacttaccgtgctcatggaagaattaacccttacatgtcttccccttgtcacattgaactcactttgtctgagaaagaagaggctgttgtcaaggagcctgagacacagttggctcctagaaccaagaagaaccaagcttaagtgaggggtgcattattatgagtgagactcgtagtttgttggtagaaggaattctgtttttgttttcacttgttatatcagaaccatgtgtttttgtttccaaagattcttatcttcttatattcaattatgaggtgattgtgttttatgaagttaaattactgaaccaaacttgtttcattcagggctggttgtccaattttgatat

SEQ ID NO: 1532 - DNA, 780 bp, Aquilegia formosa
agaaaacagcgaagcagccatggttaagtactcgcaggaacctgataacattaccaaatcttgcaaggctaggggttctgatctccgatgtcatttcaagaacactagggaaactgcccatgcaatcaggaaaatgtctttgatcaaggctaagagatacttggaggatgttttggctcataagcaagctgtccccttccgtcgcttctgtaggggtgttggacgaactgctcaggtcaaagatcgccaccccaatggacaaggacgttggcctgttaaatctgtgaagtttattctggatttgctcaagaatgcagagagcaatgctgatgtgaaagggttggatgtggattcactttatgtttcacatattcaagtgaaccaagccgcaaagcagaggcgtaggacttaccgagcacatggaagaattaacccttacatgtcgtctccatgccatattgagttgattttgtctgaaaaggaagaagcagtcaagaaggaggctgaaactcagttggcccctaggaagacaaagggttccctccgcagtggtgcatcttcttaagttttcgtgagcagttagtattatgataatcgctagatgttggtatttttcgcttatgaccaaacatttttggttttattttaatggagtacttgttgtcagtggtgaatcttcaaacatgataattttgaatcagtttatggtgtatcataactgcttttttatgattattggtttaaatgtattcagtttagatcatatttattggttattga

SEQ ID NO: 1533 - DNA, 1239 bp, Aristolochia fimbriata
gaaccgtccggtttggatcgacgggttaacttaccccgaatcccggtcggctctgaactctgaagttctagggttagggttttatacaacgaacatcgcatttctttcttttctggcctcccgcttgctcgagtgactgtgacaccggagcagccatggtgaagtactcgcgagaaccagataaccctactaaggcctgcaaggcgcgtgggtcggatcttcgggtgcatttcaagaatacgcgggaaactgctcacgcaattcgaaaactttcactcgtcaaggcaaaacgttatctggaggatgtggttgctcataagcaggctatcccctttcggagattctgtggtggggttggccgaacagcccaagctaaggcacggcattccaatgggcagggaaggtggccggtgaaatcggctaaattcattcttgaccttctaaaaaatgcagagagcaatgctgatgtcaaaggtttggatgttgatactctttatgttagtcacatccaagtcaatcaggcgcagaaacagaggcgtaggacttaccgtgctcatgggaggatcaatccgtacatgtctagcccgtgtcacattgaattaattttgtccgagaaagaagaaaatgtcaagaaggagcctgaaactcaggtggcacctcgaaaatctaagaatcagaccctgcgcagtggtgcatcatcatcatagtttttcgttttcgttttttttcttcttttggaattagtgcagatcaggtatactactttttgcagtgagtctttgtctcgcttggaaacttctactgagctccatgtgtgtaatgtttttttgaccacttatcttgataatatgtgaggacctcaaatttggtctttctaaggtgtattctgttttttgtttgctctgagagcaggggaagtagatgtacgattgtagcatggacttggtaatggcaatacaattgaagaatttatcacggaaaataacgaccgcagttttgttgaaatttatgtcaactattttctagtcctccccactagatcaaggattgctgctcttcaaccttttttcttctgttttgccttcccatttcttcgtttttttgttccttttttcattttgttggtaacagaggcatttatgaccttgagagatgatctagttcttccttttgtaccttttgttctgttcttctcgcttaatgaatcttgcagggttggcccaggttttacatctaaaa

SEQ ID NO: 1534 - DNA, 672 bp, Brassica juncea
ggtgaagtactcgcaagaacccgacaatcagaccaagtcttgcaaggctagaggttccgaccttagggttcacttcaagaacactcgtgaaacagcgcacgccatcaggaagctaccactgctcaaggcgaagaggtaccttgaagatgtgatagctcacaagcaagctattcccttcacccgtttctgcagaggtgttggaaggactgcccaagctaagaacaggcactctaatggtcagggacgttggcctgcgaaatctgctcagttcgttcttgatttgctcaagaacgctgagagcaatgctgaggtgaaaggtttggatgttgatgccctcttcatatcacacatccaagtcaaccaggctgcaaagcaaaggagaaggacttaccgtgcacacggaagaatcaatccttacatgtccaacccatgtcacattgagttgattttgtctgagaaagaagagtctgtcaagaaagagccggagacccagttggcagccaagtcaaagaaatcagcagcttaagctttctttgtttcttttagtctctcctttttgtgttgttgaaagaggttttgttccgtttttctcgatctttgcaagacaatagatgtactttcttggatcttttgttcaacgttgctgtttgatggttagtattacccaatcta

SEQ ID NO: 1535 - DNA, 767 bp, Brassica napus
ggtgaagtactctcaagaacccgacaaccagaccaagtcttgcaaggctagaggatccgatcttagggttcacttcaagaacactcgggaaacagcgcacgctatcaggaagctaccattgctcaaggccaagaggtaccttgaggatgtgatagctcacaagcaggctattcccttcacccgtttctgcagaggtgttggaaggactgctcaagccaagaacaggcactccaatggtcagggacgttggcctgctaagtctgctcagttcgttcttgatttgctcaagaacgccgagagcaatgctgaggtgaaaggtttggatgttgatgcgctcttcatttcgcacattcaagtcaaccaggctgcaaagcagaggagaaggacttaccgtgctcacggaagaatcaacccttacatgtccaacccatgccacattgagttgattctgtcagagaaggaagagtctgtcaagaaagagccggagacccagttggcagccaagtcgaagaaatcaactgcttaagctttcgtttattttcagtatctttttttgtgttcctgaacgagattttgttcccttttctccatattatcaagacaatggatagagttcaatgtgggtcttatgaatcattaatcatggttactagaatctttctatctaaatcattctatttaccattcttctatgttatgtcagtataatctttagttttaactctgctttatgtaccttcgtatggtataagacttgctacattaag

SEQ ID NO: 1536 - DNA, 3846 bp, Citrus clementina
agccaatccaaaacgaatacaaataagcaatcggccccacttcgagtcatcgctccttattttttaaaaaattttcaaattaagacactcggcaaatcgcccatcaagaggattcacgaatcgccacgcaaccggagggaactccatctgtaatgtttatttcttcactcttgagttcagttcgttgaaagaaagccagaaaacagcatcttcgagaacagaacaggcgtataaaacagatgacgttgcattacgcacactttgtcatttctctatataacacgcaagcaactttctccgtgcgtcaaatctactctaaactgcgccgtttttgaaactccgaagctataagagacgaaagatcgcccctttggtttgccgaaaaccagagaagagagagagaaagagaaaaagaaaaaaaaatggcctttcgattcgattacagggacgtcaccgccttcaaagttttgcttgtattatcattcatgtacggactcatgtcggccttggtctactcaatagttcacttgaagtttgtaaagccgcttgattccgacgcgcctcttgatcggttctccgaagctagagccattcaacacgttcgcgttttggccgatgagattggtgatcgccaagaaggtcggccaggcttgagagaagctgctgtgtatatcaaaacacagttggagggtataaaggagagagctggtcctaagtttagaattgagattgaggagaatgttgttaatggctccttcaatatgatatttttaggccacagtatatctctggggtatagaaaccatacaaatattgtcatgagaatatcgtcaacagactcacaagatactgatccgtcggttttaatgaatggtcattttgacggtccacttagttcccctggtgctggtgattgtggttcatgtgttgcatcgatgcttgaactggctagacttactatagattctggctggattccccctcggcctattatttttctattcaacggtgccgaagaactttttatgttgggtgcacatggcttcatgaaagctcataaatggcgtgattcagttggagctgttataaatgtggaagcatctgggacaggaggtcttgatttagtatgtcaatctgggcccagttcttggccttcgtcagtctatgctcagtcagcaatatacccaatggcacatagtgcagcgcaggatgtttttcctgttattccaggagatacagattacagaatattttctcaagattatggggacattcctggcctggacattatttttctcattggtggttattattaccatacttctcatgatacagtggacagattattacctggaagtgtgcaagcacggggagataatttgttcaatgtacttaaggccttcagcaattcttctaagctacaaaatgcccatgatagagcatcttttgaagctactggcattaaaaacacggatgaacgtgctattttctttgattacttgacatggttcatgatatattattcaagaagcagagccacggtacttcattggattcccattgtcatcttcatcactgtcccattctttctgcgcctgctgaactctggcctgcattcttggtttgcaacatacagtgattttgtgaaaggaatgatgatccatgctactgggaaaatgctagcaattatttttccaattgccttttcagtcctaagattgttcttctctggttatgcaatgagctggtttgctcatccattcttggctttcatgatgttcatcccttgtagtcttcttggtcttttgattccaagaagtctttggagtcattttcccctatctcaagatgctatgcttctgaagacatcaaaggaggcactatctgatgaagcaagattttggggagcatttggattttatgctatgcttacaatggcttatcttgtggctggattgactggtggtttcttgacttttattgtggctacttctatgcttcctgcatggatcttcttttgcatatcaatcaacttttatggtcgtcgatcattgaggtcaacattattttacgttgtgcctctaattccatgcattacatactcagtttattttggcgggtttgttgtccaatttttaattgagaagatgggtatgatgggagcttttccatccccttatgggtattacgtacaagatattgtagtggcagcagcagttggtgctgtaactggttggtgtgtgggccctcttttaccaatttgtggtccctggctagccaggtcatctgtcctgcagtttttgttgcatctgactgtgcttgccttggctctctcatcacagttctttccatatagcacgggtgcacataagagggttgtttttcaacatacatttgttactgcagatgcaaatcagatcgtggaatccagttttgatttttctgtggtggattccaattcttttctgtttcttttcaaatatgcacctgaagttgcaaaggaattgcacattggtccagagttctctcttgaagctgctaatatctccaaacgagagacttggatggtgctctttcctgtatccttcttattctcaaaaagcttgaaattccctgcaaccagtgctgagatttcaaagcaatatgactatttcccgtatttgtctacttctaagcctcatacaatttctggtgatggatctcgaagagtttatttggaactttccctaggctcattagaggaggtttgggttgcagtccttaacatcacaggtcctttatccaattggtcatttgcagacaataaagttccagttcctgaaatagttgacggtggcccgccatcatacatttgtcggcttagtggatccagccatgaaaattggaccttttggttggaagctagcagtcctgagaatttaacggtagaagttgctgtactagaccaagttttggttgatgaagcaaagaaattgaagggccttttcccagactggacagatgttaccgcttattctagctttagatccagctacaccttttagcttgtatacctcccacttgtttggaaaaagaaataattaggtcctcttcggtgaagtactcaaaagagcctgacaatcccaccaagtcctgcaaagccaggggctctgatctcagggttcattttaagaacacaagagaaactgcccatgccatcaggaaattgcctttgacgaaggctaagaggtatttggaggatgttatggcccataaacaggccattcccttcacacgattctgcggtggtgttggacgtactgctcaggcaaagaataggcatccaaatggacagggacgatggcctgtcaaatcagcaaagttcattcttgacttgctcaagaatgctgagagtaatgctgaggtgaaaggtttagatgttgatgcactctacatttctcacatccaagtcaaccaggcacaaaagcaaaggcgccgcacataccgtgctcatggaagaattaatccttacatgtcctctccctgccatattgagttgaccttatctgaaaaggaagagccagtaaagaaagagcctgagacccagttggcaactagcaaatcaaagaagtaattgtctgaggtttagcatagcaattggagagtgccttgattttctattttgtgttcttgatgaagtgagtttttttacctttaatagtgactgagatgttatttagtcaaatcagacatcatattttgtttatttcatattatgtccagtttactgttttgttagaatcctcagtcatactgttggagctttatgaaaattaaagacttttcaagcttattttgaagcttaga

SEQ ID NO: 1537 - DNA, 903 bp, Cucurbita pepo
actctaaaactcttctgcccaattctcttgtcgctggcgtttctcaagtcggcatcagaacaacaaagaattagcatcacccgccatggttaagtactcaagggagccggacaaccacactgagtcttgcaaagcacgaggctccgatctcagggtccatttcaagaatacacgagagactgcacatgccctcagaaagttgcccttggccaaggcaaaaaggtacttggaggatgttctcgcccacaagcaggctattccgttccgacgtttctgtggaggtgtcggacgaactgcacaggcaaaaaataggcattcaaatggacaaggacgctggcctgttaaatctgcaaaatttattctagatcttcttaggaatgctgagagtaacgctgaagtgaaaggactggacgttgattctctcatcatatcccacattcaggtgaaccaagcacagaagcaaaggcgtcgcacataccgagctcacggaagaattaacccctatatgtcatctccatgccacattgagcttattttatcagaaaagaaagagcccgtcaagaaagagcctgagacccagttggcaacgagtaaatccaaaaaatcccaagctctccgcagtggtgcttcatcttgatcaatataattactgcattatttgtttttaaaacagaattttgatacattcatcattctatagatgagttcttccgtatccattcctcccctaatcttgtagtttatggtatcgggatcgtgttcgttatgtcgggaattcttttataaattttggatattcattccttctaagcaaatcgagacttcttttaactttctgtgttggcacttgattaattttttaatcacttatttatcagtttctagtagtaaatttgatttagg

SEQ ID NO: 1538 - DNA, 1007 bp, Eucalyptus grandis
tcttcttcttcttcttcttcttcttacctttctgtcaaagttgtacgctctgccgccgcggaagctatcggggcacgaggagaactttcaccagggcgtgcgcatcagacaccatggtgaagtactccagagagcccgacaatcccaccaagtcttgcaaggctaggggctctgatctcagggttcacttcaagaacacaagagagacagcctttgcaatcagaaagctgtctttggccaaagcgaagagttacctggaggatgtgctggtgcacaagcaagcaataccattccgacgattttgccgtggtgtcggaaggactgctcaggccaaaaacaggcactctaatggacaaggacggtggccagtgaaatcggctagattcattcttgatttgttgaagaatgccgagagtaacgctgaagtgaagggtttggacgtagatgcgctctatgtatctcatgtccaggtgaaccaggctcagaagcagaggcgccgcacctacagggctcacggaagaatcaacccgtatatgtcatctccttgccacatcgagttgattttgtcagaaaaggaagaacccgtgaggaaagagccggagactcagttggcaaccagcaaatctaagaagtcacaagcttgaggcggcacgtctccctctcgggactctttcgagagatggtcctcgtgttttcttttttaaggtagtatttaggagatttgtcgtcaacctttggtacaagggaacgctttttccctataccagtatgttatagtcctcagggcttgctcaattgaaggtttttcgggttgttggttagggcagtcgagggaacggtcctccaaactaaatttatttcctcaatcaaaatcagtaccagttttttcttccctaatcatcgaggcatggaatttacttgatatcgtcctaataacattatcagatcttattatctgctcactcattcccttttatggggaatctgtttgtaaatgtgcagtgcgt

SEQ ID NO: 1539 - DNA, 848 bp, Euonymus alatus
gaagaaaattagggtttacattttatttaagcaacttgctgcgcctccttcatcttcatcttcatagaggaggaggcggcagtttagaatctctcgacgtagccatggtgaagtactcgaaagagccagacaatcccactaagtcttgcaaggctagaggctctgaacttcgagttcatttcaagaatactagggagacagcttttgcaattagaaaattgccgttggtcaaggctaagagatacttggaagatgttatggtccacaaacaggctattccgttccggcgcttctgtcgtggtgtgggacgtactgcgcaggccaaaaacagacactcaaatggacagggacgctggcctctcaaatctgctaagtttattctagatttgctcaagaatgctgagagcaatgctgaagtgaagggcttagatgtagattctctctacatttctcacatccaagttaatcaagctcaaaagcaacgtcgccgtacctatagggcacatggaagaattaacccgtatatgtcttccccatgtcatattgagttaactctgtctgagaaggaggaacccgtgaaaaaggagcccgagtcccagctgacaactagcaagtcaaagaagtctcaagctttgcgcagtggtgcttcttcttaagtcattactgtttatcatatcaagaagtgtttttgtagcttttcactggtgatttccaattgatgctagagtttttattcagaagaatctacactggcttctttgtttcaagctattttttgtttaatgttctgtgaaatattttctttgggaaattggatcttaacatgccttttggagtttcgtgtatac

SEQ ID NO: 1540 - DNA, 835 bp, Euonymus alatus
ggggccagctccatagtggaaggaggaggcaatttagaatctcttgccgccgccgccatggtgaagtactcgaaagagcctgacaatcccaccaagtcttgcaaggctagaggctctgaacttcgagttcatttcaagaatacaagggagaccgcttttgcaattagaaaattgcctttggtcaaggctaaaagatacttagaagatgtgatggcccacaaacaggctattcctttccggcgcttctgccgcggtgtgggacgtactgctcaggcaaagaacaggcactcaaatggacagggacgctggcctctcaaatctgcaaagtttattctagatttactgaagaatgctgagagcaatgccgaagtgaagggtttggatgtagattcactctacatctctcacatccaagttaatcaagccgcaaagcaacgtcgccgtacctatcgtgctcatggaagaattaacccttatatgtcttcaccatgtcatattgagttaactctgtctgagaaggaggaacctgtgaaaaaggagccggagacccagctgacaacaagcaaatcaaagaaaactcaaccgctgcgcagtggtgcttcttcttaagtattcattgtttagcacattaaggtggtgcttttgtagcttttcattggggatttcaaattgatgcgagttttgtgatggaacgtgtttttattatgaagaatctagactacctgaattgttttaggcatcttttttaatttctatgaaagattttatttgggaaattgaatgtagacaatgcctttccaagtttcatgtatacattagtttcctggttttttac

SEQ ID NO: 1541 - DNA, 733 bp, Euphorbia peplus
ggtgaagtactcaagagagcccgataattctaccaagtcctgcaaggcaaggggctcggaccttagagtccacttcaagaacaccagagaaacagcgttcgccttgagaaagttacctttggccaaggccaaaaggtacttggaagatgttatggcccacaagcaagccatacccttccgtcgtttttgtggtggtgttggaagaactgctcaagcaaaaagcaggcactctaatggccaaggacgctggcccgcaaaatctgccaagtttattctagacttgctcaagaacgctgagagcaatgctgaggttaaaggattggatgtggagaacctctatattactcatatccaggtgaaccaggcacaaaagcagaggcgtcgtacctacagggcccatggaagaattaatccttacatgtctagcccttgccacattgagttgattttgtctgagaaggaagaatcagttcagaaagagcccgagacccagttggccacaagcaaatccaagaagtctcaagctgtaagaacaggtgcttctgcttaagtgggtctgtcattaaccaatcaaaggagaagttttgaattgaatactttgtattttgctcttcagtttgaggaattttgtttgttctcattttagaatgatatgctacttagatgaattgaacagcctgtttgtttgttttgacctatgtttagttaattgttctgagattttatccttgac

SEQ ID NO: 1542 - DNA, 702 bp, Flaveria ramosissima
agcagcagcaatggtgaaatactcgaaggagcctgataaccccacaaaatcctgcaaagctaggggttccgatctcagatgtcatttcaagaacacgagagaaactgcacatgccataagaaagttgcctttgattaaggcaaagagatacttggaggatgttttggcccacaaacaggccataccgttcactcgtttttgtgggggtgttgggcgcacagctcaagcgaaaaacaggcactctaatggtcaaggtcggtggcctgcaaagtcagccaaattcattttggatttactcaaaaatgctgaaagcaatgctgaggttaaaggcttggacgttgatgcactcttcatttctcacattcaagtgaaccaagctcagaaacaaaggcgtagaacataccgagctcatggaagaattaacccctacatgtcatctccgtgccacattgagttgactttgtctgaaaaggaagagcctgtgaaaaaagaggcagaatctcagctggcaaccagtggaaagtcaaagaagtcccaggcttagcttagtgcatggtttgaccagaaaagttttgaactactttttgtcatttgtactgttgacttttgaagaatttgtttgaccattttttgtttgtgtcaactataattgattcatggatggtttcttttgttgtcaaatgaaagatggtatttatgatc

SEQ ID NO: 1543 - DNA, 689 bp, Flaveria ramosissima
acacaacatcttcaccggcgggaggcgatcatcatcatcatcagcagtcatggtgaagtactcgaaggaaccagaaaaccccaccaaatcttgcaaagccaggggatcggatctcaggtgccatttcaagaacactcgtgaaaccgcccatgctatccgtaagttgcctttagtcaaggctaagagatacttggaagatgtcttggcccacaagcaagccattccattcactcggttttgtggtggtgttgggcgtactgcgcaagcaaaaaaccgtcactccaatggacaaggacgccggcccgctaaatctgcaaagtttattcttgatctgctgaaaaatgctgagagcaatgcagaggtcaaagggttggatgtggatgctcttcacatatctcacattcaggtgaaccaagcacagaaacagagacgtcgcacataccgtgctcatggaagaattaacccttacatgtcttctccttgtcacattgaactcactttgtctgaaaaagaagagcctgttaaaaaggagcctgagacacagttggctcctagaaccaagaagaaccaagcttaagtctggggtgcattctcatgagtggtactcatattttgttggtagaaagaaccctgtttttatttttatttgttatatcagaaccatgtgtttttatttccaaagattctta

SEQ ID NO: 1544 - DNA, 646 bp, Fraxinus spp
attgcactgcatagctgaacttcgctgcagtaaaatggtgaagtactccagagagccggataaccctaccaaatcgtgcaaggccagcggttccaatctcagagttcatttcaagaacacaagggagactgcccatgccatcagaaagctgcctcttaccaaggctaagaggtatttggaggatgtacttatccacaaacaagccatacccttcactcgtttctgtcgaggtgttgggcgaactgctcaggcgaagaacaggcattcgaacgggcaggggcgctggcccgtaaaatctgctaatttcattcttgatttattgaagaatgctgaaagtaatgctgaggtgaaaggtttggatgtggatgccctctacatttctcacattcaggtgaaccaggcccagaagcagaggcgccggacgtaccgtgctcatggaagaataaacccctatatggcatcaccatgccacattgagttgattctatctgagaaagaagagcctgtcaaaaaggagccggaatcgcagttgacagctagcaaatcgaggaaggcttgagctcgaagcttgtttttaactgcagatatagctttttttggaacttttgaatacattattaagctgtgaactttgtatttggagaag

SEQ ID NO: 1545 - DNA, 697 bp, Lactuca sativa
ggccttcgcagaaacactaaattttaatcggcgacgccagcagcagcagcaatggtgaagtattcgaaggaaccagaaaaccccaccaaatcttgcaaggccaggggatctgatctcaggtgccatttcaagaacactcgtgaaaccgcacatgctatccgaaagctgccattgttgaaggcgaagagatacttggaggatgttttggtccataaacaagccattccattcactcgtttttgccgtggagttggacgaactgcacaagccaaaaatcgccattccaatggacaagggcgttggcctgcaaaatctgcaaagttcatcctcgatcttctaaagaacgccgagagtaatgcagaagtgaaaggattagatgtcgatgctcttcacatctctcatatccaggtcaaccaagcccaaaaacagaggcgtaggacataccgtgctcatggaagaatcaatccttacatgtcttctccttgccatattgaattgaccttgtctgagaaagaggagcctgttaagaaggatgagactcagttggcacctagaagcaagaagaaccaagcttaagtgaagttgagtagaaaggattcagtttttggttatctgaaaactctgtgtttctgtttttaaagatttttgtcttatcttctattattatgagatgctttatgaaattaaaacattttgg

SEQ ID NO: 1546 - DNA, 1088 bp, Tropaeolum majus
cttcctgaatgaaagaagacaaatttgaaggccagtttagactgttaattgtttcctgttagcccagcccaacaaaggcggattagggttcatagtttcttcttatataaaacataaccatcgaaccctatctctccgcctctcatcaccccgaaggatcccaaccaggacagcagccatggtgaagtactctagagagcccgacaactctaccaagtcctgcaaggcccgggggtcggatcttagggttcatttcaagaatacaagagaaacagcgcacgccatcaggaaacttcctttggtcaaggcaaagagctacttggaagatgttttggctcacaagcaagctattcctttccggaggttttgccgtggtgttggacgtactgcccaggccaagagcagacattcaaatggacagggtcgatggcctgcaaaatctgccaactttattcttgacctactgaagaatgcggagagcaatgctgaggttaaaggtttagatgtagatgcactgtatgtttcacacatccaagtgaatcaagctcagaaacaaagacgtcgtacataccgtgcccatggaagaatcaatccttatatgtcatctccatgccatattgaattggtgttgtccgagaaggaagagcctgtccagaaggagcctgaaacacagttggcagctagcaagtctaagaagtctcaaggcctacgtgcttcttcataagtggtgttacttgtttattttggtcactaatgaattggttttgatcttttagtcaatgtttacatcaatgttattttcgagatttttgaatacctatctagttaaagtgcgtttggttgcattaattgaatcaaagtttcgtaacacagttcatggatttgttgtcttctcagcatttacatttaacattttatagtatttgtgttaagccggcaatccatttaaacatcttaaatgacagcaaaaagagtaatttagctgttgtaatatttttaagaaatgattatccgtgtctgataagcttacaaaaatattcctgccttaaataaaaatttagagaaagaattattctgtgatttttgtc

SEQ ID NO: 1547 - DNA, 1030 bp, Elaeis guineensis
agcgtcaggcgagagcaaagagaaagggaaaggaccgggagacccacgtccttcccccgatccttctgcagccatggtgaagtattcgaaagaacccgacaaccctaccaagtccgccaaggcgatgggccgggacttgagggttcacttcaagaatacccgtgagacagctcatgcaattaggaagctgcctttggccaaggctaagaggtaccttgaagatgtgattgctcacaagcaggcaattcccttccggaggttttgtggaggtgtagggcgtacagcccaggctaaaagccgccatgctaatggacaggggcgttggcctgtgaaatcttgcagattcattttggatctgcttaaaaatgctgaaagcaatgctgaagtaaaaggtttggatgtcgattctcttttcatatctcacatccaggtgaaccaagcccaaaagcagaggcgccggacctaccgtgctcatggacggattaacccttatatgtcctctccatgtcacatcgagctgatcttggcagagaaggaagaggctgtcaaaaaggagcccgagacccagattgcccccaggaagcctaagaaagtggctctgcgcactgggacctcttcttgaatagtaacataagtagttttcgagtcgcagatattttggactcggttgtggtccactttggatttagttcgcgtgatgcaggttgttttgacatgtttcggaacatatttttggttaatttacttgcactatttgttatttctgtttttcgttggagatttttgtaaggatgttacctctattaaaagtctgaaaggataaatccagttggtaggtactgtccaagaatgtcacgtcagtttctgactcgcgatcattgaatcttcctatgctgagattagaatcgttgtttcactggagtaatcctcattgtttttgtcggtgtcaaggttttaaattttatgggattaaggtattctaatttcttcatgaaatagaatatttggctgttctgtctcgttcgaacaa

SEQ ID NO: 1548 - DNA, 3846 bp, Citrus sinensis
agccaatccaaaacgaatacaaataagcaatcgggccccacttcgagtcatcgctccttatttttaaaatttttttcaaattaagttactcggaaaatcgcccatcaagaggattcacgaatcgccacgcaaccggagggagctccatctgtaatgtttatttcttcactcttcagttcagttcgttgaaagaaagccagaaaacagcatcttcgagaacagaacagacgcataaaacagatgacgttgcattacgcacactttgtcatttctctatataacacgcaagcaactttctctgcgcgtcaaatctactctaaactgcgccgtttttgaaactccgaagctataagagacgaaagatcgccttgaggtttgccgaaaaccagagaagcgagagagaaagagaaaaagaaaaaaaaatggcctttcgattcgattacagggacgtcaccgccttcaaagttttgcttgtattatcattcatgtacggactcatgtcggccttggtctactcaatagttcacttgaagtttgtaaagccgcttgattccgacgcgcctcttgatcggttctccgaagctagagccattcaacacgttcgcgttttggccgatgagattggtgatcgccaagaaggtcggccaggcttgagagaagctgctgtgtatatcaaaacacagttggagggtataaaggagagagctggtcctaagtttagaattgagatcgaggagaatgttgttaatggctccttcaatatgatatttttaggccacagtatatctctggggtatagaaaccatacaaatattgtcatgagaatatcgtcaacagactcacaagatactgatccgtcggttttaatgaatggtcattttgacggtccacttagttcccctggtgctggtgattgtggttcatgtgttgcatcgatgcttgaactggctagacttactatagattctggctggattccccctcggcctattatttttctattcaacggtgccgaagaactttttatgttgggtgcacatggcttcatgaaagctcataaatggcgtgattcagttggagctgttataaatgtggaagcatctgggacaggaggtcttgatttagtatgtcaatctgggcccagttcttggccttcttcagtctatgctcagtcagcaatatacccaatggcacatagtgcagcgcaggatgtttttcctgttattccaggagatacagattacagaatattttctcaagattatggggacattcctggcctggacattatttttctcattggtggttattattaccatacttctcatgatacagtggacagattattacctggaagtgtgcaagcacggggagataatttgttcaatgtacttaaggccttcagcaattcttctaagctacaaaatgcccatgatagagcatcttttgaagctactggcattaaaaacacggatgaacgtgctattttctttgattacttgacatggttcatgatatattattcaagaagcagagccacggtacttcatgggattcccattgtcatcttcatcactgtcccattctttctgcgcctgctgaactctggcctgcattcttggtttgcaacatacagtgattttgtgaaaggaatgatgatccatgctactgggaaaatgctagcaattatttttccaattgccttttcagtcctaagattgttgttctctggttatgcaatgagctggtttgctcatccattcttggctttcatgatgttcatcccttgtagtcttcttggtcttttgattccaagaagtctttggagtcattttcccctatctcaagatgctatgcttctgaagacatcaaaggaggcactatctgatgaagcaagattttggggagcatttggattttatgctatgcttacaatggcttatcttgtggctggattgactggtggtttcttgacttttattgtggctacttctatgcttcctgcatggatcttcttttgcatatcaatcaacttttatggtcgtcgatcattgaggtcaacattattttacgttgtgcctctaattccatgcattacatactcagtttattttggcgggtttgttgtccaatttttaattgagaagatgggtatgatgggagcttttccatccccttatgggtattacgtacaagatattgtagtggcagcagcagttggtgctgtaactggttggtgtgtgggccctcttttaccaatttgtggtctctggctagccaggtcatctgtcctgcagtttttgttgcatctgactgtgcttgccttggcgctctcatcacagttctttccatatagcacgggtgcacataagaggcttgtttttcaacatacatttgttactgcagatgcaaatcagatcgtggaatccagttttgatttttccgtggtggattccaattcttttctgtttcttttcaaatttgcacctgaagttgcaaaggaattgcacattggtccagagttctctcttgaagctgctaatgtctcccaacgagagacttggatggtgctctttcctgtatccttcttattctcaaaaagcttgaaattccctgcaaccagtgatgagatttcaaagcaatatgagtatttcccgtatttgtctacttctaagcctcatacaacttctggtgatggatctcgaagagtttatttggaactttccctaggctcattagaggaggtttgggttgcagtccttaacatcacaggtcctttatccaattggtcatttgcagacaataaagttccagttcctgaaatagttgacggtggcccgccatcatacatttgtcggcttagtggatccagccatgaaaattggaccttttggttggaagctagcagtcctgagaatttaagggtagaagttgctgtactagaccaagttttggttgatgaagcaaagaaattgaagggccttttcccagactggacagatgttaccgcttattctagctttagatccagctacaccttttagcttgtatacctcccacttgtttggaaaaagaaataattaggtcctctttggtgaagtactcaaaagagcctgacaatcctaccaagtcctgcaaagccaggggctctgatctcagggttcattttaagaacacgagagaaactgcccatgccatcaggaaattgcctttgacgaaggctaagaggtatttggaggatgttatggcccataaacaggccattcccttcacacgattctgcggtggtgttggacgtactgctcaggcaaagaataggcatccaaatggacagggacgatggcctgtcaaatcagcaaagttcattcttgacttgctcaagaatgctgagagtaatgctgaggtgaaaggtttagatgttgatgcactctacatttctcacatccaagtcaaccaggcacaaaagcaaaggcgccgcacataccgtgctcatggaagaattaatccttacatgtcctctccctgccatattgagttgaccttatctgaaaaggaagagccagtaaagaaagagcctgagacccagttggcaactagcaaatcaaagaagtaattgtctgaggtttagcatagcaattggagagtgcattgattttctattttgtgttcttgatgaagtgagtttttttacctttaatagtgactgagatgttatttagtcaaatcagacatcatattttgtttatttcatattaagtccagtttactgttttgttagaatcctcagtcatactgttggagctttatgaaaattaaagacttttcaagcttattttgaagcttaga

SEQ ID NO: 1549 - DNA, 1267 bp, Pinus taeda
gccgtgagggcttcttaaaactcttagaacgccgaggcgcatgctaagttttttcccatacgccctcctcgttagggtttgtggatttggggtttatttagggtttgttccctcgttttctctttactgaagaaagcggagatcaaacgacagcagaggagaaggagacggagccgaagcagaaatcagaacacaatggttaagtattcaagcgagccttctaatcctaccaaatcatgcaaggctcgggggtcagacctacgtgtccattttaagaatactcgggaaacagctcaagctgtgaagaagttacctttggctaaggctaaagcctatcttgaggatgtgcttgcccacaagcaagcaatacctttccgtcgcttttgtgggggggtaggacgtaccgcccaagcaaagtctcggcattcaaatggccagggccgctggcctgtcaagtctgttcagtttctgttacaactgctgaagaatgcagaaagcaatgcagaggtgaagggacttgatgtggatgcactatatatttcacacatacaagtaaatcaggctcaaaagcagcggagacgaacttatcgtgcccatggaagaatcaatccttacatgtcatctccatgccatattgaattaattttgtccgagaaagaagcacctgttaaaaaggaggccgaatcacaaattgctcccactaggtcaaggagaggccaagctcttagtagtggcatctcctcctgaggttctagagcagttcttatgcagcacttcactaccacaattttgaaagcaagggattatcgagacctgaagtatttgtagttttcttatgggaactataccacttatttgtctaccaaactgaaattctaaagtctagattctagacgaacaggaatttgtgaaattttgttttgtattatttttattgcagttattttttgttcttgattgctgtctataaggtttgaaacagcagattcagcaagatggaaaccttcgacttctattcgctttaatgtttaagacaccgaggaaagattggaagattacttgcaggattatttctttgccgagtaactaaaaatgtacttattttccatgcataccatgtggaagtgtctgcaaggctgcttggggaatgaagctttgggttcaaagtgtttgttgttagaattctgacagaccttttaatgttagagacttgtatggtgcaccttaagactatgtgataatatttatgaagtggcgggttgagtta

SEQ ID NO: 1550 - DNA, 1084 bp, Pseudotsuga menziesii
aagtagatcagaggagacgaagcagaaatcagaacaatggtcaagtattcaagggagccggataatcctaccaaatcatgcaaggctcgaggctcagacttacgggtccattttaagaatactcgagaaacagctcaagctgtgaagaagttgcctgtggccaaggctaagagctatcttgaggatgtgcttgcccacaagcaagcaatacctttccgccgcttttgtgggggtgtaggacgtactgcccaagcaaagtctcgccattcgaatggccagggccgctggcctgtcaagtctgctcagtttttgttacaattgctcaagaatgcagaaagcaatgcagaggtgaagggacttgatgtggatgcgctatacatttctcacattcaagtaaaccaggctcaaaaacaacggagacgaacttatcgtgcccatggaagaatcaatccttacatgtcatcgccatgtcatatagagttgatattgtctgagaaagaagcacctgttaaaaaggaggccgaatcacaaattgctccaactaggtcgaggaaaggccaagctcttggcacctcctcgtaaggtgctagagcagtttaatgcagcacttcactaccacaatttttgaaagcaagggattatcaaggcatgaagtttttgtagttttattgtgggaactataccaaactatttgtttaccaagctggaattctaaagtcctagactccagacagacagcaatttatgaaagtttgtttcttgtttttattgtagttattatttgtgcttgactgctgtctatgggtttgaacagcaagttcagaaagatggaagccttcaacttctattctctataacgtttaagacactgaggaaattttgtaagattgcttgcaggattatttctttgctgagtaacttaaaatgcacttattttccatgcataccatgtggaagtgtctgcaaggctgcctggggaatgaagctttgggttcaaagtgtttgttgttagaattctgatagaccttttaatgcgatagacttgtacggtttaccttaaagatataatatatttatgaaacgg

SEQ ID NO: 1551 - DNA, 1372 bp, Picea glauca
actagtcgtctaattatggaccatgccgtgagggctttgtaaagctctcagggacgctgaggcatatactaagctctctcccatgtgaccttctcgttagggtttgtgtagtcggggtttatttagggtttgttcgcttgtataacgttttatttcttttccgaagaagaaaccagagaacaaactagagcacaggagacgaaccaggaatcagaacaatggttaagtattcaagggagcccgataatcctaccaaatcatgcaaggctcgagggtcagatctacgggtccattttaagaatactcgagaaacagctcaagctgtgaagaagttacctctggccaaggctaaagcctatcttgaggatgtgcttgcccataagcaagcaatacctttccgtcgcttttgtgggggggtaggacgtactgcccaagcaaagtctcggcattcaaatggccagggccgctggcctgtcaagtctgttcaatttttgttacaattgttgaagaatgcagaaagcaatgcagaggtgaagggactggatgtggatgcactatacatttctcacatccaagtaaaccaggctcaaaaacagcggagacgaacttatcgtgcccatggaagaatcaatccttacatgtcatcgccatgccatattgagttaatattgtccgagaaagaagtacctgttaaaaaggaggccgaatcacaaattgctcccactaggtcaaggaaaggccgagctcttagtagcggcatctcctcgtaaggcgctagagcagtttttatgcagcacttcattaccacaatttttgaaagcaagggattatcaaggcatcaagtttttgtagttttcttgcgggaactatacccagttatttgtttaccaaactgaaattctagagtctagactctggacagaggaatttgtgaaattttgtttgtattatttttattgccgttactttttgtgctggatttccgtctataggtttgaaacagcaaattcatttagatggaagccgtctactttcattctctgcaatgtttaagacactaaggaaagatcggaatattgcttacatgattatttctttgctgagtaacataaaatggacttattttccatgcataccatgtggaagtgtctgcaaggctgcctggggaatgaagctttgggttcaaagtgtttgttgttagaattctgacagaccttttaatgttagagacttgtacggtgtaacttgaagtatgatatatttatgaagcggtgggttgggctaaaaaaaaaaaaaaaaaacaaaaagtctacgtagtacgttagaactaaccactacgtaccttacgtagaagactagaccaagcacacga

SEQ ID NO: 1552 - DNA, 1071 bp, Picea glauca
atcagaacaatggttaagtattcaagggagcccgataatcctaccaaatcatgcaaggctcgagggtcagatctacgggtccattttaagaatactcgagaaacagctcaagctgtgaagaagttacctctggccaaggctaaagcctatcttgaggatgtgcttgcccataagcaagcaatacctttccgtcgcttttgtgggggggtaggacgtactgcccaagcaaagtctcggcattcaaatggccagggccgctggcctgtcaagtctgttcaatttttgttacaattgttgaagaatgcagaaagcaatgcagaggtgaagggacttgatgtggatgcactatacatttctcacatccaagtaaaccaggctcaaaaacagcggagacgaacttatcgtgcccatggaagaatcaatccttacatgtcatcgccatgtcatattgagttaatattgtccgagaaagaagtacctgttaaaaaggaggccgaatcacaaattgctcccactaggtcaaggaaaggccgagctcttagtagtggcatctcctcgtaaggcgctagagcagtttttatgcagcacttcactaccacaatttttgaaagcaagggattatcgaggcatgaagtttttgtagttttcttgcgggaactatataccagctaaatgtttaccaaactggaattctagagtctagactctggacaggggaatttgtgaaattttgtttgtattatttttatcgccgttactttttgtgctggattgccgtctataggtttgaaacagcaaattcagtaagatggaagccttcaacttccattctctgcaatgtttaagacactgaggaaagatcggaatattgcttacatgattatttctttgctgagtaacttaaaatggacttattttccatgcataccatgtggaagtgtctgcaaggctgcctggggaatgaagctttgggttcaaagtgtttgttgttagaattcagacagaccttttaatgttagacttgtacggtgtaacttgaagtatgatatatttatgaagcggtgggttggg

SEQ ID NO: 1553 - DNA, 3750 bp, Fragaria vesca
ggatcgaaactcagctgacaatggccgccggcgacgcgtccggcttcaagttcctgctctttcttgtcgccatttacggcctcctcgccgtgctcgtccactcgattctccacatgcgcttcattacgccgcttgagatcgacgcgccgctcgatcgcttctccgaggctcgcgccgtcgagcacatccgtgtcttggccaaagacatcgatagccgccaggaagggagtcctggattaagagaagctgctcgatacattacagcgcagttggaaatgttgaaggagcgagctggacctaatcttagagttgagatagaagagacggttgtgaatggcacatttaatatgctgtttttaggctatagcatatctctgggatacaggaaccacacaaacattgtgatgagaatatcatcagtagattcacaagactctgatgcgtcagtattgttgaatggccattttgatagtccacttggttctccaggtgcaagtgattgtggttcatgtgtagcatcgatgctggaaatagcaagacttattgtggactctggatgggttccccctcagcctgttatttttctttttaatggtgcagaagagctctttttgctggggtctcatggcttcatgaagacacataaatggcgtgaaactattggagcttttataaatgtggaagcgtcggggataggcggtcctgatttagtttgccaatcaggacctagttcttggccttctcagatctatgctcaatcagcagtatatcccatggcacatagtgcagctcaggatgtttttcctgttgttcctggagatacagattttcgaatattttctgaagactatggtgacatccctggcttggatattatctttctccttggtggttatttttatcatacatccttcgatacagtggagagactattacctggaagtatacaagctcgtggagaaaatctatttagcatacttagagcgttcaccaattcttctaagctacaaaatacgcttgaaagacattctaatttatcaactaccaagcagcaggaggttggacgtgctgttttctttgattatttaacatggttcatgatatactattctcggaaggtagctatggtacttcaccatattcctattggcatcttcctggctatgccatttttctcacaaaagcagaattctggactcctatcttggtttgctactttcagcagttttgtaaaaggaatgctatttcatgctgctggggttgttctagcaattgtaattccggttatcttttccatcctgagattgttgtttactagtcgtgcaatgaactggtttgctcatccatatttggcttatttgatgttcacaccctgcgctcttgttggtctgttaataccaagatttgtttggagtagctttcccctcactcaagaggcatcagttgtcaagtctttaaaagaagctttatctgatgaagcaaggttctggggagcatttggattatacgctacaataacgctggcttatctgtatgctgggttgagcgggggcttcttgactttttcactggccgtgtctatgcttcttggatggattttatattgcttatcagtcaaattatttggtcgcaaatcactcaggtcaacattaatttatatgttacctatacttccatgccttgcgtactctgtgtattttggtgcatttcttgtccagtttttgattgaaaagatgggtatgatgggtgctttgccacctccatatggatatttcgttcctgacattgtgttggctgcagtagttggactcgtgaccagttggtctgtaggccctctgatacctatttgcggtcgctggttagccaggtcatccattttgcaagtcttgttgcatcttactgtgctaggcttggctctgtcatctcagttctttccatacagcacggctgcacctaagagagttattttccagcatacatttctcactgaagatgcaaatcatgttgtggagtccagctatgatttttctgttgtggattccaattcattactttttcttttcaaacacgcacccgaggttgcaaaggaattgcacattagttcagagttatcttttgaaactgcaaaatcatctcaccgtgggacttggatgggactttttcctgtttctcatttgttcacaagaagcttgaagtttcctgcaagtagtgatggtattctaaagcaatacgggcagttccctcatctgtcctcttataagccacatacagtatttggcgaggaatctcggagaatatacttggaactgtttttaggttccttggaggaggtttgggttgcagtcctcaatattacaggccctttatctagttggtcatttgcagacaatacacttccagctactgagacatctgatggaggtccgccatcatacatatgccgacttagtggagctagtcctgagaattggtccttctggttagaggctaacagttctgaagagctaagggtagaagttgctgtcgtagatcagtatatggttgatgatgcaaagaagctgaaagggctttttccggagtgggtggatgtagttgcttattctggctttttgtcgagttacattttctagtttcgaaccacagtctgttcatctctgccgcttctcatgtattaatcattctctgttgttgtttcaggtgaagtactccaaggagcccgataatatcaccaagtcttgcaaggctagggggtctgacctcagagttcatttcaagaacacaagggagaccgcgttctctatcaggaagatgcccttgattaaggcaaagcgatatctggaggatgttttggttcacaagcaagccattcctttcagacgtttctgccgtggtgttgggcgtacagctcaggccaagaacaggcattccaatggccaagggcgctggcctgtgaagtctgccaagttcattttggatttgctcaagaatgctgagagcaatgctgaagtgaagggtttggatgttgactctctctacgtatctcacatccaagtcaaccaagctcagaagcaaagacgtcgaacataccgtgctcatggaagaatcaacccatacatgtcatctccatgccacattgagctcactttggccgagaaggaagaacctgtgaagaaagagcctgactcccaattggcaaccagcaaatccaggaagtctcaaggtgctcgcagtgattctgcttgagtgacaactcgacctgcctattgaagaattcccgactatcgtgccttttcttattatgagaaatttttgttgcttattatatagtttgagatgttatgcagacaatttttggaccaccttgtgtactgttaattccagatgatctttagtttggatctgtgttggtttgcttgagtacaccttgaaatccaatgctacaaacctatgcagatactatgatagattgtcatgggcatattgttaaatagttttcttgtcgctccagtatgcttctaatcttagcctcttagacccttcaactatacgttgttagttgtttctgccttcgctgactatgcttgggataataaatccctggaggaatttgtagcttagcagtattgccccatttgaagattgatgcagccttacactacctctgcaaatcaggcgaatgtattgttttgttgcatggaacatattccaaactcatggaatgcctttaatgaatcattagtattcattacc

SEQ ID NO: 1554 - DNA, 666 bp, Eutrema parvulum
gtgaagtactcccaagagcccgacaattccaccaaatcttgcaaggcaaggggatcagatcttagggtccatttcaagaacacaagggagacagcgcatgccataagaaagctacaactgaacaaggcgaagaggtacttggaagatgtgatcgctcacaagcaagctattcccttcacacgattctgtcgtggtgttggacgtactgctcaggcgaagaacaggcattcaaacggtcaaggtcgttggcctgctaaatctgctcagttcgttcttgatcttctcaagaatgctgagagcaatgctgaggtcaaaggtttggatgttgatgcccttttcatatcacacatccaagtgaaccaagcagcaaaacagaggcgaaggacatatcgtgctcatggaagaatcaatccttacatgtcaaacccatgccacattgagttgattttgtcagagaaggaagagcctgtgaagaaagagccggagactcagttggcagccaaatcaaagaaaggaacctcgtcttgagcttactatagaaacagtagtttcgtgtggtcattttgtgtcatcgcttgatacattttattcacttgtttttctgcaagactaagtagccaattttaaagacattatgatgattggttttgggatccccgaaatttg

SEQ ID NO: 1555 - DNA, 704 bp, Eutrema parvulum
ggtgaagtactcgcaagaacccgacaatcagactaagtcttgcaaggctagaggatccgatcttagggttcacttcaagaacactcgtgaaacagcgcacgccatcaggaagctaccattgctcaaggcgaagaggtaccttgaggatgtgatagctcacaagcaagcaattcccttcactcgtttctgtagaggtgtaggtagaactgctcaagctaagaacaggcactctaacggtcaaggacgttggccagcaaaatctgctcaattcgttcttgacttgctcaagaatgctgagagcaatgctgaggtgaaaggtttggatgttgatgccctcttcatatcacacatccaagtgaaccaggctgcaaaacaaaggcgaaggacctaccgtgctcacggaagaatcaatccttacatgtcaaacccatgccacattgagttgattttgtcagagaaggaagagtctgtcaagaaagagccggagacagctttggcagccaagtcaaagaaatcagccgcttaagcttttttttttgaatttctcctttttgtgttcctgaaagagattttgttcccttttctctcgatctttgcaagacaatggatagattttcttggatttttgttccatgttgctgttatgaaatcattaatcatggttagtattcattctatcttagtaattcgctaaatttatatct

SEQ ID NO: 1556 - DNA, 728 bp, Juglans hindsii x Juglans regia
tcggaagggagcagtgactagagaggcagcaggcatggtgaagtattcgaaggagccagacaacccgactaagtcctgcaaagccagaggctccgatctccgagttcattttaagaatacaagggagacagcccatgccattcgtaagttgcatctggtcaaggccaaaaggtatgtggaggatgttttggcccacaagcaagccattccattccggcgcttttgtcgtggtgtggggcgaactgcacaagctaaaaaccgtcattcaaatgggcaaggacgctggcctgttaaatctgctaagtttattctagatttacttaagaatgctgagagtaatgccgaggtgaaaggtttggatgtggattcactttatatatctcacatccaggtaaatcaagcccagaagcaaaggcgtcgcacataccgtgctcatggaagaattaacccttacatgtcatctccatgccatattgagttgactttgtcagaaaaggaagaacctgtcagaaaggagcctgagactctgttggctactaagaaaccaagggctcaagcactacgcagtggtgcttcttcttaagatgcagagttgtagaccgagtttcaacaagtctttttcttgtttctccgcagtaatgtaagaacatttttgtgtgttttatgataaaagtgtcatgaactcagagcttgtcttccgggagatacttgtactgtatttttgcccg

SEQ ID NO: 1557 - DNA, 685 bp, Brassica napus
tcacatcatctctttcttagaatcgcccttctgattctgtttttctgtcttgcaggtgaagtactcgcaagaacccgacaaccagaccaagtcttgcaaggctagaggatccgatcttagggtccacttcaagaacactcgcgaaacagcgcacgccatcaggaagctaccattgctcaaggccaagaggtaccttgaggatgtgatagctcacaagcaggcgatccccttcacccgtttctgcagaggtgttggaaggactgcccaagctaagaacaggcactccaatggtcagggacgttggcctgctaagtctgctcagttcgttcttgatttgctcaagaatgctgagagcaatgctgaggtgaagggtttggatgttgatgcgctcttcatttcgcacattcaagtgaaccaggctgcaaagcagaggagaaggacttaccgtgctcacggaagaatcaacccttacatgtccaacccatgtcacattgaattgattctgtcggagaaggaagagtctgtcaagaaagagccggagacgcagttggcagccaagtcgaagaaatcaaccgcttaagctttcgtttattttcagtatcttttttttgtgttcctgaacgagattttgttcccttttctccatattttcaagacaatggatagagttaaatgttggtgttat

SEQ ID NO: 1558 - DNA, 781 bp, Beta vulgaris
aaacaaccaccttatttttctccaaaccctaaaaatggtgaagtactccaaagaacccgataatcccactaaatcatgcaaggcaaggggttcagatctcagagtccattttaagaacactagggagacagcgttttctcttagaaagatgcctttgggcaaggccaagagatacctggaggatgtcttggctcacaagcaggccattcctttccgtcgcttctgtcgtggtgtcggtaggactgctcaagccaagaacaggcactcaaacggccaaggtcgctggccagcaaagtcagcaaaattcatccttgatttgcttaagaatgctgaaagcaacgcagagatgaagggtttggatgtggattcactctacatatctcatatccaagttaaccaagcccagaaacaaaggcgtcgtacttaccgtgctcatgggcgaatcaacccctacatgtcccatccctgccacattgagttgactttgtctgagaaggaagaatcagttaggaaggagcctgaatcacaattggctaccagcaaatctaagaagtcacaagccgcttaagagttttaaatcatcatagttgtagcctttggaaacaagttttggcagttttttttctcattgtgttgaaatctggttttgtagacaagatttttttcatctaaattaccattttgagggtttgatagcacttcttaagcagagaatatttagtgcttttctgggaagtaaacctaatgtttatgttaaagttgtttcaatgatctacccttt

SEQ ID NO: 1559 - DNA, 600 bp, Helianthus annuus
agcagcaatggtgaagtactcgcaagagcccgataatccgacaaaatcctgcaaagccagggggtctgatctgagatgccactataagaatacgagagaaacagcgcatgctatccgaaagttgcatttgattaaggcaaaaagatatttggaggacgttctggctcacaaacaggctataccgttcactcgtttttgtaggggtgttgggcgtacagctcaggcaaaaaaccggcactctaatggtcagggtcggtggcctgccaagtcagcaaaatttattttggatttactcaaaaatgctgaaagcaatgctgaggttaaaggcttggatgttgatgcacttttcatttcacatattcaagtgaaccaagctcaaaagcaaaggcgtagaacataccgagctcatggaagaattaatccttatatgtcatctccgtgtcatattgagctgactttatccgaaaaggaagagcctgtgaaaaaagaggcggaatcacaactggcaaagtcgaagtagtctcagacttgatctatggcttatttatttaatttaaaccaaaaaaacctttcaaaactattctcaggattaattttgtc

SEQ ID NO: 1560 - DNA, 723 bp, Brassica rapa
gcataatctcttctcgttggccgtcatggtgaagtactcgcaagaacccgacaattccaccaaatcttgcaaggcgaggggagcagatctcagggtccacttcaagaacactagggaaacagcgcatgctataaggaagctacccttgctcaaggcgaagaggtacttggaagatgtgatagctcacaagcaagctatccccttcacacgtttctgccgtggtgttgggcgtacttctcaggcgaagaacaggcattcaaacagtcaaggtcgttggcctgccaagtctgctcagttcgttcttgatcttctcaagaatgctgagagcaatgctgaggtcaaagggttggatgttgatgcacttttcatttctcacattcaagtgaaccaagcagcaaagcagaggcggaggacataccgtgctcatggaagaattaatccttacatgtcaaacccatgccacattgagttgatattgtcggagaaggaagagcctgttaagaaagagccggagactcagttggccgcctagtccaaaaaaggagcctcgtcttaagcctagggactgtagttatcgtgtggtcacattgtgtgatacattttgttcacttttattattgtaagacaacgcagccgattgaaaaaaacatgattgaattttggattacagaagcgttgactttatttacaaatcagtacaaaatcgtgaactttattttcaaa

SEQ ID NO: 1561 - DNA, 780 bp, Ocimum basilicum
gcacgaggcgatctacagcatttctgcagcgccgccgcagctacaatggtgaagtactccatagagcccggcaacaccaccaagtcctgcaaggccaggggatccgatctcagggttcattttaagaacactagggagaccgcacatgccattcgtaagttgcctcttatcaaggccaagaggtacttagaggatgttcttgcccacaagcaggccattcctttcacccgcttctgtggtggtgttggacgaactgctcaggccaagaacagacactcaaacggacaggggcgctggcctgtaaaatccgccaaatttatcttggatttactcaagaatgccgagagtaatgctgaggtgaaaggtttggacgtcgatgcattatacatttctcacattcaggttaaccaagcccagaagcaaaggcgccgcacataccgtgcccatggaagaattaacccgtacatgtcatctccctgccatattgagttgatactgtcagagaaggaagaacctgtgaagaaggagcctgaatcacagcagttggcggcaacaagcaaacctaggaaggcttgatctgttggtgatttgtccggtcttatatcagttttgagtttgaaattgtttttggtcttcttttttcccaaaaccagtttagtgacttgtcatatgtttctaattttggggattaatccggtttttctcatgtgggttgtgtttattttgcagctggatagtatatctcgtttatttctattgttgatgtttgcaccggccctt

SEQ ID NO: 1562 - DNA, 819 bp, Beta vulgaris
gcacgaggctcttcttcttttgagagagtgagagaaaacaaccaccttatttttctccaaaccctaaaaatggtgaagtactccaaagaacccgataatcccactaaatcatgcaaggcaaggggttcagatctcagagtccattttaagaacactagggagacagcgttttctcttagaaagatgcctttgggcaaggccaagagatacctggaggatgtcttggctcacaagcaggccattcctttccgtcgcttctgtcgtggtgtcggtaggactgctcaagccaagaacaggcactcaaacggccaaggtcgctggccagcaaagtcagcaaaattcatccttgatttgcttaagaatgctgaaagcaacgcagagatgaagggtttggatgtggattcactctacatatctcatatccaagttaaccaagcccagaaacaaaggcgtcgtacttaccgtgctcatgggcgaatcaacccctacatgtcccatccctgccacattgagttgactttgtctgagaaggaagaatcagttaggaaggagcctgaatcacaattggctaccagcaaatctaagaagtcacaagccgcttaagagttttaaatcatcatagttgtagcctttggaaacaagttttggcagttttttttctcattgtgttgaaatctggttttgtagacaagatttttttcatctaaattaccattttgagggtttgatagcacttcttaagcagagaatatttagtgcttttctgggaagtaaacctaatgtttatgttaaagttgtttcaatgatctacccttttaa

SEQ ID NO: 1563 - DNA, 769 bp, Cynara scolymus
cggggggatccctgtgggttggcaccaattcatcggcattttgcaccggcgaaccagttgctgccatggtgaagtactcaaaggaaccggacaaccccacgaaatcttgcaaagctaggggatcagatctcaggtgtcatttcaagaacaccagagaaactgcccatgctatacgtaagttgcctttaattaaggctaaaagatacttggaggatgttcttgtccataagcaagctatccccttcacacgcttctgtcgtggagttggacgtactgcacaggcaaagaatcgtcattcaaatggacaaggacgttggcctgctaaatctgcaaagtttatcctggacttgctcaagaatgccgagagcaatgcagaagttaaagggttggatgtggatgcacttcacatctctcacattcaggtgaatcaagcacggaaacagagacgtcgtacatatcgtgctcatggaagaatcaacccttacatgtcttctccttgtcacattgagctcaccttgtctgaaaaggaagaacctgttaagaaagaggtcgagagtcaattggctgcaagaaagagcaattagaacgtaatcatataactcgggtggatcgacataagttggtaactaggaagaatgggttttatttttgatctaatggttatttggaaaagatgcgtttctattttttaaagattcattgtttgattacaagattctgaatacttgatgaattttgaaattctagttatttataaaattatttttga

SEQ ID NO: 1564 - DNA, 644 bp, Hevea brasiliensis
cgtcagccgccatggtgaagtactctagagagcctgaaaatcaaaccaagtcctgcaaggccaggggctctgacctcagagtgcatttcaagaatactagagagacagcccatgcattgaggaagttacctttggcaaaggctaagaggtatttggaagatgttatggctcacaaacaagctatacctttccgacgtttctgtggtggtgtggggcgtactgctcaggcaaagaacaggcactcaaatgggcaaggaaggtggcctgccaaatctgccaagttcattcttgatttgctcaagaatgctgagagtaatgctgaggtcaaaggcttggatgtcgataatcttttcatttctcacatccaagtgaatcaggcacagaagcagaggcgtcgtacttatagggctcacggaagaatcaatccttacatgtccagcccttgccacattgagttgattttatctgagaaggaagaaccagtgaagaaggagcctgagacccaactggctaccagcaaatctaagaagtctcaagctacttgaagtgctgcttccgccggtgtggcaaccataatttaccaaaggagcacagcactatttagtatttgtcttgtttcaattggagagaatttggttgcactt

SEQ ID NO: 1565 - DNA, 507 bp, Hevea brasiliensis
aaaccatggtgaagtattctagggaaccagacaacccccccaaatcatgcaaagctcggggctctgatcttcgagtccactttaagaatacaagagagactgctcatgcaattcggaagttgcatttagccaaggctaaaaggtacttggaggatgttatggcacacaagcaagctatcccattccgtcgtttctgtggtggtgttgggcgaactgcacaggcaaaaaatcgtcattcaaatggacaagggcgctggcctgttaaatctgcaaaatttatccttgatttgctcaagaatgcagaaagtaatgcagaggtgaaaggtttagatgttgattcactctacatatctcacatccaagtcaatcaagcacagaaacaacgtcgccgcacttatagagcccatggaaggataaatccttatatgtcctcgccatgccacatcgagttgattttgtcagaaaaggaagaacctgttaagaaagagcctgagactcatctggctc

SEQ ID NO: 1566 - DNA, 888 bp, Carica papaya
gcttcttctgctaaccagacctcagtttgaggcagaagtatagcagtaacagcagccgccatggtgaagtattcaagggagcctgacaatccgacaaagtcctgcaaagcgaggggctccgatctcagggttcattttaagaacacaagggagactgcattcgcaatcagaaagcttcctttggccaaggcgaaaaggtacttggaggatgttcttgctcacaagcaggctatacctttccgacgattctgtggtggtgttggacgcactgctcaagcaaagaacaggcattctaatggtcaaggtcgctggccagtgaaatcagccaagttcattcttgatttgctgaagaatgcggagagcaatgctgaagtgaaaggtttggatgtagatgcactctttatatcacacatccaggtaaatcaggcacagaaacaaaggcgccgtacttaccgtgctcacggaagaataaacccctatatgtcttctccatgtcacattgagttgattttgtccgagaaagaagagcctgtgaagaaggagcccgagacccagttggcaactagcaaatccaagaaatctcaagctctgtgaagtggtgcctcttcataagtcatccttaattttaagttgggtcaagggcctcctttttttgtgttttgttgattaaagggaggaatgttgctactatttgatgatatagttggttgagctatttatttagatgtaatggatggttttttctttttcattcaaaaccatgtttgggtaaaattccttttgagattttgattggaaacctattcttgtttaggagttgattaagttgcttagaaccgatgaatatgtaatactagatattaatatcattattatatttagttatcc

SEQ ID NO: 1567 - DNA, 517 bp, Sesamum indicum
cagggcggagcgttttctccagcagctacagctacaatggtgaagtactcgagggagcccgacaaccccaccaaatcctgcaaggccaggggatccgatctcagagttcatttcaagaacactagggagacagcacatgccatcaggaagctgcctctagccaaggccaagaggtatttggaggatgtgcttgcccacaagcaggccatacctttcactcgcttctgtggaggtgttgggagaactgctcaggcaaagaacagacattctaatggacaggggcgctggcctgtgaaatctgccaagtttatcctggatttactcaagaatgctgaaagcaatgctgaggtgaaaggtttggatgttgatgctctctacatttcgcacattcaagtaaaccaggcccagaagcaaaggcgccgaacataccgtgctcatggaagaataaacccgtacatgtcatcaccctgccacattgagttgattctatctgaaaaggaagaacccgtcaaaaagg

SEQ ID NO: 1568 - DNA, 887 bp, Tragopogon dubius
atcggaagaacaacaattcagcggcatttgcaattttccccggacgaagccgctcctgccgccatggtgaagtactcaaaggaaccggagaaccctacgaaatcttgcaaagcaaggggatcagatctcaggtgtcattttaagaacactagggaaactgcacatgctattcgtaagttgccattgatcaaggccaaaagatacttggaggatgttcttgtccacaaacaagctattccatttacacgtttctgtcgtggagttgggcgaactgcacaggccaagaatcgccattcaaatggtcaaggacgttggcctgctaaatctgcaaaatttattctggatttgctcaagaacgccgagagcaatgcagaagttaaagggttggatgtggatgctcttcacatctcccacattcaggtgaaccaagcacagaaacagagacgtagaacatatcgtgcacatggaagaatcaacccttacatgtcttctccgtgtcatattgagctgactttgtctgagaaggaagaacctgttcagaaagagcctgagagtcaattggctgcaagaaagaccaagtagagttcactatagctgatggtggttcaacttagaaagaggtttatttttggtctatgcacttatattttggaagatttttatataatgttcaattatgagatacttcatactgtaagggtattttggcacaatttgggaacttgtgttggaggtttttggtgtttgattattttttgatgaggttaacttgagtaaacatagcatatttgaacaaacattagaacaatatgaattgacatttaaaactgccaattgatgtaagctcaaatgatcaatgcaattgtttattctatttttgttgaact

SEQ ID NO: 1569 - DNA, 1360 bp, Cannabis sativa
tttttcctgctatttcttcttcttcttctttctctttctctctctctctctagagatcggccatggacccaaatttgcttccctctcttcaccgctattttctatacagttactagaaaattacaatattgcccccatttacgttacagataaaatagctaaggcccagcccaactaagttaataacagggtaactatcttataaggcccaattaatcaaagcccagattttgacccaataaaaactcagtccaaaacatctcgttaggccgtaaaccctacttctgaactcttcccaagagacccccatatatattggaaaccctaattttcgactagggatttgccacttcgccaggaaaaattttgattcggaagcggaaggtcagaagaagccatggtgaagtattctaaggagcctgataatcccaccaaatcctgcaaagccagggggtcagatctcagagttcactttaagaatactagggagacagcgttttcaattagaaagatgcctttgatcaaggcaaaaaggtatttggaggatgttttggttcacaagcaagctatcccattccgtcgcttctgtagaggagtagggcgtactgcacaggcaaaaaatcgccactcaaatggacaaggacgttggcctgtaaaatctgccaagtttattcttgacctactgaagaatgctgagagcaatgctgaggtgaaaggtttggatgtcgattcactttacgtttctcacatccaggtgaaccaagctcaaaagcaaaggcgtcgtacataccgtgcccatggaagaattaacccttacatgtcatccccatgccatatcgagctgactttgtcagagaaagaagagccggtcaagaaagagcctgaaagtcagttggcttctaggaaaccagaaaagactcgtgcttagagagctctccaaggcggtgcctctgcttcttcaacagctgaaggtgtaggctaagtaggaatccaagtttttgtttgagtgcccagaaattttatttttgttttttgtcaaacctgaagcttgtttttgtggcagattttatattaatctttattttatagctattgctagaaagcctttttggactttttcaatgttagtttgttttaatgagttggaagttgatgctggatactaaagccttaaattaaaattatatacctctactaaaggtttagctatataactcttacgattctcttaaatctcctccttgtgttcttgagtaggttaatcttataaaactggtgataattcagtaagtcaaatgaagcatcgaaatgtactcataagctgttttgttccataaaaaaatacagttgctttgctctt

SEQ ID NO: 1570 - DNA, 1053 bp, Cannabis sativa
gaaaccctaattttcgactagggatttgccacttcgccaggaaaatttttgaatcggaagcggaaggtcagaagaagccatggtgaagtattctaaggagcctgataatcccaccaaatcctgcaaagccagggggtcagatctcagagttcactttaagaatactagggagacagcgttttcaattagaaagatgcctttgatcaaggcaaaaaggtatttggaggatgttttggttcacaagcaagctatcccattccgtcgcttctgtagaggagtagggcgtactgcacaggcaaaaaatcgccactcaaatggacaaggacgttggcctgtaaaatctgccaagtttattcttgacctactgaagaatgctgagagcaatgctgaggtgaaaggtttggatgtcgattcactttacgtttctcacatccaggtgaaccaagctcaaaagcaaaggcgtcgtacataccgtgcccatggaagaattaacccttacatgtcatccccatgccatatcgagctgactttgtcagagaaagaagagccggtcaagaaagagcctgaaagtcagttggcttctaggaaaccagaaaagactcgtgcttagagagctctccaaggcggtgcctctgcttcttcaacagctgaaggtgtaggctaagtaggaatccaagtttttgtttgagtgaccagaaattttatttttgttttttgtcaaacctgaagcttgtttttgtggcagattttatattaatctttatttatagctattgctagaaagcctttttggactttttcaatgttagtttgttttgatgagttggaagttgatgctggattctaaagccttaaattaaaattatatacctctactaaaggtttagctataactcttacgattctcttaaatctcctcgtgttcttgagtaggttaatcttataaaactagtgataattcagtaagtcaaatgaagcatcgaaattaggggtgttcatccgatccaatccgcacttttttggtcaaacaacatccaatccgcactaattgcg

SEQ ID NO: 1571 - DNA, 860 bp, Gossypium raimondii
taaaaaaccatcccttttatttgctaaagaaaccctagctacgcacctcgtctcttgcagcggtagggaaccaactgttaccacacagcagcagcagcagccatggtgaagtactcaagagaaccggacaaccctactaaatcttgcaaagctaggggttctgaccttcgtgttcattttaagaatacacgagaaactgcctttgcaatccgaaagctacctttgacgaaggcaaaaaggtacttggaagatgttattgcccacaagcaagcaattccattcaggcgcttctgtggtggagttgggcgaaccgcacaggctaagaatcgccattctaatggacaaggccgttggcccgtgaaatcagcaaaattcattctcgatttgctcaagaatgccgagagcaatgctgaggtgaaaggcttggatgtagattcacttatcgtatctcacatccaagtaaaccaagcacagaagcaaaggcgccgaacatatcgtgcacatggaagaattaacccctacatgtcttcaccgtgtcacattgaactgatcctgtctgagaaagaggaagccgtcaaaaaagagccggagactcagttggctccgaggaaatcaaagggtgcttcgtcttaaactgctgagtgatggattgttagtcggaagcttttaatttgttgtctctgtaatgagaacatttttgtttacttcacaatgaggtgcttaagactcaaaagtttgtctgtggagattcctggtttctatttaaagctatgctcatttcgcattgaatatcttaatactaaattaaatttatattgaaaaatccatcaaattaattgcgttaattatttgattataaa

SEQ ID NO: 1572 - DNA, 732 bp, Brassica oleracea
gacttcagtcacttctcctccgtcaactcacctgtttcgccgccatggtgaagtactcccaggagcccgacaattccaccaaatcttgcaaggcgaggggagctgatctcagggtccacttcaagaacactagggagacagcgcacgccataagaaggctgccattgaacaaggccaagaggtacttggaagacgtgatagctcacaagcaagctatccccttcacacgtttctgtcgtggtgttggccgtactgctcaggctaagaacaggcattcaaacggtcaaggtcgatggcctgctaaatctgctcagttcgttcttgatctcctcaagaatgctgagagcaatgctgaggtcaaaggtttggatgttgatgcacttttcatatctcacatccaagtgaaccaagcagcaaaacagaggcggaggacataccgtgctcatggaagaatcaatccttacatgtcaaacccatgccacattgagttgatattgtcagagaaggaagagcctgttaaaaaagagccagagactcagttggcagcgaagtcaaagaaaggagcctcgtcttgagcctatagacaagtagctttttcgtggtcacctctgttacaagaaccgcttgatacattttgttcacttatcgttctgtaagacagggagccaacattttcaaagacataataatatgtttctttgtttctggaacaacggggcattgttcacttta

SEQ ID NO: 1573 - DNA, 866 bp, Brassica rapa
tcatatgtgtctccccatatataaagtagtttgtcctacttaacgttacttcagtcacttctcctccgtcgactcacctgtttcgccgccatggtgaagtactcccaggaacccgacaattccaccaaatcttgcaaggctaggggagctgatctcagggtccacttcaagaacactagggagacagcgcacgccataagaaggctaccattgaacaaggccaagaggtacttggaagatgtgatagctcacaagcaagcaatccccttcacacgtttctgtcgtggtgttggtcgtactgctcaggctaagaacaggcactcaaatggtcaaggtcgatggcctgctaaatctgctcagttcgttcttgatctcctcaagaatgctgagagcaatgctgaggtcaaaggtttggatgttgatgcacttttcatatctcacatccaagtgaaccaagcagcaaaacaaaggcgtaggacataccgtgctcatggaagaatcaatccttacatgtcaaacccgtgccacattgagttgatattgtcagagaaggaagagcctgttaagaaagagccagagactcagttggcagcgaagtcaaagaaaggagcctcgtcttgagcctatagacaagtaactttttcgtggtcacctctgttacaagaaccgcttgatacattttgttcacttatcgttctgtaagacaaggagccaacattttcaaagacataataatatgattctttgtttctggaacaacgagcattgttcactttattgagtaaccaattccaaaattttgaaacgaatcagttctgtaatgattacaaattctcacttgttaaatacttgaaatctatcttttg

SEQ ID NO: 1574 - DNA, 734 bp, Ocimum basilicum
gcatttgcacagcgccgcggaagaagaagccgccgcagttacaatggtgaagtactcgagagagcccggcaattcaaccaaatcctgcaaggccaggggatcagatcttagggttcatttcaagaacactagggagactgcacatgccatcagaaagttgcctctagtaaaggcgaagaggtacttggaggatgtgcttgcacacaagcaagccattcccttcactcgtttctgtggtggtgttgggcgaacagctcaggccaagaacagacactctaatggacagggccggtggcctgtgaaatctgccaagttcatcttagatttactcaagaatgctgaaagtaacgctgaggtgaaaggcttggatgtggatgcactatatatttctcacattcaggttaaccaggcccagaagcagaggcgccgcacataccgagcccacggaagaattaacccttatatgtcatctccctgccacattgagttgatcctgtcggaaaaggaagagccagtaaaaaaggagccggaatcacagttggcagcaacacggagacctaagaaatcttgatcctctataacaagcaaaccctaggtagtttggtgatttgttggatcaaatattagtttcaagttttgaaattgtaattgttgtactttgttttcggaccaaattcagtggcagcttgtcttacgttttcttatttggagataattcggattttaaaaaaaaa

SEQ ID NO: 1575 - DNA, 752 bp, Brassica napus
tcatatgtgtctccccatatataaagtagtttgtcctacttaaccccacttcagtcacttctcctccgtcaactcacctgtttcgccgccatggtgaagtactcccaggagcccgacaattccaccaaatcttgcaaggcgaggggagctgatctcagggtccacttcaagaacactagggagacagcgcacgccataagaaggctaccattgaacaaggccaagaggtacttggaagatgtgatagctcacaagcaagctatccccttcacacgtttctgtcgtggtgttggccgtactgctcaggctaagaacaggcattcaaacggtcaaggtcgatggcctgctaaatctgctcagttcgttcttgatctcctcaagaatgctgagagcaatgctgaggtcaaaggtttggatgttgatgcacttttcatatctcacatccaagtgaaccaagcagcaaaacagaggcggaggacataccgtgctcatggaagaatcaatccttacatgtcaaacccatgccacattgagttgatattgtcagagaaggaagagcctgttaaaaaagagccagagactcagttggcagcgaagtcaaagaaaggagcctcgtcttgagcctatagacaagtagctttttcgtggtcacctctgttacaagaaccgcttgatacattttgttcacttatcgttctgtaagacaaggagccaacattttcaaagacataataatatgattctttgtttct

SEQ ID NO: 1576 - DNA, 807 bp, Catharanthus roseus
gctcagccggcagcagcagaagaagcagggaaaatggtgaagtactcaagggagccggacaatcctaccaaatcctgcaaggccaggggttctgatctccgtgttcatttcaagaacactagggagacagctcatgccatcaggaagctgcctctagttaaagccaaaaggtatctggaggatgttttggcccataagcaggcaattccattcactagattctgtggaggtgttggccgcactgctcaggccaagaataggcattcgaatggacaaggtagatggcctgtgaaatctgccaagttcattttggatctgctaaaaaatgcagaaagcaatgctgaggtgaaaggtcttgatgtggattccttatatatttcccacattcaagtgaaccaggcacaaaagcaaaggcgccgaacataccgtgctcatgggaggattaatccatacatgtcctccccatgccatatagagttaattttggctgagaaggaagagccagtcagaaaagagcctgaatcacagttggctaccagcaccaaatcgagaaaggcttaagagctctgtggtcttgtgcgttgttgagcattggaagagtcttgtagcctgttaattttgcaaattttagttcttctgttaccttgtgcctttaggttggagacaattacaagtgttattctagtgcttttcataagcactttaaaaaatttgatttatagacatcatattttgaaccttgagcaaaaaagacacttttggttgattttggattgtcttatggctaaatttgaatgacctatgatg

SEQ ID NO: 1577 - DNA, 730 bp, Raphanus sativus
  misc_feature (3)..(3): n is a, c, g, or t
ggnagtcacttctcctccgtcatcgaatcacctgtttagtccccatggtgaagtactcccaggaacccgacaattccaccaaatcttgcaaggcgaggggagctgatctcagggtccacttcaagaacacaagggagacagcgcacgccataagaaggctaccattgaacaaggccaagaggtacttggaagatgtgatagctcacaagcaagctatccctttcacgcgtttctgtcgtggtgttggtcgtactgctcaggctaagaacaggcattcaaacggtcaaggtcgatggcctgctaaatctgctcagttcgttctcgatctcctcaagaatgctgagagcaatgccgaggtcaaaggtttggatgtggatgcgcttttcatatctcacatccaagtgaaccaagcagctaaacagaggcggaggacataccgtgctcacggaagaatcaatccgtacatgtcgaacccttgccacattgagttgatattgtcagagaaggaagagcctgtgaagaaagagccggagactcagttggcagctaagtcaaagaaaggagcctcgtcttgagcttattatatagacaaagtagcttttcgttgatcatctctgttataagaacgtataatacgttttgttatagacttatcattctgtaagacaaggagccaacattttcaaagacattataattatgttgttgatttgttttttggaataccgga

SEQ ID NO: 1578 - DNA, 733 bp, Raphanus sativus
  misc_feature (37)..(37): n is a, c, g, or t
  misc_feature (715)..(715): n is a, c, g, or t
ggcagtcacttctcccccgtcatcgaatcacctgttnggccgccatggtgaagtactcccaggaacccgacaattccaccaaatcttgcaaggcgaggggagctgatctcagggtccacttcaagaacacgagggagacagcgcacgccataagaaggctaccattgaacaaggccaagcggtacttggaagatgtgatagctcacaagcaagctatccctttcacgcgtttctgtcgtggtgttggtcgtactgctcaggctaagaacaggcattcaaacggtcaaggtcgatggcctgctaaatctgctcagttcgttcttgatctcctcaagaatgccgagagcaatgctgaggtcaaaggtttggatgttgatgcgcttttcatatctcacatccaagtgaaccaagctgctaaacagaggcggaggacgtaccgtgctcatggaagaatcaatccttacatgtcgaacccttgccacattgagttgatattgtcagagaaggaagagcctgttaagaaagagccggagactcagttggcagctaagtcaaagaagggagcctcgtcttgagcttatatatagacaaagtagcttttcgttgatcatctctgttataagaacgtatgatacgttttgttatagacttatcattctgtaagacaaggagccaacattttcatagacataattgtgttgttgatttgtttttngaataccggagctttgtt

SEQ ID NO: 1579 - DNA, 780 bp, Raphanus sativus
ggagtcacttctcctccgtcatcgaatcacctgtttggccgccatggtgaagtactcccaggaacccgacaattccaccaaatcttgcaaggcgaggggagctgatctcagggtccacttcaagaacacgagggagacagcgcacgccataagaaggctaccattgaacaaggccaagaggtacttggaagatgtgatagctcacaagcaagctatccccttcacacgtttctgtcgtggtgttggtcgtactgctcaggctaagaacaggcattcaaacggtcaaggtcgatggcctgctaaatctgctcaattcgttctcgatctcctcaagaatgctgagagcaatgccgaggtcaaaggtttggatgtggatgcacttttcatatctcacatccaagtgaaccaagctgctaaacagaggcggaggacataccgtgctcatggaagaatcaatccttacatgtcaaacccttgccacattgagttgatattgtcagagaaggaagagcctgtgaaaaaagagccggagactcagttggcagctaagtcaaagaaaggagcctcgtcttgagccaatatatagacaaagtagcttttcgtgatcatctctgttataagaacgtatgatacgttttgttatagacttatcattctgtaagacaaggagccaacattttcaaagacataattatgttgatttgtttttggaagtaccagagctttgttcactttatagtgtaaccaattcaaaatgctaaaaatcgaatcagttcaata

SEQ ID NO: 1580 - DNA, 867 bp, Silene vulgaris
tcgtcaatcaatcaaaatgataaataagccccttttcaaaaccctaacttaataattccgcctctactctttctttcaatcaatctctctaaaatggtgaaatactctcaagaacctgagaatcccaccaaatcatgcaaggccaggggttcagatctcagggtgcatttcaagaacactagggagactgcattttcccttagaaagatgcctttggtgaaggccaaaaggtacttagaggatgttctggctcacaagcaagcaattccattccgtcgtttctgtggtggtgttggcagaacagcccaagctaagagcaggcattctaatggtcaaggtcgttggcctgccaagtcagctaaatttatcctcgatttactgaagaatgctgagagcaatgctgagatgaaaggtttagatgtggactcactctacatctctcacattcaagttaaccaggcccagaaacaaaggcgtcgtacttaccgtgctcatggaaggatcaacccttacatgtctcacccttgccacatcgagttggttttgtcagagaaggaagagccagttaggaaggaggcggagactcagctagctacaagcaaatcgaagaagtcacaagcctaaagtcttccgattgtaacttcattactatagttcttttagccattgagtcgacgttttgggcttcattctgttttgatcttgtgtttctgaacattgacatctgcaaaaatttacccagtgccagtctattgctagtctatttttcggacagactcttgttaatgtttttttgtaatcaaagctatattaaatacagtatattgatgatatccatccatcatcaccttttgacttgtaagtttt

SEQ ID NO: 1581 - DNA, 747 bp, Utricularia gibba
gcgccgccgcagaaatggtgaagtactccagagagcctgataatcccactaaatcgtgcaaggcgaggggatctgatcttagggttcacttcaagaacacccgggagactgcccatgctatcaggaagctgcctcttttgaaggccaagagatatttggaagatgttatcgcccacaagcaggccatacccttcacacggtactgtggaggcgttggacgcactgctcaagcaaaaaataggcactccaatggtcagggacgctggcctgccaagtctgctaagtttatactggatctgctcaaaaatgccgaaagcaatgctgaggtcaagggcctcgaggtagattcactgtacatctcccatatccaggtcaaccaggcccagaagcaaagacgccgcacataccgtgctcatggaagaataaacccctatatgtcttctccatgccacatcgaactcatcctttccgagaaggaagagcctgtcaagaaagagcctgaatctcagttggctgctgccagcaaacccaagaggtcttgagcgcgcgcctacctgctttggcacacttcgttgctgctagtcaagctttgaaacctctgttctgtggcttcggttcattgtttttgttctgtttggagaactactcatctgactgtctcaaagaccagcattctcgtttctatttatatgtccttttttgtttccccaagcagattgtcctgtgagtcagtactttttttaaaaa

SEQ ID NO: 1582 - DNA, 1008 bp, Ricinus communis
gttctaaaacctttataaatcgaaaccctaagcgcctcccattctcttcttgataggcgaaagtaagaacacttcactagaggcagaaacaccatcaccgtcaccataagccgccatggtgaagtactcaagagagcctgaaaatcctactaagtcatgcaaggcaaggggctctgacctcagagttcacttcaagaatacaagagagacagcctttgccttgaggaagctacctttgacaaaggctaagaggtatttggaagatgttatggctcacaagcaagctatacctttcagacgtttctgtggtggtgttgggcgtactgctcaagcaaaaaacaggcattcaaatggtcaaggacgctggcctgtaaaatctgccaagttcattctagatttgctcaagaatgctgagagcaacgctgaggttaagggtttggatgtcgatgcactctacatttctcacatccaagtgaatcaggcacagaagcagaggcgtcgaacttatcgcgcccatggaagaatcaatccttacatgtccagcccttgccacattgagctgattttggctgagaaagaagaagcagtgaggaaggagcctgagacacagcttgctaccagcaacaaacccaagaagtctcaagctctacgatctggtgcttcctcttaagtagggatatcataatttaccaatagaaggagcactaggaagtgtttgtgtttttgttgtttggaaagaattttgttgcttttcaatttagaatgagctacttagatgaattgaacagcttgtttgtttattttgacctatgtttagttaattgctctatgagatttttgtcgaagaatttatttgagagctcatcttttcccgagttttatatgatatgattgtatgaagaatcactgtgtttggtaatggaatgtgtttccagcttccatttgttgcgacagaaaataaacatcctatgataatatcggtgtcatatgggtaaaaattgatatttg

SEQ ID NO: 1583 - DNA, 828 bp, Helianthus annuus
ggttgttggggtggcctccgaagaaccacgccattttcacgcagcagcagcagcaatggtgaagtactcgaaggaaccagaaaaccctaccaaatcttgcaaagccagaggatctgatctcaggtgccattttaagaatacccgtgaaacagcccatgctatccgtaagttgcctttaatcaaggctaagagatacttggaagatgttttggctcataagcaagccattccatttacccgtttttgtcgcggagttgggcgtactgctcaggcaaaaaaccgtcattctaatggtcaagggcgttggcctgcaaagtctgcgaagtttatccttgatttactcaaaaatgctgagagtaacgcagaggtcaaagggttggatgtggacgcccttcacatctctcacatccaggtgaaccaagcccagaaacagagacgtcgtacataccgtgcacatggaagaattaatccttacatgtcatctccgtgtcacattgagctcactttgtctgagaaagaagaacctgttaaaaaggagcctgagactcaattggcccctagaaccaaaaagaatcaagcttaagtgaggggtgcatcctcttcagtcatagtgtggttttttgttttcatttgttatatttccctttccaaagattcttatatatcaattatggagatcttgctttttggttttaaaatattcaaggaaaacttgtttcattcatggttgaatattcaattgtgatttggttcaaaaaccacaaaaaaaaggaaagaggtatttgtggcccgctgggcccagtgaaattttgaattgggacaagcttt

SEQ ID NO: 1584 - DNA, 859 bp, Helianthus annuus
ggattcgattgtgtttttgagggcagagaatggggatctttgtgtcgggattcgaagggcgaaaagaggggttggaggggggcagcctccgaagatccaacagcattttcaccggcggcacgatcatcctcagcagtcatggtgaaatactccaaggaaccagaaaaccccaccaaatcttgcaaagctaggggatcagatctcaggtgtcactttaagaacacccgagaaactgcccatgctatccgtaagttgcctttgatcaaggctaagagatacttggaagatgtcttggctcacaagcaagctattccattcacccggttttgccgtggtgttggccgtaccgcacaagccaaaaaccgtcactccaatggacaaggacgttggcccgctaagtctgcaaagttcatccttgatctgctgaaaaatgccgagagtaacgctgaggtcaaagggttggatgtggatgctcttcacatttctcacattcaggtgaaccaagcacagaaacaaagacgtcgcacataccgtgctcacggaagaattaacccttacatgtcttcaccttgtcacattgaactcactttgtctgagaaagaagaaccagttaaaaaggagcctgagacacagttggctcctagaaccaagaagaaccaagcttaagtcaggagtgcattttcatgagtgaggctcatagtttgttggtagaaggaattctgtttttgttttcacttattatatcagaaccatgtgtttttgtttccaaagattcttatcctcttatattcaattatgaggtacttgtgctttatgaaactaaaatgttgagcaaaacttgtttcattcagggctggtt

SEQ ID NO: 1585 - DNA, 730 bp, Helianthus annuus
ggggtggccaccgaagaaacacgccattttcacgcagcagcagcagcaatggtgaagtactcgaaggaaccagaaaaccctaccaaatcttgcaaagccagaggatctgatctcaggtgccattttaagaatacccgtgaaacagcccatgctatccgtaagttgcctttaatcaaggctaagagatacttggaagatgttttggctcataagcaagccattccatttacccgtttttgtcgcggagttgggcgtactgcacaggcaaaaaaccgtcattctaatggtcaagggcgttggcctgcaaagtctgcgaagtttatccttgatttgctaaaaaatgctgagagtaacgcagaggtcaaagggttggatgtggacgcccttcacatctctcacatccaggtgaaccaagctcagaaacagagacgtcgtacataccgtgcacatggaagaattaatccttacatgtcatctccttgtcacattgagctcactttgtctgagaaagaagaacctgttaaaaaggagcctgagactcaattggcccctagaaccaaaaagaatcaagcttaagtgaggggtgcatcctcttcagtcatagtgtggtttttgttttcatttgttatatttcccttcccaaagattcttattcttattatatcaattatggagatcttgccttttggttttaaaatatttaaggaaaacttgtttcattcatggttga

SEQ ID NO: 1586 - DNA, 717 bp, Helianthus annuus
gcagcagcagcagcagcaatggtgaagtactcgaaggaaccagaaaaccctaccaaatcttgcaaagccagaggatctgatctcaggtgccatttcaagaatacccgtgaaacagcccatgctatccgtaagttgcctttaatcaaggctaagagatacttggaagatgttttggctcataagcaagccattccatttacccgtttttgtcgcggagttgggcgtactgcacaggcaaaaaaccgtcattctaatggtcaagggcgttggcctgcaaagtctgcgaagtttatccttgatttgctcaaaaatgctgagagtaacgcagaggtcaaagggttggatgtggacgcccttcacatctctcacatccaggtgaaccaagcccagaaacagagacgtcgtacataccgtgcacatggaagaattaatccttacatgtcatctccgtgtcacattgagctcactttgtctgagaaagaagaacctgttaaaaaggagcctgagactcaattggcccctagaaccaaaaagaatcaagcttaagtgaggggtgcatcctcttcagtcatagtgtggttttttgttttcatttgttatatttccctttccaaagattcttattatatcaattatggagatcttgccttttggttttaaaatatttaaggaaaacttgtttcattcatggttgaatcttcaattgtgatttggttc

SEQ ID NO: 1587 - DNA, 706 bp, Helianthus annuus
tggggtggcctccgaagaacacacgccattttcacgcagcagcaatggtgaagtactcgaaggaaccagaaaaccctaccaaatcttgcaaagccagaggatctgatctcaggtgccattttaagaatacgcgtgaaacagcccatgctatccgtaagttgcctttaatcaaggctaagagatacttggaagatgttttggctcataagcaagccattccatttacccgtttttgtcgcggagttgggcgtactgcacaggcgaaaaaccgtcattctaatggtcaagggcgttggcctgcaaagtctgcgaagtttatcctcgatttgctcaaaaatgctgagagtaacgcagaggtcaaggggttggatgtggacgcccttcacatctctcacatccaggtgaaccaagcccagaaacagagacgtcgtacataccgtgcacatggaagaattaacccttacatgtcatctccgtgtcacattgagctcactttgtctgagaaagaagaacctgttaaaaaggagcctgagactcaattggcccctagaaccaaaaagaatcaagcttaagtgaagggtcttcagtcatagtgtggtgttttgttttcatttgttatatttccctttccaaagattcttattatatcaattatggagatcttgccttttggttttaaaatatttaaggaaaacttgtttcattc

SEQ ID NO: 1588 - DNA, 752 bp, Helianthus annuus
gttgttggggtggcctccgaagaacacacgccattttcacgcagcagcaatggtgaagtactcgaaggaaccagaaaaccctaccaaatcttgcaaagccagaggatctgatctcaggtgccattttaagaatacgcgtgaaacagcccatgctatccgtaagttgcctttaatcaaggctaagagatacttggaagatgttttggctcataagcaagccattccatttacccgtttttgtcgcggagttgggcgtactgctcaggcaaaaaaccgtcattctaatggtcaagggcgttggcctgcaaagtctgcgaagtttatccttgatttgctcaaaaatgctgagagtaacgcagaggtcaaagggttggatgtggacgcccttcacatctctcacatccaggtgaaccaagcccagaaacagagacgtcgtacataccgtgcacatggaagaattaacccttacatgtcatctccttgtcacattgagctcactttgtctgagaaagaagaacctgttaaaaaggagcctgagactcaattggcccctagaaccaaaaagaatcaagcttaagtgaagggtgcatcctcttcagtcttagtgtggttttttgttttcatttgttatatttccctttccaaagattcttattatatcaattatggagatcttgctttttggttttaaaatattcaaggaaaacttgtttcattcatggttgaatcttcaattgtgatttggttcaaaa

SEQ ID NO: 1589 - DNA, 693 bp, Helianthus annuus
gcagcagcagcagcagcaatggtgaagtactcgaaggaaccagaaaaccctaccaaatcttgcaaagccagaggatctgatctcaggtgccattttaagaatacccgtgaaacagcccatgctatccgtaagttgcctttaatcaaggctaagagatacttggaagatgttttggctcataagcaagccattccatttacccgtttttgtcgcggagttgggcgtactgcacaggcaaaaaaccgtcattcaaatggtcaagggcgttggcctgcaaagtctgcgaagtttatccttgatttgctcaaaaatgctgagagtaacgcagaggtcaaagggttggatgtggacgcccttcacatctctcacatccaggtgaaccaagctcagaaacagagacgtcgtacataccgtgcacatggaagaattaacccttacatgtcatctccgtgtcacattgagctcactttgtctgagaaagaagaacctgttaaaaaggagcctgagactcaattggcccctagaactaaaaagaatcaagcttaagtgaggggtgcatcctcttcagtcatagtgtggttttttgttttcatttgttatatttccctttccaaagattcttattattattatatcaattatggagatcttgccttttggttttaaaatatttaaggaaaacttgtttcattc

SEQ ID NO: 1590 - DNA, 728 bp, Arabidopsis lyrata
tcttcccaaatttcacaactcttctgcagccgattcttctattagccgccatggtgaagtactcgcaagaacccgacaaccagaccaagtcttgcaaggctagaggatccgatcttagggttcacttcaagaacactagggaaacagcgcacgccatccggaagctaccattgatcaaggcgaagaggtaccttgaggatgtgatagctcacaagcaagcaattcccttcacacgtttctgcagaggtgttgggcgaactgctcaagctaagaacaggcactctaatggtcaaggacgttggccagccaagtctgctcagtttgttcttgatttgctcaagaacgctgagagcaatgctgaggtgaaaggtttggatgttgatgccctgttcatatcacacatccaagtgaaccaggccgcaaagcaaaggagaaggacttaccgtgctcacggaagaatcaacccttacatgtccaacccatgccacattgagttgattttgtctgagaaggaagagcctgtcaagaaagagccggagactcagttggctgccaagtccaagaaatctgcagcttaagctttctttgttttatttttatgtctctttatgttcttgaatcagattttgttccctttttctttagttctaatcgttttgtaagaccatggatagatttttcttggagattttcgttcaatgttactgttatgaaatcattggtcatgg

SEQ ID NO: 1591 - DNA, 740 bp, Arabidopsis thaliana
tcttcacaaatctcacatctcttctgcagccgattcttctattagccgccatggtgaagtactcgcaagaacccgacaatcagaccaagtcttgcaaggctagaggatccgatcttagggttcacttcaagaacactagggaaacagcgcacgccatcaggaagctaccattgatcaaggcgaagaggtaccttgaggatgtgatagctcacaagcaagcaattcccttcacacgtttctgcagaggtgttgggagaactgctcaagctaagaacaggcactctaatggtcaaggacgttggccagccaagtctgctcagtttgttcttgatttgctcaagaacgctgagagcaatgctgaggtgaaaggtttggatgttgatgccctcttcatatcacacatccaagtgaaccaggccgcaaagcaaaggagaaggacttaccgtgctcacggaagaatcaacccttacatgtccaacccatgccacattgagttgattttgtcagagaaggaagagcctgtcaaaaaagagccggagactcagttggctgccaagtccaagaaatcagcagcttaagctttctttctttattttcatgtcccttgtgttcttgaacgagattttgttctcttttttctttagctcgaatcgttttgtaagacaatggatagatttatcttggaaattttcgttctatgacttatgaaatcagtgatcatggttctgcaagttttggtt

SEQ ID NO: 1592 - DNA, 811 bp, Arnica chamissonis
ctccgaagaacacagcattttcaccggcgacaccgtcagcaacagcagcagccatggtgaaatactctaaggaaccagaaaaccctaccaaatcttgcaaagccagggggtctgatctcaggtgccatttcaagaacactcgtgaaactgcccacgctatccgtaagttgcctttaactaaggctaagagatacttagaagatgttttggcccataagcaagccattccatttacccgtttttgtcgtggagttgggcgtactgcacaagcaaaaaaccgtcattccaatggtcaagggcgctggcctgccaagtctgcaaagtttatccttgatctgctaaaaaatgcggagagtaacgcagaagtcaaagggttggatgtggatgctcttcacatctctcacatccaggtgaaccaagcacagaaacagagacgtcgtacataccgtgctcatggaagaatcaacccatacatgtcatctccttgtcacattgagctcactttgtctgagaaagaagaacctgttaagaaggagcctgagactcagttggctcctagaaccaagaagaaccaggcttaagtcaggggtgcatcctcttgagtcacagcgtggtggtttttgtttgcatttgttatatttctattctcaaagattcttatcatatcagttgtccggtcgtgctttatggatctaaaatatttatggaacttgtttcagtcatggttgaatgtccaattgtgatttggttctctttctggttgattcatttcatgtctgattttgccatttaagctatagtatatgttagt

SEQ ID NO: 1593 - DNA, 833 bp, Centaurea maculosa
gggggtttgttggggtggccttcgaagaaacacagcaccggcgaagcaatcaatcaacagcagcagcagccatggttaagtattcgaaggagccagaaaaccctaccaaatcttgcaaagctaggggttcggatctcagatgtcatttcaagaacactcgagaaactgcccatgctatccgtaagttgcctttgattaaggctaaaagatacttggaggatgttttggctcataaacaagccattccattcacccgtttctgccgtggagttgggcgtactgcacaagccaagaaccgtcattccaatggacaagggcgttggcctgctaagtctgccaagtttatcttggacttgctaaagaatgcagagagcaacgcagaagtcaaggggttggatgtggatgcccttcacatctctcacatccaggtcaaccaagctcagaaacagagacgccgcacgtaccgtgctcatggaagaattaacccatacatgtcttccccatgccatattgaactcactttgtctgagaaagaagagcctgttaaaaaggagcctgagactcagttggctcctagaaccaagaagaatcaagcttaagtaagagatcctttggagtcatagtttgctggtagaaagagttgtggttttgttttgatttgtaatctcaaaaacttgtttccattttcaaagattcttcttatccaatatccttattatgagattatcatgcttcatcaagttaaaatattgaatgagactttttgtgtttcaaggctgatttcatgcctgattttgccatttgcagcagttatataacataattgtgtttgc

SEQ ID NO: 1594 - DNA, 775 bp, Centaurea maculosa
  misc_feature (46)..(46): n is a, c, g, or t
  misc_feature (50)..(50): n is a, c, g, or t
  misc_feature (66)..(66): n is a, c, g, or t
  misc_feature (78)..(78): n is a, c, g, or t
  misc_feature (159)..(159): n is a, c, g, or t
  misc_feature (174)..(174): n is a, c, g, or t
  misc_feature (195)..(195): n is a, c, g, or t
  misc_feature (285)..(285): n is a, c, g, or t
  misc_feature (414)..(414): n is a, c, g, or t
  misc_feature (426)..(426): n is a, c, g, or t
  misc_feature (432)..(432): n is a, c, g, or t
  misc_feature (435)..(435): n is a, c, g, or t
  misc_feature (492)..(492): n is a, c, g, or t
  misc_feature (632)..(632): n is a, c, g, or t
  misc_feature (697)..(697): n is a, c, g, or t
  misc_feature (737)..(737): n is a, c, g, or t
  misc_feature (764)..(764): n is a, c, g, or t
  misc_feature (769)..(769): n is a, c, g, or t
cttggcggggatcatttttcgtttggtcgcctccgaaacactcacnattntgcagcagtcgcaccngccaaaccaccnccagcagcgatggtgaagtattccaaggagccagagaaccctaccaaatcttgcaaagccagaggatctgatctcaggtgncatttcaagaacacnagagaaactgcacatgctatncgtaagttgcctttgatcaaggctaagaggtacttggaggatgttcttgttcacaaacaagcaattccgttcacacgtttctgtcgtggngttggacgtactgcacaggcgaagaatcgccattcaaatgggcaaggacgttggcctgctaaatctgcaaagttcattctggacttgctaaagaatgctgagagtaatgcggaagtcaaagggttggangtggatgctctncatatntcncacatccaggtgaaccaagcacagaaacagagacgtcgcacataccgtgctcatggnagaatcaatccttacatgtcttcgccgtgtcatatcgaactgactttgtccgagaaggaagaacctgtgaagaaagagcccgagactcagttggctcctagaaagaccaagaatcaagcgtaacttgcggatttggctgnctgtctcgttgtggttcgatgccagaacgggttgttttcatttttgtcatgcatttttatcttanatactcctaatgaatgttggtttttattacaagaacttgntacttgatagtgtaagttgagtgaatngtttngaaagt

SEQ ID NO: 1595 - DNA, 801 bp, Cichorium intybus
ggggatctttgttggggtggcctctgaagaaacgaacgttttcaccgtcgaagcaagcagccgcagcaatggtgaagtattcgaaggaaccagaaaaccccaccaaatcttgcaaggccaggggatccgatctcaggtgtcatttcaagaacactcgtgaaaccgcccatgctatccgcaagctacctctactcaaggccaagagatacttggaagatgttttggtccataagcaagctattcccttcacccgtttctgccgtggagttggacgtactgcacaagccaagaatcgtcattccaatggacaaggtcgttggcccgctaaatctgccaaattcatcctagaccttctaaaaaacgctgagagcaatgccgaagtcaaaggattagatgttgatgctcttcacatctcccacatccaagtcaaccaggcgcaaaaacagagacgtcgcacatacagggcccatggaagaatcaacccttacatgtcttctccctgtcacatagagctcactttgtcagagaaagaggagcctgttaaaaaggaggctgagactcagttggcaccaagaaccaagaagaatcaagcttaaggcgagttgagagttagaaaggattcagttttttgtttttgattttgttatctgaatattttgtgtttctctttacttaaagattgttgtcttatggttggttttgaggtgatctatcttcttaaattaaaacatttgatgtgtgtcaaaattgaactcctaagtttatgacagaaactagtctgaatagtttgctcacaaaaaa

SEQ ID NO: 1596 - DNA, 715 bp, Cirsium arvense
aaaccaccaccagcagcagcgatggtgaagtattccaaggagccagagaaccctaccaaatcttgcaaagccagaggatctgatctcaggtgtcatttcaagaacactagagaaactgcacatgctatccgtaagttgcctttgatcaaggctaagaggtacttggaggatgttcttgttcacaaacaagcaattccgttcacacgtttctgtcgtggagttggacgtactgcacaggcgaagaatcgccattcaaatgggcaaggacgttggcctgctaaatctgcaaagttcattctggacttgctaaagaatgctgagagtaatgcggaagtcaaagggttggatgtggatgctcttcatatctcccacatccaggtgaaccaagcacagaaacagagacgtcgcacataccgtgctcatggaagaatcaatccttacatgtcttcgccgtgtcatatcgaactgactttgtctgagaaggaagaacctgtgaagaaagagcccgagactcagttggctcctagaaagaccaagaatcaagcgtaacttgcggatttggctgcctgtctcgttgtggtttgatgaactgggttgttttcatttttgtcatgcattgtcatcttagatactcctaatggatgttggtttttgattacaagaacttgatacttgatagtgtaagttgaatgaatcgtttaaaagttgtctcagg

SEQ ID NO: 1597 - DNA, 694 bp, Cirsium arvense
ccgaaaacacacaagattctccagcagtctcaccggcgaaaccagcagcagcgatggtgaagtattccaaggagccggagaaccccaccaaatcttgcaaggccagaggatccgatctcaggtgccatttcaagaacactagagaaactgcacatgctattcgaaagttgcctttgatcaaggccaagagatacttggaggatgttcttgttcataaacaagcaattccatttacacgtttctgtcgtggagttggacgtactgcacaggcaaagaatcgccattcaaatgggcaaggacgttggcctgctaaatctgcaaagttcattttggacttgctaaagaatgctgagagtaatgcagaagtcaaagggttggatgtggatgctcttcatatctcccacatccaggtgaaccaagcacaaaagcagagacgtcgcacataccgtgctcatggaagaatcaatccttacatgtcttcaccctgccatatcgaactgactttgtccgagaaggaagaacccgtcaagaaagagcccgagactcagttggctccaagaaagaacaagaatcaagcttaaacttgcggattttgtggtttgatgacggaacgagttattttcatttttgccatgcaatttcatcttttagatactcgtaatgaatgttcgtttcgattacaagaacttcatag

SEQ ID NO: 1598 - DNA, 868 bp, Citrus sinensis
gcgtttctcaattggctgaaaaacgcaacgctgagaagagcagcagcagcagccatggtgaagtattcgaaagagccggacaatcccaccaagtcatgcaaagctagaggctctgatctccgtgttcacttcaagaacactagggaggcagcccatgctcttagaaagctgtctttgaccaaggctaaaaggtacttggaggatgttatggctcacaagcaagccataccattcacccgcttctgtcgcggtgttgggcgaactgcacaggctaaaaaccgtaatccaaatggtcaaggtcgctggccggttaaatctgcaaagttcattctggatttactcaagaatgctgagagtaatgcagaggtgaaaggcttagatgtggacgcgctttacatttctcacatccaagtgaatcaagcccagaagcagaggcgtcggacttatcgtgcacatggaaggattaacccatacatgtcttccccatgtcatattgagttgacactctcagaaaaggaggaacctgtgaagaaagagccggagacccagttggcttccaggaaaccgaggacagctacatagtggtgccttatcttgaatgttgggagtcctgagttgatttctcttttttccccctttgtactaccatgacaacatacaattttgtttacaagatacttgttcctgaagacttctgttggttcagtatttagttttattctgtcttgccatggctcgcttaccatgatagttctcagtggaattttgatggtggttatgttgaggttgactttgccgcaacaatgcttgtttggcctttctattgatttacttcatgttatattgggttcaaaaaaaaaaaaaaaaa

SEQ ID NO: 1599 - DNA, 1002 bp, Citrus clementina
accctagagtttccctcgtatgacataacccgcgtttctcaattggctgaaaaacgcaacgctgagaagagcagcagcagcagccatggtgaagtattcgaaagagccggacaatcccaccaagtcatgcaaagctagaggctctgatctccgtgttcacttcaagaacactagggaggcagcccatgctcttagaaagctgtctttgaccaaggctaaaaggtacttggaggatgttatggctcacaagcaagccataccattcacccgcttctgtcgcggtgttgggcgaactgcacaggctaaaaaccgtaatccaaatggtcaaggtcgctggccggttaaatctgcaaagttcattctggatttactcaagaatgctgagagtaatgcagaggtgaaaggcttagatgtggacgcgctttacatttctcacatccaagtgaatcaagcccagaagcagaggcgtcggacttatcgtgcacatggaaggattaacccatacatgtcttccccatgtcatattgagttgacactctcagaaaaggaggaacctgtgaagaaagagccggagacccagttggcttccaggaaaccgaggacagctacatagtggtgccttatcttgaatgttgggagtcctgacttgatttctcttttttccccctttgtactaccatgacaacatacaattttgtttacaagatacttgttcctgaagacttctgttggttcagtatttagttttattctgtcttgccatggctcgcttaccatgatagttctcagtggaattttgatggtggttatgttgaggttgactttgccgcaacaatgcttgtttggcctttctattgatttacttcatgttctattgtgttcttttagttgttccagctgtgttttcttccagctttagattgccgtgatctattctttatatgttgcatgccactgctgatggaatatcttagatgatctttaacgcccgtgcatacctct

SEQ ID NO: 1600 - DNA, 765 bp, Taraxacum officinale
ataactaacataagcgtgcactcaccagctgcgccggaaacactcaaacagaagcaccgtatccgtcaccgtaggaagcagccatggttaagtactcaaaagagcctgataatcccaccaaatcctgcaaggccaggggttctgatctcagatgtcacttcaagaatacccgggaaaccgcacatgctctcaggaagatgccattaatcaaggcgaagagctatttagaagatgttcttgtccacaaacaggcaattcccttcaccagattttgtaggggtgttgggcgtacagctcaagcaaaaaacagacattccaatggtcaagggcgatggcccgccaagtcagcaaagttcatcttggatttgcttaaaaatgctgaaagcaatgctgaggtgaaagggttggatgtggatgcccttttcatttctcacattcaagtgaaccaagctcaaaaacaaaggagacgaacgtaccgtgcccatggaagaattaatccctatatgtcatccccttgccatattgagttgactctatccgagaaggaagaacctgtgaaaaaggaggctgaatctcaattggcaacaagtggcaaatcgaagaaaccttaggttattgatttgcacagttttgtgtcgattgagtgttttggtttgtttaagacggaaattgttctacatattttgattttggatatttttgatggtagaaattgaaatcttgattaagcttcctactgctttttatctggtgttgcatcactga

SEQ ID NO: 1601 - DNA, 773 bp, Taraxacum officinale
tcttctggggtggcctccgaagaacacacaagtttttcaccggcgaagcaagcagcagcaacaatggtgaagtattcgaaggaaccagaaaaccccaccaaatcttgcaaagccaggggatcggatctcaggtgtcatttcaagaacactcgtgaaaccgcccatgctctccgtaagatgtctttaatcaaggccaagagatacttagaagatgttttggtccacaagcaagccattccattcactcgattttgccgtggagttgggcgtactgcacaagccaagaaccgtcattccaatggacaagggcgttggcctgcaaagtctgcaaagttcatcctcgatctgctcaaaaacgcagagagtaatgcagaagtcaaagggttggatgtggatgctcttcacatctctcacatccaggtgaaccaagcccagaaacagagacgccgcacataccgtgcccatggaagaatcaacccttacatgtcttctccttgccatattgaattgactttgtctgagaaagaggagcctgttaaaaaggagcctgagagtcagttggcacctagatccaagaagaaccaagcttaagtgaagttgagttgagtgggtagaaaagattcagtttttgttttgattttgttatctgaaaactccagtgtttgtgttttttaagatttttatcttatgttctattatgaagagatcgtgctttatgaagttaaaacatttttgttgagtttccaacatctttttgtgttgcaaactaaaat

SEQ ID NO: 1602 - DNA, 744 bp, Guizotia abyssinica
accctggaattcggcccttacggccgggggattccttgttggggtggcctccgaagaacacagcattttcaccggcgacgccatcagcaacagccatggtgaagtactcgaaggaaccagaaaaccctaccaaatcttgcaaggccaggggatccgatctcaggtgtcatttcaagaacactcgtgagactgcccatgctatccgtaagttgcctttaataaaggcaaagaggtacttggaagatgttttggcgcacaagcaagccattccttttacccgtttttgtcgtggagttgggcgtacagcacaggcaaagaaccgtcattctaatggtcaaggtcgctggcctgctaagtctgcaaaatttatccttgatctgctaaaaaatgccgagagtaacgcagaagtcaaagggttggatgttgatgctcttcacatctctcacatccaggtgaaccaagcacagaaacagaggcgtcgtacataccgtgctcatggaagaatcaatccttacatgtcttcaccttgtcacattgagctcactttgtctgagaaagaagaacctgttaaaaaggagcctgagactcagttggctccgagaaccaagaagaaccaatcttaagtcacatcctcttcagtcatagcgtggtcgtttttgtgtttgtttgttatatttctattttgaaaagattcttatcatatcaattatggtgatcatgcttgatggatctaaaatatttaac

SEQ ID NO: 1603 - DNA, 1005 bp, Citrus sinensis
accctagagtttccctcgtatgacataacccgcgtttctcaattggctgaaaaacgcaacgctgagaagagcagcagcagcagcagccatggtgaagtattcgaaagagccggacaatcccaccaagtcatgcaaagctagaggctctgatctccgtgttcacttcaagaacactagggaggcagcccatgctcttagaaagctgtctttgaccaaggctaaaaggtacttggaggatgttatggctcacaagcaagccataccattcacccgcttctgtcgcggtgttgggcgaactgcacaggctaaaaaccgtaatccaaatggtcaaggtcgctggccggttaaatctgcaaagttcattctggatttactcaagaatgctgagagtaatgcagaggtgaaaggcttagatgtggacgcgctttacatttctcacatccaagtgaatcaagcccagaagcagaggcgtcggacttatcgtgcacatggaaggattaacccatacatgtcttccccatgtcatattgagttgacactctcagaaaaggaggaacctgtgaagaaagagccggagacccagttggcttccaggaaaccgaggacagctacatagtggtgccttatcttgaatgttgggagtcctgagttgatttctcttttttccccctttgtactaccatgacaacatacaattttgtttacaagatacttgttcctgaagacttctgttggttcagtatttagttttattctgtcttgccatggctcgcttaccatgatagttctcagtggaattttgatggtggttatgttgaggttgactttgccgcaacaatgcttgtttggcctttctattgatttacttcatgttctattgtgttcttttagttgttccagctgtgttttcttccagctttagattgccgtgatctattctttatatgttgcatgccactgctgatggaatatcttagatgatctttaacgcccgtgcatacctct

SEQ ID NO: 1604 - DNA, 824 bp, Solanum tuberosum
aagcagacatcttctatcagcagctgcaggggaacagcagcatcaccggcagccatggtgaagtattcgaatgaaccagagaacccaaccaaatcttgcaaagctaggggttcggatctcagagctcatttcaagaatactagagaaacagcgcatgcccttaggaagatgcctttgaacaaggcaaagagctacttggaggatgttcttgcccacaaacaagccatccccttcacccgcttttgtcgtggggttggtcgcactgctcaggcaaagaatcgccactcaaatggacaaggacgttggcctgtcaaatctgcgaagtttattctggatttgctaaaaaatgctgagagtaatgctgaagttaaaggcttggatgtggattcactttacattactcacatccaagtaaaccaagcacagaaacagaggcgccgtacataccgtgctcatggaagaatcaatccttatatgtcacatccgtgccatatcgagctggtattgtctgaaaaggaagaatctgttaagaaagagcctgagactcaattggctcccaggaagacgaaggcatcttcttgaggggaggaatgaatccctaaattttggaagtataatttcaatacttatagccttggtatcagaagaatttagtgctatttcaaacatttcttcataggaatttgtgttattgtgtaattttactatttcggagcttaaattgggttttgtgctttttgaagcatgtttacgaggaaattttggatttctatgttgcttttttttttttaccccgaaggttgaattaggatgtttatggtaaa

SEQ ID NO: 1605 - DNA, 874 bp, Carthamus tinctorius
  misc_feature (790)..(790): n is a, c, g, or t
ggcgggggtatccattcttactttggtcgcctccgaaaacacaaaccattctgcagcagtcgcaccggcgaaaccaccaccaccaccagcagcagcagcagcgatggtgaagtattccaaggagccagagaaccctaccaaatcttgcaaagccagaggatcagatctcaggtgccatttcaagaacactagagaaactgcacatgctattcgtaagttgcctttaatcaaggctaagaggtacttggaggatgttcttgttcataaacaagcaattccattcacacgtttctgccgtggagttggacgtactgcacaggcgaagaatcgccattcaaatgggcaaggacgttggcctgctaaatctgcaaagttcattctggacttgctaaagaatgctgagagtaatgcggaagtcaaagggttggatgtggatgctcttcatatctcccacatccaggtgaaccaagcacagaaacagagacgtcgcacgtaccgtgctcatggaagaatcaatccttacatgtcttcgccgtgtcatatcgaactgactttgtccgagaaggaagaacctgtgaagaaagagcccgagactcagttggctcctagaaagaccaagaatcaagcgtaacttgcggattttgttgcccatctcgttgtggttcaatgccgggacgggttgttttcatttttgtcatgcattttcatcttagatactcgtaatgaatgttggttttgattacaagaacttgatagtgtaagttgagtgaatcgtttaaagttgtctcangaattttatgtttttaatgattttgttacaactattatgaagttatgcaggtttgatgcactcagtttattttgtcgaaaaaaa

SEQ ID NO: 1606 - DNA, 768 bp, Carthamus tinctorius
  misc_feature (28)..(28): n is a, c, g, or t
cggggttgttggggtggcctccgaaganacacagcaccggcgaagcaatcaatcagcagcagcagccatggtgaagtattcgaaggaaccagaaaaccccaccaaatcctgcaaagccaggggatccgatctcaggtgtcatttcaagaatactcgagaaactgcccatgctatccgcaagttgcctttaatcaaggctaaaagatacttggaggatgttttggctcataaacaggccattccattcactcgtttctgccgtggagttgggcgtaccgcacaagcaaagaaccgtcattccaatggacaagggcgctggcctgctaaatctgccaagtttatcttggacttgctaaagaatgcagagagcaacgcagaagtcaaagggttggatgtggatgctcttcacatctctcacattcaggttaaccaagctcagaaacagagacgtcgcacataccgtgctcatggaagaattaacccctacatgtcctctccatgccatattgaactcactttgtctgagaaagaagagcctgttaaaaaggagcctgagactcagttggctcctagaaccaagaagaatcaagcttaagtaagagatccttggagtcatagtttgctggtagaaagagttgtggttttgttttgattttgtaatctcaaaaacttgtttccattttcaaagattcttcttatccaatgccctattatgagattatcatgctccatcaagttaaaatattgaatgagacttttttttgtttc

SEQ ID NO: 1607 - DNA, 828 bp, Solanum phureja
aaaccctagcacccaagcagacaccttctatcagcagctgcaggggaacagcagcatcaccggcagccatggtgaagtattcgaatgaaccagagaacccaaccaaatcttgcaaagctaggggttcggatctcagagctcatttcaagaatactagagaaacagcgcatgcccttaggaagatgcctttgaacaaggcaaagagctacttggaggatgttcttgcccacaaacaagccatccccttcacccgcttttgtcgtggggttggtcgcactgctcaggcaaagaatcgccactcaaatgggcaaggacgttggcctgtcaaatctgcaaagtttattctggatttgctaaaaaatgctgagagtaatgctgaagttaaaggcttggatgtggattcactttacattactcacatccaagtaaaccaagcacagaaacagaggcgccgtacataccgtgctcatggaagaatcaatccttatatgtcgcatccttgccatatcgagctggtattgtctgaaaaggaagaatctgttaagaaagagcctgagactcaattggctcccaggaagacaaaggcatcttcttgaggggaggaatgaatccctaaattttggaagtataatttcaatacttatagccttggtatcagaagaatttagtgctatttcaaacatttcttcataggaatttgtgttggtgtaattttattatttcggagcttaaattggattttgtgctttttgaagcatgtttacgaggaaattttggatttctatgttgcttttttttttcgaaggttgaattaggatgtttatggta

SEQ ID NO: 1608 - DNA, 793 bp, Helianthus annuus
agattcgttgttggggtggcctccgaagaacacacgccattttcacgcagcagcaatggtgaagtactcgaaggaaccagaaaaccctaccaaatcttgcaaagccagaggatctgatctcaggtgccattttaagaatacccgtgaaacggcccatgctatccgtaagttgcctttaatcaaagctaagagatacttggaagatgttttggctcataagcaagccattccatttacccgtttttgtcgcggagttgggcgtactgcacaggcgaaaaaccgtcattctaatggtcaagggcgttggcctgcaaagtctgcgaagtttatccttgatttgctcaaaaatgctgagagtaacgcagaggtcaaagggttggatgtggacgcccttcacatctctcacatccaggtgaaccaagcccagaaacagagacgtcgtacataccgtgcacatggaagaattaatccttacatgtcatctccttgtcacattgagctcactttgtctgagaaagaagaacctgttaaaaaggagcctgagactcaattggcccctagaaccaaaaagaatcaagcttaagtgaggggtgcatcctcttcagtcatagtgtggttttttgttttcatttgttatatttccctttccaaagattcttatatatcaattatggagatcttgctttttggttttaaaatattcagggaaaacttgttttcattatgggtggaaatatcaattgtggagttggtttccggcagaaagagaaggaggaaaaaagactttgttggg

SEQ ID NO: 1609 - DNA, 729 bp, Helianthus annuus
ggggcagcctccgaagatccaacagcattttcaccggcggcacgatcatcctcagcagtcatggtgaaatactccaaggaaccagaaaaccccaccaaatcttgcaaagctaggggatcagatctcaggtgtcactttaagaacacccgagaaactgcccatgctatccgtaagttgcctttgatcaaggctaagagatacttggaagatgtcttggctcacaagcaagctattccattcacccggttttgccgtggtgttggccgtaccgcacaagccaaaaaccgtcactccaatggacaaggacgttggcccgctaagtctgcaaagttcatccttgatctgctgaaaaatgccgagagtaatgctgaggtcaaagggttggatgtggatgctcttcacatttctcacattcaggtgaaccaagcacagaaacaaagacgtcgcacataccgtgctcacggaagaattaacccttacatgtcttcaccttgtcacattgaactcactttgtctgagaaagaagaaccagttaaaaaggagcctgagacacagttggctcctagaaccaagaagaaccaagcttaagtcaggagtgcattttcatgggtgaggctcatagtttgttggtagaaggaaatctgtttttgttttcacttattatatcagaaccatgtgtttttgtttccaaagattcttatcctcctattttcaattatgaggtacttg

SEQ ID NO: 1610 - DNA, 751 bp, Thellungiella halophila
  misc_feature (2)..(2): n is a, c, g, or t
gntcgcttctgcagccaattcttgtctttagccgccatggtgaagtattcgcaagaacccgacaatcagaccaagtcttgcaaggctagaggatccgatcttagggttcacttcaagaacacccgtgaaacagcgcacgccatcaggaagctaccattgatcaaggcgaagaggtaccttgaagatgtgatagctcacaagcaagcaattcccttcactcgtttctgtagaggtgtaggaagaactgctcaagctaagaacaggcactctaatggtcaaggacgttggcctgcaaaatctgctcagttcgttcttgatttgctcaagaatgctgagagcaatgctgaggtgaaaggtttagatgttgatgccctcttcatatcacacatccaagtgaaccaggctgcgaaacaaaggagaaggacttaccgtgctcacggaagaatcaacccttacatgtccaacccttgccacattgagttgattttgtcagagaaagaagagcctgttaagaaagagccggagacccagttggcagccaagtcaaagaaatcagcagcttaagttttctttaatttttcatctctctttttgtgttcttggaagagattttgctcccctttctttcgatctttgcaagacaatggatagattttcttggattattgttcaatgttgctgtcatgaaatcattcgccatggttggtagtatttattcttgcttaataattctgctaatttatatctaaaa

SEQ ID NO: 1611 - DNA, 940 bp, Nicotiana tabacum
ggccattacggccggggaacgaagaagcgacctctaccagccgcagcaggagaaggggagtagcagcagcatcgccagcagccatggtgaagtattcgagggaacccgacaaccctaccaagtcctgcaaagctaggggcgctagtctcagagttcactttaagaacacacgagagacagcccatgcacttaggaaaatgcctttggacaaggccaagagatatctggaagatgttcttgcacacaaacaagccattcctttcacacgcttttgtggtggggttggtcgtactgctcaggtaaagcatcgccattcaaatggtcaaggacgctggccagtcaaatctgcaaagattattctggatttactcaaaaatgctgagagtaatgctgaggttaaaggcttggatgtggattcacttttcatatctcacatccaagtgaaccaagcacaaaaacagaggcgccgcacgtaccgagctcatggaagaataaacccctacatgtctcacccctgccatgttgagctgacattatctgaaaaggaagaatctgtcaagaaggagcctgagacacagttggctcctagaaaggcgaaggcatcctcttaatccggcagtgactccaggaatgcagatggtggaatgttttccgtgtccttgtagtctgtgttatgaaaaacaattttggcattttgaaccatgtttgtctttctccagaaatttgtggtactgtttagcatatccttactattttgaaacttgaattgaatatttaccttgttggtttattagtggccgagacctttaaattttgccttggttgatcacaaagtcttcctgtgaacttgcaattgcatggatataattacaggtagttttgacgccattgttgtttcatgggtcaaagctaaagaataattgataattccccgtgcttt

SEQ ID NO: 1612 - DNA, 955 bp, Solanum lycopersicum
aaaccctaacacccaagcagacaccttctatcagcagctgcaggggaacagcagcatcaccggcagccatggtgaagtattcgaatgaaccagagaacccaaccaaatcttgcaaagctaggggttcggatctcagagctcatttcaagaatactagagaaacagcgcatgcccttaggaagatgcctttgaacaaggcaaagagctacttggaggatgttcttgcccataaacaagccatccccttcacccgcttttgtcgcggggttggtcgtactgctcaggcaaagaatcgccactcaaatggacaaggacgttggcctgtcaaatctgcaaagtttattctggatttgctcaaaaatgctgagagtaatgctgaagttaaaggcttggatgtggattcactttacatcactcacatccaagtaaaccaagcacagaaacagaggcgccgtacataccgtgctcatggaagaatcaatccttatatgtctcatccgtgccatatcgagttggtattgtctgaaaaggaagaatctgttaagaaagagcctgagactcaattggctcccaggaagacgaaggcatcttcttgatggaaggaatgaattcctaaattttgaaagtataatttcaatacctatagccttggtatcagaagaatttagtgctatttcaaacatttctttataggaatttgtgttattgtgtaatttttactacttcagagcttaaattgggttgtgctttttgaagcatgtttatgaggaaatttttggatttctatgttctggctttttcgaagagtatgtttatagtattctgattctgaaagctggactttttactcaactggttatgatgatgctgacttgattgatcatttagaggatcaaataagtgtgttttagaaggttctttacgcaaacatcagtaatacacaagataagactag

SEQ ID NO: 1613 - DNA, 714 bp, Tragopogon dubius
aagattctctgttggggtggcctccgaagaacacacaaattttcaccggcggaagcaaagcagcagcagcagcgatggtgaagtactcgaaggaaccagaaaaccccaccaaatcttgcaaagccaggggatcagatctcaggtgccatttcaagaacacccgtgaaactgcccatgctatccgtaagctccctttattgaaggccaagagatacttggaggatgttcttgcccacaagcaagccattcctttcacccgtttttgccgtggtgttggacgtaccgcacaagcaaagaaccgccattccaatggacaagggcgttggcctgcaaaatctgcaaagttcatcctcgatcttttgaagaacgctgagagcaatgcagaagtcaaaggtttggatgtggatgttcttcacatctctcacattcaggtgaaccaagcccagaaacagagacgccgtacttaccgtgctcatggaagaatcaacccttacatgtcttctccttgccatattgaattgacattgtctgagaaggaagagcctgttaaaaaggagcctgaaactcagttggcaccaagaactaagaagaatcaagcttaagtgaagtggtagaaagaaatctggttttgtttttgattcggtatctgaaattgtgtttttgattttaaagattgttatgttatgtttaatttatgaaattaaaacattggat

SEQ ID NO: 1614 - DNA, 898 bp, Lactuca sativa
ataggcccgatccgaatccatagcaagtaaacccccggcccctgtattggtaacaaaaacacaaaccctagattctccgttagaccattagctgctgtggcctctgcaaactcactctcaatcctgcagcagtcgcaccggcaaaacaatcagcagccatggtgaagtattccaaggagccagataaccctaccaaatcttgcaaagccagaggatcggatctcaggtgtcatttcaagaacacaagagaaactgcacatgctattcgcaagatgcctttaatcaaggctaaaagatacctggaggatgttttggttcataaacaagccattccattcacacgtttttgtcgtggagttggaagaactgcacaggcaaagaatcgtcattccaatggacaaggacgttggcctgctaagtctgcaaagttcattctggatttgctaaagaatgctgagagtaatgcagaagtcaaagggttggatgtagatgctcttcatatttcccacattcaggtgaatcaagctcagaaacagaggcgtcgcacatatcgtgctcatggaagaatcaatccttacatgtcttccccatgtcacattgagctgaccttatcagaaaaggaagaacctgtgaagaaagagcctgagactcagctagcttctagaaagaccaagaatcaagcctaacttatagttttgtttgatcgatttaccagaatgagtttttgaattttgttttgttagtgcgatttcaaattgtattagatacatgtattgagtttggttacaagaacttgatagttgagtgaagctgaattatatgtgatgtttattaattattatggctgtgatccatttgccatcaaatttcttacatcttgactgtcttcattcttttt

SEQ ID NO: 1615 - DNA, 1093 bp, Lactuca sativa
gccacggcccaaccaaaatcaggaagacgaactcgttatagttagaaaccctagaccctccattagattctttctcggggtggccttcgcagaacacactaaatttttatcggcgacgccagcagcagcagcagcaatggtgaagtactcgaaggaaccagaaaaccccaccaaatcttgcaaggccaggggatctgatctcaggtgccatttcaagaacactcgtgaaacagcacatgctatccgaaagatgcctttattgaaggcgaagagatacttggaagatgttttggtccataaacaagccattccatttactcgtttttgccgtggagttggaagaactgcacaagccaagaatcgtcattccaatggacaaggacgttggcctgctaaatctgcaaagttcattctcgatcttctaaagaacgctgagagtaatgcagaggtgaaaggattggatgtcgatgctcttcacatctcccatatccaggtcaaccaagcccaaaaacagaggcgtcggacataccgtgctcatggaagaatcaatccttacatgtcttctccttgccatattgaattgaccttgtctgaaaaagaggagcctgttaaaaaggagcctgagactcagttggcaccaagaaccaagaagaaccaagcttaagtgaagttgagtggtagaaaggattcagtttttgttatctgaaaactctgtttctgtttttaaaagatttgttttatgtttctattattatgaggtgatgttttttgctttatgaaattaaaacattttggttgagtgtttatgattctttttgtggctgtttgagctcaaagctgcaaaacccctcatcactcttttgtgtaaacaacacattataacgacatatctgtgtttgtgacatttcccagcactcaattgcagcatccttgtgatgttagagaactcttgtcatgtgctttttttggtactatgaagaattttgaagcgcttgcaaacttcatagagaataatcatctcatttttgagtatttgcaattttctatcattgaacctgcaacttaatatctgactatcacatgtgagtcgcct

SEQ ID NO: 1616 - DNA, 804 bp, Cucumis sativus
ttcacggccaaatccaactttgtttcttcacaaccccaagttgcagccgtcgccatggtgaagtattccagggaaccagacaatcccaccaagtcctgcaaagcccgtggctcggacctcagagtccactttaagaacacaagggagactgcacatgccattagaaagttgccactggccaaggccaagaggtacctagaggatgtacttgcccacaaacaagccattcctttccgtcgcttctgtggtggtgttggacgaactgctcaggcaaagaacaggcactccaatggccaaggacgctggcccgtcaaatctgccaagttcattcttgatttgcttaagaatgctgagagcaatgctgaagtgaagggtctcgatgttgatttgctccacgtatctcacgtccaggtaaaccaagctcagaaacaaaggcgtcgtacctaccgtgctcatggaagaatcaacccttacatgtcttctccttgccatattgagctgattttgtctgaaaaggaagaacctgtgaagaaggagcccgagactcagctggcgactggcaaacctaagaaaggtcaagctatccgtagcggcgcttcctcttgaatggcctaagtagaaattctgttgtgggtttttgctgtgccatttctttttctttttgaagtgagtttaattattgatcagatcactatatagaacgagggattattatttagatgttttgtgtgacaatgttatatttggaacctttcgtagttcaattttcttcaagtttaaatcacattctcgtacttttgcgtt

SEQ ID NO: 1617 - DNA, 822 bp, Cucurbita pepo
tccaacttttcttcagaaccccaagttgcagccgtcgccatggtgaagtattcgagggaaccagacaatcccaccaagtcctgcaaggcccgtggctcggacctcagagtccactttaagaacacaagggaaactgcacatgctatcagaaagttgccattggccaaggccaagaggtatcttgaggatgtacttgcccacaagcaggccattccattccgtcgcttctgtggtggtgttggaagaaccgctcaggcgaagaataggcattccaatggccaaggtcgctggcctgtcaaatctgccaagtttattctagatttgcttaagaatgctgagagcaatgctgaagttaagggtcttgatgttgatttgctccacgtatctcacgtccaggtaaaccaagctcagaagcaaaggcgtcgcacctaccgtgctcatggaagaatcaatccttacatgtcttctccttgccatattgagctgattttatctgaaaaagaagagcctgttaagaaggagcccgagactcagctggcgactggcaaacctaagaaaggtcaagcaatccgtagtggcgcttcctcttgattggtataagtataaactctgttgtgggttttgctatgccatttctttttgaagtgagttttaattattggtcattatatagatctaaggattattatttagatgttttgtgtgacatggtttatgtggaacctttctagcttcaattttcttcacgttgcaatcacattcgggtacttgcttttatttcttgatgagatctcttgacgccttatttccttctgctaacta

SEQ ID NO: 1618 - DNA, 853 bp, Momordica charantia
gagtttctctcctgctgctctcgaagaaatagaaactctgttagacgccgaagttcagccgtcgccatggtgaagtattcgagggagcctgacaatccgaccaagtcctgcaaagccagaggctcggaccttagagttcactttaagaacactagggaaactgcccatgctatcaggaagttgccactggccaaggccaagaggtatctagaggatgtacttgcccacaaacaggccattcctttccgtcgcttctgtggtggtgttggacgaactgctcaggcaaagaataggcattcaaatggccaaggacgctggcccgtcaagtctgcaaagtttattcttgatctgcttaagaatgctgagagcaatgctgaagtaaagggtttggacgttgatttgctccatgtatctcacgtccaggtaaaccaagctcagaaacaaaggcgtcggacctaccgtgctcacggacgaatcaacccttacatgtcttccccttgccatattgaactgattttgtcagaaaaagaagagcctgtcaagaaggagcccgagactcaactggcgactggcaaacccaagaaaggtcaagctatccgtagtggtgcttcctcttgaatggcagaagtataaattttgttgtgggttttgctgtgaccatttcttttttgaagtgagttttattattgaacactatatagaacggagtattgttatttagatgttttctgtgacattgttttatttggaaccttttctagttcaattttcttcaagtaagttgcaatcaatcacattctggtatttgctgcttttctcttggtcttccacaagaataaaattaaatcgaact

SEQ ID NO: 1619 - DNA, 993 bp, Coffea canephora
attcccttccgtttctgccacccgccgctgaagctgaaaagatggtgaagtactcaagggagcccgataaccctaccaagtcctgcaaagccaggggatctgatctccgtgttcatttcaagaacacaagggaaacagcgcatgccatcaggaagctgcctttagcgaaggctaagaggtacttggaggatgttttggcccataagcaggcgattccgtttacacgtttctgtggaggtgttgggcgtactgctcaggccaagaataggcattcaaatggacagggtcgctggcctgttaaatctgctagcttcattttggatttgctcaagaatgctgaaagcaatgcagaggtgaaaggcttggatgtggattcacttttcatttctcacattcaagtgaatcaagcacagaaacaaagacgccgcacatatcgtgcccatggaagaataaacccctacatgtcttccccctgccatattgagttgattttgtccgagaaggaagagtctgtcaaaaaggagcctgaatcacagttggccaccagcaaatctaggaaggcttgagctatatgtaatggtgctttcattggcaatggctttaggggattctacaaattttgaggcatattgttacttaatgctattggaggttgcaagacaagttttgctagtgtttaaattcaaagagttcattcaaacacatactttgacttgtagagacagctttttgttcttcatgattgtcgtctggctttgtttgggttggatgttatggtagtgttggactatttatcaaggtgcacttactggctgtctctattatgctgtcacacccctaggacatggcaatttggtaggtgctggaagaacttttgcaaggatgattgagtgatcgaattgctacagcaagtacttaatacagtgtaagtagttatagcccagcatggctgttataggagtgtagcttaaaatttaattgcctggtttcacg

SEQ ID NO: 1620 - DNA, 866 bp, Coffea canephora
cggccggggggggccgacgtagccttagaaaatgtgcagcagaacaccacgagactcctgctgaaaatccctagctgcactaggccacttcttcttctgctgaaaaaccctagcaggagcatattcccatccgtttcccccacgctgaaaagatggtgaagtactcaagggagcccgataaccctaccaagtcctgcaaagctaggggatctgatctccgtgttcatttcaagaacacaagggaaacagcgcacgcgatcaggaagctgcctttagccaaggctaagaggtacttggaggatgttttggcccataaacaggcaattccttttacacgtttctgtggaggtgttggccgtactgctcaggccaagaataggcattcaaatggacagggtcgctggcctgttaaatctgctggattcattttggatttgctcaagaatgctgaaagcaatgcagaggtgaaaggcttggatgtggattcacttttcatttctcacattcaggtgaatcaagcacaaaaacaaagacgccgcacatatcgtgcccatggaagaataaacccctacatgtcttccccctgccatattgagttgattttgtctgagaaggaagagtctgtgaaaaaggagcctgaatcgcagttggccacaagtaaatctaggaaggcttaagctttatgtaatggtgctttcattggcaatgcttttagccgattctacaaattttgaggcatattgttacttaatgctattggaagttgcagacaagttttgctagtgcttaaattcaaaaagttcattcaaagacatactttgacttgtagagacagctttttgttcttcttaaatgtcgtgtggctt

SEQ ID NO: 1621 - DNA, 688 bp, Olea europaea
taagaactggcgctacatttcatttacagaactcgagagaaaaaccctagaccacaattcccagtgaagtcagccgcagaagcagctacaatggtgaagtattcgagagagcccgataatgccaccaaatcctgcaaagccaggggatctgatctccgagttcatttcaagaataccagggagactgctcatgccatcagaaagcttcccttaacaaaagccaaaaggtacttggaggacgtcttggcccacaagcaagccatccctttcactcgcttttgtggaggtgttgggcgaactgctcaggcaaagaacagacattctaatggacagggacgttggcctgttaaatctgctactttcatcctggatttattgaagaatgccgaaagtaatgctgaggttaaaggcttggatgtggatgcactctacatttctcacattcaggtgaaccaggctcggaagcaaagacgtcgcacataccgagctcatggaagaataaacccttatatgtcatctccttgccatattgaattgatcttatctgaaaaagaagagcccgtgaaaaaggagcctgagtcacagttggcaactagcaagtccaagaaggcttgagattgaccttgagatacttgagtttaatggactatcatacagtgtttaagcttgttttgaagcctagtacttt

SEQ ID NO: 1622 - DNA, 830 bp, Linum usitatissimum
ggcagctagccagcagaaactatctcccctccagtcgccgccatggtgaagtactcgagagagcccgagaacccgaccaagtcttgcaaagctaggggctctgatctcagagttcatttcaagaacacaagggagacagcgttctccatcaggaagatgactttggtgcgtgccaagagttatcttgaagatgtcatagcccacaagcaggctattcccttcaggaggttctgtcgtggtgttggcagaaccgcacaggcaaagaatgctggtcacccgaatggacaggctcgttggcctgcaaagtctgctaagttcgtccttgatttattgaaaaatgctgagagtaacgctgaggtgaaagggttggacgtcgatgctctccacatttcccacgtccaggttaaccaggctcggaagcaaaggcgtcgtacttaccgtgcacatggacgaatcaacccttacatgtcgaatccttgccacatcgagctgatcctttccgagaaagaggagcctgtcaagaaagagccggagtctcaactggctactagcggcaggtcgaggaagaaccaagctttgcgaagtggtgcatcctcttaggctgtttctgctttgaacacagttttgttttggattgtttccatgtagtcttgctagagggaagctatttagaggaatcgttcttaatgttatactacaatttaatggacctttgtttcagtttttactgttctatctgaattttgctcgagtgaagatctaggtgttgtttcatgatctttgacctccgattccggcagggatttccaaatccatagaatttcaattca

SEQ ID NO: 1623 - DNA, 881 bp, Linum usitatissimum
cggggaccagagcgaattctaagcagctgccgccagccacactaccgctccgggaaacagctgccgccatggtgaagtactcgcaagagccggtgaaccctaccaagtcatgcaaggctaggggctctgatctcagagtacatttcaagaacactagggaaacagcgttctccatcaggaagatggctttggtcaaggccaaggcatacctggaggatgtccttgctcacaagcaggccattcctttcaggagattctgccgtggagtcggtagaactgctcaggctaagaacgctgggcaccccaatggtcaggctcgctggcccgcaaagtctgccaagttcatccttgacctgttgaagaatgctgagagcaatgctgaggttaaaggtctggatgtcgatgccctcttcatctcccatatccaggttaaccaagctcagaagcaaaggcgtcgtacttaccgtgcccacggaaggatcaacccttacatgtccaacccttgccccattgagttgaccctatctgagaaggaagaacccgtcaagaaggagcccgagacccagcttgccgcctctagcaaatccaggaagggtcaagctttgagaagcggagcatcttcttagagaccggttcctaccattgtggtgtttcgaattttctgagagatctgttttgtgctcgctcttatattttaaaatttgcgataaggctacttagaggaaaggtttgaacttaatgatgttatctttctggactaatgttccttttgttatcagaatcagaattttgcttggttatgttttcttattgtcaacgtgatctcctccatcgttaggtgtttgtgatcgtgctgatttatacatgtcatgttagtgttg

SEQ ID NO: 1624 - DNA, 937 bp, Populus trichocarpa
gcaggaattagggtttctttcacttagaaaccctatataaaccgcactcagcatcctctccgcctctcctctgctagagccaccaaatcaacgtatctccagcttcgacaaggcagacggtgcagccaccatggtgaagtactctagagagcctgataaccccaccaaatcttgcaaggcaaggggctctgacctcagagttcacttcaagaatacaagagagacagcttttgctctaaggaagttgcctctggtcaaggccaagaggtatttggaagatgttatggctcacaaacaggccattccattccgacgtttctgtggtggagttgggcgtactgcacaagcaaagaacaggcactctaatggacaaggacgatggcctgccaagtctgctaagttcatcttggatttactcaagaatgccgagagcaatgctgaggtcaagggtttggatgtggatgcactctacattactcacatccaggtgaatcaggcacagaagcagagacgtcgtacttatcgggcgcatggaagaattaatccttacatgtccagcccttgccacattgagttgactttatctgaaaaggaagagccagttaagaaagagcctgagacccagctagcaaccagcaagtcaaagaagtctcaagcctcctcttgagtggcgatcttagttcagtgtggatccccttttgatttctgtgtttttttcttaagaaggattttgttgcgtatcttatagaatgatcagatttttagatgtattggacgtcttgtatgttgatttcgaattatgtttagttctttgttctatgagaaatgtcttggcgagtttatttgaagtctattttcatcacagtttttatcgtaaattgacaaatagtccttgataatggtaatgatcggccgtttgtgaaccaccgtgtagttt

SEQ ID NO: 1625 - DNA, 1209 bp, Amborella trichopoda
ctaggtttactcagccactcacccacccacccaccctctcttcgccgcccagcaaaacagcagctccactgcgaaagttctctcgctctctcttcccagtaaaggcagcctctcgcccagtactattcgcggccttgcaagctcaacagttatcaaacaggcccttagtgttttctacttttgtcgttgcgattaaagagagagaattttagggtttttggattcacaaagattcacagctttaaggcgctcataacccttggcctctgcgagcaactagagacctttatttcgatcagcagccatggtgaagtattccaaggagccggacaatccaactaaatcttgcaaggccaaaggatctgacctgagggttcacttcaagaacaccagggaaaccgcatttgctatcaggaagctcccgttggtcaaggctaagaggtatctagaggacgttcttgcccacaagcaggccatccctttccggcgcttttgtggaggtgttgggcgcactgctcaagcaaagaaccgccatccaaatggacaagggcggtggcctgtcaagtctgccaagttcatcttgaacttgctcaagagtgctgagagtaatgctgatgtgaaaggcttggatgtggatacactattcctttcgcatatccaggtgaatcaagcccagaagcaaaggcgacgaacttaccgtgcccatggaagaatcaacccttacatgtcctcgccctgtcatattgagttgatattgtctgaaaaggaggcacctgtcaagaaagaggttgaaacccaagtggtgcccaagaggacgaagaaatctcaagctcttcgtagtgcggcttcatcttaaagatttgcagagtaagagattagtatcgcggcaacttggagatttactctgagagagattggcatcttttttccttctatttgaatgctcatgtttttgcttcatcttaagacatttcttaaagaaatttgtggttgtattagaaccaagaatcgtccaaccccatttggggagagattttcttgcttgagttggctagtttgagccttagatcatatttgggtcattgttttggctatgtcttcctttgtggacacctgtgtccttatattgcaagcattagttcatacgaaagtgttttagaacttttgttagtaatgtgattttttcataacctactattttaggcattc

SEQ ID NO: 1626 - DNA, 734 bp, Helianthus annuus
cagtaactccattgaagcataagcagccgcagcaatggtgaaatactcgaaggagcctgataatcctacaaaatcctgcaaagcgaggggttccgatctcagatgtcactttaaaaatacaagagaaaccgcacatgccataaggaagttgcctttgatcaaggcaaaaagatatctggaggatgttttggcccacaagcaggccattccatttacccgtttttgtaggggcgttgggcgtacagctcaggccaaaaataggcactctaatggtcaaggccggtggcctgccaagtcagctaaattcattttggatttactcaagaatgctgaaagcaatgctgaggtcaaaggtttggatgttgatgcacttttcacttcacacattcaagtaaaccaagctcagaaacaaaggcgtagaacataccgagctcatggaagaatcaacccctatatgtcatctcccagccacattgagttgacgttgtctgaaaaggaagaacctgtgaaaaaagaggcggaatctcaactagcaaccagcggaaagtcaaagaagtcccaggcttagttcacctcatagaaacatttaggtttgatcggaaacagttttgaactactattgtcatttgtgttttgaagacgatctttgtttggctctcgtgtttttgtggcaagtagacgatcctggtttgatcggagtttttttgttatcaaatgaaagatgctttttatga

SEQ ID NO: 1627 - DNA, 645 bp, Ambrosia trifida
tttcagacaccatatcctaattgaaacacaagcagccgcaccaatggtgaaatactcaaaggagcctgataatcccactaaatcctgcaaagctaggggttcggatctcagatgtcatttcaagaatacgagagaaaccgcacatgccattagaaagttgcctttgatcaaggcaaaaagatatctggaggatgttctagcccacaagcaggccattccatttacccgcttttgtaggggtgttgggcgtacagctcaggcgaaaaacaggcactctaatggacaaggtcggtggcctgccaagtcagctaaattcattttggatttactcaaaaatgctgaaagcaatgccgaggttaaaggcttggatgttgattcacttttcatttcgcacattcaagtaaaccaagctcagaaacaaaggcgtagaacataccgagctcatggaagaattaacccgtatatgtcatctccttgccacattgagttgactttgtctgaaaaggaagaggctgtgcaaaaagaggcggaatctcaattggcaaccagtggaaagtcaaagaagtcgcaggcttagttcatgtcatagaacatgtaggtttgaccacaaacagttttgaactacttgtcatttgtgatttgaag

SEQ ID NO: 1628 - DNA, 877 bp, Amorphophallus konjac
cgccatggtgaagtactcgagagaaccgggcaacccaaccaaatctgccaaggcaatggggcgggacctgagggttcattttaagaacaccagagaaactgcccatgcaattcgaaagttgcccctggccaaggctaagaggtaccttgaggatgttatagcccacaaacaagccattccctttaccagattttgtggaggtgtaggccgtactgctcaggcaaagaaccgtcatccaaatggacagggacggtggcctatgaaatctgcaagattcattcttgacttgctaaagaatgctgaaagcaatgcagatgtgaaaggtttggatgtggatactctctatatatcccatatccaggttaaccaggcccaaaagcagagacgccgaacctaccgtgcccatggacgaatcaatccttatatgtcatcaccttgccatatcgagttgatcctgtctgagaaggaagaggctgtaaagaaagagcctgaaacgcagctggctaccacaaccaggaagcccaagaaaactcaagctttgcgcagtggtgcctcatcttgagcagttattggagaattccgtttatttgagagttgattagttgttttacgcttttgagctccgtggtacaattttgtttgagtttgatctaatccctttgattaaatattccgtgtttgtagtgtatgtattttaagtacaagagattgaactatttccccccccggactttgaagttgcagtggcttggtagcatcaatttgaacgttgctgttacatttaccaacttgggttactcgagatttagtgctggttttcctgtatttttacatgggcgttggtcgacctttagtaaagaacccggtatgtcgcttt

SEQ ID NO: 1629 - DNA, 770 bp, Arabidopsis lyrata
gccgattagggtttcatatgttgcactatatataaagtatctccaaataaagagatctctactctctccgtcctctgttcttctctttggccgccatggtgaagaagtactctcaggagcccgacaattccaccaaatcttgcaaggcaagaggagccgatctcagggtccacttcaagaacactagggaaacagcgcacgccataaggaagctaccattgaacaaggccaaaaggtacttggaagatgtcatagctcacaagcaagctatccccttcacccgtttctgtcgtggtgttggtcgtactgctcaggcaaagaacaggcattctaacagtcagggtcgttggcctgctaaatctgctcagttcgttcttgatcttctcaagaatgctgagagcaatgctgaggtcaaaggtttggatgttgatgcccttttcatttctcacatccaagtgaaccaagcagcaaaacagaggagaaggacatatcgggctcatggaagaatcaatccttacatgtcaaacccatgccacattgagttgattttgtcagagaaggaagagcctgtgaagaaagagccggagacacagttggcagcaaagtcaaagaaaggagcctcgtcttgagctaatatagacagtctttttgttgtgctcacttgtgttgccccctcaatacattttgttagcttctctttcctataagaccaagacccaatttttaagtatgatgattatcggtttttggattgctggaagaacctctct

SEQ ID NO: 1630 - DNA, 825 bp, Fagus grandifolia
ggctttggggaagacagcattcaacagaggcggcagcagcagcagcagcagcagtagcggtagcagccatggtgaaatattcaagggagcccgacaattccaccaaggcttgcaaagcgagaggttctgatctccgtgttcatttcaagaatacaagggagactgcgcaggcaattcgaaagttgcagttggccaaggccaaaagatatttggaggatgttttggcccacaagcaagccattcctttccggaggttttgtagaggagttgggcgaactgcacaggctaagagccgccattcaaatggacaaggacgctggcctgttaaatctgcaaagtttattctggatttactgaagaatgctgagagtaatgctgaggtgaaagggttggatgtggatacgctttacgtatctcatatccaggtaaatcaagctcagaagcaaaggcgacgcacataccgtgctcatggaagaatcaacccttacatgtcatctccgtgccatattgagttgattttatcagaaaaggaagaacctgtcaagaaggagccagagactcagttgactacaaagaaaccaaagtctaaagcactacgtagtggtgcttcttcttgagatgcagagttgtagtctgttcttcatcagcggtctctctttttagaacatttttgtctcctttttttgtctgccttctttaatcaagtgttacaaaccctcaacgtcttgagagatatttgtattgtgtttttggagcttatttcaagccatttgaaactgtctttgtcacccatttaacatgaatggtagaattgctttggttttc

SEQ ID NO: 1631 - DNA, 1236 bp, Ceratodon purpureus
ggaggctgggggaggggagcgtggcgccgggcgggtggaacaacgcccccggctcttcctcgcagtccccactccgccctctccacccgcccggcgccacgctcccctccccagcctcccaccatggtgaagtacgcgagggacccggacaattcgaccaaggcctgcaaggccaggggatcggacttgcgagtgcactttaagaataccagagaggcagcgcaagccattaagcatatggagttggcgaaggccaagaggtacctcgaggacgtatgcgctcacaagcaggctattcctttccgcagattctgtggtggtgttgggcgtactgctcaggctaaggcccgccactccaatggacagggacgttggcccgtgaagtcagctcagttcttgttgggtctgttgaagaacgccgagagcaacgccgaggtgaagggtttggacgtggacactctgtgtgtctctcacattcaggtgaaccaggcccagaggcagcgcaggcgtacttaccgtgctcacgggcgtatcaacccctacatgtcctctccttgccacattgagctgatcctttccgagaaggaggctccggtgaagaaggaagcggaagaggttgttgccccacgcaagaagaaccaaggacgtctgcgcagcggcgctacctccgccacggcttaggattgcccgtgctgatgcacatttgacagacatgttttgttgggtatatcaatcaaatgagtttgtgaacggctctgattctctgaagttcgtgttcttggtctccctgtcaagtttttcaacatctgttcatgcgtgagtttcgatgtggttctcttttttggtcattactgccaatgtcgccgaatgggggtcattctgttttttaatattgtcctctatttgtgtaccttgaaatcagttcacgaataaagttaccaattcaatcgggctttttcttaatcatccacgagtggccggactaactgtcagaattatttcatcgtggaagcatagacctgtatttaacttcatgcatgagaatatgatggaactgtgtacctttacgtatttgttggagtagtgagctaaaatgcagtctttaatgtcggagatatcgctaagtagatatagttagtcaaggggatagaatagattacctcacctcattccagggagccgttttctgtagatgcccaagaaatctcctgtcacgaaactcatgggccaatgccc

SEQ ID NO: 1632 - DNA, 622 bp, Cirsium arvense
tactcgaaagagcccgataatcctaccaaatcttgcaaggctaggggtgctgatctcagagttcacttcaagaatactagagaaaccgcacacgccatcaggaaattgcctttaaacaaggcgaaaaggtacttggaggacgtccttgctcataagcaagccatacccttcactcgtttttgtaggggtgttgggcgtactgctcaagccaaaaaccgacattccaatggtcaaggtcgatggcctgccaagtcagcaaagtacattttggatttactcaagaatgccgaaagcaatgctgaggtgaaaggattggatgtggatgcacttttcatttctcacatacaagtgaaccaagctcagaaacaaagacgtagaacataccgtgcccatggaagaatcaacccctatatgtcatctccctgccatattgagttgactttgtctgaaaaggaggagcctgtgaaaaaggaggctgaatctaggttggcaactagtggcaagtagaagaatccatacttttggatatcagttttggattgattttatgcttcatttttgaagacaaattttgttctatatatttatggttttgtaccttgatattgggtttactttaatc

SEQ ID NO: 1633 - DNA, 779 bp, Cleome gynandra
tcgggggtcttcttctttctgctgcagttaaggaacgagaggaagagccggcggccatggtgaagtactcgagagaacccgacaatcagaccaaagcttgcaaggcaaggggatctgatctcagggttcatttcaagaacaccagggaaactgcccatgctatcagaaagcttccgttggtgaaggccaagcggtacttagaggatgttattgcccacaagcaagctatccccttcacccgcttttgtcgtggtgttggacgaactgctcaggcaaagaataggcattccaatggtcaaggtcgatggcctatgaagtctgccaaattcatcctcgacttgctcaagaatgctgagagcaatgctgaggtgaaaggtttggatatagatgccctctacatatcacacatccaagtgaatcaagcacagaaacaaaggcgtaggacctaccgagctcacggaagaatcaacccttacatgtcatctccgtgccacatcgagctgatcctgtctgagaaggaggaggctgtgaagaaagagccggagactcagttggcagcaagcaagtcgaagaaatcttcagcttaaatcttgagggtcgtgggtgcaatattttctcttgttttcttggagagattgattttgccgcgtctttgtgctaatagaagaatcatgacattaagacaaatgtgatggttttcacttatgatcatactagtcttgtgagttttgtgaaaacttctctttcaaatggtttctttccacattttcctttgtcta

SEQ ID NO: 1634 - DNA, 768 bp, Cleome gynandra
acgagaaataagagaactagggtttttttcccatctttctacttctgtataaaactccatccgtcatcttctctttttcctgtcgcagatagcagagatcggccgccatggtgaagtactcgacagaaccggacaactccaccaagtcttgcaagtcgagaggatccgatctcagggttcactttaagaacacgagggaaactgcgcacgccatcaggaagctccccttgactaaggctaagaggtacttggaagatgtcatagctcacaagcaggccatccccttcactcgcttctgcagaggtgttggacgtactgcccaggctaagaacaggcattccaatggccaaggtcgctggccagcaaaatctgctcagttcatcctcgatttgcttaagaatgctgagagcaatgctgaagttaagggtttggatgtggatgccctccacatttcccacatccaagtaaaccaggcaaggaaacaaaggcgtaggacttaccgtgcacacggaagaattaacccttacatgtcgtctccatgccacattgagttgatattgtcggagaaagaagagcctgtgaagaaagagcctgaaactcagctggctaccaagtcaaagaaatcggcatcaacttgagcttatatatatatatatatattatctatttggtttcataagtatcttgtttctccaagagattttgtttctttttttcccatagattgaagcattcactcttatttccaagacaatatggatgattttg

SEQ ID NO: 1635 - DNA, 669 bp, Cleome spinosa
gaacaaagtaaggtaatacaaacgacagagtacgcgggggcagtgagagcagaggttggccgccatggtgaagtactctaaagaacccgacaatcctaccaagtcttgcaaggcgaggggagccgatctcagggtccacttcaagaacacaagggaaactgcacatgccattaggaagctcccattgattaaggccaagaggtatttggaagatgttatcgctcacaagcaggcgatccctttcacgcgcttctgccgtggtgttggccgtactgcccaggctaagaacaggcattccaatggtcaaggtcgttggccagccaaatctgccaagttcatccttgatttgctcaagaatgccgagagcaatgctgaggttaagggtttggatgtggatgcccttcacatttcgcacatccaggtgaatcaggcaaggaaacagaggcgtagaacctaccgtgctcacggaaggatcaatccttacatgtcttccccttgccacatcgagttggtcttatcggagaaagaggagccagtgaagaaagagcctgagactcagctggcaaccaagtcgaagaaatcggcaacatcgtcttgagctatccatctcctgttttgttctccaactatctcttgtttcttttaagagatttttctttttcttaaaac

SEQ ID NO: 1636 - DNA, 672 bp, Cleome spinosa
gaccatctccccattcttctgccgcagcgagcaggagatcggccgccatggtgaaatactcgagagagcccgacaattccaccaagtcttgcaaggcgaggggatctgatctcagggttcacttcaagaacactagggaaacagcacatgccattaggaagctccccttgacaaaggccaagaggtacctagaagatgtgatagctcacaaacaagccattcccttcactcgtttctgcagaggtgttggccgtacagcccaggcaaagaacaggcattccaatggccaaggtcgttggcccgccaaatctgccaatttcatcctcgatttgctcaagaatgccgagagcaatgccgaggttaagggtttggatgtcgatgccctccacatatcgcatatccaggtgaatcaagcaaggaaacaaaggcgtagaacctatcgtgctcacggaagaatcaacccttttatgtcatccccatgccatatcgagttgattttgtcggagaaagaagaacccgttaagaaagagcctgagtcgcagttggcaaccaagtcgaagaaaccagtgtcatcttagagctcatatccgtttcgttcccaagtatcttttgtttcttcaaagagatttttgttcactgtcaccatagatgaaaccatttgttttaccgcaa

SEQ ID NO: 1637 - DNA, 916 bp, Linum usitatissimum
aacaccagcagccacactaccgctccagaaacaccagccgccatggtgaagtactcgcaggagccggtgaaccctaccaagtcatgcaaggctaggggctctgatctcagagttcacttcaagaatactagggaaacagcgttctccatcaggaagatggctttggtaaaggccaaagcatacctggaggatgtccttgctcacaagcaggccattcctttcaggagattctgccgtggagtcggtagaactgctcaggcaaagaatgctgggcacccaaatggtcaggctcgctggcccgcaaagtctgctaagttcatccttgacctgttgaagaacgctgagagcaatgctgaagttaaaggattggatgtcgatgctcttttcatctcccatatccaggtgaaccaggctcagaagcaaaggcgtcgtacttaccgtgcccatggaaggatcaacccttacatgtccaacccttgccatatcgagttgaccctatccgagaaggaagagcccgtcaagaaggagccggagacacagcttgctgccagtggcaaatccaggaagggtcaagctttgagaagcggtgcatcttcttagagacctattcctatcattgtggtgtttcgaattttccgagagatctgttttgtgctcgctcttatattttagaattcgtgataagtctacttagagggaaggtttgaactgaatgatgttatctttctggactaatgttccttttgttatgagattcagaattttgcttggttatgtttaccttctatcaaagtgatctactccatcaattagcaatgtatcgaaaagttatcatgccgaattattcatgtcgtgcttgtggtcgatcatagtagttccttctttgatgccttgttatatagtaacctttgttgct

SEQ ID NO: 1638 - DNA, 1035 bp, Gnetum gnemon
taaagcccaacaaaaccctagcaaagcagttgtatcgtgcgtaagaagaacacagacggaaagggaagagttcagacgcagacgcagagggagagggagagggagtggagggattgaaggagagcggaagaatggtgaagtacgctagagagccggacaatttaaccaaggctgcgaaagccaggggatcagatttgcgtgtccatttcaagaatacaagggaaacggcacaggcaattaaaaagctgccactggctaaggcaaagagatatcttgaggatgtgatagcgcataagcaggctattcctttccgtcgcttctgtggtggcgtgggcaggactgcacaggctaaggcccgccactcaaatggccaaggccgttggcctgtcaaatccgcacatttcctgcttgggctcttaaaaaatgcagagagcaatgctgaggtcaagggacttgatgttgactccctctacatttcccatatacaagtgaatcaagcacagaaacaaaggaggcgtacatatcgagcacacggaagaattaacccgtacatgtcctctccatgccacattgagctgatattgtctgagaaagaagtacaagtcaagaaagaggctgagactcaaattgcgcccaggaaaacgaggagatctgctgtagccgcataatgtgcttgcatagagttctttatttagatattagcatggatctattaagaggaatattctgaaattttggttggtccttggaaccgagttcaagcagcttggtgccgtattgttttatttaccttcgataatgttaataccagaaatctttaaaccagttgaaaggtttttcaccagtggaatttattttaatttagctggataattcatgtggcttcttgaaaattttaactataaagtcatttttggaagcttgtttgtgaactgaaagtgcattactgtatggttccacaaatggccgtcaactattaactcagtttctgttcctgcaatctagtagcgatatggaagacaccgttggttttcc

SEQ ID NO: 1639 - DNA, 862 bp, Orobanche aegyptiaca
aacataaagtcaagaaggcctcactggtggaactcatttcctccggtgcgcagcttaagcaggcagcgaagatggtgaagtattctagagagcctgacaatcctaccaaatcctgcaagaccaggggggccgatctaagagttcatttcaagaacactagggaaacagcccacgctatcaggaaacttcctctggtcaatgctaaaaggtatttagaggatgtacttgcccacaagcaggccataccattcactcgcttctgcagaggtgttggccgaactgctcaggctaagaacagacattcaaatggacagggtcgctggccagtaaagtctgccaagttcatcttggatttgcttaagaatgctgagagtaatgctgaggtgaaaggtttggatgtggatgctctctttatctctcacattcaggttaatcaggctcgaaaacagagacgccgcacataccgtgctcacggacgaataaatccgtatatgtcatcaccctgccacattgagttgattttgtccgaaaaggagcgccagtcaagaaggagcctgaatcacaattggcaactagcaaatcccggaaggcttgagagttgtgaatcaatcacatataggtggtttgaaaaatctatttcccgtggagccttttattttgttagtatgagtttggttatttgttgtcggttctaggtttggattggatggaaatatcatagcatgctttcatgatacattttatttctcactgctaattggattttggatataaggttacatcaaagttctgaacattgatttgtgtgtatattcaatcgtaagcatcattagttatttggcaagtatctgattaaaaaatc

SEQ ID NO: 1640 - DNA, 1147 bp, Sequoia sempervirens
ggtatcgatgctagggttatggtatacctacatcgaactctctaatgattagtcttggccttgcgagtgaagagaggggagacgattgaggagagagtgacgtagtgtggtgtggaggtctcagcagctatggtgaaatactcgagagagcccgacaattccaccaagtcttgcaaggccaggggatccgacctacgagttcacttcaagaacacaagggaaaccgcacaggccattaagaagcttcctttaggcaaggcgaagaggtatcttgaagatgtgcttgcccacaagcaagcaataccctttcgccgtttttgtgggggtgtgggtagaactgcccaagcgaagtcacgcaactctaatggtcaaggtcgctggcctgttaagtctgctgaattcttgttaggtctactaaaaaatgcagagagtaatgctgaggtgaagggtcttgatgtggacacactttatgttactcacattcaagttaatcaggctccaaagcagcgaaggcgaacgtatcgtgcccatgggagaattaatccttatatgtcatcaccatgtcacattgagttgatattgtctgagaaagaggcacctgtgaaaaaagagcctgagactcaaattgctccgaggaagtcaaggaaagctcaacaacttcaaagtggaacatcatcatgagttgctcaagaagttgaaccgtggcatagtaaggccatattttattggaaggacaatattgaggggaaactatgcctggttctgttcagtggcatggtttgtagttgtggaccagaattctcatttaaaactttactttggttctgtcattttaattttgttcgagtcctatcagttgctgtgttactcctagtcagcttgctaaggatacagggaaatcttgggttctaatgtttaaaatggtaataaggcattggatggtttgtatgatcctccaagtaaagaaaattacaggttattttatgaatactgtgaggacttatatgcaaggctgtctctggaatgaaggttcaggttcagttgacacatcaactatatggagagttgttgacatattgacttttgctgattagttgactgttatacttttgtttggaatttcagtttatgcgcaagtgcaaatttt

SEQ ID NO: 1641 - DNA, 1215 bp, Picea glauca
catatactaagctctttcccatgtgacctcatcgttagggtttgtggagtcggggtttatttagggtttgttcgcttgtataacgttttatttcttttccgaagaagaaaccagagaacaaattagagcacaggaggcgaaccaggaatcagaacaatggttaagtattcaagggagcccgataatcctaccaaatcatgcaaggctcgagggtcagacctacgggtccattttaagaatactcgagaaacagctcaagctgtgaagaagttacctgtggccaaggctaaagcctatcttgaggatgtgcttgcccataagcaagcaattcctttccgtcgcttttgtgggggggtaggacgtactgcccaagcaaagtctcggcattcaaatggccagggccgctggcctgtcaagtctgttcaatttttgttacaattgttgaagaatgcagaaagcaatgcagaggtgaagggacttgatgtggatgcactatacatttctcacatccaagtaaaccaggctcaaaaacagcggagacgaacttatcgtgcccatggaagaatcaatccttacatgtcatcgccatgtcatattgagttaatattgtccgagaaagaagtacctgttaaaaaggaggccgaatcacaaattgctcccactaggtcaaggaaaggccgagctcttagtagtggcatttcctcgtaaggcgctagagcagtttttatgcagcacttcactaccacaatttttgaaagcaagggattatcgaggcatgaagtttttgtagttttcttgcgggaactatataccagctaaatgtttaccaaactggaattctagagtctagactctggacaggggaatttgtgaaattttgtttgtattatttttatcgccgttactttttgtgctggattgccgtttataggtttgaaacagcaaattcagtaagatggaagccttcaacttccattctctgcaatgtttaagacactgaggaaagatcggaatattgcttacatgattatttctttgctgagtaacttaaaatggacttattttccatgcataccatgtggaagtgtctgcaaggctgcctggggaatgaagctttgggttcaaagtgtttgttgttagaattcagacagaccttttaatgttagacttgtacggtgtaacttgaagtatgatatatttatgaagcggtgggtt

SEQ ID NO: 1642 - DNA, 916 bp, Camellia sinensis
ggggaaggaaccctagctcatttctctctggttgggatccgtgaacacatccaccaccagaggaggaggaggagccgccgacatggtgaagtattcgaaggaaccggacaatcccaccaagtcgtgcaaagctaagggctccgatctccgagttcatttcaagaatacaagagagaccgcccatgcaattcgaaaattgcctctgtccaaggccaaaagctatttggaggatgttcttgcccacaaacaagccattccgttcactcgcttctgccgcggtgttgggcgaactgctcaggcaaagaaccgacattcaaatggacaaggacgttggccagtcaaatctgcgggatatattttggatctacttaagaatgctgagagtaatgcagaagtgaaaggtttggatgttgagtcactttacatatcccacatccaagtaaatcaagcccagaagcagaggcgtcgcacataccgtgctcatggaagaatcaacccttacatgtcatctccctgccatattgagttgattttgtccgagaaggaagaaccagtcaaaaaggagcctgagatgcaagtggcttcaaggaccaagaagagcaacaaagctctacgcagtggcactgcttcttgaataacacagtaatagagcctgattccagaaactgaggatgattttcatttctttgccctatctaatggaaacatattttgtgttctattaagaatgctatttgtgaatttgatttttgttagattcttaaattactatcgctcaagagagtttagaattttcagatggaacttgatggtttttgcttattgagtaggttctgctgatttgctgtgtttcattggagacatgttgtggttcattggttattcaatctatgtgatgttgcttgtttaaaccaac

SEQ ID NO: 1643 - DNA, 615 bp, Zamia vazquezii
gctaccgggagaagaggcgagaggagaagccaaagggatcggcactgcagaaatggtgaagtattcgagggagcccgataatcctaccaagtcatgcaaggctcgggggtcagacctgcgagttcattttaagaacactcgggaagctgcacaggccattaagaagctgcctctggccaaggctaagaggtatctcgaggatgtgcttgcccacaagcaagcaatacccttccgtcgcttttgcgggggtgtaggccgaactgctcaagcgaagtctcgccattcaaatggccagggccggtggcctgtgaagtctgcccaatttttgttaggactgctgaaaaatgcagagagcaacgctgaggtgaaaggacttgatgtgcatacactgtacatttctcacatccaagtgaaccaggctcaaaagcagcggaggcgtacttatcgtgcacatgggagaatcaatccttacatgtcatcaccatgccatattgagttgatattatctgagaaagaggcacccgttaaaaaaggagcctgaatcgcaaattgctccaagcagggtgaagaaaggtccagctcttcgtactggtgcctcctcatacggtgctagag

SEQ ID NO: 1644 - DNA, 750 bp, Bupleurum chinense
tttcgtcggtgctccacactaatccagcagcggcgacaaaaatggtgaagtattcaaaggaacctgataaccctaccaagtcttgcaaagccaggggagctgatctcagagttcattttaagaatactagggaaaccgcacatgccctccgtaagttgcctttgttgaaggccaagaggtacttagaggatgttcttgcacacaagcaagccattccattcactcgcttctgtaggggagttggacgaactgctcaggctaagaacagacattctaatggacaagggcgttggcctgctaaatctgcaaaatttattctggatttgctcaagaatgctgagagtaatgctgaagtgaagggcttggacgtggattccctttacatatctcacattcaggttaaccaggcgcagaaacagagacgtaggacatatcgtgcccatggaagaattaatccttacatgtcatccccatgccacattgaattgactttgtctgaaaaagaagagcctgtcaagaaggagcctgattctcagttggctccaaggaagaagacaaaccaagttttacgaagtggtgcttcctcttgagttgcttttgtagtggaatttaagttttgtgaagaacatctcttgttctcagtttagtgagagaattttcgtttgttatgatgtttcaagagattattattttttgatatttggttggatttcaagtgagttgactgactgtgttgtggtttgcctttgc

SEQ ID NO: 1645 - DNA, 802 bp, Amborella trichopoda
  misc_feature (17)..(17): n is a, c, g, or t
  misc_feature (208)..(208): n is a, c, g, or t
  misc_feature (300)..(300): n is a, c, g, or t
  misc_feature (365)..(365): n is a, c, g, or t
  misc_feature (699)..(699): n is a, c, g, or t
  misc_feature (719)..(719): n is a, c, g, or t
  misc_feature (721)..(721): n is a, c, g, or t
ctaggtttactcagccnctcacccacccaccctctcttcagccgctcagcaaaacagcagctccactgcgaaagttctctcgctctctcttcccagtaaaggcagcctctcgcccagtactattcgcggccttgcaacctcaacagttatcaaacaggcccttagggtttcctacttttgtcgttgcgattagagagagagaattttngggtttttggattcacaaaaattcacagctttgaggcgctcataaccctcggcctctgggagcagtcagagaccttcatttcgatcagcagncatggtgaagtattccagggagccggacaatccaactaaatcttgcaaggccagaggatctgacntgagggttcacttcaagaacaccagggaaaccgcatttgctatcaggaagctcccattggccaaggctaagaggtatctagaggacgttcttgcccacaagcaggccatccctttccggcgcttttgtggaggtgttgggcgcactgctcaagcaaagaaccgccatccaaatggacaagggcggtggcctgtcaagtctgccaagttcatcttgaacttgctcaagagtgctgagagcaatgctgatgtgaagggcttggatgtggatacactattcatttcgcatatccaggtgaatcaggcccagaagcagaggcggcgaacttaccgtgnccatggaagaatcaaccctnanatgtcctccccctgtcatattgagttgatattgtctgaaaaggaggcacctgttaagaaagaggctgaaaccgaagtggtg

SEQ ID NO: 1646 - DNA, 893 bp, Manihot esculenta
ctcctgccctcctactacagggagcaataactgagaacttcactggggcagaacagccaaagtcgccatggtgaagtactcaagagagcctgaaaatcccactaagtcctgcaaggccaggggctctgacctcagagtgcatttcaagaatacaagagagactgcccatgccttaaggaagttgcctttgatgaaggctaagaggtatttggaagatgtcatggctcacaaacaagctatacctttccgacggttctgtggtggtgtagggcgtactgctcaggcaaagaacaggcactcaaatggacaaggaaggtggcctgtcaaatctgccaagttcattctagatttgctcaagaatgctgagagtaatgctgaggtcaaagggttggatgttgatgccctcttcatttctcacatccaagtgaatcaagcacagaagcagaggcgtcggacatatagggctcacggaagaatcaatccttacatgtccagcccttgccacattgagttgatcttgtctgagaaggaagaaccagtgaagaaggagcctgagacccagttggctaccagcaaatctaagaagtctcaagctgcatgaagtggtgcttcctgctgagtggcagcaataatttttaccaaacgaaggagctttttctaatttttgtctttgtttcaattggagagattattgttgcactaaatttagaatgagcagtaatttagatgaattggacagcttctttatttgtatgtctgtttagttgattgttctgtgagatttttgttggagatcttaagtggaagcccatcttttcatacctttatatgatggttatgaaaattactcttgtagcttatggtattggattacagatctccattttcatcct

SEQ ID NO: 1647 - DNA, 791 bp, Actinidia deliciosa
atcgtagtagcagcaaccatggtgaagtattcgagggaaccagacaatccaaccaagtcttgcaaagctaggggctctgatctccgagttcacttcaagaacacgagagagacagcccatgctattcgaaagatgcctctgacaaaggccaaaagatatttggaggatgtgcttgcccacaaacaagccatacccttcacacgcttctgtcgaggagttgggcgaactgctcaggcaaagaaccgccactcaaatggacaagggcgttggcctgttaaatctgcaggatttattctggatttactcaagaacgctgagagtaatgcagaagtgaaaggcttagatgttgattcactttacatatctcacatccaggtgaaccaagctcaaaagcagaggcgtcgcacttaccgtgctcatggaagaatcaacccttacatgtcatctccctgtcatattgagctgattttatcagagaaggaagagcccgtcaagaaagagcctgagatgcaagtggcttcagggaacaagaggagcaaagctctacgtagtggagtctcttcttgaattacgtagcggtagatctctggaaagagctgcaaaggattttcatatttttggcctgtcatggcaacattttattgcatcgctcttttgtgggagtgtacttttgaatgttgtttcttgagatttttaactttaaactgctattgctgaaagttggaacttcggtatatggcttccttattatcttccaggggcatactggttgtgtttcatggaattgggtt

SEQ ID NO: 1648 - DNA, 831 bp, Lactuca sativa
gggggttatacagaaaccctagaccatcaatttggactctttgaactccgaatccacacaattcagcggcatttgcaccggcgaacgagctactgcgatggttaagtactcaaaggaaccggacaaccctaccaaatcttgcaaagcaaggggatcagatctcaggtgccattttaagaacactagagaaactgcacatgctattcgtaagttgccattgatcaaagctaaaagatacttggaggatgttcttgtccacaaacaagcaatcccattcacacgcttctgtcgtggagttgggcgtactgcacaggcaaaaaatcgccattcaaatggacaaggacgttggcctgctaaatctgcaaaattcattctggacttgctcaagaacgctgagagtaacgcagaagtgaaaggattggatgtggattcccttcacatctcccacattcaggtgaatcaagcacagaaacagaggcgtaggacatatcgtgctcatggaagaatcaacccttacatgtcttctccatgtcatattgagctgactttgtcagagaaggaagaagctgttaagaaggagcctgagactcaattggctgcaaagaagaccaagtaaagtgcagcatcagttttggaagtctagtttagtatgctagaaagagtgtcattttaccctgaaaagatgtactttgatattgaaagatttttatctaaagttcagttatgaaattataaagctaaatgtgattcacttacttttctttattgaagttttttattttggttggaatagttatgtgaaggcatagtcatacttttgattcaatgaaa

SEQ ID NO: 1649 - DNA, 740 bp, Triphysaria pusilla
attacgccgggggaatcgaaaaacctgttccattaattattcccagtgagccgccgaagcagcaaagacgatggtcaagtattcaagagagcctgacaatgtcaccaaatcatgcaaggcaaggggatccggcctcagggttcatttcaagaacactagggagacagcgcatgctctcaggaagcttcctttgaccaaggcgaaaagttatttggaagatgtacttgcccacaagcaagctattcctttcactcgtttctgtcgaggtgttggtcgaactgctcaggcaaagaacagacattcaaatggacaagggcgctggccggtcaagtctgccaagttcatcttggatttgcttaagaatgctgaaagtaatgctgaggtgaaaggtttggatgtggatgctctgtttatctctcacattcaggttaaccaggcaataaagcaaagacgccgcacataccgtgcacacggaagaataaacccatatatgtcgtcgccttgccacattgagttgattttatccgaaaaggagcaaccagtcaaaagagagcctgaatctcagttgtcaaggaaggcttgagattgtaatggagggtggtgttatcatatatatatttgttttgaaaaaaccatgccaaatgtggccttcaattttgaatatgaattttgttatattttctattttaggtgtgacttggatttcgaagaatatgtttggctagcgtttcatcatatgc

SEQ ID NO: 1650 - DNA, 659 bp, Parthenium argentatum
tgaagataagcagccgcggaaatggtgaaatactcgaaggagcctgataatcctactaaatcctgcaaagctaggggttcggatctcagatgtcattttaagaatacgagagaaacagcacatgccataagaaagctgcctttgattaaggcaaagagatatctggaggatgttctggcccacaagcaggccattccatttacccgtttttgtgggggtgttgggcgtaccgctcaggcaaaaaacaggcactccaatggacaaggtcgatggcctgccaagtcagctaaattcattttggatttactcaaaaatgcagagagcaatgctgaggttaaaggcttggatgttgatgcacttttcatttcacacattcaagtaaaccaagctcagaaacaaaggcgtagaacataccgagctcatggaagaatcaacccctatatgtcatctccctgccacattgagttgactttgtctgagaaggaagagcctgtgaaaaaagaggctgaatctcaactggctgccagtggaaagccaaagaagtcacaggcttagttcatgtcatagaaagatgtaggtttgaccagaaacagttttaaactacttttgtcatttgtgctgtggagacgatctttattcgactattttggttttgtggc

SEQ ID NO: 1651 - DNA, 834 bp, Brassica juncea
tcgggggattctcttctcttctcgttggccgccatggtgaagtactcccaagaaccggacaattccaccaaatcttgcaaggcgaggggagcagatctcagggtccacttcaagaacactagggaaacagcgcatgccataaggaagttaccattgatcaaggcgaaaaggtacttggaggatgtgatagctcacaagcaagctattcccttcacacgtttctgccgtggtgttggacgtactgctcaggcgaagaacaggcattcaaacggtcaaggtcgttggcctgccaagtctgctcagttcgttcttgatcttcttaagaatgctgagagcaatgctgaggtcaaaggtttggatgttgatgcccttttcatttctcacattcaagtgaaccaagcagcaaagcagaggcggaggacatatcgtgcacatggaagaatcaatccttacatgtcaaacccatgccacattgagttgatattgtccgagaaggaagagcctgttaagaaagagccggagactaagttagctgcaaagtcaaagaaaggagcctcgtcttgagcctagttacagtagctttcttgtggtgtgtgatacattttcttcacttttattgtaagacaacggagccgattctaaaaaacataagatacgatgattggatttttgataagagtagcgttgacttattcactaatcaatgcaaaatcgtgaaataatgtaaattttttgtagaggttacaagcaacgtaattaatcatgtacaactttgattaattatgaacgaacacgcatggtcaatgtaatctaagagttatcgtttggacaaaa

SEQ ID NO: 1652 - DNA, 838 bp, Amsonia hubrichtii
taccctaccctctctcgctcagccgcagaagcaggaaacaatggtgaagtactcaaaggagccagacaaccccactaagtcctgcaaggctaggggatctgatctccgggttcactttaagaacactagggaaacagcacatgccatcaggaagttgcctttggccaaggccaaaaggtatttggaggatgttttggcccacaagcaggccatccccttcactcgcttttgtggaggtgttggccgtaccgctcaagctaagaacaggcattctaatggacaaggccgctggcctgtgaaatctgccaggttcattttggatctgcttaagaatgctgaaagcaatgctgaggtaaaaggtttggatgtggattctctatttatttctcacgttcaggtgaaccaggcccagaaacaaaggcgccgaacatacagggcccatggaagaataaatccatatatgtcttctccatgccatattgagttaatcttgtctgagaaggaagaaccagtcaagaaggagcccgagtcacagttggctaccagcaacaaatctaggaaggcttaagctcctgtgggcttcttctttattgcgtctgttacttttgtgctttatcctagtgtttcagttcataaatattaagtatttgaaagagttaccgatttatagacatcaaattttgttcttccttagcaaagaggacttatttttggtaattttggaatgcttgaatgcgaatgatttctgttaatcagatttcttcagaggattatgcatgcccccggagcttcgtgacatgtttagttgacaatgagcttaatacattaattgtctttc

SEQ ID NO: 1653 - DNA, 841 bp, Arabidopsis thaliana
gccgattagggtttcttctgtttcactatatattaagtgtctccaactactgagatctctatcctctccgtcctctgttcttctcattggccgccatggtgaagtactctcaagagcccgataatatcaccaaatcttgcaaggcgagaggagccgatctcagggtccacttcaagaacactagagaaacagcgcacgccataaggaagctaccattgaacaaggccaaaaggtacttggaagatgtcatagctcacaagcaagctatccccttcacccgtttctgtcgtggtgttggtcgtaccgctcaggcaaagaacaggcattcgaacggacaaggtcgctggcctgctaaatctgctcaattcgttcttgatcttctcaagaatgctgagagcaatgctgaggtcaaaggtttggatgtcgatgcccttttcatttctcacatccaagtgaaccaagcagcaaaacagaggagaaggacatatcgtgctcatggaagaatcaatccttacatgtcaaacccatgccacattgagttgattttgtcagagaaagaagagcctgtgaagaaagagccggagacacagttggcagcaaagtcaaagaaaggagcctcatcttaagctataacatagacagtctatttgtgctcacttgtgttacccttaatactttttgttagcttctctctataagaccaatactcaatttttaagtatgatgattatcggtttttggattgctgaaagaatctctctttatccttggtattgatagatgaataactcatagtaaaatcttgaaatatgttttagagatggattagttaagacttgtt

SEQ ID NO: 1654 - DNA, 704 bp, Brassica juncea
gttggccgtcatggtgaagtactcgcaagaacccgacaattccaccaaatcttgcaaggcgaggggagcagatctcagggtacactttaagaacactagggaaacagcgcatgctataaggaagctacccttgatcaaggcgaagaggtacttggaagatgtgatagctcacaagcaagctatccccttcacacgtttctgccgtggtgttgggcgtactgctcaggcgaagaacaggcattcaaacggtcaaggtcgttggcctgccaagtctgctcagttcgttcttgatcttctcaagaatgctgagagcaatgctgaggtcaaagggttggatgttgatgcacttttcatttctcacatccaagtgaaccaagcagcaaagcagaggcggaggacataccgtgctcatggaagaattaatccttacatgtcaaacccatgccacattgagttgatattgtcggagaaggaagagcctgttaagaaagagccggagactcagttggccgccaagtccaaaaaaggagcctcgtcttgagcctagggactgtagttatcgtgtggtcacattgtgtgatacattttgttcacttttattattgtaagacaacgcagccgtttaaaaaacatgattgaattttggataacagaagcgttgactttatttacaaatcagtacaaaatcgtgaaacgtggctcgg

SEQ ID NO: 1655 - DNA, 649 bp, Brassica juncea
gttggccgtcatggtgaagtactcgcaagaacccgacaattccaccaaatcttgcaaggcgaggggagcagatctcagggtccacttcaagaacactagggaaacagcgcatgctattaggaagctacccttgctcaaggcgaagaggtacttggaagatgtgatagctcacaagcaagctatccccttcactcgtttctgtcgtggtgttggacgtactgctcaggcgaagaacaggcattcaaacggtcaaggtcgttggcctgccaaatctgctcagttcgttcttgatcttctcaagaatgctgagagcaatgctgaggtgaaagggttggatgttgatgcccttttcatttctcacatccaagtgaaccaagcagcaaagcagaggcggaggacttaccgtgctcatggaagaattaatccttacatgtcaaacccatgccacattgagttgatattgtcggagaaggaagagcctgttaagaaagagccggagactcagttggccgccaagtccaaaaaaggagcctcgtcttaagcctagggactgtagttatcgtgtggtcacattgtgtgatacattttgttcacttttattattgtaagacaacgcagccgtttaaaaaacatgattgaattttggata

SEQ ID NO: 1656 - DNA, 631 bp, Brassica juncea
ggccgccatggtgaagtactcacaagagccagacaactccaccaaatcttgcaaggcaaggggagctgatctcagggtccacttcaagaacacaagagagacagcgcatgccataagaaagctaccattgaacaaggcgaaaaggtatttagaagatgtgattgcacacaagcaagctatccccttcacacgtttctgtcgtggtgttggacgtactgctcaggcaaagaacagacattcaaacggtcaaggtcgctggcctgctaaatctgctcagttcgttcttgatctcctcaagaatgctgagagcaacgctgaggtgaaaggtttggatgttgatgccctttttatatctcacatccaagtgaaccaagcagcaaagcagaggcgaaggacataccgtgctcatggaagaatcaacccttacatgtcgaacccatgtcacatcgaattgattctttcagagaaagaggagcctgttaagaaagagcctgagactcagttggcagccaagtcaaagaagggaacctcgtcttgatcttatagagactagttatcaattgtcacaacgcttgatacattttgttcacttattcactaagacaagaaaccagaaatttaaagacaacga

SEQ ID NO: 1657 - DNA, 667 bp, Brassica oleracea
gctctactcgttggccgtcatggtgaagtactcgcaagaacccgacaattccaccaaatcttgtaaggcgaggggagcagatctcagggtccacttcaagaacactagggaaacagcgcatgccatcagaaagctacccttgatcaaggcgaaaaggtacttggaagatgtgatagctcacaagcaagctatccccttcacacgtttctgtcgtggtgttggacgtactgctcaggcaaagaacaggcattcaaacggtcaaggtcgttggcctgccaagtctgctcagttcgttctcgatcttctcaagaatgctgagagcaatgctgaggtcaaagggttggatgttgatgcccttttcatttcgcacatccaagtgaaccaagcagcaaagcagaggcggaggacataccgtgctcatggaagaattaatccttacatgtcaaacccatgccacattgagttgatattgtcagagaaggaagagcctgtgaagaaagagccggagactaagttggccgccaagtccaaaaaaggagcctcgtcttgagcctagggactgtagttatcgtgtggtcacattgtgtgatatattttgttcacttttattactgcaagacaacgcagccgattaaaaaacttaagaatatgattattgaattttgga

SEQ ID NO: 1658 - DNA, 742 bp, Brassica rapa
gtccatcagatcttctctttggccgtcatggtgaagtactcacaagaaccagacaacaccaccaaatcttgcaaggcaagaggagccgatctcagggtccacttcaagaacactagggagacagcgcatgcgataagaaagctaccgttgaacaaggcgaaaaggtacttggaagatgtgatagctcacaagcaagctatccccttcacacgtttctgccgcggtgttggacgtactgctcaagcaaaaaacagacattcaaacggtcaaggtcgttggcctgctaaatctgctcagttcgttcttgatcttctcaagaatgctgagagcaatgctgaggtgaaaggtttggatgtagatgcccttttcatatcacacatccaagtgaaccaagcagcaaaacagaggcggagaacataccgtgctcacggaagaatcaacccttacatgtcaaacccatgtcacattgagttgattctttcagagaaagaggagcctgtgaagaaagagccggagactcagttggcagcgaagtcaaagaagggaacctcgtcttgatccttatagacttgtagttaccattatcacttcgtgttacagcgcttggtacattttgttcactttctgtaagacatgtaaccaaaattttaaaacacttaatgaagattagtttttggattaccaaagctttgatttactactttatttaagattattaattaaccaatacaaaaccttaagg

SEQ ID NO: 1659 - DNA, 691 bp, Brassica napus
gccatggtgaagtactcgcaagaaccggacaactccaccaaatcttgcaaggcgaggggagcagatcttagggtccacttcaagaacactagggaaacagcgcatgctataaggaagctacccttgatcaaggcgaagaggtacttggaagatgtgatagctcacaagcaagctatccccttcacacgtttctgccgtggtgttgggcgtactgctcaggcgaagaacaggcattcaaacggtcaaggtcgttggcctgccaagtctgctcagttcgttcttgatcttctcaagaatgctgagagcaatgctgaggtcaaagggttggatgttgatgcacttttcatttctcacatccaagtgaaccaagcagcaaagcagaggcggaggacataccgtgctcatggaagaattaatccttacatgtcaaacccatgccacattgagttgatattgtcggagaaggaagagcctgttaagaaagagccggagactcagttggccgccaagtccaaaaaaggagcctcgtcttgagcctagggactgtagttatcgtgtggtcacattgtgtgatacattttgttcacttttattattgtaagacaacgcagccgtttaaaaaacatgattgaattttggataacagaagcgttgactttatttacaaatcagtacaaaatcgtgaacttga

SEQ ID NO: 1660 - DNA, 638 bp, Brassica napus
catggtgaagtactcgcaagaacccgacaattccaccaaatcttgcaaggcgagaggagcagatctcagggtccacttcaagaacactagggaaacagcgcatgccatcagaaagctacccttgatcaaggcgaaaaggtacttggaagatgtgatagctcacaagcaagctatccccttcacacgtttctgtcgtggtgttggacgtactgctcaggcaaagaacaggcattcaaacggtcaaggtcgttggcctgccaagtctgctcagttcgttctcgatcttctcaagaatgctgagagcaatgctgaggtcaaagggttggatgttgatgcccttttcatttcgcacatccaagtgaaccaagcagcaaagcagaggcggaggacataccgtgctcatggaagaattaatccttacatgtcaaacccatgccacattgagttgatattgtcagagaaggaagagcctgtgaagaaagagccggagactaagttggccgccaagtccaaaaacggagcctcgtcttgagcctagggactgtagttatcgtgtggtcacattgtgtgatatattttgttcacttttattactgcaagacaacgcagccgattaaaaaacttaagaatatgattat

SEQ ID NO: 1661 - DNA, 713 bp, Cicer arietinum
cttcttcctcactgtctcctccctgaatcgtgtgtgtgcggaagaagtcatggtgaagtactccagagaacccgataatcccaccaaatcctgcaaagccagaggtgctgaccttagggtgcatttcaagaacactagggaaacagcgtttgccatcaggaagttgccattgacaaaagctaaaagatatttggaagatgttttggcccacaaacaggccattcctttcagacgcttttgtcgtggtgttggaaggactgcccaagctaagaacaggcattctaatgggcagggacgctggcctgtcaagtcagctaaattcattcttgatttgcttaagaatgccgagagtaatgctgaagtgaaaggtttggatgtcgatgctctatacgtatctcatgtccaggtcaaccaagctcaaaagcaaagacgtcgtacataccgtgctcacggaagaatcaatccctacatgtcatctccatgccacattgaactgattttatctgagaaggaagaagctgtccagaaagagcccgagtctcagttggcaaccaacaagaagaagtctcaagctctttgaagtggtgcttcatcataaattggatcttatagttgaggccctaattttctagtttatgagctgtttgaagtagcactctttcccttatttcccttatgtttgttatgagctgtttttgaattctgagcagcgg

SEQ ID NO: 1662 - DNA, 844 bp, Gossypium hirsutum
ggcacgagtaaaaaatcatcccttttatttgctaaagaaaccctagctacgcacctcgtctcttgcagcggtagggaaccaactgttaccaaacagcagcagcagccatggtgaagtactcaagagaaccggacaaccctactaaatcttgcaaagctaggggttctgaccttcgtgttcattttaagaatacacgagaaactgcctttgcaatccgaaagctacctttgacgaaggcaaaaaggtacttcgaagatgttattgcccacaagcaagcaattccattcaggcgcttctgtggtggagttgggcgaaccgcacaggctaagaatcgccattctaatggacaaggccgttggcctgtgaaatcagcaaaattcattctcgatttgctcaagaatgccgagagcaatgctgaggtgaaaggcttggatgtagattcacttatcgtatctcacatccaagtaaaccaagcacagaagcaaaggcgccgaacatatcgtgcacatggaagaattaacccctacatgtcttcaccgtgtcacattgaactgatcctgtctgagaaagaggaagccgtcaaaaaagagccggagactcagttggctccgaggaaatcaaagggtgcttcagtttaaactgctgagtgatggattgttagtcggaagcttttacaattttctttttgttgtctctgtaatgagaacagttttgtttacttcacaatggggtgcttaagacttagaagtttggagattcttggtttctatttaaagctatgctcatttcgcattgaatatcttaatactaaattaaatttatattgaaaaatccatcaaattaa

SEQ ID NO: 1663 - DNA, 964 bp, Vigna unguiculata
ggagtttgcttcgtccttcagcagttgctcttcttcaatcgcggaagaagtagaagaagaaggcagagccgtcatggtgaagtactccagagaacctgaaaatcccaccaagtcttgcaaggcaaggggcgcagacctcagagtgcatttcaagaacactagggagactgcatttgccatcaggaagttgcctctggttaaagctaaaagatacttggaggatgtattggcccacaaacaagctatccctttccgacgcttttgcagaggtgttgggaggacagctcaggccaaaaacagacactccaatggacaaggacgctggcctgtcaaatcagctaaattcatcctggatttgctgaagaatgccgagagtaatgctgaagtgaaaggtttggatgtagatgctctttatatttctcatatccaggttaatcaagcacagaagcaaagacgccgcacctacagagcccatggaagaatcaacccttatatgtcatctccttgccatattgagctgatattatctgagaaggaagagcctgtgaagaaagagccggagacacaattggcaactagcaagaagaagggtgctcttcgtagtggggcttcatcttaaattgctcttgatgctagttattgagggattcatcttcttagattatgtcagttttgaagatcgttttcattttttaaatttgaatatttgtgatgagccgcatttgaatgttgaacagcactttttgttgagcatactatgtttttagttaattgagccatgcaaaaattgagtacttcaaattcaaaaggtatttttgtttgggattttatttcgttaatgctgatcttctgtctaatctgttatttctgtttgtgacgaaccgtcttcccttctcattggtgtaatttttatattcttgtaattaaatatattttaaagagttttgtaaaaaaaaaaaaaaaa

SEQ ID NO: 1664 - DNA, 954 bp, Vigna unguiculata
ggaccctagtttgcttcgtccttcagcagttgctcttcttcaatcgcggaagaagtagaagaagaaggcagagccgtcatggtgaagtactccagagaacctgaaaatcccaccaagtcttgcaaggcaaggggcgcagacctcagagtgcatttcaagaacactagggagactgcatttgccatcaggaagttgcctctggttaaagctaaaagatacttggaggatgtattggcccacaaacaagctatccctttccgacgcttttgcagaggtgttgggaggacagctcaggccaaaaacagacactccaatggacaaggacgctggcctgtcaaatcagctaaattcatcctggatttgctgaagaatgccgagagtaatgctgaagtgaaaggtttggatgtagatgctctttatatttctcatatccaggttaatcaagcacagaagcaaagacgccgcacctacagagcccatggaagaatcaacccttatatgtcatctccttgccatattgagctgatattatctgagaaggaagagcctgtgaagaaagagccggagacacaattggcaactagcaagaagaagggtgctcttcgtagtggggcttcatcttaaattgctcttgatgctagttattgagggattcatcttcttagattatgtcagttttgaagatcgttttcattttttaaatttgaatatttgtgatgagccgcatttgaatgttgaacagcactttttgttgagcatactatgtttttagttaattgagccatgcaaaaattgagtacttcaaattcaaaaggtatttttgtttgggattttatttcgttaatgctgatcttctgtctaatctgttatttctgtttgtgacgaaccgtcttcccttctcattggtgtaatttttatattcttgtaattaaatatattttaaagagttttgta

SEQ ID NO: 1665 - DNA, 719 bp, Eschscholzia californica
aaaagggttttcccatactccaaaaaatctgtctcttcacagcagtttttgcctcaccagaataaaatttcaaaatcaaacaatggtgaagtattcaaaggaaccagataatcccaccaaatcttgcaaggctagaggatcagatcttagggttcattttaagaacacaagggagacagcgttttcaattagaaaattgcctcttatcaaagctaagaggtatttggaagatgtgttggctcacaaacaagccattcccttccgacgcttttgtggtggtgttggtaggaccgctcaagcaaaaaaccgtcattccaacggtcaaggacgttggcctgctaaatctgcaaaatttatccttgatttgctcaaaaatgccgagagcaatgctgatgtgaaaggtttggatgtggatacgctttacatttctcatattcaagtgaaccaagcacagaagcaaaggcgtagaacttaccgtgctcacggaagaatcaacccttatatgtcatctccttgccatattgagttgaccttatctgagaaggaagaaccagtgaagaaagaggctgacactcaattggcaccaaggaaatcaaagaaagttcttcgtagcggtgcttcatcttagaaagagaaaatagagatagtttgcgactattaggaaagaactgaacactttcagatactatttttccttttttcttgtattgaatttggaa

SEQ ID NO: 1666 - DNA, 807 bp, Primula obconica
tattccagagaaccggacaatcagaccaagtcttgcaaggcaaggggctctaatcttcgatgccatttcaagaacacaagggagactgcacatgctcttcgaaagatgcctctgaacaaggccaaaagctacttggaagatgttcttgctcacaagcaagcaattccatttacccgcttttgtcgaggtgttgggcgtactgcccaggctaagaaccgtcactcaaatggacaagggcgctggcctgccaaatctgcaaaatttgttcttgatttgctcaagaacgccgagagcaatgcagaagtgaaaggtttggatgttgattcgctttacatatcccacatccaggtgaaccaagcccaaaagcagaggcgtcgcacttaccgtgctcatggaaggattaacccttacatgtcatccccttgccacatcgagcttgttttgtcagagaaggaagaacctgtgaaaaaggagcctgagatgcaagtggcttcggcaaccaagaagaacaaagcttgaagcatttgcagtttctgttgttttgttctgtttttttagcgtttgttttcttttctgagagcgtttgtcttttgtgttgaattcttaaactggtttgaactcggtttcattgttttcgactattttggatccttctgaagttactttgcaattttatccatgaatttgctccctagaagccactcatattcaatgtcatttacttgtgttgaacttcatttctgtagtgtgattcgtcactatattatttttcttgtctaaaccattggaatgcatccttttttgtaa

SEQ ID NO: 1667 - DNA, 821 bp, Silene vulgaris
gagagagagagagaggcgcatcagagtccataaaccctaacaaaaatggtgaagtattccaaagaacccgagaatcctaccaaatcttgcaaagcaaggggctcagatctcaggtgtcatttcaagaacaccagggagacagcgttttccctcaggaagatgcctttggtgaaggccaagagatacttggaagatgttttggctcacaagcaggctattcctttccgccgtttctgtggtggtgttggccgaacagctcaagccaaggcgaggcactcaaacggtcagggacgttggcctgccaagtcagccaaatttatccttgatttgttgaaaaatgctgagagcaatgctgagatgaaaggattggatgttgactcactctacatctctcacatccaagtaaaccaggcccagaagcaaaggcgtcgtacataccgagctcacggaaggatcaatccctacatgtcccacccttgccacattgagttggtgttgtctgagaaggaagagccagttagaaaggaggctgagactcagttggctacaagcaaatcaaagaagtcgcaggcttaagtaggtgttgccttgagacgagttttgaggtttaatttgttatgatcttggattttgtagtcgtttggttatttataagaccgagtattttactttcttttggagccgctatgaaatttgactttttgtttgataccgttgatggtactgcacccgaaatcagcagcttggggttttgccaatgctttcaccttttcgttttgttattttaggcaattactttctctatcaaaattgcaagttat

SEQ ID NO: 1668 - DNA, 770 bp, Glycine max
aaactcattatattatataaactccgtcaatctttgtgacaagccaattctttgtgtaggtgctaaatccctagtaagccgccatggtgaagtactcaagggagcctgacaatccaaccaagtcttgcaaggctagaggcgccgaccttagggttcattttaagaacactagggaaactgcctttgcaatcaggaagttgcccttggttaaagctaaaaggtacttggaagatgttcttgcgcacaagcaggccattccgttcagacgtttctgtcgtggtgttggaaggacagctcaagcaaagaatagacactctaatggccaaggaaggtggcctgtcaagtcagcaaaattcatccttgatttgctcaaaaatgctgagagcaatgctgaagtgaaaggtttggatgttgatgcgctttacatttctcatatccaagtcaatcaagcacagaagcaaagacgccgaacataccgagcccatggaagaatcaatccttatatgtcatctccgtgccacatagagttgatattatctgaaaaagaagaacctgtgaagaaggagcccgagactaagttagcaacaagcaagaaatcccaagctcttcgaagtggcacttcatcttagattaccactaaattgtttgaggcccaatattcctagattatgtcaagtggagagttttgtttgtttgttttatttttgttatggtttggtatgagtttcatactatgcttcaaattaatgagttaattgaaaacttagtat

SEQ ID NO: 1669 - DNA, 972 bp, Glycine max
ccattatatataaagcgaataactgctaattatgccctagtttgcttcttcccttagccgttgctctgcttcaacattgcggaagcagaagaagcgccgcagctatggtgaagtactccagagaacccgacaatcccaccaagtcctgcaaggccagaggcgctgacctcagagttcattttaagaacactagggagactgcctttgccatcaggaagttgccccttgttaaagctaaacgatacttagaggatgttttggcccacaaacaggctattcctttccgacgcttttgtggtggtgttgggaggacggcccaggctaagaacagacactccaatgggcaaggacgctggcccgtcaaatcagctaagttcattctagatttgctgaagaatgctgagagtaatgctgaagtgaaaggtttggatgtcgatgctctgtacatttctcatatccaggttaatcaagcacagaagcaaagacgccgcacctacagagctcatggaagaatcaacccttacatgtcatctccatgccacattgagctgatattatctgagaaggaagagccggtgaagaaggaggctgagactcaattggcaacaagcaagaagaagggcgctcttcgaagtggtgcttcatcttaaattacccttgaagctactggatgaccttcattcctgatttatgtcagttttgtctatcgttttcctttatatttgttatgagctgcttttgaagcttggacagcaccttttgcttggtatactatgtttcaagttaattgagttactcgggaatttttattatggtaattggatgattaattttagtttcaattctgtggatccctgctgctgggaatttacggaagtagaatcttgttcagaagatgcatcttttagacattggagagcaattgggctaacataacacaaccagtaataatactttattgacggcaatgtt

SEQ ID NO: 1670 - DNA, 704 bp, Brassica juncea
gcagccgattcttctgttagccgcagccatggtgaagtactcgcaagaacccgataaccaaaccaagtcttgcaaggctagaggatccgatcttagggttcacttcaagaacactagggaaacagcgcacgctatcaggaagctaccattgctcaaggccaagaggtaccttgaggatgtgatagctcacaagcaggcaatccccttcacccgtttctgcagaggtgttggaaggactgctcaagctaagaacaggcactccaacggtcaaggacgttggcctgctaaatctgctcagttcgttcttgatttgctcaagaatgctgagagcaatgctgaggtgaaaggtttggatgttgatgcccttttcatttcacacatccaagtgaaccaggctgcaaagcagaggagaaggacttaccgtgctcatggaagaatcaacccttacatgtcaaacccatgccacattgaattgattctgtcagagaaggaagagtctgtcaagaaagagccggagacacagttggcagccaagtctaagaaatcatccgcttaagctttgttatctttttaatttctcgtttttttgttcttagaaagagattttgttccctttcctccatctttgtaagacaatggatagagtttcttggattttcatccattgttgctcgtatgaatcattaatcatggttactatgatc

SEQ ID NO: 1671 - DNA, 565 bp, Brassica juncea
agccgattcttctgttagccgcagccatggtgaagtactcgcaagaacccgataaccaaaccaagtcttgcaaggctagaggatccgatcttagggttcacttcaagaacactagggaaacagcgcacgctatcaggaagctaccattgctcaaggccaagaggtaccttgaggatgtgatagctcacaagcaggcaatccccttcacccgtttctgcagaggtgttggaaggactgctcaagctaagaacaggcactccaatggtcagggacgttggcctgctaagtctgctcagttcgttcttgacttgctcaagaatgctgagagcaatgctgaggtgaaaggtttggatgttgatgcgctctttatttcgcacattcaagtgaaccaggctgcaaagcagaggagaaggacttaccgtgctcacggaagaatcaacccttacatgtcaaacccatgccacattgagttgattttgtctgagaaggaagagtctgtcaagaaagagccggagacgcagttggcagccaagtcaaagaaatcatccgcttaagctttctttgc

SEQ ID NO: 1672 - DNA, 647 bp, Brassica juncea
ggccgccgatttcttccgttagccgcagccatggtgaagtactcgcaagaacccgataaccagaccaagtcttgcaaggctagaggatccgatcttagggttcacttcaagaacactagggaaacagcgcacgctatcaggaagctaccattgctcaaggccaagaggtaccttgaggatgtgatagctcacaagcaagctattcctttcacccgtttctgtagaggtgttggaaggactgctcaagctaagaacaggcattccaatggtcaaggacgttggcctgctaaatctgctcagttcgttcttgatctgctcaagaacgctgagagcaatgctgaggtgaaaggtttggatgttgacgcgctcttcatttcgcatatccaagtgaaccaggctgctaaacaaaggagaaggacttatcgtgctcatggaagaatcaacccttacatgtccaacccatgccacattgagttaattttgtcagagaaggaagagtctgtcaagaaagagccggagacgcagttggcagccaagtcgaagaaatcaagtgcttaagctttcgttattttctgtttcttcttttgtcttattgaaagagattttgttcccttttctctccatcttctcaaaagacaatggataga

SEQ ID NO: 1673 - DNA, 789 bp, Brassica juncea
tacgcgggggcagccaattcttccgtttagcagccatggtgaagtactcgcaagaacccgacaatcagaccaagtcttgcaaggctagaggttccgaccttagggttcacttcaagaacactcgtgaaacagcgcacgccatcaggaagctaccactgctcaaggcgaagaggtaccttgaagatgtgatagctcacaagcaagctattcccttcacccgtttctgcagaggtgttggaaggactgcccaagctaagaacaggcactctaatggtcagggacgttggcctgcgaaatctgctcagttcgttcttgatttgctcaagaacgctgagagcaatgctgaggtgaaaggtttggatgttgatgccctcttcatatcacacatccaagttaaccaggctgcaaagcaaaggagaaggacttaccgtgcacacggaagaatcaatccttacatgtccaacccatgtcacattgagttgattttgtctgagaaagaagagtctgtcaagaaagagccggagacccagttggcagccaagtcaaagaaatcagcagcttaagctttctttgtttcttttagtctctcctttttgtgttgttgaaagaggttttgttccgtttttctcgatctttgcaagacaatagatgtactttcttggatcttttgttcaacgttgctgtttgatggttagtattacccaatctatctttactagttctgctaactttatatcctgcttggtgtcactagacactgtattctatgtccaagtctttgttttcagc

SEQ ID NO: 1674 - DNA, 700 bp, Brassica juncea
gcagccgattcttctgttagccgcagccatggtgaagtactcgcaagaacccgataaccaaaccaagtcttgcaaggctagaggatccgatcttagggttcacttcaagaacactagggaaacagcgcacgctatcaggaagctaccattgctcaaggccaagaggtaccttgaggatgtgatagctcacaagcaggcaatccccttcacccgtttctgcagaggtgttggaaggactgctcaggctaagaacaggcactccaacggtcaaggacgttggcctgctaaatctgctcagttcgttcttgatttgctcaagaatgctgagagcaatgctgaggtgaaaggtttggatgttgatgccctcttcatttcacacatccaagtgaaccaggctgcaaagcagaggagaaggacttaccgtgctcatggaagaatcaacccttacatgtctaacccatgccacattgagttgattctgtcagagaaggaagagtctgtcaagaaagagccggagtcgcagttggcagccaagtcgaagaaatcaagtgcttaagttttcgttattttcagtttcttcgttgtcttattgaaagagattttgttcccttctctctccatcatctgaagacaatggatagagttaaatgttggccttatgaatcattaatcattgttactgaagtcattccatctttaa

SEQ ID NO: 1675 - DNA, 728 bp, Brassica juncea
agggcagccaattctcccatttagcagccatggtgaagtactctcaagaacccgacaatcagaccaagtcttgcaaggctagaggatccgaccttagggttcacttcaagaacacccgtgaaacagcgcacgccatcaggaagctaccattgctcaaggcgaagaggtaccttgaagatgtgatagctcacaagcaagccattcccttcacccgtttctgcagaggtgttggaaggactgcccaagctaagaacaggcactctaacggtcaaggacgttggcccgcgaaatctgctcagttcgttcttgatctgcttaagaacgctgagagcaatgctgaggtgaaaggtttggatgtggatgccctcttcatatcacacatccaagtgaaccaggctgcaaagcaaaggagaaggacttaccgtgcccacggaagaatcaatccttacatgtcaaacccatgccacattgagttgattttgtctgagaaagaagagtctgtcaagaaagagccagagacgcagttggcagccaagtctaagaaatcagcagcttaagctttctttgtttttttttagtctctcctttttgtgttgttgaaagagattttgtttcatttttctccatctttgcaagacgttagatatgttttttgttggatcttttgttcagtgttgctgtttgatgatggttagtattattcattcgaatttttctgaaaaaaaaaa

SEQ ID NO: 1676 - DNA, 776 bp, Brassica juncea
attcgttacacttctctcatcgtttctgcagccaattctcccatttagcagccatggtgaagtactctcaagaacccgacaatcagaccaagtcttgcaaggctagaggatccgaccttagggttcacttcaagaacacccgtgaaacagcgcacgccatcaggaagctaccattgctcaaggcgaagaggtaccttgaagatgtgatagctcacaagcaagccattcccttcacccgtttctgcagaggtgttggaaggactgcccaagctaagaacaggcactctaacggtcaaggacgttggcccgcgaaatctgctcagttcgttcttgatctgcttaagaacgctgagagcaatgctgaggtgaaaggtttggatgtggatgccctcttcatatcacacatccaagtgaaccaggctgcaaagcaaaggagaaggacttaccgtgcccacggaagaatcaatccttacatgtcaaacccatgccacattgagttgattttgtctgagaaagaagagtctgtcaagaaagagccagagacgcagttggcagccaagtctaagaaatcagcagcttaagctttctttgttttttttagtctctcctttttgtgttgttgaaagagattttgtttcatttttctccatctttgcaagacgttagatatgttttttgttggatcttttgttcagtgttgctgtttgatgatggttagtattattcattcgaatttttctagttccgctaagcttatatcctgcttggtgtcagta

SEQ ID NO: 1677 - DNA, 668 bp, Brassica juncea
agccgcagccatggtgaagtactcgcaagaacccgacaaccagaccaagtcttgcaaggctagaggatccgatcttagggtccacttcaagaacactcgcgaaacagcgcacgccatcaggaagctaccattgctcaaggccaagaggtaccttgaggatgtgatagctcacaagcaggcgatccccttcacccgtttctgcagaggtgttggaaggactgctcaagccaagaacaggcactccaatggtcagggacgttggcctgctaagtctgctcagttcgttcttgatttgctcaagaacgctgagagcaacgctgaggtgaagggtttggatgttgatgcgctcttcatttcgcacattcaagtgaaccaggctgcaaagcagaggagaaggacttaccgtgctcacggaagaatcaacccttacatgtccaacccatgtcacattgagttgattctgtcagagaaggaagagtctgtcaagaaagagccggagacccagttggcagccaagtcgaagaaatcaactgcttaagctttcgtttattttcagtatctttttttttgtgttcctgaacgagattttgttcccttttctccatattttcaagacaatggatagagttaaatgttggtcttatgaatcattaatcatggttactaga

SEQ ID NO: 1678 - DNA, 674 bp, Brassica juncea
gtatcttctgttagccgcagccatggtgaagtactcgcaagaacccgacaaccagaccaagtcttgcaaggctagaggatccgatcttagggtccacttcaagaacactcgcgaaacagcgcacgccatcaggaagctaccattgctcaaggccaagaggtaccttgaggatgtgatagctcacaagcaggcgatccccttcacccgtttctgcagaggtgttggaaggactgctcaagccaagaacaggcactccaatggtcagggacgttggcctgctaagtctgctcagttcgttcttgatttgctcaagaacgctgagagcaacgctgaggtgaagggtttggatgttgatgcgctcttcatttcgcacattcaagtgaaccaggctgcaaagcagaggagaaggacttaccgtgctcacggaagaatcaacccttacatgtccaacccatgtcacattgagttgattctgtcagagaaggaagagtctgtcaagaaagagccggagacccagttggcagccaagtcgaagaaatcaactgcttaagctttcgtttattttcagtatctttttttttgtgttcctgaacgagattttgttcccttttctccatattttcaagacaatggatagagttaaatgttggtcttatgaatcattaatcatggtt

SEQ ID NO: 1679 - DNA, 747 bp, Brassica juncea
agccgcagccatggtgaagtactcgcaagaacccgacaatcagaccaagtcttgcaaggctagaggatccgatctcagggttcacttcaagaacactagggaaacagcgcacgctatcaggaagctaccattgctcaaggccaagaggtaccttgaggatgtgatagctcacaagcaggctattcctttcacccgtttctgcagaggtgttggaaggactgcccaagctaagaacaggcactccaatggtcaaggacgttggcctgctaaatctgctcagttcgttcttgatttgctcaagaacgctgagagcaatgctgaggtgaaaggtttggatgttgatgccctcttcatatcacacatccaagtgaaccaggctgcaaagcaaaggagaaggacttaccgtgcccacggaagaatcaatccttacatgtccaacccatgtcacattgagttgattttgtctgagaaggaagagtctgtcaagaaagagccggagactcagttggcagccaagtcgaagaaatcatctgcctaagctttctttgttatttagcttctactttttgtgttcttgaaagagattttgatcccttgtctctctatctttgcaagacaatggatagattttctttgattgttcaatgttatgaaactatcaatctttgtgctggcagtattttattctatcttaatatttttgctaaaaaaaaaaatatattatggtgtgtgcgtttttctttcttt

SEQ ID NO: 1680 - DNA, 703 bp, Brassica juncea
agccgcagccatggtgaagtactcgcaagaacctgacaatcagaccaagtcttgcaaggctagaggatccgatcttagggttcacttcaagaacactcgggaaacagcgcacgctatcaggaagctaccattgctcaaggccaagaggtaccttgaggatgtgatagctcacaagcaggcgatccccttcacccgtttctgcagaggtgttggaaggactgctcaagctaagaacaggcactccaatggtcagggacgttggcctgctaagtctgctcagttcgttcttgacttgctcaagaatgctgagagcaatgctgaggtgaaaggtttggatgttgatgcgctctttatttcgcacattcaagtgaaccaggctgcaaagcagaggagaaggacttaccgtgctcacggaagaatcaacccttacatgtccaacccatgtcacattgagttgattttgtctgagaaggaagagtctgtcaagaaagagccggagactcagttggcagccaagtcgaagaaatcatctgcctaagctttctttgttatttagcttctactttttgtgttcttgaaagagattttgatcccttgtctctctatctttgcaagacaatggatagattttctttgattgttcaatgttatgaaactatcaatctttgtgctggcagtattttattctatcttaatatttttg

SEQ ID NO: 1681 - DNA, 686 bp, Brassica juncea
gttagccgcagccatggtgaagtactcgcaagaacccgataaccagaccaagtcttgcaaggctagaggatccgatcttagggttcacttcaagaacactagggaaacagcgcacgctatcaggaagctaccattgctcaaggctaagaggtaccttgaggatgtgatagctcacaagcaggctattcccttcacccgtttctgcagaggtgttggaaggactgctcaggctaagaacaggcactccaacggtcaaggacgttggcctgctaaatctgctcagttcgttcttgatttgctcaagaatgctgagagcaatgctgaggtgaaaggtttggatgttgatgcactcttcatttcacacatccaagtgaaccaggctgcaaagcagaggagaaggacttaccgtgctcatggaagaatcaacccttacatgtcaaacccatgccacattgagttgattttgtcagagaaggaagagtctgtcaagaaagagccggagacacagttggcagccaagtcgaagaaatcatctgcctaagctttctttgctattttagtttctcccttttttgtgttctcttgaaagagattttgttccctttttctctcatctctgcaaagacaatggataaattttcttggattatatttcagtgttggtgttatgaaattattaatctttg

SEQ ID NO: 1682 - DNA, 691 bp, Brassica oleracea
gcagccatggtgaagtactctcaagaacccgacaaccagaccaagtcttgcaaggctagaggatccgatcttagggttcacttcaagaacactcgggaaacagcgcacgctatcaggaagctaccattgctcaaggccaagaggtaccttgaggatgtgatagctcacaagcaggctattcccttcacccgtttctgcagaggtgttggaaggactgctcaagccaagaacaggcactccaatggtcagggacgttggcctgctaagtctgctcagttcgttcttgatttgctcaagaacgccgagagcaatgctgaggtgaaaggtttggatgttgatgcgctcttcatttcgcacattcaagtcaaccaggctgcaaagcagaggagaaggacttaccgtgctcacggaagaatcaacccttacatgtccaacccatgccacattgagttgattctgtcagagaaggaagagtctgtcaagaaagagccggagacccagttggcagccaagtcgaagaaatcaactgcttaagctttcgtttattttcagtatctttttttgtgttcctgaacgagattttgttcccttttctccatattatcaagacaatggatagagttcaatgtgggtcttatgaatcattaatcatggttactagaatctttctatctaaatcattctatttacc

SEQ ID NO: 1683 - DNA, 636 bp, Brassica oleracea
gaatcgcttctgcagccgtttccttccgttagccgcagccatggtgaagtactcgcaagaacctgacaatcagaccaagtcttgcaaggctagaggatccgatcttagggttcacttcaagaacactcgggaaacagcgcacgctatcaggaagctaccattgctcaaggccaagaggtaccttgaggatgtgatagctcacaagcaggctattcccttcacccgtttctgcagaggtgttggaaggactgcccaagctaagaacaggcactccaatggtcaaggacgttggcctgccaagtctgctcagttcgttcttgatttgctcaagaacgctgagagcaatgctgaggtgaaaggtttggatgttgatgcgctcttcatttcgcacattcaagtgaaccaggctgcgaaacaaaggagaaggacataccgtgctcatggaagaatcaacccttacatgtccaacccatgtcacattgagctgattttgtctgagaaggaagagtctgtcaagaaagagccggagactcagttggcagccaagtcgaagaaatcatctgcctaagctttctttgttttttagcttctactttttgtgttcctgaaagagattttgatcccttgtctctccat

SEQ ID NO: 1684 - DNA, 705 bp, Brassica oleracea
ggcagccaattctcccgtttagcagcaatggtgaagtactctcaagaacccgacaatcagaccaagtcttgtaaggctagaggatccgaccttagggttcacttcaagaacacccgtgaaacagcgcacgccatcaggaagctaccattgctcaaggcgaagaggtaccttgaagatgtgatagctcacaagcaagccattcccttcacccgtttctgcagaggtgttggaaggactgcccaagccaagaacaggcactctaatggtcagggacgttggcctgcgaagtctgctcagttcgttcttgatttgcttaagaacgctgagagcaatgctgaggtgaaaggtttggatgttgatgccctcttcatatcacacatccaagtgaaccaggccgcaaagcaaaggagaaggacttaccgtgcccacggaagaatcaatccttacatgtcaaacccatgccacattgagttgattttgtctgagaaagaagagtctgtcaagaaagagccggagacgcagttggcagctaagtctaagaaatcagcagcttaagctttctttgttttttttagtctcctttttgtgttgttgaaagagattttgtttcatttttctccatcttgtcaagacgatagatatgttttttgttggatcttttgttcagtgttgctgtttgatgatggttactagttccgctaagtt

SEQ ID NO: 1685 - DNA, 2547 bp, Brassica rapa
ttttgcacatatatagtctcttcacaactatttctctatctcttcttctgttagccgcagccatggtgaagtactcgcaagaacccgacaaccagaccaagtcttgcaaggctagaggatccgatcttagggttcacttcaagaacactcgggaaacagcgcacgccatcaggaagctaccattgctcaaggccaagaggtaccttgaggatgtgatagctcacaagcaggctattcccttcacccgtttctgcagaggtgttggaaggactgctcaagctaagaacaggcactccaatggtcagggacgttggcctgctaagtctgctcagttcgttcttgatttgctcaagaatgctgagagcaatgctgaggtgaaaggtttggatgttgatgcgctcttcatttcgcacattcaagtcaaccaggctgcaaagcagaggagaaggacttaccgtgctcacggaagaatcaatccttacatgtccaacccatgtcacattgagttgattctgtcggagaaggaagagtctgtcaagaaagagccggagacccagttggcagccaagtcgaagaaatcatctgcctaagctctcgtttattttcagtatcttttttttttgttttcctgaacgagattttgttcccttttctccatattctcaagacaatggatagagttaaatgttggtcttatgaattattaatcatggttactagaatctttctatctaaatcattctatttaccattcttctatgttatgttatgaccttcgatggtgtaagaattgctcattagaaagtgaactggtaacatgaagtgttggtacttagtatgtgcaacaaatgagcatcaaaagtaaaatctattttgctttgctaagtttctccgcttctaagtttttactaaagattttctcatttactttgtccctttcgttctttatacaaaagacttgttcgtgaaaatagacactgactccgtggatcttctcatcatctttctttctcgttctcaatggcttggacaattgggtcgtcctctatgtccaagtcgctctcttcatcttcgtactcgtctagttcactaatcattgtttgtttaaccttcttcctcgactctctcctatgtttcttcggctgtagccttggttcagcttgtttcacacccattcctcccactttttacctaacatcgccttcccttttggttccaaaagtcctgagttgaaactcctccctgactcttatctcatctagcagttgtaggtagtaaggatacctttcccactctcctttcactacacatcctggttctccgatatgcaagcaatctttgaatccacatttctcttcctctatcattttccttatctaagcaaaaaaaaagagagagtcaaataatccatccttcacaatcagtctacatgcgaaatgagcacaagacaaaaggtacaaacctcagggaaacacaaggcaagtgaatgcttggttactttcagcaaactaggctggttaaaaccaggagtatcagcgagataaccaccttcagtaatcggcagcagcgacacattcctcgttgtgtgtttgcctctaccactcctagttgaaacttcaccaactcgctgatcttcaaaccacttattacctcttacaggctcaaaccaattctcttcttcaacgtcaccaccaccagagctgctcctcaatatgttgatcaaactcgactttccaacaccactaggtccaacaatcacagaagtctgattcctcaagacgaacgcaatcgcatcaagcccctctttagttcccacactgcaaaagaacggttcatagttccatccacgcagtctcatcttccaagattccaattcctcttcggtgatgagttcacatttgttcaaggcaagagtgagtggaatcccagtggactcagcctccaccaagaacctagtgagagtaaacggttcaagcttgggctgatcaagcgagaaaagaacaagcaagtgatcaacattcgccaccggaggatcaagaatctcggaccgccgctggaacacattctcaatcatccctctccgatcaacccaatcgattgaccccacgagaaccttatccccaaccagcactctcctccttatcttcttcagcactgctctcaccacgcagagcagctcaactccgtccttagacgacgacgaagaagaagaacgatcgtctccctctccgtctcggtccttgacgacgacgcgcatgaagttcgcctgagcggtggcgacggtgccgatggcctgagaaggtaagagcgaaggattgtggtcgggagagagaacgggagctaaggaggagtggtctttgccgatgtgcttggctctgagcatgtttttgctcggctggggttttctgaagacatcggggttgtctcgtcgagctgagagtgtgaggagatggaagctgcggcggaatccgattccgattccgagtcgagctccgtgtccgccgtggtgaatcgccgcgcgacggaggaagagaggagaagagtggc

SEQ ID NO: 1686 - DNA, 864 bp, Brassica rapa
attcgttacacttctctcatcgtttctgcagccaattctcccatttagcagccatggtgaagtactctcaagaacccgacaatcagaccaagtcttgcaaggctagaggatccgaccttagggttcacttcaagaacacccgtgaaacagcgcacgccatcaggaagctaccattgctcaaggcgaagaggtaccttgaagatgtgatagctcacaagcaagccattcccttcacccgtttctgcagaggtgttggaaggactgcccaagctaagaacaggcactctaacggtcaaggacgttggcccgcgaaatctgctcagttcgttcttgatctgcttaagaacgctgagagcaatgctgaggtgaaaggtttggatgtggatgccctcttcatatcacacatccaagtgaaccaggctgcaaagcaaaggagaaggacttaccgtgcccacggaagaatcaatccttacatgtcaaacccatgccacattgagttgattttgtctgagaaagaagagtctgtcaagaaagagccagagacgcagttggcagccaagtctaagaaatcagcagcttaagctttctttgtttttttttagtctctcctttttgtgttgttgaaagagattttgtttcatttttctccatctttgcaagacgttagatatgttttttgttggatcttttgttcagtgttgctgtttgatgatggttagtattattcattcgaatttttctagttccgctaagcttatatcctgcttggtgtcagtagacattcttttgctcgatctttcatgtccccgtcttggtcttctcctaccaattcgtctggttaaagccaggatgtatcaaccttgg

SEQ ID NO: 1687 - DNA, 786 bp, Brassica rapa
aatgccgttttcgcactataaagtctcttcacaactttactcgaatcgcttctgcagccgtttccttccgttagccgcagccatggtgaagtactcgcaagagcctgacaatcagaccaagtcttgcaaggctagaggatccgatcttagggttcacttcaagaacactcgggaaacagcgcacgctatcaggaagctaccattgctcaaggccaagaggtaccttgaggatgtgatagctcacaagcaggctattcccttcacccgtttctgcagaggtgttggaaggactgctcaagctaagaacaggcactccaatggtcagggacgttggcctgctaagtctgctcagttcgttcttgatttgctcaagaatgctgagagcaatgctgaggtgaaaggtttggatgttgatgcgctcttcatttcgcacattcaagtgaaccaggctgcaaagcagaggagaaggacttaccgtgctcatggaagaatcaacccttacatgtccaacccatgtcacattgagttgattttgtctgagaaggaagagtctgtcaagaaagagccggagactcagttggcagccaagtcgaagaaatcatctgcctaagctttctttgttttttagtttctactttttgtgttcttgaaagagattttgatcccttgtctctccatctttgcaagacaatggatagattttcttggattattcaatgttatgaaactattaatctttgtgctggcagtattttattctatcttaatattatttgctaaatttct

SEQ ID NO: 1688 - DNA, 759 bp, Ocimum basilicum
ggacgacccttaatctctggttttgccgcccgtatcaggagcagcgacaatggtgaagtactccagagagccagacaattccaccaattcctgcaaggctaggggatctgatctccgagttcacttcaagaacactcgggagactgctcacgctatcagaaagcttcctctgatcaaggccaagaggtatctggaggatgtactcgcccacaagcaggcaataccatttacccgattttgtggaggtgtcggacgaactgctcaagcaaagaacagacactccaatggacagggccgttggcctgtgaagtctgctaagttcatcttggatttgcttaagaatgctgaaagcaatgctgaggtgaaaggcttggatgtggatgcgctctacatttctcacattcaggttaaccaggcacagaaacagaggcgccgcacataccgtgctcacggaagaatcaacccgtacatgtcttcgccttgccacattgagttgattctgtctgaaaaggtggagtccgtgaaaaaagagcccgagtctcagttggcaactagcaaaccgggtaaggcttgatcttgtagtgaatgaccagatcatatagttggacaagttttgagaaaactgtgtgcctcatatcctatcctcttttctttctacatatggatttttttatcaactttccatttttgaggaatattggatttattgaatcccattgttaccttatttcagatttgggttaatgcttctctgagttt

SEQ ID NO: 1689 - DNA, 671 bp, Brassica napus
cccatttagcagccatggtgaagtactctcaagaacccgacaatcagaccaagtcttgcaaggctagaggatccgaccttagggttcacttcaagaacacccgtgaaacagcgcacgccatcaggaagctaccattgctcaaggcgaagaggtaccttgaagatgtgatagctcacaagcaagccattcccttcacccgtttctgcagaggtgttggaaggactgcccaagctaagaacaggcactctaatggtcaaggacgttggcccgcgaaatctgctcagttcgttcttgatttgcttaagaacgctgagagcaatgctgaggtgaaaggtttggatgttgatgcccttttcatatcacacatccaagtcaaccaggctgcaaagcaaaggagaaggacttaccgtgcccacggaagaatcaatccttacatgtcaaacccatgccacattgagttgattttgtctgagaaagaagagtctgtcaagaaagagccggagacgcagttggcagccaagtctaagaaatcagcagcttaagctttctttgttttttttagtctcctttttgtgttgttgaaagagattttgtttcatttttctccatctttgcaagacgatagatatgttttttgttggatcttttgttcagtgctgctgtttgatgat

SEQ ID NO: 1690 - DNA, 724 bp, Brassica napus
ccgtttccttccgttagccgcagccatggtgaagtactcgcaagaacctgacaatcagaccaagtcttgcaaggctagaggatccgatcttagggttcacttcaagaacactcgggaaacagcgcacgctatcaggaagctaccattgctcaaggccaagaggtaccttgaggatgtgatagctcacaagcaggctattccctttacccgtttctgcagaggtgttggaaggactgctcaagctaagaacaggcactccaatggtcaaggacgttggcctgctaagtctgctcagttcgttcttgatttgctcaaaaacgccgagagcaatgctgaggtgaaaggtttggatgttgatgcgctcttcatttcgcacattcaagtgaaccaggctgcgaaacaaaggagaaggacttaccgtgctcacggaagaatcaacccttacatgtccaacccatgtcacattgagctgattttgtctgagaaggaagagtctgtcaagaaagagccggagactcagttggcagccaagtcgaagaaatcatctgcctaagcttttttttttttttagcttctactttttgtgttcctgaaagagattttgatcccttgtctctccatctttgcaagataatggatagattttcttggattattcaatgttatgaaactattaatctttgtgctggtagtattttattctatcttaatatttttgacctga

SEQ ID NO: 1691 - DNA, 964 bp, Brassica napus
gggcagccaattctcccgtttagcagcaatggtgaagtactctcaagaacccgacaatcagaccaagtcttgtaaggctagaggatccgaccttagggttcacttcaagaacacccgtgaaacagcgcacgccatcaggaagctaccattgctcaaggcgaagaggtaccttgaagatgtgatagctcacaagcaagccattcccttcacccgtttctgcagaggtgttggaaggactgcccaagccaagaacaggcactctaatggtcagggacgttggcctgcgaagtctgctcagttcgttcttgatttgcttaagaacgctgagagcaatgctgaggtgaaaggtttggatgttgatgccctcttcatatcacacatccaagtgaaccaggccgcaaagcaaaggagaaggacttaccgtgcccacggaagaatcaatccttacatgtcaaacccatgccacattgagttgattttgtctgagaaagaagagtctgtcaagaaagagccggagacgcagttggcagctaagtctaagaaatcagcagcttaagctttctttgtttttttagtctcctttttgtgttgttgaaagagattttgtttcatttttctccatcttgtcaagacgatagatatgttttttgttggatcttttgttcagtgttgctgtttgatgatggttactagttccgctaagtttataccccgtcttggtcttctccttccaactcgtctggttaaagccaggatgtatcaaccttaagagactggtagtagtgacaggattgaggctttatgtcatcttccacttgttgaaacttcattaactcagctgttcttcggatcacttattaccaattatctgaatatgacagaatggtccagccattttagacgatttcttatctttaatgtcatatggttagcaagacatcaattttatatatattattaaaat

SEQ ID NO: 1692 - DNA, 739 bp, Brassica napus
tcgaatcgcttctgcagccgtttccttccgtcagccgcagccatggtgaagtactcgcaagagcctgacaatcagaccaagtcttgcaaggctagaggatccgatcttagggttcacttcaagaacactcgggaaacagcgcacgctatcaggaagctaccattgctcaaggccaagaggtaccttgaggatgtgatagctcacaagcaggctattcccttcacccgtttctgcagaggtgttggaaggactgctcaagccaagaacaggcactccaatggtcagggacgttggcctgctaagtctgctcagtttgttcttgatttgctcaagaatgctgagagcaatgctgaggtgaaaggtttggatgttgatgcgctctttatttcgcacattcaagtgaaccaggctgcaaagcagaggagaaggacttaccgtgctcatggaagaatcaacccttacatgtccaacccatgtcacattgagctgattttgtctgagaaggaagagtctgtcaagaaagagccggagactcagttggcagccaagtcgaagaaatcatctgcctaagctttctttgttttttagtttctactttttgtgttcttgaaagagattttgatcccttgtctctcctgtctttgcaagacaatggatagattttcttggattattcaatgttatgaaactatttgtctttgtgctggcagtattttattctatcttaatatttttgcta

SEQ ID NO: 1693 - DNA, 677 bp, Brassica napus
cgttagccgcagccatggtgaagtactcgcaagaacctgacaatcagaccaagtcttgcaaggctagaggatccgatcttagggttcacttcaagaacactcgggaaacagcgcacgctatcaggaagctaccattgctcaaggccaagaggtaccttgaggatgtgatagctcacaagcaggcgatccccttcacccgtttctgcagaggtgttggaaggactgctcaagctaagaacaggcactccaatggtcaaggacgttggcctgctaagtctgctcagttcgttcttgatttgctcaagaatgctgagagcaatgctgaggtgaaaggtttggatgttgatgcgctattcatttcgcatatccaagtgaaccaggctgctaagcagaggagaaggacttaccgtgctcatggaagaatcaacccttacatgtccaacccatgtcacattgagttgattttgtcagagaaggaagagtctgtcaagaaagagccggagactcagttggcagccaagtcgaagaaatcatctgcctaagctttctttgttttttggtttctactttttgtgttcctgaaagagattttgatccctttgcaagacaatggatagattttcttggattattcaatgttatgaaactattaatctttgtgctggcagtattttatt

SEQ ID NO: 1694 - DNA, 698 bp, Brassica napus
cgggggcagccaactctcccatttagcagccatggtgaagtactctcaagaacccgacaatcagaccaagtcttgcaaggctagaggatccgaccttagggttcacttcaagaacacccgcgaaacagcgcacgccatcaggaagctaccattgctcaaggcgaagaggtaccttgaagatgtgatagctcacaagcaagccattcccttcacccgtttctgcagaggtgttggaaggactgcccaagctaagaacaggcactctaacggtcaaggacgttggcccgcgaaatctgctcagtttgttcttgatttgcttaagaacgctgagagcaatgctgaggtgaaaggtttggatgtggatgccctcttcatatcacacatccaagtgaaccaggctgcaaagcaaaggagaaggacttaccgtgcccacggaagaatcaatccttacatgtcaaacccatgccacattgagttgattttgtctgagaaagaagagtctgtcaagaaagagccggagacgcagttggcagccaagtctaagaaatcagcagcttaagctttctttgttttttttagtctctcctttttgtgttgttgaaagagattttgtttcatttttctccatctttgcaagacgatagatatgttttttgttggatcttttgttcagtgttgctgtttgatgatggttagta

SEQ ID NO: 1695 - DNA, 767 bp, Centaurea maculosa
gaagcaatcaatcagcagcagcagccatggttaagtattcgaaggagccagaaaaccctaccaaatcctgcaaagccaggggatcggatctcaggtgtcatttcaagaacactcgagaaactgcccatgctatccgtaagttgcctttaatcaaggctaaaagatacctggaggatgttttggttcacaaacaagccattccattcacccgtttttgccgtggagttgggcgtaccgcacaagcgaagaaccgtcattccaatggacaagggcgttggcctgctaagtctgccaagtttatcttggacttgctaaagaatgcagagagcaacgcagaagtcaaggggttggatgtggatgctcttcacatctctcacatccaggttaaccaagctcagaaacagagacgccgcacataccgtgctcatggaagaattaacccctacatgtcttccccgtgccatattgaactcactttgtccgagaaagaagagcctgttaaaaaggagcctgagactcagttggctcctagaaccaagaagaatcaagcttaagtaagagagaacttttggagtcatagtttgtttggtggtagaaagaaattctggttttgttttgttttgatttgtaatctcaaaaacttgtttccattttcaaagattcttcttatccaatgccctattatgagattatcatgcttcatcaagttaaaatattgaattagacatttttgtttcaaggctgatttcattgcctgattttgccat

SEQ ID NO: 1696 - DNA, 766 bp, Cirsium arvense
gcgaagcaatcaatcagcagcagcagcagccatggttaagtattcgaaggagccagaaaaccctaccaaatcctgcaaagccaggggatcggatctcaggtgtcatttcaagaacactcgagaaactgcccatgctatccgtaagttgcctttaatcaaggctaaaagatacctggaggatgttttggttcacaaacaagccattccattcacccgtttctgccgtggagttgggcgtaccgcacaagcgaagaaccgtcattccaatggacaagggcgttggcctgctaagtctgccaagtttatcttggacttgctaaagaatgcagagagcaacgcagaagtcaaggggttggatgtggatgctcttcacatctctcacatccaggttaaccaagctcagaaacagagacgtcgcacataccgtgctcacggaagaattaacccctacatgtcttccccgtgccatattgaactcactttgtctgagaaagaagagcctgttaaaaaggagcctgagactcagttggctcctagaaccaagaagaatcaagcttaagtaagagagaacttttggagtcatagtttgtttggtggtagaaagaaattctggttttgttttgttttgatttgtaatctcaaaaacttgtttccattttcaaagattcttcttatccaatgccctattatgagattatcatgcttcatcaagttaaaatattgaatgagacatttttgtttcaaaaagaaaaaagtaccgactgcg

SEQ ID NO: 1697 - DNA, 767 bp, Cynara scolymus
cggggtttgttggggtggcctccgaagaagcacagctcttgcatcggcgaagccatcaatcagcagcagccatggtgaagtattctaaggaaccagaaaaccccaccaaatcttgcaaagccaggggatcagatctcaggtgtcatttcaagaacactcgagaaactgcccatgctattcgtaagttgcctttaattaaggccaaaagatacttggaggatgttctggttcacaaacaagccattccattcacccgtttctgtcgtggagttgggcgtactgcacaagcaaagaatcgtcattccaatggacaagggcgttggcctgccaagtctgccaagttcatcttggatctgctaaagaacgcagagagcaacgcagaagtcaaagggttggatgtggatgctcttcacatctctcacatccaggtgaaccaagctcagaaacagagacgtcgcacataccgtgctcatggaagaatcaacccttatatgtcctctccctgtcatattgaacttaccttgtccgagaaagaagagcctgttaaaaaggagcctgagactcagttggctcctagaaccaagaagaatcaatcttaaatctgagagacttggagtcatagtttgctggtagaaagaattctggttttgttttgatttgtaatctcaaaaacttgtttccatttccaaagattgttatccaatgcccttatatgagatatgatcatgcttcatgaagttaaaatatttaatgagacttttctttca

SEQ ID NO: 1698 - DNA, 852 bp, Solanum melongena
aaaaccctagcttcgaagcagatagcagctgcagtggaatagcagcatcaccggcagccatggtgaagtattcgaatgagccagagaacccaaccaaatcttgtaaagctaggggttcggatctcagagctcatttcaagaataccagagaaactgcacacgccattaggaagatgcctttgaacaaggcaaagagctacttggaggatgttcttgcccacaaacaagccatccccttcacacgcttttgtcgtggggttggtcgtactgctcaggcaaagaatcgccactcaaatggacaaggacgttggcctgtcaaatctgcaaagtttattctagatttgctcaaaaatgctgagagtaatgctgaagttaaaggcttggatgtggattccctttacattactcacatccaagtaaaccaagcacagaaacagaggcgccgtacataccgtgctcatggaagaatcaacccttatatgtcacatccgtgccatattgagctggtattgtctgaaaaggaagaatctgttaagaaagagcctgagactcaattggctcccaggaagacgaaggcatcttcttgagagggatgaatccctaaattttggaagtataattacaatacctgtagccctggtgtcagaagaatttagtgctatttcaaacatttcttcataggaatttgtgttttttgcttgtaatttttactattttggagcttaaattgggttgtgctttttgaagcatgttgaggaaatattggatttctatggtcttgctttttcgaagattgaattgggatgtttgtagttctgattctgatagctcggaatgcatgaaaacttacag

SEQ ID NO: 1699 - DNA, 836 bp, Flaveria ramosissima
gcggggattctttgtaggggcggcctccgaagaacacacaatatcttcaccggcgggaggcgatcatcatcatcatcatcagcagcagtcatggtgaagtactcaaaggaaccagaaaaccccaccaaatcttgcaaagcgaggggatcagatctcaggtgtcatttcaagaacactcgtgaaaccgcccatgctatccgtaagttgcctttagtcaaggctaagagatacttggaagatgtcttggcccacaaacaagccattccatttactcgtttttgcggtggtgttgggcgtactgcgcaagcaaaaaaccgtcactctaatggacagggacgctggcccgctaagtctgcaaagtttatccttgatctgctgaagaatgcagagagtaacgcggaggttaaagggttggatgtggatgctcttcacatatctcacattcaggtgaaccaagcacagaaacagagacgtcgcacataccgtgctcatggaagaattaacccttacatgtcttcaccttgccacattgaactcactttgtctgagaaagaagaacctgttaaaaaggagcctgagacacagttggctcctagaaccaagaagaaccaagcttaaggggtgcattctcatgagtggtgctcatattttgttggcagaaagaaccctgtttttgtttttgtttttatttgttatatcagaaccatgtgtttttatttccaaagattcttatcctatattcaattatgaggagtttgtgctttatgaaaattaaaatgtgaaattttgttgcatttaggattggatgtcctgatttgatatggttatgttattga

SEQ ID NO: 1700 - DNA, 705 bp, Flaveria ramosissima
cgaagaacacaacacctttcatcagcagcagttgcaacaatggtgaagtactcgaaggaaccagagaaccctaccaaatcttgcaaagctaggggatctgatctcaggtgccatttcaagaacacccgtgaaactgcccatgctatccgtaagttgcctttggttaaggctaagaggtacttagaagatgttttggcccacaagcaagccattccgtttacccgattttgtggtggagttgggcgtactgcacaagcaaagaaccgtcactctaatggtcaaggtcgttggcctgctaagtctgcaaagtttattcttgatctcctaaaaaatgccgagagtaatgcagaagtcaaaggtttggatgttgatgctcttcacatctctcacatccaggtgaaccaggcacagaaacagagacgtcgcacataccgcgcccatggaagaattaacccttacatgtcatctccttgtcacattgagcttactttgtctgagaaagaagaaccagttaaaaaggagcctgagactcagctggcccctagaaccaagaagaaccaagcttaagtctggggtgcatcttccttagtcatagcgagtcatagcgtgtcggtttttgttctcatttgttatatctccatttctaaagatttttataatatcaattacggtgctcgtgctttatggatttaaaatatttaagga

SEQ ID NO: 1701 - DNA, 649 bp, Flaveria ramosissima
ttgcaacaatggtgaagtactcgaaggaaccagagaaccctaccaaatcttgcaaagctaggggatctgatctcaggtgccatttcaagaacactcgtgaaactgctcatgctatccgtaagttgcctttgattaaggctaagagatacttagaagatgttttggcccacaagcaagccattccatttacccgtttttgtggtggagttgggcgtactgcacaagcaaagaaccgtcactctaacggtcaaggtcgttggcctgccaagtctgcaaagtttatccttgatcttctaaaaaatgccgagagtaacgcagaagtcaaaggtttggatgtcgatgctcttcacatctctcacatccaggtgaaccaggcacagaaacagagacgtcgcacataccgtgcccatggaagaattaacccttacatgtcatctccttgtcacattgagctcactttgtctgagaaagaagaaccagttaaaaaggagcctgagactcagctggctcctagaaccaagaagaaccaagcttaagtctggggtgcattttctttagtcatagcgagtcatagcgcgctagtttttgttctcatttgttatactttcatttctaaagattcttatcatatctattacggtcgtgcttt

SEQ ID NO: 1702 - DNA, 729 bp, Flaveria ramosissima
ggggtggcctccgaagaacacaacacctttcaccggcgacaccatcagcagccgttgcaaacatggtgaagtactcgaaggaaccagaaaaccctaccaaatcttgcaaagctaggggatctgatctcaggtgccatttcaagaacactcgtgaaactgcccatgctatccgtaagttgcccttggttaaggctaagagatacttagaagatgttttggcccacaagcaagccattccatttacccgtttttgtggtggagttgggcgtactgcacaagcaaagaaccgtcactctaatggtcaaggtcgttggcctgctaagtctgcaaagtttatccttgatctcctaaaaaatgccgagagtaatgcagaagtcaaaggtttggatgttgatgctcttcacatctctcacatccaggtgaaccaggcacagaaacagagacgtcgcacataccgtgcccatggaagaattaacccttacatgtcatctccttgtcacattgagctgactttgtctgagaaagaagaaccagttaaaaaggagcctgagactcagctggcccctagaaccaagaagaaccaagcttaagtctggggtgcatcttccttagtcatagcgaatcatagcgtgtcgtttttgttctcattagttatatttccatttctaaagattcttatcatatcaattacggtgctcgtactttatggatttaaaatttttaaggaaa

SEQ ID NO: 1703 - DNA, 688 bp, Flaveria ramosissima
ggggcggcctccgaagaacacacatcatcttcaccggcgggaggcgatcatcatcctcagcagcagcagcagtcatggtgaagtactcgaaggaaccagaaaaccccaccaaatcttgcaaagcgaggggatcagatctcaggtgtcatttcaagaacactcgtgaaactgcccatgctatccgaaagttgcctttagtcaaggctaagagatacttggaagatgttttggcccacaagcaagccattccatttactcggttttgcggtggtgttgggcgtactgcgcaagcaaaaaaccgtcactccaatggacagggacgctggccggctaagtctgcaaagtttatccttgatctgctgaaaaatgcagagagtaatgcagaggtcaaagggttggatgtggatgctcttcacatatctcacattcaggtgaaccaagcacagaaacagagacgtcgcacataccgtgctcatggaagaattaacccttacatgtcttctccttgtcacattgaactcactttgtctgagaaagaagagcctgttaaaaaggagcctgagacacagttggctcctagaaccaagaagaaccaagcttaaggggtgcattttcatgagtggtactcatattttgttggtagaaagaaccctgtttttgtttttatttgttatatcagaaccatgtg

SEQ ID NO: 1704 - DNA, 655 bp, Flaveria ramosissima
catcagcagcagttgtagcaatggtgaagtactcgaaggaaccagagaaccctaccaaatcttgcaaagctaggggatctgatctcaggtgccatttcaagaacacccgtgaaactgcccatgctatccgtaagttgcctttggttaaggctaagagatacttagaggatgttttggcccacaagcaagctattccatttacccgtttttgtggtggagttgggcgtactgcacaagcaaagaaccgtcactctaatggtcaaggtcgttggcctgctaagtctgcaaagtttatccttgatctcctaaaaaatgccgagagtaatgcagaagtcaaaggtttggatgttgatgctcttcacatctctcacatccaggtgaaccaggcacagaaacaaagacgtcgcacataccgtgcccatggaagaattaacccttacatgtcatctccttgtcacattgagctcactttgtctgagaaagaagaaccagttaaaaaggagcctgagactcagctggcccctagaaccaaaaagaaccaagcttaagtctggggtgcatcttccttagtcatagcgagtcatagcgtgtcgtttttgttctcatttgttatatttccatttctaaagattcttatcatatcagttacggtgct

SEQ ID NO: 1705 - DNA, 720 bp, Flaveria ramosissima
ggggcggcctccgaagaacacacaacatcttcaccggcgggaggcgatcatcatcagcagcagcagtcatggtgaagtactcgaaggaaccagaaaaccccaccaaatcttgcaaagcgaggggatcagatctcaggtgtcatttcaagaacactcgtgaaactgcccacgctatccgtaagttgcctttagtcaaggctaagagatacttggaagatgtcttggcccacaagcaagcgattccatttactcggttttgcggtggcgttgggcgtaccgcgcaagcaaaaaaccgccactccaatggacagggacgctggcccgctaagtctgcaaagtttatccttgatctgctgaaaaatgcagagagtaacgcagaggtcaaagggttggatgtggatgctcttcacatatctcacattcaagtgaaccaagcacagaaacagagacgtcgcacgtaccgtgctcatggaagaattaacccttacatgtcttctccctgtcacattgaactcactttgtccgagaaagaagaacctgttaaaaaggagcctgagacacagttggctcctagaaccaagaagaaccaagcttaaggggtgcattttcatgagtggtactcatattttgttggtagaaagaacctgttttgttttatttgttatatcagaaccatgtgttttattccaaagattcttatcctatattacaattatgagg

SEQ ID NO: 1706 - DNA, 758 bp, Gerbera hybrid cultivar
aacacacagcacttacaccggcgaaatcagcagcagcggcagccatggtgaagtattctaaggaaccagaaaaccctaccaaatcttgcaaggccaggggatcagatctcaggtgtcatttcaagaacactagagaaactgcacatgctattcgtaagttacctttgactaaggctaaaagttacttggaggatgttttggcccataaacaagccattcccttcacccgtttctgtcgcggagttggacgtactgctcaggcaaagaatcgtcattcaaacggacaaggacgttggcctgctaagtctgcaaagttcatccttgacttgctcaaaaatgcagagagtaatgcagaagtcaaagggttggatgtggatgctcttcacatctctcacatccaggtgaaccaagcacagaaacagaggcgtcgcacataccgtgctcatggaagaattaacccttacatgtcttctccgtgtcatattgaacttactttgtctgagaaggaagaacctgtcaagaaggagcctgagactcagttggctcccagaaccaagaagaatcgagcttaactcaggggtctaaccccgttagtgggcatcgtagtttgttagaagaaagagttgtgtttttcgttttgattgtcattttgaaaacggttgtttccattttcggagatgtttaatccggtgttcaattacgagataatcttgctttatcaaattaatatattgaatgagccacgtttcattcattgg

SEQ ID NO: 1707 - DNA, 859 bp, Lactuca sativa
ggccttcgcagaacacactaaatttttatcggcgacgccagcagcagcagcagcaatggtgaagtactcgaaggaaccagaaaaccccaccaaatcttgcaaggccaggggatctgatctcaggtgccatttcaagaacactcgtgaaacagcacatgctatccgaaagatgcctttattgaaggcgaagagatacttggaagatgttttggtccataaacaagccattccatttactcgtttttgccgtggagttggacgaactgcacaagccaagaatcgtcattccaatggacaaggacgttggcctgctaaatctgcaaagttcattctcgatcttctaaagaacgctgagagtaatgcagaggtgaaaggattggatgtcgatgctcttcacatctcccatatccaggtcaaccaagcccaaaaacagaggcgtcggacataccgtgctcatggaagaatcaatccttacatgtcttctccttgccatattgaattgaccttgtctgaaaaagaggagcctgttaaaaaggatgagactcagttggcaccaagaaccaagaagaaccaagcttaagtgaagttgagtagaaaggattcagtttttgttatctgaaaactctgtttctgtttttaaaagatttgttttatgtttctattattatgaggtgatgttttttgctttatgaaattaaaacattttggttgagtgtttatgattctttttgtggctgtttgagctcaaagctgcaaaacccctcatcactcttttgtgtaaacaacacattataacgacatatctgtgtttgtgacaagagaagagctcttgtcatgtgctttttttgggactatgaag

SEQ ID NO: 1708 - DNA, 773 bp, Lactuca sativa
aactcactctcaatcctgcagcagtcgcaccggcaaaacaagcagcagccatggtgaagtattccaaggagccagataaccctaccaaatcttgcaaagccagaggatcggatctcaggtgtcatttcaagaacacaagagaaactgcacatgctattcgcaagttgcctttaatcaaggctaaaagatacctggaggatgttttggttcataaacaagccattccattcacacgtttttgtcgtggagttggaagaactgcacaggcaaagaatcgtcattccaatggacaaggacgttggcctgctaagtctgcaaagttcattctggatttgctaaagaatgctgagagtaatgcagaagtcaaagggttggatgtagatgctcttcatatttcccacattcaggtgaatcaagctcagaaacagaggcgtcgcacatatcgtgctcatggaagaatcaatccttacatgtcttccccatgtcacattgagctgaccttatcagaaaaggaagaacctgtgaagaaagagcctgagactcagctagcttctagaaagaccaagaatcaagcctaacttatggttttgtttgatcgattgccagaatgagtttttgaattttgttttgttagtgcgatttcaaattttattagatacatgtattgagtttggttacaagaacttcatagttgagtgaagctgaattatatgtgatgtttattattatggctaggatccatttgccatgacatttcttacatcttaattgtc

SEQ ID NO: 1709 - DNA, 800 bp, Lactuca sativa
gcggggacattagctggtgttggcctccgcaaactcactctcaatcctgcagcagtcgcaccggcaaaacaagcagcagccatggtgaagtattccaaggagccagataaccctaccaaatcttgcaaagccagaggatcggatctcaggtgtcatttcaagaacacaagagaaactgcacatgctattcgcaagttgcctctaatcaaggctaaaagatacttggaggatgttttggttcataaacaagccattccattcacacgtttttgtcgtggagttggaagaactgcacaggcaaagaatcgtcattccaatggacaaggacgttggcctgctaaatctgccaagttcattcttgatctgctaaagaatgctgagagtaatgcagaagtcaaagggttggatgtagatgcccttcatatttcacacattcaagtgaaccaagctcagaaacagaggcgtagaacataccgtgctcatggaagaatcaatccttacatgtcttcaccatgccacattgagttgaccttatcagaaaaggaagaacctgtgaagaaagagcctgagactcagttggcttctagaaagagcaagaatcaagcttaacttatggattcatgatttgatcgattccctgaatgagtttttgaattttattttgttagtgcatttcaaattttagatacatgtattgagtttggttacaagaacttcatagttgaatgaagctgaattacatgtgatgttattatggatgtgttccatttgccatgaagtttcttacatcataattgtcc

SEQ ID NO: 1710 - DNA, 799 bp, Nicotiana benthamiana
  misc_feature (55)..(55): n is a, c, g, or t
  misc_feature (77)..(77): n is a, c, g, or t
gcacgagggaaggagcgacctctaccagccgcagcaggagaaggggattagcagnagcatcgccggcagccatggtnaagtattcgagggaacccgacaaccctaccaagtcctgcaaagctaggggcgctagtctcagagttcactttaagaacacacgagagacagcccatgcacttaggaaaatgcctttggacaaggccaagaaatatctggaagatgttcttgcacacaaacaagccattcctttcacacgcttttgtggtggggttggtcgtactgcacaggtgaagcatcgccattcaaatggtcaaggacgctggcctgtcaaatctgcaaaaattattcttgatttactcaagaatgctgagagcaatgctgaggttaaaggcttggatgtggattcacttttcatatctcacatccaagtgaaccaagcacaaaaacagaggcgccgcacgtaccgagctcatggaagaataaacccctacatgtctcacccctgccatgttgagttgacattatctgaaaaggaagagtctgtcaagaaggagcctgagacacagttggctcctagaaaggcgaaggcatcctcttaatccgggcagtgactccaggaatgcagatggtggaatgttatccgtgtccttgtagtctgtgtcatgaaacaattttggcattttgaaccatgtatgtgtttctccagaaatttgtggtactatttagcatatccttactattctgaaacttgaattggatgtttaccttattggcttatttagtggtggttgagacctta

SEQ ID NO: 1711 - DNA, 721 bp, Raphanus sativus
ggggcagccaattcttccgtttagcagccatggtgaagtactcgcaagaacccgacaatcagaccaagtcctgcaaggctagaggttccgaccttagggttcacttcaagaacacccgtgaaacagcgcacgccatcaggaagctaccattgctcaaggcgaagagataccttgaagatgtgatagctcacaagcaagccattcccttcacccgtttctgcagaggtgttggaaggactgcccaagccaagaacaggcactctaacggtcagggacgttggcctgcgaaatctgctcagttcgttctcgatttgcttaagaacgctgagagcaacgctgaggtgaaaggtttggatgttgatgcactcttcatatcgcacatccaagttaaccaggctgcaaagcaaaggagaaggacttaccgtgcccacggaagaatcaatccttacatgtccaacccatgccacattgagttgattttgtctgagaaggaagagtctgttaagaaagagccggagacgcagttggcagccaagtcaaagaaatcagcagcttaaaagctttctttgtttttttttttaagtctctcctttttgtgttgttgaaagagattttgttacatttttctctatctttgcaagacaatagatatattttcatggatcagtttggtgatggtttgtactatcactccatctttactagtttccgcttatcttta

SEQ ID NO: 1712 - DNA, 765 bp, Raphanus sativus
  misc_feature (653)..(653): n is a, c, g, or t
  misc_feature (695)..(695): n is a, c, g, or t
gggcagccgattcttttgatagccgcagccatggtaaagtactcccaagaaccagacaaccagaccaagtcatgcaaggctagaggttccgatcttagggttcacttcaagaacactcgggaaacagcgcacgccatcaggaagctaccattgctcaaggcgaagaggtaccttgaggatgtgatagctcacaagcaggctattcctttcacccgtttctgcagaggtgttggaaggactgctcaagctaagaacaggcactccaatggtcaaggacgttggcctgctaaatccgctcagttcgttcttgatttgctcaagaacgctgagagcaatgctgaggtgaaaggtttggatgttgatgcgctattcatttcgcacattcaagttaaccaggctgcgaaacagaggagaaggacttaccgtgctcatggaagaatcaacccttacatgtccaacccatgccacattgagttgattttgtctgagaaggaagagtctgtcaagaaagagccggagacccagttggcagccaagtcgaagaaatcaagtgcttaattaagctttcgtttatttccagttttttctttttgcgtttctgaacgagattttgttcccttttctccatattctcagtcaagacaatggatagngttcaatgttggtcttatgaatcattaatcattgttactagnatctttcttctgccttcattggttatgtcagatactatcttcagtttaactctgcttatatttgccttgg

SEQ ID NO: 1713 - DNA, 700 bp, Raphanus sativus
ggggcagccgattcttttgatagccgcagccatggtgaagtactctcaagaaccagacaaccagaccaagtcatgcaaggctagaggttccgatcttagggttcacttcaagaacactcgggaaacagcgcacgctatcaggaagctaccattgctcaaggcgaagaggtaccttgaggatgtgatagctcacaagcaggctattcctttcacccgtttctgcagaggtgttggaaggactgctcaagctaagaacaggcactccaatggtcaaggacgttggcctgctaaatctgctcagttcgttctcgatttgctcaagaacgctgagagcaatgctgaggtgaaaggtctggatgttgatgccctcttcatttctcacatccaagtcaaccaggctgcgaaacagaggagaaggacttaccgtgctcatggaagaatcaacccttacatgtccaacccatgccacattgagttgattttgtcagagaaggaagagtctgtcaagaaagagccggagacccagttggcagccaagtcgaagaaatcaagtgcttaagctttcgtttattttcagtttcttcttttttttttgcgtttttgaacgagattttgttcccttttctccatattctcagtcaagacaatggatagagttaaatgttggtcttatgaatcattaatcattgttactagaatc

SEQ ID NO: 1714 - DNA, 660 bp, Raphanus sativus
gggcagccaattcttccgtttagcagccatggtgaagtactcgcaagaacccgacaatcagaccaagtcttgcaaggctagaggttccgaccttagggttcacttcaagaacacgcgtgaaacagcgcacgccatcaggaagctaccattgctcaaggcgaagagataccttgaagatgtgatagctcacaagcaagctattcccttcacccgtttctgcagaggtgttggaaggactgcccaagctaagaacaggcactctaatggtcagggacgttggcctgcgaaatctgctcagttcgttcttgatttgcttaagaacgctgagagcaacgctgaggtgaaaggtttggatgttgatgcactcttcatatcgcacatccaagttaaccaggctgcaaagcaaaggagaaggacttaccgtgcccacggaagaatcaacccttacatgtccaacccatgccacattgagttgattttgtctgagaaggaagagtctgttaagaaggagccggagacgcagttggcagccaagtcaaagaaatcagcagcttaaaagctttctttgttattttttttaagtctctcctttttgtgttgttgaaagagattttgttacatttttctccatctttgcaagacaatagatatattttcatg

SEQ ID NO: 1715 - DNA, 724 bp, Raphanus sativus
  misc_feature (71)..(71): n is a, c, g, or t
  misc_feature (723)..(723): n is a, c, g, or t
gaggcagccaattcttccgtttagcagccatggtgaagtactcgcaagaacccgacaatcagaccaagtcntgcaaggctagaggttccgaccttagggttcacttcaagaacacccgtgaaacagcgcacgccatcaggaagctaccattgctcaaggcgaagagataccttgaagatgtgatagctcacaagcaagctattcccttcacccgtttctgcagaggtgttggaaggactgcccaagctaagaacaggcactctaacggtcaaggacgttggcctgcgaaatctgctcagttcgttcttgatttgcttaagaacgctgagagcaacgctgaggtgaaaggtttggatgttgatgcactcttcatatcgcacatccaagttaaccaggctgcaaagcaaaggagaaggacttaccgtgcccacggaagaatcaatccttacatgtccaacccatgccacattgagttgattttgtctgagaaggaagagtctgttaagaaagagccggagacgcagttggcagccaagtcaaagaaatcagcagcttaaagctttctctattttttctagtctctcctttttgtgttgttgaaagagattttgttacattttctccatctttgcaagactagagatatattttcttggatcttttgttcaacgttgctgtttgatgatgtctagtattattcatcctatctttactagttccgcna

SEQ ID NO: 1716 - DNA, 775 bp, Raphanus sativus
ggaaagtctctccacaactttactcgaatcgcttctgccgccgatctcttccgttagccgcagccatggtgaagtactcacaagaacctgacaatcagaccaagtcttgcaaggctagaggatccgatcttagggttcacttcaagaacactcgggaaacagcgcacgccatcaggaagctaccattgctcaaggccaagaggtaccttgaggatgtgatagctcacaagcaggctattcctttcacccgtttctgcagaggtgttggaaggactgctcaagctaagaacaggcactccaacggtcaaggacgttggcctgctaaatctgctcagtttgttctcgatttgctcaagaacgctgagagcaatgctgaggtgaaaggtttggatgttgatgcgctcttcatttcgcacatccaagttaaccaggctgcgaaacagaggagaaggacttaccgtgctcatggaagaatcaacccttacatgtccaacccatgccacattgagttgattttgtctgagaaggaagagtctgtcaagaaagagccggagacccagttggcagccaagtcgaagaaatcaagtgcttaagctttctttgttttttagtttctactttttgtgttcgtgaaagagattttgctcccttttctctcccatctttgcaagacaatggatagattttcgtggattattattgttggtgttatgaaaattaaactattgatctttgcgtttgtagtatttaattctatctttatatttttgctaaa

SEQ ID NO: 1717 - DNA, 800 bp, Raphanus sativus
  misc_feature (662)..(662): n is a, c, g, or t
gatatcaacgcagagggcattacggccggggggcagccgattcttttgatagccgcagccatggtgaagtactcgcaagaaccagacaaccagaccaagtcttgcaaggctagaggttccgatcttagggttcacttcaagaacactcgggaaacagcgcacgctatcaggaagctaccattgctcaaggccaagaggtaccttgaggatgtgatagctcacaagcaggctattcctttcacccgtttctgcagaggtgttggaaggactgctcaagctaagaacaggcactccaatggtcaaggacgttggcctgctaaatctgctcagtttgttcttgatttgctcaagaacgctgagagcaatgctgaggtgaaaggtctggatgttgatgcgctcttcatttcgcacatccaagtcaaccaggctgcgaaacagaggagaaggacttaccgtgctcatggaagaatcaacccttacatgtccaacccatgccacattgagttgattttgtctgagaaggaagagtctgtcaagaaagagccggagacccagttggcagccaagtcgaagaaatcaagtgcttaagctttcgtttattttcagtttttttctttttgcgtttctgaacgagattttgttcccttttctccatattcccngtcaagacaatggatagagttcaatgttggtcttatgaatcattaatcattgttactagaatctttcttctgccttcattggttatgtcagaaactatctttatttaactctgcttatatttgccttggaaaaaaaaa

SEQ ID NO: 1718 - DNA, 682 bp, Raphanus sativus
  misc_feature (121)..(121): n is a, c, g, or t
  misc_feature (136)..(136): n is a, c, g, or t
  misc_feature (353)..(353): n is a, c, g, or t
  misc_feature (535)..(535): n is a, c, g, or t
  misc_feature (564)..(566): n is a, c, g, or t
  misc_feature (569)..(570): n is a, c, g, or t
  misc_feature (575)..(575): n is a, c, g, or t
gggccgccgatctcttccgttagccgcagccatggtgaagtactcacaagaacctgacaatcagaccaagtcttgcaaggctagaggatccgatcttagggttcacttcaagaacactcgngaaacagcgcacgcnatcaggaagctaccattgctcaaggccaagaggtaccttgaggatgtgatagctcacaagcaggctattcctttcacccgtttctgcagaggtgttggaaggactgctcaagctaagaacaggcactccaatggtcaaggacgttggcctgctaaatctgctcagtttgttcttgatttgctcaagaacgctgagagcaatgctgaggtgaaaggtntggatgttgatgcgctcttcatttcgcacatccaagtcaaccaggctgcgaaacagaggagaaggacttaccgtgctcatggaagaatcaacccttacatgtccaacccatgccacattgagttgattttgtctgagaaggaagagtctgtcaagaaagagccggagacccagttggcagcnaagtcgaagaaatcaagtgcttaagcttnnnttnnttttnagtttctttttttttttttgcgtttttgaacgagattttgttcccttttcttcatattctcaagacaatggacagagttcaatgttggtcttatgaatcattaatca

SEQ ID NO: 1719 - DNA, 734 bp, Raphanus sativus
gggcagccgattcttttgatagccgcagccatggtgaagtactcgcaagaaccagacaaccagaccaagtcttgcaaggctagaggttccgatcttagggttcacttcaagaacactcgggaaacagcgcacgctatcaggaagctaccattgctcaaggccaagaggtaccttgaggatgtgatagctcacaagcaggctattcctttcacccgtttctgcagaggtgttggaaggactgctcaagctaagaacaggcactccaatggtcaaggacgttggcctgctaaatccgctcagtttgttcttgatttgctcaagaacgctgagagcaatgctgaggtgaaaggtttggatgttgatgcgctcttcatttcgcacatccaagttaatcaggctgcaaaacagaggagaaggacttaccgtgctcatggaagaatcaacccttacatgtcaaacccatgccacattgagttgattttgtctgagaaggaagagtctgtcaagaaagagccggagacccagttggcagctaagtcgaagaaatcaagtgcttaagctttcgtttattttcagtttcttttttttttttgcgtttttgaaccatattttgttcccttttcttcatattctccaagacaatggatagagttcaatgttggtcttatgaatcattaatcattgttactagaatctttcttttgccttcattgattatgtcggatactatcttt

SEQ ID NO: 1720 - DNA, 709 bp, Eutrema halophilum
ggtgaagtattcgcaagaacccgacaatcagaccaagtcttgcaaggctagaggatccgatcttagggttcacttcaagaacacccgtgaaacagcgcacgccatcaggaagctaccattgatcaaggcgaagaggtaccttgaagatgtgatagctcacaagcaagcaattcccttcactcgtttctgtagaggtgtaggaagaactgctcaagctaagaacaggcactctaatggtcaaggacgttggcctgcaaaatctgctcagttcgttcttgatttgctcaagaatgctgagagcaatgctgaggtgaaaggtttagatgttgatgccctcttcatatcacacatccaagtgaaccaggctgcgaaacaaaggagaaggacttaccgtgctcacggaagaatcaacccttacatgtccaacccttgccacattgagttgattttgtcagagaaagaagagcctgttaagaaagagccggagacccagttggcagccaagtcaaagaaatcagcagcttaagttttctttaatttttcatctctctttttgtgttcttggaagagattttgctcccctttctttcgatctttgcaagacaatggatagattttcttggattattgttcaatgttgctgtcatgaaatcattcgccatggttggtagtatttattcttgcttaataattctgctaatttatatct

SEQ ID NO: 1721 - DNA, 822 bp, Brassica juncea
ggaatgccgtttcactctataaagtctcttcacaacttaactcgaatcgcttctgccgccgatctcttccgttagccgcagccatggtgaagtattcgcaagaacccgacaatcagaccaagtcttgcaaggctagaggatccgatctcagggttcacttcaagaacactagggaaacagcgcacgctatcaggaagctaccattgctcaaggccaagaggtaccttgaggatgtgatagctcacaagcaggctattcctttcacccgtttctgcagaggtgttggaaggactgcccaagctaagaacaggcactccaatggtcaaggacgttggcctgctaaatctgctcagttcgttcttgatttgctcaagaacgctgagagcaatgcagaggtgaaaggtttggatgttgatgcactcttcatttcacacatccaagtgaaccaggctgcaaagcagaggagaaggacttaccgtgctcatggaagaatcaacccttacatgtcaaacccatgccacattgagttgattttgtcagagaaggaagagtctgtcaagaaagagccggagacacagttggcagccaagtcgaagaaatcatctgcctaagctttctttgctattttagtttctcccttttttgtgttctcttgaaagagattttgttccctttttctctcatctctgcaaagacaatggataaattttcttggattatatttcagtgttggtgttatgaaattattaatctttgtggtggtagtattttattttatcttaatattttggctaaatttattttgacaagagttaaggcgcg

SEQ ID NO: 1722 - DNA, 1217 bp, Secale cereale
aaagaaatccaggggtcgcagtagaagacggaagcagcaggcgctaggggctagcaggcgcagacgagaaaaaaaacgccgtcctccccaagcgcccccctcaccccggaaccaaatcgaacaaccgagagaagccatggagcgactgcagcggatcttcggcgccggcgggatgggccagccgccgtcggactcgccgctgctcgactcctccgagcaggtctacatctcctccctcgccctcctcaagatgctcaagcacgggagggccggcgtgccgatggaggtcatgggcctcatgctcggcgagttcgtcgacgactacacggtccgggtggtcgacgtcttcgccatgccgcaaagcgggacgggggtcagcgtcgaggccgtcgaccacgtcttccagaccaacatgctcgacatgctcaagcagaccggcaggccagaaatggtggtagggtggtatcactctcatcctggttttggttgctggctatcgggtgtcgatatcaatactcaacagagttttgaagctttgaaccccagggcagttgctgtcgtgatcgaccccatccagagtgtcaaggggaaggtggtcattgatgcatttcgtctcattaaccctcagaccatgatgcttgggcaggagccacggcagacaacatccaatgttgggcacctgaataagccatctattcaggctcttattcatgggctcaatagacactactactccattgcaataaattaccgcaagaatgagctcgaggaaaagatgctgcttaaccttcacaaaaagaaatggaccgatggattaattctgaagaaatttgacgcgcactcagaaaccaatgagcagactgttcaggaaatgctgagcctggccatcaagtacaacaaggcagtgcaagaggaggatgagctgtcccctgagaaattagcgatagctaatgtgggacggcaagatgcgaagaagcatctagaagagcatgtctcaaatctgatgtcgtcgaacatagttcagaccctagggaccatgcttgacacggttgtcttttagtctactactgttgttccaaccgtatgtagactcacccagtctatcattgatgttgtgtatccaaagcctgccacaatgcagcaaggcacattcgggttctaacagtttgctcgacagactcaattttctgtagtaccatcttctgcatgtttcattt

SEQ ID NO: 1723 - DNA, 1068 bp, Leymus cinereus x Leymus triticoides
  misc_feature (9)..(10): n is a, c, g, or t
gaacaaccnnagagaagccatggagcggctgcagcggatcttcggcgccggcgggatgggccagccgccgtcggactcgccgctgctcgactcctccgagcaggtctacatctcctccctcgccctcctcaagatgctcaagcacgggagggccggcgtgccgatggaggtcatgggcctcatgctcggcgagttcgtcgacgactacacggtgcgggtggtcgacgtcttcgccatgccgcagagcgggacaggggtcagcgtcgaggccgtcgaccacgtcttccagaccaacatgctcgacatgctcaagcagaccggcaggccagaaatggtggtagggtggtatcactctcatcctggttttggttgctggctatcgggtgttgatatcaatactcagcagagttttgaagctttgaaccccagggcagttgccgttgtgattgaccccatccagagtgtcaaggggaaggtggtcattgatgcatttcgtctcattaaccctcagaccatgatgcttgggcaggagccacgacagacaacatccaatgttgggcacctgaataagccatctattcaggctcttattcatgggctcaatagacactactactctattgcaataaattaccgcaaaaatgagctcgaggagaagatgctgcttaaccttcacaaaaagaaatggactgatggattaattttgaagaaatttgacgcacattcagaaaccaatgagcagactgttcaggaaatgctgagcctagccatcaagtacaacaaggcagtgcaagaggaggatgagttgtcccctgagaaattagcgatagctaatgtgggacggcaagatgcgaagaagcatctggaagaacatgtctcaaatttgatgtcgtcgaacatagttcagaccctagggaccatgcttgacaccgttgtcttttagtcaaccactagtgttgttccaaccctatttagactcgcccagtctatcattcatgttatgtatccaaagcctgccacaacgcagcaaggtacattcgggttctaacagtttgctcgacagactca

SEQ ID NO: 1724 - DNA, 1160 bp, Pseudoroegneria spicata
  misc_feature (23)..(23): n is a, c, g, or t
aagcgccccccgaaaccaaatcnaacaacctagagaagccatggagcggctgcagcggatcttcggcgccggcgggatgggccagccgccgtcggactcgcctctgctcgactcgtccgagcaggtctacatctcctccctcgcgctcctcaagatgctcaagcacgggagggccggcgtgccgatggaggtcatgggcctcatgctcggcgagttcgtcgacgactacacggtccgggtggtcgacgtcttcgccatgccgcagagcgggacaggggtcagcgtcgaggccgtcgaccacgtcttccagaccaacatgctcgacatgctcaagcagaccggcagaccagaaatggtggtggggtggtatcactctcatcctggttttggttgctggttatcgggtgtcgatatcaatactcaacagagttttgaagctttgaaccccagggccgttgccgttgtgatcgaccccatccagagtgtcaaggggaaggtggtcattgatgcatttcgtctcattaaccctcagaccatgatgcttgggcaggagccacgacagacaacatccaatgttgggcacctgaataagccatctattcaggctcttattcatgggctcaatagacactactactctattgcgataaattaccgcaaaaatgagctcgaggaaaagatgctgcttaaccttcacaaaaagaaatggaccgatggattgattctgaagaaatttgacgcacattcagaaaccaatgagcagactgttcaggaaatgctgagcctggccatcaagtacaacaaggcagtgcaagaggaggatgagttgtcccccgagaaattagcgatagctaatgtgggacggcaagatgcgaagaagcatctagaagagcatgtctcaaatttgatgtcgtcgaacatagttcagaccctagggaccatgcttgacacggttgtcttttagtctaccactagtgttgttccaaccctataatatagactcacccagtctatcattcatgttatgtatccaaagcctgccacaacgcagcaaggtacattcgggttctaacagtttgctcggcagactcaatttctgtattactatcttctacatgtttaatttcgcagcacatctcatccgtgccctttaccattga

SEQ ID NO: 1725 - DNA, 1230 bp, Triticum aestivum
acggaagcagcaaggcgcagccgagaaaaaaaacgccgtcctcccgaagcgccccccttaccccggaaccaaatcgaacaacccagagaagccatggagcggctgcagcggatcttcggcgccggcgggatgggccagccgccgtcggactcgccgctgctcgactcctccgagcaggtctacatctcctccctcgccctcctcaagatgctcaagcacgggagggccggcgtgccgatggaggtcatgggcctcatgctcggcgagttcgtcgacgactacacggtccgggtggtcgacgtcttcgccatgccgcagagcgggacgggggtcagcgtcgaggccgtcgaccacgtcttccagaccaatatgctcgacatgctcaagcagaccggcaggccagaaatggtggtagggtggtatcactctcatcctggttttggttgctggctatcgggtgttgatatcaatactcaacagagtttcgaagctttgaaccccagggcagttgccgtcgtgatcgaccccatccagagtgtcaaggggaaggtggtcatcgatgcatttcgtctcattaaccctcagaccatgatgcttgggcaggagccacgtcagacaacatccaatgttgggcacctgaataagccatctattcaggctcttattcatgggctcaatagacactactactctattgcaataaattaccgcaaaaatgagctcgaggagaagatgctgcttaaccttcacaaaaagaaatggactgatggattaattctgaagaaatttgacgcacattcagaaaccaatgagcagactgttcaggaaatgctgagcctagccatcaagtacaacaaggcagtgcaagaggaggatgagttgtcccctgagaaattagcaatagctaatgtgggacggcaagatgcgaagaagcatctagaagagcatgtctcaaatctgatgtcgtcgaacatagttcagaccctaggtaccatgcttgacacggttgtcttttagtctaccactagtgttgttccaaagtctatcattcatgttatgtatccaaagcctgccacaacgcagcaaggcacattcgggttctaacagtttgctcgacagactcaattttctgtagtactatcttctgcatgtttaatttcgcagcaattttcatgggtgtactttaaaattgcaagttctggttctgccgaagtgatcatgattgctgaa

SEQ ID NO: 1726 - DNA, 1559 bp, Triticum aestivum
acggaagcagcaaggcgcagccgagaaaaaaaacgccgtcctcccgaagcgccccccttaccccggaaccaaatcgaacaacccagagaagccatggagcggctgcagcggatcttcggcgccggcgggatgggccagccgccgtcggactcgccgctgctcgactcctccgagcaggtctacatctcctccctcgccctcctcaagatgctcaagcacgggagggccggcgtgccgatggaggtcatgggcctcatgctcggcgagttcgtcgacgactacacggtccgggtggtcgacgtcttcgccatgccgcagagcgggacgggggtcagcgtcgaggccgtcgaccacgtcttccagaccaatatgctcgacatgctcaagcagaccggcaggccagaaatggtggtagggtggtatcactctcatcctggttttggttgctggctatcgggtgttgatatcaatactcaacagagtttcgaagctttgaaccccagggcagttgccgtcgtgatcgaccccatccagagtgtcaaggggaaggtggtcatcgatgcatttcgtctcattaaccctcagaccatgatgcttgggcaggagccacgtcagacaacatccaatgttgggcacctgaataagccatctattcaggctcttattcatgggctcaatagacactactactctattgcaataaattaccgcaaaaatgagctcgaggagaagatgctgcttaaccttcacaaaaagaaatggactgatggattaattctgaagaaatttgacgcacattcagaaaccaatgagcagactgttcaggaaatgctgagcctagccatcaagtacaacaaggcagtgcaagaggaggatgagttgtcccctgagaaattagcaatagctaatgtgggacggcaagatgcgaagaagcatctagaagagcatgtctcaaatctgatgtcgtcgaacatagttcagaccctaggtaccatgcttgacacggttgtcttttagtctaccactagtgttgttccaaagtctatcattcatgttatgtatccaaagcctgccacaacgcagcaaggcacattcgggttctaacagtttgctcgacagactcaattttctgtagtactatcttctgcatgtttaatttcgcagcaattttcatgggtgtactttaaaattgcaagttctggttctgccgaagtgatcatgattgctgaagtcagctaaatcttatgctgatggatatgtggctgcccatgtgttaatatgacttgtggtggagtaacatagtgagatggcagcgaaaattccatatgggtcatactagcatatgatcatattatctgagttgttggtccttcttgggatctgtgtgtatgcatgtataagatggcgtattgatgcattctttaggtttattgtacagtgcccctgactctgtgcagaccgcatttagtgatggataccaccctggtcttccagggtctaggcgtttgccttttttcatggtccggttctgctcgcacctggaccgattttgactgctt

SEQ ID NO: 1727 - DNA, 1135 bp, Avena sativa
cgagaagagaagccaagccgtctctcccgggaccaaatcgatcaagcgagtgagaagccatggagaggctgcagcggatcttcggcgccggcgggatggggcagccaccgtctgactcgccccttctcgactcctccgagcaggtctacatctcctccctcgcgctcctcaagatgctcaagcacgggagggccggcgtgccgatggaggttatgggcctcatgctcggggagttcgtcgacgactacacggtccgggtggtcgacgtcttcgccatgccgcagagcgggacaggggtcagcgtcgaggccgtcgaccacgtcttccagaccaacatgctcgacatgctcaagcagaccggcagaccagaaatggtggtagggtggtatcactcccatcctggttttggttgctggctatcaggtgtcgatatcaatactcaacagagttttgaagctttaaaccccagggcggttgctgttgtgatagaccccatccagagtgtcaagggcaaggtggtcattgatgcatttcgtctcattaatcctcagaccatgatgcttgggcaggagccacgacagacaacatccaatgttgggcacctgaataagccatctattcaggctcttattcacgggctgaacagacactactactcgattgcaattaattaccgcaaaaatgagctcgaggaaaaaatgctgctgaaccttcacaaaaagaaatggactgatggattaattttaaagaaattcgatgcacattcagaaaccaatgagcagactgttcaggaaatgctgagcctagccatcaagtacaacaaggcagtgcaagaggaggatgagctatcacctgagaaattagcgatagctaatgtggggcggcaagatgccaagaagcatctagaagaacacatctcaaatttgatgtcgtcaaacatagttcagaccctagggaccatgctcgacacggttgtcttttagtctgctatatactagtgttgttccaacaatgtatacagacttcacccggtcttatcattcatgttatcgaaagcttgccacaagctaggtttggtgcttggtacattctggttctaacagtttgctcggtggacttggtttttccgcagcac

SEQ ID NO: 1728 - DNA, 1391 bp, Brachypodium distachyon
aaagaaagaagccagaagcgaaaggaacaagccgcaagcaacaccagggcacgcacagcagagaagagaagccgtctcccccaaagctcttcccgaccaaatagaagagaggccatggagcggctgcagcggatcttcggcgccggcgggatggggcagccgccgtctgactcaccgctgctcgattcctccgagcaggtctacatctcctccctcgcgctcctcaagatgctcaagcacgggagggccggcgtgcctatggaggtcatgggcctcatgctcggcgagttcgtcgacgactacacggtcagggtggttgacgtattcgccatgccgcagagcgggaccggggtcagcgtcgaggccgtcgaccacgtcttccagaccaacatgctcgacatgctcaagcagaccggcagaccagaaatggtggtagggtggtatcattcacatcctggttttggttgctggctatctggtgttgacataaatactcaacagagtttcgaagctttaaatcccagggcagttgctgttgtgatagatcccatccagagtgtcaaggggaaggtggtcattgatgcatttcgtctcatcaatcctcagactatgatgcttgggcaggagccgcgacaaacaacatccaatgttgggcacctaaataagccctctattcaggctcttattcatgggctgaacagacactactactccattgcaattaattaccgcaaaaatgagctcgaggaaaagatgttattgaacttgcacaaaaagaaatggactgatggattaattttgaagaggtttgacacacattcaactactaacgagcagactgttcaggaaatgctgagcctagccatcaagtacaacaaagcagtgcaagaggaggatgagctgtcacctgagaaactagcgatagccaatgtgggacgtcaagatgcaaagaagcatctagaagagcacgtctcaaatttgatgtcgtcaaacatagttcagaccctagggaccatgctcgacacggttgtcttttagtctactactactgttgttccaaccctatatacagaccaacccagtttatcagtcgtgttatcccggcctgccataatgcagtgaggttgatgtgaggtacattcgtgtactaacagtttactgcatgaacttaattatttttcctgtagcactatcttctgtatgttgttaaccagttgttaatttggctgcatcttttggtccattgtcagttgtggctattgctggagttatcgtggttgctgagagtcagtgggatcttattttccttgggaggtctgtcgtgcttgatatgtcattgacaatgtatcaccaattaaccatgaacttttagtagactagtcctagtatca

SEQ ID NO: 1729 - DNA, 1237 bp, Brachypodium distachyon
agaagccagaagcgaaaggaacaagccgcaagcaacaccagggcacgcacagcagagaagagaagccgtctcccccaaagctcttcccgaccaaatagaagagaggccatggagcggctgcagcggatcttcggcgccggcgggatggggcagccgccgtctgactcaccgctgctcgattcctccgagcaggtctacatctcctccctcgcgctcctcaagatgctcaagcacgggagggccggcgtgcctatggaggtcatgggcctcatgctcggcgagttcgtcgacgactacacggtcagggtggttgacgtattcgccatgccgcagagcgggaccggggtcagcgtcgaggccgtcgaccacgtcttccagaccaacatgctcgacatgctcaagcagaccggcagaccagaaatggtggtagggtggtatcattcacatcctggttttggttgctggctatctggtgttgacataaatactcaacagagtttcgaagctttaaatcccagggcagttgctgttgtgatagatcccatccagagtgtcaaggggaaggtggtcattgatgcatttcgtctcatcaatcctcagactatgatgcttgggcaggagccgcgacaaacaacatccaatgttgggcacctaaataagccctctattcaggctcttattcatgggctgaacagacactactactccattgcaattaattaccgcaaaaatgagctcgaggaaaagatgttattgaacttgcacaaaaagaaatggactgatggattaattttgaagaggtttgacacacattcaactactaacgagcagactgttcaggaaatgctgagcctagccatcaagtacaacaaagcagtgcaagaggaggatgagctgtcacctgagaaactagcgatagccaatgtgggacgtcaagatgcaaagaagcatctagaagagcacgtctcaaatttgatgtcgtcaaacatagttcagaccctagggaccatgctcgacacggttgtcttttagtctactactactgttgttccaaccctatatacagaccaacccagtttatcagtcgtgttatcccggcctgccataatgcagtgaggttgatgtgaggtacattcgtgtactaacagtttactgcatgaacttaattatttttcctgtagcactatcttctgtatgttgttaaccagttgttaatttggctgcatcttttggtcca

SEQ ID NO: 1730 - DNA, 1269 bp, Oryza sativa
gtaactccccctcctcctccatccaaaagaaaagaaggaaaagaagaaaaaagatcctgtgaaccctacgaaactaccgaagcgaagcgaagcgaagaatcggcggcggcggcggcggcggcggtggggagaagccatggagcggctgcagcggatcttcggcgcctccggcatggggcagccgccgtcggactcgccgctgctcgactcctccgagcaggtctacatctcctccctcgccctcctcaagatgctcaagcacgggagggccggcgtgccgatggaggtgatggggctgatgctgggggagttcgtcgacgactacacggtcagggtggtcgacgtcttcgccatgccgcagagcgggaccggggtcagcgtcgaggccgtcgaccatgtcttccagaccaacatgctcgacatgctcaagcagaccgggaggccagaaatggtggtaggttggtaccattcccatcctggatttggttgctggctttcaggagttgacatcaatactcaacagagttttgaagctttaaaccccagggcagttgccgtcgtgatagatcccatccaaagtgtcaaggggaaagttgtcattgatgcatttcgccttattaaccctcagaccatgatgcttggtcaggagccacgacagacaacatcaaatgttgggcacctaaataagccatctattcaggctcttattcatgggctgaacaggcactactattcaattgcaatcaattaccggaaaaatgagcttgaggaaaagatgttactgaacttgcacaaaaagaaatggaccgatggattgattctgaagaggtttgacactcattcaaagaccaatgagcagactgttcaggaaatgctgaaccttgctatcaagtacaacaaggcggtgcaagaggaggatgagctgccgcctgagaaattagcgatagcaaatgtgggacggcaagatgctaagaagcacttggaagagcatgtctccaatttgatgtcatcaaacatagttcagacgctaggaaccatgctcgatacagttgtattttagatcactactgctgttatcccaacactgtacccagagctcgtttattttttatttttttatgtttatcgaagcctaccataattcagtgaacttaacgccagttacatttgggttatgaaagcttaccacttgacaacttcataattcattttgttggagcgctatctcctgtacggtgcatatatgaatgaaggttaatagtgtgtcta

SEQ ID NO: 1731 - DNA, 1147 bp, Secale cereale
cgcgatccgaaggcgaaggcgagctgaagcaatggagcgactgcagagaatcttcagcggcgccaccgggatggggcagccggggagcgactcgccgctgctcgactcctccgagcaggtctacatctcctccctcgctctccttaagatgctcaagcacgggagggccggcgtgcccatggaggtgatgggcctgatgttgggcgagttcgtcgacgactacacggtcagggtggtggatgtcttcgccatgccgcagagtgggaccggcgtcagcgtcgaggccgtcgaccacgtcttccagaccaacatgctcgacatgctcaagcagaccgggagacctgaaatggtggtaggctggtaccactcgcatcctggatttggttgttggctttcgggagttgacatcaatactcagcagagttttgaagctttaaaccccagggcagttgctgttgtgatagatcccatccagagtgtgaaggggaaggtggtcattgatgcattccgtctcattaaccctcagaccatgatgcttggccaggagccaaggcagacaacatccactgttgggcacctaaacaaaccatctattcaggcacttattcacgggctgaacaggcactactactccattgcaatcaattaccggaaaaatgagcttgaggagaagatgctgctgaacttacacaaaaagaaatggactgatgggttgattttaaagaaattcgacgcccactcaaagaccaacgaggagactgttcaggaaatgctgagtctggccatcaaatacaacaaggcagtgcaagaggaggatgagctgccgcctgagaaactagcgatagcaaatgttgggcggcaggatgcaaagaagcacttggaggagcatgtctcgaatttgatgtcgtcgaacattgtccaaaccctaggaaccatgctcgacacagtggtcttttagtctgccaccactggttgttccaactctatacacagaactgtctgttatttttgttggtcacagcctttcataattcagtaaggcagtgcaagaggttaggtttttttgtctgatgtagcaccatgcgacgcgactatcttctgtagggcgtactgttaatctaatatctcccctgcaaaaagaatcaaa

SEQ ID NO: 1732 - DNA, 1469 bp, Setaria italica
ggaagctccgattccatctcgttcccgtcaccgtccgctcgcgtgcgtccccatcgcggcgacaactccaccgccgggagcttccccgtcgccgacgagcgcatctccaccggaggcctcctccaggggtccgcagcaaacagccaatccccaaaaaagagccacacaagaaaaacacaagcagctgagaagctttccggtctcttgatagcacatcagcatggagcgcctgcagaggatcttcggcgcctctggaatgggacagccaccatcggactcgccgctgctcgattcatccgagcaggtctacatttcctcccttgcactcctcaagatgctcaagcacgggagggctggtgtaccaatggaggtgatgggtcttatgctgggtgagtttgtggatgactacacggtcagggtggtggatgtgttcgccatgccacagagtggtactggggtcagtgttgaggctgttgatcatgtcttccagaccaacatgcttgacatgctcaagcagaccggaagaccggaaatggttgtagggtggtaccactcccatcctggctttggttgctggctttcaggcgttgacatcaacactcaacagagttttgaagctttaaatcccagggcagttgctgttgtgatagatcccatccaaagtgtcaaagggaaggtggtcattgatgcatttcgtctcattaacccccaaactatgatgcttggccaggagccacgacagacgacatctaatgttgggcacctaaataagccatctattcaggctcttatccatgggctgaacaggcactactactccattgcaatcaactaccgaaagaatgagctcgaggagaaaatgttgctgaacttgcacaaaaagaagtggactgatgggttgattttgaagaggtttgacactcattcaaaaaccaacgagcagactgtgcaggaaatgctgaacctagctgtgaagtataacaaggcggtgcaagaggaggatgagctgccaccagagaaactggcgattgcgaacgtgggacgccaggatgcgaagaagcatttggaggagcacgtctctaatttgatgtcttcaaacatagttcagaccctagggaccatgctcgacacggttgtcttttagtttggtagtagcgtgtcctcaatgaatgcagcactgaaattatctttatgtttatttggctttatgtttatcaaagttgccataatgcagtgagccaaatactagttacgattgtgtttggacagatcatattttaagaatttttataatctactgtagcaccatcttcggtgtggttctgtatgggcatcaaacatttagattgtcgcttgatcatatggaacgtatcagggcccgttcggtttggccggaatgacctggattgtagcccaatcgggcggattggaacggctcggaacgaatacaatccaatataaaaattgtt

SEQ ID NO: 1733 - DNA, 1450 bp, Zea mays
gaaccggcccagcggtggccaaaccggcccgggcacaactacaaggcgtgcggtcgaagaaagaaattgatgaaacggcggccgaggccgcaagcttctcactggccgcaagcaaaccgaacgaacccaaccgaagcgagagctgagcaaggcagaggcggcgtgaccggcgatggagcggctgcagcggatctttggcgcctccggcatggggcagccgccgacggactcgccgctgctcgattcctccgagcaggtctacatctcctccctagcgcttctcaagatgctcaagcacgggagggctggggtgcccatggaggtcatgggcctcatgctcggcgagttcgtcgacgactacaccgtcagggtcgtcgacgtcttcgccatgccgcagagcgggactggtgtcagcgtcgaggccgtcgaccacgtcttccagacaaacatgcttgacatgcttaagcagaccggcaggccagaaatggttgtaggttggtatcactcacatcctggcttcggatgctggctatcaggcgtcgatatcaatactcagcagagttttgaagctttgaaccctagagccgttgctgttgtgatagaccccatccagagtgtgaaggggaaggtggttattgatgcattccgcctcattaatcctcagaccatgatgcttggccaggagccacgtcagacaacatcaaatgttgggcacctaaataagccatctattcaggctcttatccatgggttgaatagacactactattcaattgcaatcaattaccggaaaaatgagcttgaggagaaaatgctgttgaacttgcacaaaaagaaatggaccgatgggctaattttgaagaggtttgacactcactcgaaaaccaacgagcagactgtccaggaaatgctaaacctagccatcaagtacaacaaggcagtgcaggaggaggacgaactgccacctgagaaacttgcgatagcaaatgtgggtcggcaagatgcaaaaaagcatttggaagagcatgtgtcgaatttgatgtcatcaaacatagttcagaccctaggaaccatgctcgacacggttgtcttttagtctactaataatattgttgtcccaaactgaaacatagccacactatcgaagcatgacacatgcaatgagcttgaggccggatacattttggttctaaggtttgtttatgaatggatttgtctacatttcattgttgttaaacttcctgccttttctatcaaagcttcagtgcgttctagttatgtttaagccaaggtggctccagatgtcagttgggatgtcattgccctgggagaactgtgtaatgtgattatgacctgtggcagataacttatttttgagttaatccatcaccacttcattctttattgttagttgtttagtactaatatgtggaatggagtcatcccatca

SEQ ID NO: 1734 - DNA, 1411 bp, Zea mays
tccggaccggcgcatcggttgcctacgactgtgcggtcgaagaaagaaattaatgaaacggcagtcgcaactcgcaagcaaatcgaacgaacccagccgaagcgcgagctgagcaaggcggaggcggcgggaccggcgatggagcggctgcagcggatctttggcgcctccggcatggggcagccgccgacggactcgccgctgctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatactcagcagagttttgaagctttgaaccccagggcagttgctgttgtgatagaccccatccagagtgtgaaggggaaggtggttattgatgcattccgcctaattaatcctcagaccatgatgcttggccaggagccacggcagacgacatcaaatgttgggcacctaaataagccatcgattcaggctcttatccatgggctgaacagacactactactcgattgcaatcaattaccgaaaaaatgaacttgaggagaaaatgttgctgaacttgcacaaaaagaaatggacagatgggctaattttgaagaggtttgacactcattcaaaaaccaacgagcagactgtccaggaaatgctaaacctagccatcaagtacaacaaggcggtgcaggaggaggacgaactgccacctgagaaacttgcgatagcaaatgtaggtcggcaagatgcaaaaaagcatttggaagagcatgtgtccaatttgatgtcatcaaacatagttcagaccctaggaaccatgctcgacacggttgtattttagtctctactaatattgttgttccaaactgaaacatagcccactctatcgaagcatgacacatgcaatgagctcgatgccggatacatttttggttctaagatttgtttacgaatggatttgtctacattctgttgttaaactccctaccttttctatcaaagcttcagtatgttctagttatatttaagccaatgtgggtccacattgtcaattgggatgtcattacccctgggagaaattgtgtaatgcgattatatgacttgttgcgtgggccgcgtgtgatggcttattttgtttgttccacatgcgttggcaccaagtttctcatgcaaatatttgagtgatcttg

SEQ ID NO: 1735 - DNA, 1215 bp, Pennisetum glaucum
ttttctcactagtcgcaagcagatcgaacgaaccgagccggaagcaagagcacagagcaaggcgaggaggcggcggaaccggcgatggagcggctgcagcggatcttcggcgcctcggggatggggcagccgccgtcggactcgccgctgctcgactcctccgagcaggtctacatttcctccctcgcgctcctcaagatgctcaagcacgggagggcgggcgtgcccatggaggtcatgggcctcatgctcggcgaattcgtcgacgactacaccgtcagggtcgtcgacgtcttcgccatgccgcagagcgggaccggggtcagcgttgaggccgtcgaccacgtcttccagacgaacatgcttgacatgctcaagcagaccggcagaccagaaatggttgtaggctggtatcactcgcatcctggcttcggttgctggctctcaggagttgatatcaatactcaacagagttttgaagctttgaaccccagggcggttgctgttgtgatagatcccatccagagtgtcaaggggaaggtggttattgatgcattccgcctcattaatcctcagacaatgatgcttggccaggagccacgacagacgacgtctaatgttggacacctaaataagccgtctattcaggctcttatccatgggctgaacagacactactactcaattgcaatcaattaccgaaaaaacgagcttgaggagaaaatgttgctgaacttgcacaaaaagaaatggactgatggactaattttgaagaggttcgacactcactcgaaaaccaatgagcagactgtccaggaaatgttgaacctagctgtcaagtacaacaaggcagtgcaggaggaggatgagctgccgcctgagaaacttgcgatagcaaatgttggtcggcaagatgcaaagaagcatttggaagagcatgtgtcgaatttaatgtcatcgaacatagttcagaccctaggaaccatgctcgacacggttgtcttttaggctgccactattgttgtacacttgtaccaaactatctacacatacccatttaagtttatggaggcttaacatgtgcaatggccttacgccagatacattttggttctaaggtttgttttatgaatgcattcttctcttgcttggtgttgtttaacttcatctctacaatgttctagctatgttaagctgacgtgagtgcagaagtcc

SEQ ID NO: 1736 - DNA, 1411 bp, Oryza sativa
ccgtcttcacaccgaagcggcggacgagacgactcgcagtcgcagcctctttcctcctccgtctctctctcccctcttcctctcctccgcgcggcgaacgaagcgagcgagcggcggccatggagcggctgcagcggatcttcggggcgtcggggatggggcagccgccgacggactcgccgctgctcgactcctccgagcaggtctacatctcctccctcgccctcctcaagatgctcaagcacgggcgggccggcgtgccgatggaggtgatggggctgatgctcggggagttcgtcgacgactacaccgtcagggtggtcgacgtcttcgccatgccgcagagcgggacgggcgtcagcgtcgaggccgtcgaccacgtcttccagaccaacatgctcgacatgctcaagcagaccgggagaccagaaatggtggtgggctggtatcactcccatcctggatttggatgttggctttcaggtgttgatatcaacactcagcagagttttgaagctttaaatcccagggctgttgcagttgtgatagacccaatccagagtgtcaaggggaaggtggtcattgatgcatttcgtctcattaatcctcagaccatgatgcttggccaggaaccgcgacagacaacatcaaatgttgggcatctaaacaaaccatctatccaggctcttattcacgggctgaacagacactactactccattgcaatcaattaccgcaaaaatgaactggaggagaaaatgttgcttaacttacacaaaaagaaatggaccgatggattgattttgaagagttttgacactcattcgaaaaccaatgagcagactgttcaggaaatgctgaacctagccatcaaatataacaaggcagtgcaggaggaggatgagctgccacctgagaaactagcgattgccaatgtgggacggcaggatgccaagaagcacttggaagagcatgtctcaaatttgatgtcgtcaaacatagttcagaccctaggaaccatgctcgacacggttgtgttctagtctccttctactgttgtgtcaaccctatacagacccccacccaaattattatttatgtttatcgaagcctctgccgtaattctgtaacttttggtgccagctacatttgggttctaacagttcgacttgaagaatttgttttcttttagcacggtgtactgttaatcttctgttgatttcgctgcattttcaaggttccatcacttgatgactagagatcctacgttattgttcaggtgtaccttctctcttcatgatccatgcagatatccgtgttggggacaaaccacttcatttaacacagatatgttgttaagtttttgttgtagagcaaattattaaatacattgataccaatgcgaacgcta

SEQ ID NO: 1737 - DNA, 1425 bp, Sorghum bicolor
aaccggcccaacggtggccgatccggtctcggcacaaggcgtgcggtcgaagaaagaaaatttaataaaaaacggcggccgaggcccggccgcaagccaacccacgatttttttctcactagtccgcaagcaaatcgaacgaacccgctgccgaagcgagagagctgagcagggcgaggcggcgatggagcggctgcagcggatcttcggcgcctccggcatggggcagccgccgacggactcgccgctgctcgactcctccgagcaggtctacatctcctccctcgcgcttctcaagatgctcaagcacgggagggcgggcgtgcccatggaggtcatgggcctcatgctcggcgagttcgtcgacgactacaccgtcagggtcgtcgatgtcttcgccatgccgcagagcgggactggggtcagcgtcgaggccgttgaccacgtcttccagacaaacatgcttgacatgctcaagcagaccggcaggccagaaatggttgtaggctggtatcactcacatcctggcttcggttgctggttatcaggcgttgatatcaatactcagcagagttttgaagctttgaaccccagggcggttgctgttgtgatagaccccatccagagtgtgaaggggaaggtggttattgatgcattccgcctcattaatcctcagaccatgatgcttggccaggagccacggcagacaacatcaaatgttgggcatctaaataagccatctattcaggctcttatccatgggctgaacagacactactactcaattgcaatcaattaccggaaaaatgagcttgaggagaaaatgttgttgaacttgcacaaaaagaaatggacggatgggctaattttgaagaggtttgacactcactcaaaaaccaacgagcagactgtccaggaaatgctgaacctagccatcaagtacaataaggcagtgcaagaggaggacgagctgccacctgagaaacttgcgatagcaaatgtgggtcggcaagatgcaaaaaagcatttggaagagcatgtgtcgaatttgatgtcatcaaacatagttcagaccctaggaaccatgctcgacacggttgtcttttagtctgctaatattgttattccaaactgaaacatagccactctacttaagcttatcgaagcatgacacatttggtcctaaggtttgtttatgaatggatttgtctacaattcattgttgttaaactccttgccttttctatcaaagcttcactgtgttctagttacatttatgccaatgtgggtccagatggcagtcgggatgccattgccttgggagaattgtgtgatgcgattatgacctgttgtctgggccgtggcagatggcttattttgtttgttctatataaattgacaccaagtttctttttagaatgatct

SEQ ID NO: 1738 - DNA, 1423 bp, Sorghum bicolor
aaccggcccaacggtggccgatccggtctcggcacaaggcgtgcggtcgaagaaagaaaatttaataaaaaacggcggccgaggcccggccgcaagccaacccacgatttttttctcactagtccgcaagcaaatcgaacgaacccgctgccgaagcgagagagctgagcagggcgaggcggcgatggagcggctgcagcggatcttcggcgcctccggcatggggcagccgccgacggactcgccgctgctcgactcctccgagcaggtctacatctcctccctcgcgcttctcaagatgctcaagcacgggagggcgggcgtgcccatggaggtcatgggcctcatgctcggcgagttcgtcgacgactacaccgtcagggtcgtcgatgtcttcgccatgccgcagagcgggactggggtcagcgtcgaggccgttgaccacgtcttccagacaaacatgcttgacatgctcaagcagaccggcaggccagaaatggttgtaggctggtatcactcacatcctggcttcggttgctggttatcaggcgttgatatcaatactcagcagagttttgaagctttgaaccccagggcggttgctgttgtgatagaccccatccagagtgtgaaggggaaggtggttattgatgcattccgcctcattaatcctcagaccatgatgcttggccaggagccacggcagacaacatcaaatgttgggcatctaaataagccatctattcaggctcttatccatgggctgaacagacactactactcaattgcaatcaattaccggaaaaatgagcttgaggagaaaatgttgttgaacttgcacaaaaagaaatggacggatgggctaattttgaagaggtttgacactcactcaaaaaccaacgagcagactgtccaggaaatgctgaacctagccatcaagtacaataaggcagtgcaagaggaggacgagctgccacctgagaaacttgcgatagcaaatgtgggtcggcaagatgcaaaaaagcatttggaagagcatgtgtcgaatttgatgtcatcaaacatagttcagaccctaggaaccatgctcgacacggttgtcttttagtctgctaatattgttattccaaactgaaacatagccactctacttaagcttatcgaagcatgacacatttggtcctaaggtttgtttatgaatggatttgtctacaattcattgttgttaaactccttgccttttctatcaaagcttcactgtgttctagttacatttatgccaatgtgggtccagatggcagtcgggatgccattgccttgggagaattgtgtgatgcgattatgacctgttgtctgggccgtggcagatggcttattttgtttgttctatataaattgacaccaagtttctttttagaatgat

SEQ ID NO: 1739 - DNA, 1300 bp, Triticum aestivum
gcacgagccgcaagcttctcactggccgcaagcaaaccgaacgaacccaaccgaagcgagagctgagcaaggcagaggcggcgtgaccggcgatggagcggctgcagcggatctttggcgcctccggcatggggcagccgccgacggactcgccgctgctcgattcctccgagcaggtctacatctcctccctagcgcttctcaagatgctcaagcacgggagggctggggtgcccatggaggtcatgggcctcatgctcggcgagttcgtcgacgactacaccgtcagggtcgtcgacgtcttcgccatgccgcagagcgggactggtgtcagcgtcgaggccgtagaccacgtcttccagacaaacatgcttgacatgcttaagcagaccggcaggccagaaatggttgtaggttggtatcactcacatcctggcttcggatgctggctatcaggcgtcgatatcaatactcagcagagttttgaagctttgaaccccagagccgttgctgttgtgatagaccccatccagagtgtgaaggggaaggtggttattgatgcattccgcctcattaatcctcagaccatgatgcttggccaggagccacgtcagacaacatcaaatgttgggcacctaaataagccatctattcaggctcttatccatgggctgaatagacactactactcaattgcaatcaattaccggaaaaatgagcttgaggagaaaatgctgttgaacttgcacaaaaagaaatggaccgatgggctaattttgaagaggtttgacactcactcgaaaaccaacgagcagactgtccaggaaatgctaaacctagccatcaagtacaacaaggcagtgcaggaggaggacgaactgcctcctgagaaacttgcgatagcaaatgtgggtcggcaagatgcaaaaaagcatttggaagagcatgtgtcgaatttgatgtcatcaaacatagttcagaccctaggaaccatgctcgacacggttgtcttttagtctactaatagtattgttgtcccaaactgaaacatagccacactatcgaagcacacgtgcgatgagcttgacgccgggtacattttggttctaaggtttgtttttgaatggatttgtctacatttcattgttgttaaacttcctgccttttctatcaaagcttcagtgcgttctagttatgtttaagccaaggtggctccagatgtcagttgggatgtcattgccctgggagaactgtgtaatgtgattatgacctgtggcagataacttattttgtttcttct

SEQ ID NO: 1740 - DNA, 1116 bp, Cenchrus ciliaris
tttctcactactagtcgccagcagatcgaacgaacggagagcagcagagagcaaaggcgaggaggcggcggaaccggcgatggagcggctgcatcggatcttcggcgcctccgggatggggcagccgccgtcggactcgccgctgctcgactcctccgagcaggtctacatctcctccctcgcgctcctcaagatgctcaagcacgggagggcgggcgtgcccatggaggtcatgggcctcatgctcggcgagttcgtcgacgactacaccgtcagggtcgtcgacgtcttcgccatgccgcagagcgggaccggggtcagcgtcgaggccgtcgaccacgtcttccagaccaacatgcttgacatgctcaagcagaccggcagaccagaaatggttgtaggctggtatcactctcatcctggcttcggttgctggctctcaggagttgatatcaatactcaacagagttttgaagctttgaaccccagagcggttgctgttgtgatagaccccatccagagtgttaaggggaaggtggttattgatgcattccgcctcattaatcctcagaccatgatgcttggccaggagccacgacagacaacgtctaatgttgggcacctaaacaagccgtctattcaggctcttatccatgggctgaacagacactactactcaattgcaatcaattaccggaaaaatgagcttgaagagaaaatgttgctgaacttgcacaaaaagaaatggaccgatgggctgattttgaagaggtttgacactcactcgaaaaccaatgagcagactgtccaggaaatgctgaacctagccgtcaagtacaacaaggcagtgcaagaggaggatgagctgccacctgagaaactcgcgatagcaaatgttggtcggcaagatgcgaagaagcatttggaagagcatgtgtcgaatctaatgtcatcaaacatagttcagaccctaggaaccatgcttgacacggttgtcttttaggctgcccctattgttgtaccaaactgtttacatatacccactttaagtttatggaggcctgatatgtgcaatgaccttacgccagatacatttctggttctaaggcttgttta

SEQ ID NO: 1741 - DNA, 1477 bp, Setaria italica
gaactggcccagccgcgaccgattcggtcccgggcacaagccgtgcggtcgaagaaagaaatttaaccggcggccgagagcccgagaccgcaagcgaacccacgatttcgcaagcagatcgaacgaaccgagccgaagcgagagcagagagcaaggcaaggaggcggcggaaccggcgatggagcggctgcagcggatcttcggcgcctccgggatggggcagccgccgacggactcgccgctgctcgactcctccgagcaggtctacatctcctccctcgcgctcctcaagatgctcaagcacgggagggcgggcgtgcccatggaggtcatgggcctcatgctcggcgagttcgtcgacgactacaccgtcagggtcgtcgacgtcttcgccatgccgcagagcgggaccggggttagcgtcgaggccgtcgaccacgtcttccagacgaacatgcttgacatgctcaagcagaccggcagaccagaaatggttgtaggctggtatcactcgcatcctggcttcggttgctggctctcaggagttgatatcaatactcaacagagttttgaagctttgaaccccagggcggttgctgttgtgatagaccccatccagagtgtcaaggggaaggtggttattgatgcattccgcctcattaatcctcagaccatgatgcttggccaggagccacgacagacaacgtctaatgttgggcacctaaataagccgtctattcaggctcttatccatgggctgaacagacattactactcaattgcaatcaattaccggaaaaacgagcttgaggagaaaatgttgctgaacttgcacaaaaagaaatggaccgatggactaattttgaagaggtttgacactcactcgaaaaccaatgagcagactgtccaggaaatgctgaacctagccgtcaagtacaacaaggcagtgcaagaggaggatgagctgccacctgagaaactcgcgatagcaaatgttggtcggcaagatgcgaagaagcatttggaagagcatgtgtcgaatttaatgtcatcaaacatagttcagaccctaggaaccatgcttgacacggttgtcttttaggttgtcactcttgttgtacctaactgtctacacatacccactttaagtttatggaggcctgacatgtgcaatgaccttacgccagatacattttggttctaaggtttgtttatgaatgcattcttctgttgcttggtgttgtttaacttcatctttacggtgttctagctatgtttaagccaacgtgggtgcagaagtccagtggattgtaattgttcttgggagacttatgacctgtggtgtgggatgtgggagctgtttttttttctttttttgttggtagggagtgttcccctgtggtgactccatgttaggcactggatgaaaatggatcggatctgtacgatatacatggatcaaattcggatacgaata

SEQ ID NO: 1742 - DNA, 1515 bp, Pennisetum glaucum
agagtacgcgggagaggctccgattccatctcgttcccttcaccgtccccaacgcggcgacaactccaccgccgggagcttccggtcgccgacgagcgcatccccaccggaagactcctccagggttctgcagcaaatatccaatccctaaaaaagagtcacacaagaaaaacacaagcagctgagaagctttccatctctccatagcacatcatcatggagcgcctgcagaggatctttggcgccgctgggatgggacagccaccatcagactcaccgctgctcgactcgtctgagcaggtctacatttcctcccttgcactcctcaagatgctcaaacatgggagggctggtgtgccaatggaggtgatgggtcttatgctgggtgagtttgtggatgactacacagtcagggtggtggatgtgttcgccatgccacagagtggtactggggtcagtgttgaggccgttgatcatgtcttccagaccaacatgcttgacatgctcaagcagaccggaagaccggaaatggttgtagggtggtaccactcccatcctggctttggttgctggctttcaggcgttgacatcaacactcaacagagttttgaagctttaaaccccagggcagttgctgttgtgatagatcccatccaaagtgtcaaagggaaggtggtcattgatgcatttcgtctcattaacccccaaactatgatgcttggccaggagccacgacagacgacatctaatgttgggcacctaaataagccatctattcaggctcttatccatgggctgaacaggcactactactccattgcaatcaactaccgaaagaatgagcttgaggagaaaatgttgctgaacttgcacaaaaagaagtggactgatgggttgattttgaagaggtttgacactcattcgaaaaccaacgagcagactgtgcaggaaatgctgaacttagctgtgaagtacaacaaggcagtgcaagaggaggacgagctgccaccggagaaactggcgattgcaaacgtgggacgccaggatgcgaagaagcatttggaggagcacgtcgctaatttgatgtcttcaaacatagttcagaccctagggaccatgctcgacacagttgtcttttagctttgtaggagtgtgtcctcaatgagtgcagcactgaaattatcttcatttggctccatgttcatcaaagttgccataatgcagccagccaaatacttgttacgattgtgcttcgacagctcagatgttaagtttttttttcataatctactgtagcaccatcatctgtgtggttctgtatgggcatcaaacatttaggttgtcgcttgatctgttgatcatatggaacgcttcagcagtttcaccgttggagtgttcctggtcatacccctttgtctctggttgcaacacatgcatgttcgacatactatacatgaacgcttacccctatgaatgcttgggtaacaacttatgagattgatgaaaattggtcgt

SEQ ID NO: 1743 - DNA, 1133 bp, Pseudoroegneria spicata
ccgaacgctaaggcgagctgaagcaatggagcggctgcagagaatcttcagcggcgccaccgggatggggcagccggggagtgactcgtcgctgctcgactcctccgagcaggtctacatctcctccctcgctctcctcaagatgctcaagcacgggagggccggcgtgcccatggaggtgatgggcctgatgctgggcgagttcgtcgacgactacacggtcagggtggtggatgtcttcgccatgccgcagagcgggaccggggtcagcgtcgaggccgtcgaccacgtcttccagaccaacatgctcgacatgctcaagcagaccgggagacctgaaatggtggtaggctggtaccactcgcatcctggatttggttgctggctttcaggagttgacatcaatactcagcagagttttgaagctttaaaccccagggcagttgctgttgtgatagatcccatccagagtgtcaaggggaaggtggtcattgatgcattccgtctcattaaccctcagaccatgatgcttggccaggaaccacgacaaacaacatctaatgttgggcacctaaacaagccatctattcaggctcttattcacgggctgaacaggcactactactccattgcaatcaattaccggaaaaatgagcttgaggagaagatgctgctgaacttacacaaaaagaaatggactgatgggttgattttaaagaaatttgacacccactcaaagaccaacgaggagactgttcaggaaatgctgagtctggccatcaaatacaacaaggcagtgcaagaggaggatgagctgccccctgagaaactagcgatagcaaatgtcgggcggcaggatgcaaagaagcacctggaggagcatgtctcgaatttgatgtcatcgaacatagtccagaccctagggaccatgctcgacacagtagtcttttagtactggttgttccaactctataatctatatatacagaactgtctgttatgtttgttgctcagtctgtcataatgctgtgaggcagtgttagattttttggtctgatgtagcaccatgcggtgagactatcttctgtacggcatactgttaatctactagtcctactaatatctccccggca

SEQ ID NO: 1744 - DNA, 1288 bp, Panicum virgatum
ttttctcacgagtcgcaagcagatcgagcgaacgaacccagccgaagagagagcgcagagcgaggcgagtcgaggcggcggcggaaccggcgatggagcggctgcagcggatcttcggcgcctccgggatggggccgccgccgacggactcgccgctgctcgactcctccgagcaggtctacatctcctccctcgcgctcctcaagatgctcaagcacgggagggcgggcgtgcccatggaggtcatgggtctcatgctcggcgagtttgtcgacgactacaccgtcagggtcgtcgacgtcttcgccatgccgcagagcgggaccggggtcagcgtcgaggccgttgaccacgtcttccagacgaacatgcttgacatgctcaagcagaccggcagaccagaaatggttgtaggctggtatcactcacatcctggcttcggttgctggctctctggagttgatatcaatactcaacagagttttgaagctttgaatcccagggctgttgctgttgtgatagatcccatccagagcgtgaaggggaaggtggttattgatgcattccgcctcattaatcctcagaccatgatgcttggccaggagccacggcagacgacatcaaatgttgggcacctaaataagccatctatccaggctcttatccatgggctgaacagacactactactcaattgcaatcaattacaggaaaaacgagcttgaggagaaaatgttgttgaacttgcacaaaaagaaatggactgatggactaattttgaagaggtttgacacacactcgaaaaccaacgagcagactgtccaggaaatgctgaacctagccatcaagtacaacaaggcagtgcaagaggaggatgagttgccacctgagaaacttgccatagcgaatgtgggtcggcaggatgcaaagaagcatttggaagagcatgtgtcgaatttgatgtcgtcaaacatagttcagaccctaggaaccatgcttgacacggttgtcttttagcctacagctattgttgctccaaacaatctacacatacccattttattgaagcccctgacacatgaatgagcttgacgccagatacattttggttctattgtttgtttatgaatgcattgttctgtagcatgctgttgttaaacttcttgctttttttttctatcaaagctttaggctattctaattatgtttaagctgatgtatcaagtaggatgtcattgttcttgggagacttatataatgggattatgacctgtggtgtgggctgtggc

SEQ ID NO: 1745 - DNA, 1372 bp, Brachypodium distachyon
cgattacgagggtcctgtgatactgcggctgtgctggttgctgcacggaacagccgcaccagcacagccgcggcgagaagccaaggagtcgcgacttgcgaggcaaggacgagaagccatggagcgtctgcagagaatcttcagcaccgggatggggcagtcgccgtcggactcaccgctgctcgattcctccgagcaggtctacatctcctccctcgcgctcctcaagatgctcaaacacgggagggccggcgtgccgatggaggtgatgggcctgatgctgggcgagttcgtcgatgactacacggtcagggttgtggatgtcttcgccatgccgcagagcgggacaggggtcagcgtcgaggctgttgatcacgtcttccagaccaacatgctcgacatgctcaagcagaccgggagacctgaaatggtggtaggctggtaccattcacatcccggatttggttgctggctttcaggagttgacattaacactcaacagagttttgaagctttaaaccccagagcagttgctgttgtaatagatcccatccagagtgtcaaggggaaggtggtcattgatgcattccgtctcattaaccctcagaccatgatgcttggccaggagccacgacagacaacatctaatgttgggcacctaaacaagccatctattcaggctcttattcatgggctaaacaggcactactactccattgcaattaattaccgaaaaaatgagcttgaggaaaagatgttgctgaacttgcacaaaaagaaatggactgatggattgattttgaaacggtttgacactcattcaaagaccaacgaggagactgttcaggaaatgctgagcctggccatcaaatacaacaaggcagtgcaagaggaggatgagctgccacctgagaaactagcgatagcaaatgttggacgacaggatgcaaagaagcatttggaagagcatgtctcgaatttgatgtcatcaaacatagttcagaccctagggactatgctcgatacagttgtcttttagtctgctactaccagttatctcaattctttacacagaacttgtctgttactttttgttcacagttagcttgatgtaaggcacatattaggcaaaagaaaattctgctgtagaacaacttgacaattttctgtcaatcttttgatattttttaatgttccatgtattaagccctagcaaattctaggtttgcatgttcttatgagatttctctaccgaataaaaaatttattcatgctttaataaatatctgtagcactggagcatgttctgaccccccatttggcctatcaatagaatttacctgacatgtctttggctcaagtggagcacaac

SEQ ID NO: 1746 - DNA, 1200 bp, Hordeum vulgare
ggcgcgatccgaaggcgaaggccagctgaagccatggagcggctccagagaatcttcagcggcgcgaccgggatggggcagccggggaccgactcgccgctgctcgactcctccgagcaggtctacatctcctccctcgccctcctcaagatgctcaagcacgggagggccggcgtgcccatggaggtgatgggcctgatgctgggcgagttcgtcgacgactacacggtcagggtggtggatgtcttcgccatgccgcagagcgggaccggggtcagcgtcgaggccgtcgaccacgtcttccagaccaacatgctcgacatgctcaagcagaccggaagacctgaaatggtggtaggctggtaccactcgcatcctggatttggttgctggctttcaggagttgacatcaatactcagcagagttttgaagcgttaaaccccagggcagttgctgttgtgatagatcccatccagagtgtcaaggggaaagtggtcattgatgcattccgtctcattaaccctcagaccatgatgcttggccaggagccacggcagacaacatcgaatgttgggcacctaaacaaaccatctattcaggcacttattcatgggctgaacaggcactactactctattgcaatcaactaccggaaaaatgagcttgaggagaagatgttgctgaacttgcacaaaaagaaatggacagatgggttgattataaagaaattcgacacccactcaaagaccaacgaggagactgttcaggaaatgcttagtctggccatcaaatataacaaggcagtgcaagaggaggatgaactgccgcctgagaaactggcaatagcaaatgtcgggcggcaggatgcaaagaagcacttggaggagcatgtctcgaatttgatgtcatcgaacatagtccagaccctagggaccatgctcgacacagtggtcttttagtagtcgtcgttccaactctatatacagaactgtctgttatttttgttggtcagtctgtcataatgcagtgaggcagtgttagattttgtttgtctggtgtagcaccatgcggcgagactatcttctgtatggcataccgttaatctactagtcctattaattaaaggaaacacttcccgtcatacgactgatccttacaaatcgtcagaccaatgttgcaccgccgatctgttgtacggg

SEQ ID NO: 1747 - DNA, 1297 bp, Hordeum vulgare
acaaaaactgaactaattggcagcccaactcgcctgtgtgaagcaaccgcggcgagaagcaaaggaggaggcgcgatccgaaggcgaaggccagctgaagccatggagcggctccagagaatcttcagcggcgcgaccgggatggggcagccggggaccgactcgccgctgctcgactcctccgagcaggtctacatctcctccctcgccctcctcaagatgctcaagcacgggagggccggcgtgcccatggaggtgatgggcctgatgctgggcgagttcgtcgacgactacacggtcagggtggtggatgtcttcgccatgccgcagagcgggaccggggtcagcgtcgaggccgtcgaccacgtcttccagaccaacatgctcgacatgctcaagcagaccggaagacctgaaatggtggtaggctggtaccactcgcatcctggatttggttgctggctttcaggagttgacatcaatactcagcagagttttgaagcgttaaaccccagggcagttgctgttgtgatagatcccatccagagtgtcaaggggaaagtggtcattgatgcattccgtctcattaaccctcagaccatgatgcttggccaggagccacggcagacaacatcgaatgttgggcacctaaacaaaccatctattcaggcacttattcatgggctgaacaggcactactactctattgcaatcaactaccggaaaaatgagcttgaggagaagatgttgctgaacttgcacaaaaagaaatggacagatgggttgattataaagaaattcgacacccactcaaagaccaacgaggagactgttcaggaaatgcttagtctggccatcaaatataacaaggcagtgcaagaggaggatgaactgccgcctgagaaactggcaatagcaaatgtcgggcggcaggatgcaaagaagcacttggaggagcatgtctcgaatttgatgtcatcgaacatagtccagaccctagggaccatgctcgacacagtggtcttttagtagtcgtcgttccaactctatatacagaactgtctgttatttttgttggtcagtctgtcataatgcagtgaggcagtgttagattttgtttgtctggtgtagcaccatgcggcgagactatcttctgtatggcataccgttaatctactagtcctattaattaaaggaaacacttcccgtcatacgactgatccttacaaatcgtcagaccaatgttgcaccgccgatctgttgtacgggtcactacaaaaaagaaaatgaaaaaaaa

SEQ ID NO: 1748 - DNA, 1301 bp, Brachypodium distachyon
cgattacgagggtcctgtgatactgcggctgtgctggttgctgcacggaacagccgcaccagcacagccgcggcgagaagccaaggagtcgcgacttgcgaggcaaggacgagaagccatggagcgtctgcagagaatcttcagcaccgggatggggcagtcgccgtcggactcaccgctgctcgattcctccgagcaggtctacatctcctccctcgcgctcctcaagatgctcaaacacgggagggccggcgtgccgatggaggtgatgggcctgatgctgggcgagttcgtcgatgactacacggtcagggttgtggatgtcttcgccatgccgcagagcgggacaggggtcagcgtcgaggctgttgatcacgtcttccagaccaacatgctcgacatgctcaagcagaccgggagacctgaaatggtggtaggctggtaccattcacatcccggatttggttgctggctttcaggagttgacattaacactcaacagagttttgaagctttaaaccccagagcagttgctgttgtaatagatcccatccagagtgtcaaggggaaggtggtcattgatgcattccgtctcattaaccctcagaccatgatgcttggccaggagccacgacagacaacatctaatgttgggcacctaaacaagccatctattcaggctcttattcatgggctaaacaggcactactactccattgcaattaattaccgaaaaaatgagcttgaggaaaagatgttgctgaacttgcacaaaaagaaatggactgatggattgattttgaaacggtttgacactcattcaaagaccaacgaggagactgttcaggaaatgctgagcctggccatcaaatacaacaaggcagtgcaagaggaggatgagctgccacctgagaaactagcgatagcaaatgttggacgacaggatgcaaagaagcatttggaagagcatgtctcgaatttgatgtcatcaaacatagttcagaccctagggactatgctcgatacagttgtcttttagtctgctactaccagttatctcaattctttacacagaacttgtctgttactttttgttcacagttagcttgatgtaaggcacatattaggcaaaagaaaattctgctgtagaacaacttgacaattttctgtcaatcttttgatattttttaatgttccatgtattaagccctagcaaattctaggtttgcatgttcttatgagatttctctaccgaataaaaaatttattcatgctttaataaatatctgtagcactggagc

SEQ ID NO: 1749 - DNA, 1335 bp, Avena sativa
gacttcacaaaaaataaaaattagtccatcctcgccgcaaccgggtactctcgcctgtgtgcagcaaccgcggagagaagcagaggaggaggaggagagatccgagaaacgccatggagcgcctgcagcgaatcttcggccaaaccgggatgggacagccggggagcgactcgccgctgctcgactcctccgagcaggtctacatctcctccctcgcgctcctcaagatgctcaagcacgggagggccggcgtgccgatggaggtgatgggcctgatgctgggcgagttcgtcgacgactacacggtcagggtggtggatgtcttcgccatgccgcagagcgggaccggggtcagcgtcgaggccgtcgaccacgccttccagaccaacatgctcgacatgctcaagcagaccgggagacctgaaatggtggtaggctggtaccactcacatcctggatttggttgctggctttcaggagttgacatcaatactcagcagagtttcgaagctttaaaccccagggcagttgctgttgtgatagatcccatccagagtgtgaaggggaaggtggtcattgatgcattccgtcttattaaccctcagaccatgatgcttgggcaggagccacgacagacaacatcgaacgttggccacctaaacaagccgtctattcaggctctcattcacgggctgaacaggcactactactccattgcaatcaattaccggaagaatgagctcgaggagaagatgttgctgaacttacataaaaagaaatggactgatggtttgattttgcggaagtttgacactcattcaaagaccaacgaggagactgttcaggaaatgctgagcctggccatcaaatacaacaaggcagtgcaagaggaggatgagctgacacctgagaaactggcgatagcaaatgttgggcggcaggatgcgaagaagcatctggaggagcatgtctcgaatttgatgtcgtcgaacatagttcagaccctagggaccatgctagacacagttgtcttttagttggctttccaaatctttacactgaactttctgttatcataatgcaacgagattgataccagctacaggctaggtattttgttcgctgtagcattatgtggctatcttctgtacggtgtactgttactactcctaatatttttttttcgcaaaacaaatgtaccatcaatgtgcttattctggatatgcctgttcttgggagactttctgccagaaggtacgttacctttattcttgttctaagtagtacctactagtactggatcaacaaggttatagaattacgaccctactcccc

SEQ ID NO: 1750 - DNA, 1177 bp, Avena sativa
gacaaaaaataaaaattagtccatcctcgccgcaaccgggtactctcgcctgtgtgcagcaaccgcggagagaagcaaaggaggaggagagatccgaggagacgccatggaacgcctgcagcgaatctttggccaaactgggatggggcagccggggagcgactcgcctctgctcgactcctccgagcaggtctacatctcctccctcgcgctcctcaagatgctcaagcacgggagggccggcgtgccgatggaggtgatgggcctgatgctgggcgagttcgtcgacgactacacggtcagggtggtggatgtcttcgccatgccgcagagcgggaccggggtcagcgtcgaggccgtcgaccacgccttccagaccaacatgctcgacatgctcaagcagaccgggagacctgaaatggtggtaggctggtaccactcacatcctggatttggttgctggctttcaggagttgacatcaatactcagcagagtttcgaagctttaaaccccagggcagttgctgttgtgattgatcccatccagagtgtcaaggggaaggtggtcattgatgcattccgcctcattaaccctcagaccatgatgcttgggcaggagccacgacagacaacatcgaatgttgggcacctaaacaagccatctattcaggctctcattcacgggctgaacaggcactactactccattgcaatcaattacaggaaaaatgagctcgaggagaagatgttgctgaacttacataaaaagaaatggactgatggtttgattttgcggaagtttgacacccattcaaagaccaatgaggagactgttcaggaaatgctgagcctggccatcaaatacaacaaggcagtgcaagaggaggatgaactgacgcctgagaaactggcgatagcaaatgttgggcggcaggacgcgaagaagcatctggaggagcatgtctcgaatttgatgtcgtcgaacatagttcagaccctagggaccatgctagacacagttgtcttttagtttgctttccaaatctttgcactgaactgtctgttaccataatgcaactcgagattgataccagctactggttaggtattttgtttgctgtaccactatgtggccatcttctgtacggtgtactgttactactcctattattttttt

SEQ ID NO: 1751 - DNA, 1150 bp, Elaeis guineensis
gaacgcccgaggttgagatggagcggctgcatcgcatcttctcgggggcgggagcgatggggcacccgcccactgactccccgctgctcgactcgtcggagcaggtctacatctcctccctcgccctcctcaaaatgctgaagcacgggagggctggggttccgatggaggtgatggggttgatgctgggggagttcgtggacgagtacacggtgcgggtggtggacgtgttcgccatgccgcagagcgggaccggcgtcagcgtcgaggctgtcgatcatgtctttcagaccaatatgctcgatatgctcaagcagaccggaaggcctgaaatggtggtaggctggtaccactctcatccaggctttggttgttggctttctggggtcgatataaatacacagcagagttttgaagccctgaatccaagggcagtagcagttgtcatagatccaatccagagcgttaaagggaaagttgtcattgatgcgttccgcttgatcaatcctcagaccatgatgctaggccaagaacctcgccagactacttccaatgttgggcatctgaacaaaccatccattcaggcacttatccatggtttgaatcggcattactactcaatagctataaattatcgaaaaaatgagcttgaagaaaagatgttactaaacctgcacaaaaagaagtggactgatggattgactttgcggaagttcgatacccattccaaaactaacgagcagactgtgcaggaaatgctgaatttagccatcaagtataacaaagcagttcaggaggaagatgagctgccaccagagaagctggcgattgcaaatgttggaaggcaagatgcaaagaagcatttggaagagcatgtctcgaacttgatgtcatcaaacatagttcagactctggggaccatgctagacacagttgtgttctaacaggtctacattgcagaagacatgcttgcttaactttcttagttgaaccgagttagatcgtctttttcttttttccaaaatgaatctcatgcggactggctttgagtgacgatgatattgttgttaacgggatagcaaatttcaggagcatgagggaccatatttgcgagtaagcccttatattgaagttctccattcaaatttca

SEQ ID NO: 1752 - DNA, 1008 bp, Elaeis guineensis
tggagaggctgcatcggatcttctcaggggcgggagggatggggcaccccccaacggactccccactgttggactcgtcggagcaggtctacatctcctccctcgccctcctcaagatgctcaagcacgggagggctggggtgccgatggaggtgatggggctgatgctgggggagttcgtggacgagtacactgtgcgggtggtggacgtattcgccatgccgcagagcgggaccggcgtcagcgtcgaggccgtcgaccacgttttccagaccaacatgctcgatatgctcaagcagactggaaggcctgaaatggttgtgggatggtaccattctcatccaggctttggttgttggctttctggcgttgatataaatacgcagcagagttttgaagccttgaatccaagggcagtagccgttgtcatagatccaattcagagtgttaaggggaaggtggttattgatgctttccgcttgatcaatcctcagaccatgatgctaggccaagagcctcgccagactacttctaatgttgggcatctcaacaagccatctattcaggcactcattcatgggttgaatcgacattactactctatagccattaactatcggaaaaatgagcttgaagaaaagatgttgctgaacctgcacaaaaagaaatggactgatggactgacactgaggcggtttgatgcacattctaaaactaatgagcagactgtgcaggaaatgctaaacttagccatcaaatataacaaagcggttcaggaggaagatgagctgccaccagagaagctggcaatcgtgaatgttggaaggcaagatgcgaagaagcatctagaagaacatgtctcaaacctgatgtcatctaatatagtccagacattggggaccatgctagacactgttgtattctaagaatgtctacatttcagaaaaaacatgcatggctttctgtcttatttgaacttgttccatcatttatttgctcaaaatgaat

SEQ ID NO: 1753 - DNA, 1307 bp, Phalaenopsis aphrodite
cttctctcccgcttcgcagcatttccaattctggaaccctagctcgccggagtcgactcatcgataccaaaagagagggatagagatagagttttattcataatggaaaggcttcaccgtattttctctggcgctggagcgatgggtcatccgcccaccgattctccgctcctcgactcatccgagcaggtctacatctcatcgcttgctcttctcaagatgcttaagcacggcagggcgggggtgcccatggaggtgatggggcttatgctcggagaattcgtggatgaatataccgttcgagtggtcgatgtcttcgccatgcctcagagcggcactggagtcagtgttgaggccgtcgatcacgtcttccagaccaacatgctcgatatgctaaagcagaccggaaggcctgaaatggtggtagggtggtaccattcccatcctggatttggttgttggctgtctggcgttgatattaacacccagcagagctttgaagccttgaatccgagagctgttgctgttgtggtcgaccccatccagagtgttaaagggaaggtggtgatcgatgctttccgtttgatcaacccgcagaccatgatgctcgggcaagagcctcgccagaccacttccaacttgggacatctcaacaaaccctccatccaggcactcattcatgggctgaaccggcactactactctatagccatcaattatcggaaaaatgagctggaagagaaaatgcttctgaatctgcataagaagaaatggacggatggcttaacgttgagacgatttgatgcccattcaaaaaccaatgagcaaacggtgcaggagatgctaaacttagctataaaatataacaaagcggtccaagaggaggatgaactgccgccggagaaattggccatcgcgaacgtgggcaggcaagatgcaaagaagcatttggaggagcatgtctccaatctaatgtcctccaatatagtccagaccctcggtactatgcttgatacggtagtcttctagtcttcctacatctcacctcaccattttgttttatgcttcgctggaatcaactcttattggcagtctctctgtgtattgtttacttcgtcagttgaatgtcccctttataattgtttggaactgctttaatttatagtagaggaggagacgttattcaggttacttgggtgtggctttctttgtatgaacggaggacttgtccgatgcgcttttaatagaatgaatgtgttgcgactgccttttgtttcatgatgattgcaatgcattggagaatcacc

SEQ ID NO: 1754 - DNA, 1428 bp, Phalaenopsis aphrodite
acctccaaagcttccatctttctcctctttctctcccgcttttgcttatctaaatccctcaaatccgttttccaacgggatttcactaaatcctggatttgaggacgcgttcatttgccttttggcagaattcagcataaatcctactcaaaaccggcgaccaaatagtcccttataatggagaggcttcaccggatattctctggggccggagggatgggccacccgccctccgattctcctctcctcgactcatccgagcaggtctacatctcatcgcttgctcttctcaagatgcttaagcatggcagggcaggtgttccgatggaggtgatggggcttatgctcggagaattcgtggacgagtacaccgttagggtggtggatgtcttcgccatgcctcagagcggcactggagtcagtgttgaggccgtcgatcacgtcttccagaccaacatgctcgatatgctgaagcagaccggaaggcctgaaatggtggtagggtggtatcattcccatcctgggtttggttgttggctctctggcgttgatattaacacccagcagagctttgaagccttgaatcctagagccgttgctgttgtggtcgaccccatccagagtgttaaagggaaggtggtgatcgatgctttccgtttgatcaacccacagaccatgatgctcggccaagagcctcgccagaccacttccaacctggggcatctcaacaaaccctccatccaggctctcattcatggcctcaaccggcactactactctatagccatcaactatcggaaaaacgagcttgaagaaaaaatgcttctgaatctacataagaagaaatggacagacggcttaacgttgcgacgatttgactcccattcaaaaaccaatgagcaaacggtgaaggagatgctgaacttagctataaaatataacaaagcagtccaagaggaggatgaactgccaccggagaaattggccatcgccaatgtgggcaggcaagacgcaaagaagcatttggaggagcacgtgtccaatctaatgtcttccaatattgtccagacgctgggtacaatgctggatacggttgtattctaaatctctcacggttttctgctccggaatcactcatctctctttgcgtcagctgaatgttgttaaatttatcgcaactggttcgatagaatgtgttgcaattgccttttatttcatgatgaatgagctggagaaaacttgctatgaaatacgttgtcagactgattttatttaaaattacatttgtgcttttagatttgtttagaactggctaggcaaaattaatacgtgcggtccggataatagtctggatgcagtcatgctactataaacgcacggcggcccatccgaactgtcatccagagttgcggccgccgcatgtaataa

SEQ ID NO: 1755 - DNA, 1402 bp, Phalaenopsis aphrodite
tgagaggcgacgggatcgcaacaaaaacctccaaaacttccatctttctcctccttccctcccgcttttgctcatctaaatccctcaaatccgtcttccaaagggatttcactaaatcctgaatttgaggacgcgttcgtttgccgtttggcagaattcagcataaatcttgctcaaaaccggcgaccgaatagtcccttataatggagaggcttcaccggatattctctggggccggagggatgggccacccgccctccgattctcctctcctcgactcatccgagcaggtctacatctcatcgcttgctcttctcaagatgcttaagcatggcagggcgggtgttccgatggaggtgatggggcttatgctcggagaattcgtggacgagtacaccgttcgggtggtggatgtcttcgccatgcctcagagcggcactggagtcagtgttgaggccgtcgatcacgtcttccagaccaacatgcttgatatgctgaagcagaccggaaggcctgaaatggtggtagggtggtatcattcccatcctgggtttggttgttggctctctggcgttgatattaacacccaacagagttttgaagccttgaatcctagagccgttgctgttgtggtcgaccccatccagagtgttaaagggaaggtggtgatcgatgctttccgtttgatcaacccacagaccatgatgctcggccaagagcctcgccagaccacttccaacctggggcatctcaacaaaccctccatccaggctctcattcatggcctcaaccggcactactactctatagccatcaactatcggaaaaacgagctcgaagaaaaaatgcttctgaatctacataagaagaaatggacagacggcttaacgttgcgacgatttgactcccattcaaaaaccaatgagcaaacggtgaaggagatgctgaacttagctataaaatataacaaagcagtccaagaggaggatgaactgccaccggagaaattggccatcgccaatgtgggcaggcaagacgcaaagaagcatttggaggagcacgtgtccaatctaatgtcttccaatattgtccagacgctgggcacaatgctggatacggttgtattctaaatctctcacggttttctgctccggaatcactcctctctctttgcgtcagctgaatgttgttaaatttatcgcaactggttcgatagaatgtgttgcaattgccttgtatttcatgatgaatgagctggagaaaacttgctatgaaatacgttgtcagactgattttatttaaaattacatttgtgcttttagatttgtttagaactggcaaggcaaaattaatacgtgcggtccggataatagtctggatgcggtcatgctactataaacgc

SEQ ID NO: 1756 - DNA, 1261 bp, Platanus occidentalis
gcaaccaaggcttcataaactcatcttacgtttccctcaaaacgatcagaaaaagcaatcagttgcggcagtgaaggccacggtttgaagaaaagccatggagagattgcagagaattttctcgggtgcaggtggaatgggtcatcctcctcctgactctccccttctcgattcatccgagcaggtttacatctcctctcttgccctcctcaagatgctcaaacacgggagagctggggttcccatggaagtcatggggttgatgcttggtgagtttgtagatgagtacactgtccgtgtcgtggatgttttcgcaatgccgcaaagtggtaccggtgttagtgttgaggcagttgatcatgtctttcaaaccagcatgcttgatatgctcaagcagactggcagacctgaaatggtggtaggttggtaccattcacatcctggctttggctgctggctttctggggttgacattaatacccagcagagtttcgaagctctaaatcaaagggctgtcgcagtggtggtagatccaatacagagtgttaaagggaaggtggtaatagatgccttccgcttgatcaacccacagaccatgatgcttggccaagagccacgccagacaacttccaaccttggacatctgaacaagccatctattcaggcattgatccatggactaaaccgacattactactcgatcgccattaactacaggaagaatgaacttgaggaaaaaatgttactgaacctacacaagaagaaatggactgatggtttgacattacaacggtttgacgcccactccaaaaccaatgagcagactgtgcaggagatgctgaacctggccatcaagtacaataaagcggttcaggaagaggatgagctgcctcctgaaaagcttgccattgcaaatgtaggtaggcaggatgccaagaagcatttggaagagcacgtatccaacttgatgtcatcaaatatagttcagactctaggaaccatgctggacacagtagtattctaagtgagcggttgtctccaagataccatggtggttctgttggattacattacttttccctgaaattgtcctgttgtagcaactaaggaactgccacagttgaacgttgagtcacatatttcattgtgatttagtgtaccgattccggactgttagtgtaggaaataaaccgatcttgcatcttatcaatgacacctatttgataactgagacgtagagccttcattttgttcccaagtt

SEQ ID NO: 1757 - DNA, 1024 bp, Cynodon dactylon
cggatcttcggcgcctccgggatggggcagccgccgacggactcgccgctgctcgactcgtccgagcaggtctacatctcctccctcgcgctcctcaagatgcccaagcacgggagggccggcgtgccgatggaggtcatgggcctcatgctcggcgagttcgtcgacgactacaccgtcagggtcgtcgacgtcttcgccatgccgcagagcgggaccggggtcagcgtcgaggccgtcgaccacgtcttccagaccaacatgctcgacatgctcaagcagactggcagacctgaaatggtggtaggttggtaccactcccatcctggctttggttgctggttgtctggagttgacattaatactcaacagagctttgaagcattgaaccccagggcagttgctgttgttatagaccccatccagagtgtcaaggggaaggtggttatagatgcatttcgcctgattaaccctcagaccatgatgcttggccaggagccgcgccaaacaacatctaatgttgggcacctaaataagccatctattcaggcccttattcatggtctgaacagacactactactccattgcaatcaattaccggaaaaatgagcttgaagaaaagatgctgctgaacctgcacaaaaagaaatggactgatggattaattttgaagaggtttgatactcattcaaaaaccaacgagcaaactgttcaggaaatgctgaacctagccatcaagtataacaaggcagtgcaagaggaggatgaacttccgcctgagaaaatggcgattgcaaatgtgggtcggcaagatgccaagaagcatttggaggagcatgtctcaaatttgatgtcatcaaacatagttcagacccttgggaccatgctagacactgttgtcttttagtctcccaatactagttcccagaatacacatacttgctctattgttgtggtgttaaacaatctctggcatatgaattcgagaccccaggtggttgtatttaaaagtttgcgaagat

SEQ ID NO: 1758 - DNA, 1305 bp, Aristolochia fimbriata
aggaagccaaccgtgtgaccattgaataactgctgtagcaataaattatggaacactttcaacacaaatccattgtaatattttcaggttcctaccgattcaaccttccgtcttcggctatgtgaggattaaacaacaaaatcaaaccgagaaaaagttcaaacagctgagctatttcagtcgagataagtacatcatcgattcccatcaatagatacgcatacgtgttgaaatgggaggatcgctaatccggcgcacctgcattagtttcttcagcttcaactagaatacaacagtatccaacatggttcccagagtctgaatgatgttggatgacatcaaattggagacatgctcctccaggtgcttctttgcgtcttgcctccccacgttagcaatagctagcttttctggaggtaattcgtcctcctcctgaaccgccttgttgtacttaatggccaaattcagcatctcctggacagtctgttcatttgttttggagtgggtatcgaaccgttgtaaagtcaagccatcagtccattttttcttatgtaggtttagcaacatttttttcctccaattcattcttccggtagttaatggcaatggagtagtaatgacggttcaagccatggatcaatgcctggatggaaggtttattgagatgaccaaggttggaagtggtctgccgcggttcttggccaagcatcatggtttgtgggttgatcaagcggaaggcatcaatcactactttccctttaacactttgaattgggtccaccaccactgcaacagctctttgattcagagcctcaaagctctgctgagtattaatgtccacaccagagagccaacagccaaaaccaggatgggaatggtaccatcctaccaccatttctggtctgccagtctgcttgagcatatcaagcatgttagtctgaaatacatgatcgacggcttcaacgctaacgcccgtcccactctgcggcatcgcgaaaacatcaacgacgcgaacggtatactcgtccacaaactccccgagcatcagacccataacctccataggaaccccagccctcccgtgcttgagcatcttgaggagcgcaagcgaagagatataaacctgttctgaggaatcgagaagtggagaatccggaggaggatgccccattcccccggcgccggaaaatatcctctgcagtcgctccatgtctgcgaattccactcgacaactcgccgcaccgtcccggcaaacgttggtctgcttggagtagccttgaagaaatctgagacgtcgccccccga

SEQ ID NO: 1759 - DNA, 1360 bp, Chelidonium majus
gtatatatataggaggaggattgataacaataacatatattattttctcgttatttgatactcgtagcagatcgatcgattagagagagaaccaaagtgaagaaagaaagtgttcaaaatcaatctatggagaggttacagaggatattggccggagcaggagggatgggacatccacctccagattcaccgctcttggattcatctgaacaagtttatatttcttctctcgccctactcaagatgctcaaacacggaagagctggggttccgatggaagtgatgggtttaatgctcggtgactttgttgatgagtatactgtccgtgtcgtcgatgtcttcgccatgccccagagcggtacaggtgttagtgtggaggcagttgatcatgttttccagactaacatgcttgatatgctcaagcagactggcagaccagaaatggtggtaggatggtaccattcacatcctggatttggctgttggctttctggtgttgatattaatacgcaacagagttttgaagctttgaatcaaagagctgttgcagtggtagtggacccaatccagagcgttaagggaaaggtggttattgatgctttccgtttgatcaatcctcaaaccatgatgcttggccaggagccaaggcagacgacttccaaccttggtcatctcaacaaaccatccattcaagcgttgatccatgggttgaacaggcattattactcgatagccattaattacaggaagaatgagcttgaggagaaaatgctactaaatctacacaagaagaaatggactgatggcttgactcttcagagatttgacacccattcgaaaaccaacgagcagactgttcaggagatgctaggcctggccataaaatacaataaagctgttcaggaggaggatgagttgtcgccggagaagcttgctattgcgaatgtgggcaggcaagatgccaaaaagcacttagaggagcatgtctctaacctgatgtcgtcgaacatagttcagaccttgggaaccatgctagacacggtcgtgttctaagtttcatccatttgactgaaggttgccactccttcggtacttcccataatttacttctttgtactagtggaacctaaaaagaagtggtaggtatgttttattgggttcacacatacccttatcctttatttgaacttttcatgcaagtagtacgtacgaatcaaatatcaaagtacaattgtaaacagtttttgtcctggatgtgttacactttaagtgagtttcgtcccccttatcaaatatcaaagtacaattgtaaacagttttaggtgttatgtccagtggattgaaagttatccaatgattc

SEQ ID NO: 1760 - DNA, 1481 bp, Amborella trichopoda
atgcaggcacatttcgggctttttctttctactttgcctctgacccaagaaacgtccctcaaactcagcaggttctgttttactttttgaaacaaaataaagtccttactgcccataagagatagagttgtgaggaatggaacgcctacagagaatcttctctggtgcaggaggtatgggacacccacctccagattcacctctcctcgactcttctgaacaggtctacatctcctcccttgcccttctcaagatgctcaaacatggaagagctggagttcccatggaagttatgggcctgatgcttggtgagtttgtggatgaatatactgtgcgagttgtggatgtttttgcaatgccccaaagtggaactggagtgagtgtggaagctgttgatcatgtttttcagacaaatatgcttgatatgctcaagcagactggaagaccagagatggttgttggctggtaccattcacatccaggctttggttgttggctttctggtgttgacataaatacccaacagagttttgaggccttgaaccaaagggcagttgcagtggtcgtagatccaatccaaagtgtcaaaggtaaggtggttattgatgcctttcgcttgatcaatcctcagaccatgatgcttggccaagagccacgtcaaactacttcaaacctcgggcacctcaacaagccatccattcaggctttgatccatgggctcaacaggcactactactctatagccatcaattacagaaagaatgaactggaagagaagatgttacttaacctccacaagaagaagtggactgatggtttgacactgcagcggtttgatgtccattcaaaaactaatgaacagactgtacaggagatgctgaacctggctattaagtataacaaagcagttcaggaagaggatgagttgcccccagaaaagcttgccattgccaatgttggaaggcaagacgccaagaagcatttggaggagcatgtttccaacttgatgtcttcaaatataattcagattctggggacaatgcttgacacagtggtgttctagagaaagagagaaaacgagagagagagagagagatttcccttttgcaagctctctgatcattccctttcagagaagaagattatgatttctctcatgggatatataccattcatctatgactcagagctttgtgctgcaccttagactataatcatttcacattatttttgtggtggtgctatgttatttgacatttcttgttaatgtcaaaactagggttttaagtccagaattgctttaggctctctctctctctctctctctcttgatatgattggagctgttttaaacttgtctacactgtttttccacttatttgtttgtctgactgtacaaaagcctcgagacgtttgaggcgatcggtcaaactgggttgtacaattattgcttttgtgttcaagaattttgatccttcaac

SEQ ID NO: 1761 - DNA, 1436 bp, Persea americana
atcagtcggtgtgcagaacacgagagagagagagagagagaagaagatggagagattgcagaggctatttgcaggagctggtggaatgggagtaggtcaccctcctccggactcgcctctcctcgattcctccgagcaggtctacatctcttccctcgcccttctcaaaatgctcaaacacggaagagctggggtacctatggaagtgatggggttgatgctaggtgagtttgtcgatgagtacactgttcgtgtcgtggatgtctttgcaatgccgcagagtggtactggagttagcgtcgaggccgttgatcatgtgttccagaccaacatgcttgatatgctcaagcagaccggaagaccagagatggtggttggatggtaccattcgcatcctggctttggctgttggctttctggcgttgacatcaatacacaacagagttttgaagctctgaatcaaagggctgttgcggtggtggtagatcccatccagagtgttaaagggaaggtggtgattgatgccttccgtttgatcaacccacagacaatgatgcttggccaagagcctcgtcagacaacgtcgaaccttggacatctcaacaagccatccattcaggcattgatccatgggctaaatcggcattactactcaatagccatcaattacaggaagaacgaacttgaggagaagatgttgttgaacctacacaaaaagaagtggactgatggcttgattctccaacgctttgatacccattccaaaaccaatgaacagactgtccaggagatgttgagcctggccatcaaatacaacaaggcagttcaagaggaggatgagctgccacctgagaagcttgcaattgcaaatgtgggcaggcaggatgccaagaaacatctggaagagcatgtgtctaatttgatgtcatcgaatataatacagactctaggaaccatgctggataccgttgtattctagaggagcaattgccagtgttcccagcagatggtgagcagtgtgatgttttcaagtgagtttgcggaattgcacatttctactattcagggacaaagattccactaccatgaggaagattgcagctggcacttgaacatgagtgaggatgtatgggtagctgatattccaatggttgggagagattgtcttccttcttttgaagtatgaatacagcaaaacggaatctaatgcctgttgggaaggacattgtattccctctcttttttttacttttttttccttcagatgcttgggcaacatggttgtggatgcagatacgattagacacctagtaatggatggtcggaagaagccagaagaaggtgtcacactttgtcatgccgtaattttagagtgttatgacttaattagtttaatatttgcttatagacaaaaaaaaaaaaaaaaaggccgcctc

SEQ ID NO: 1762 - DNA, 1379 bp, Eschscholzia californica
cgaaggtttgggaagagagagagaaaggatcaatggagagactacagaggattctagcaggagccggagggatggggcacccaccaccggactcaccgttgttggattcgtcagagcaggtttacatatcttctcttgctctcctcaaaatgctcaaacacggaagagctggtgtaccaatggaagtaatgggtttgatgttgggtgattttgttgatgaatacactgttagggtagttgatgtttttgctatgcctcagagtggtactggtgttagtgttgaagctgtcgatcatgtttttcagactaatatgcttgatatgctcaagcagactggcagacctgagatggtggtaggatggtatcattcacatcctggatttgggtgctggctttccggtgttgatattaatacgcagcagagttttgaagctctgaatcaaagagccgttgcggtggttgtggacccaatacaaagtgtcaaggggaaggttgtcattgatgcctttcgtttgatcaaccctcaaactatgatgcttggccaagaacctcgacaaacgacttcgaaccttggtcacctcaataagccatctattcaggcattgatccatggcttgaacaggcactactactcgatagccatcaattacaggaaaaatgaacttgaagagaaaatgctactaaatttacataagaagaagtggactgatgggttaacacttcagcgatttgacacccattccaaaacaaatgagcaaactgtccaggaaatgctaggcttagctattaaatacaacaaagcagttcaagaagaggacgagttgccgccggagaagcttgccattgccaacgtcggaaggcaagatgcaaaaaagcacttggaggagcatgtctcgaacttgatgtcatcaaacatagttcagacgttgggtaccatgctcgatactgttgtattttaaggaccatggtccatttaaatgggtgtagtttttctttcgggaaactgatttatatctttctatctgaatctaaaaaaaacagtaggtggtgttagttactacttttcatttgtattgtttttttatgcaagtagaatttgatgagcggagtgatgaatcaatgttgaagtaaaagtctaaatttgctggctaatgtagtgcttcttttctttaatatacttggatttgaatctgactcagatttatgtgtgattttacggtcaatatgacgttgcatttcctttgaggagagtgctgttatgacaaaaaaaattggcttaatttgtgacgtaatgactagccttctaaaagacaaataaatttaaagtttcattacgatcttgaccactcttttataaggtgagtcattaagtaataaac

SEQ ID NO: 1763 - DNA, 1416 bp, Vitis vinifera
gttacatccctgtttaggttgttttatataagactagactggcacccaaagagaaatcttgctcccaaagaaatcaaaatccgatcgaccagagagaaaccgaaagaaaccgagagaaagccagaggaaattcagagatggaaaggctgcagcgaatgtttgccggtgcaggaggggcattggggcaccctccgccggattcgccgactctggactcgtcggagcaggtttacatttcctctctcgctctcctcaaaatgctcaaacacgggagagctggagttcccatggaagtcatgggtctgatgctgggagagttcgttgatgagtacacagttcgtgtagtagatgtgttcgcgatgccgcagagtggtactggcgttagtgtcgaggccgttgatcatgttttccagactaatatgcttgatatgctcaaacaaactggaagacctgagatggtggtaggatggtaccattcacatcctggatttggctgctggctctctggtgtggacattaacacacaacagagttttgaagctctgaatcagcgagctgtggcagtagtggtggatccaattcagagtgttaaggggaaggttgtgattgatgctttccgtttgataaatccccaaaccatgatgcttggccaagagcctcgacagacaacatcaaatcttgggcatcttaacaaaccatccattcaggctttgatacacggattgaacaggcactattactcaatagctattaattacaggaagaatgaactcgaggaaaagatgttactgaacctacacaagaagaaatggacagatgggcttacacttaaacgatttgatacccactccaaaaccaatgagcagaccgttcaggagatgcttagtctagctatcaagtacaacaaggctgtacaggaagaggatgagttgccaccggaaaagctggcaattgcaaatgttggaaggcaagatgctaagaagcatcttgaagaacatgtctccaacttgatgtcctcaaacattgtccaaactttgggaaccatgctcgatacagttgtgttctagactgaaatgttcagaaccaaacttaacaccagcctgttgtagacattgttgaattacagatgaacaacagtttgggaatgctttccattgaattttttttctgttaatttgcttttaattgctagaaagacaatgttgttccagcggaagcaaaaagtagtgtgaaagtaatggaggccaagtatcatgtgtcttactgatttgtaccatggatggatcttgatcatcatttatgtttgttcctcatttttcgcatattgcaagtcctgcgagcttttcttatatgtcggtgttttgtgaagccaatgggatactttgtttttacattaatccaattatcttctctgtg

SEQ ID NO: 1764 - DNA, 1169 bp, Ananas comosus
agagagagagagagagagagagaggaggagaggaggagagatggagaggttatctcgaatcttcggagcgggggggatggggcacccacccagcgacgcccctctcctcgactcctccgagcaggtctacatctcctccctcgccctcctcaagatgctcaagcacggaagggccggggttcccatggaggtgatggggttcatgctcggcgagttcgtggacgagtacacggtgcgcgtcgtcgacgtcttcgcgataccgcagagcggaacaggggttagcgtcgaggccgtcgatcacgtcttccaaacaaacatgctcgacatgctcaagcaaactggaagaccggaaatggtggtgggttggtaccactctcatcctggctttggttgttggctctctggtgttgacataaatacccagcagagttttgaagccttaaatcctagggcggttgcagtggttgtagacccaatccaaagtgtaaaggggaaggtggttattgatgctttccggttgattaatcctcagactatgatgctaggccaagagcctcgccagaccacatccaatgttggacacctcaacaaaccatccattcaggcattgattcatggatcgaaccgacattactactccatagccattaattatcgtaaaaatgagctggaggaaaagatgttactgaatttgcataagaagaagtggacggatggtttgatgctgcggcgattcgatacacatgccaaaactaatgagcagactgtgcaggaaatgctgaatttggctatcaagtacaataaagcagtccaggaggaggacgaactgccgcctgagaagctggcaatcgctaatgtagggcggcaagatgcaaagaagcacctggaggagcacgtctcgaacttgatgtcatccaacatcgtgcagactctcggaacgatgctagacactgttgtattttaatgttggtatgactttcaaagcacgtgcttattgcttgggattatgttgatctaagtttctctacctgttccgtgaaaagaaactttggaaattttgacgtcgaatgattttatagttgtggtcgtcagagaaacacttgtaaaaagttacatcttctgggtcctctgtcaaattactcttcgtcaactctaatatcttgtttatt

SEQ ID NO: 1765 - DNA, 1218 bp, Tripterygium wilfordii
aggaggaccaagatctagcaacttgctctctttgcttatcaatttatcaaagctttacagagcagacagagagacaggatggagcgattgcagaggatattcggcggaggaatgggagggatgggtcagccgcatccggattctccgctcttggactcctcggagcaagtctacatatcgtcgctggcgctcctcaagatgctgaagcatgggagggccggggttcctatggaggtgatgggcctcatgcttggggagttcgtcgacgagtatactgtcagagtcgtcgacgtcttcgccatgccccagagcggtaccggtgtcagtgtggaggccgtcgaccacgtcttccagaccaacatgctcgacatgctcaagcagactggcagaccagagatggtcgttggttggtaccattcacatcccggatttggttgctggctttctggtgttgatataaacactcagcagagttttgaggcattgaatcaaagggctgttgctgtagtggtcgacccgattcagagtgttaaagggaaagtggttatcgacgcattccgtcttattaaccctcaaacaatgatgctcggacaagagccacgtcaaacaacgtctaatcttgggcatttgaacaaaccatcgattcaggctttgattcatgggctgaaccgacattactactctatagccataaactatagaaaaaatgaacttgaggagaagatgcttctgaacctccataagaagaagtggactgatggcttgaccctgcgtcggtttgatacccattctaaaacaaatgagcaaactgtgcaggacatgcttaacttggccataaaatacaacaaggcagttcaagaagaagatgaattgtccccagagaaacttgctattgcaaatgtggggaggcaagacgcaaagaagcatctggaagagcatgtatcgaatttgatgtcgtcaaatatagttcagactcttgggaccatgcttgatactgttgtattctagggtgatttgatgatgttttacgttgaacgcttgtgattttcaagcctgatttaggcatatggttatgtttggagaatctcctgtaagacacttttaaagttggcctagtccttggacgtaatgtaagggcggtgaaagatgatattgttcttgcataagccttaactaggcaataatttcatattcgcgcttgtgtcatggctattgaat

SEQ ID NO: 1766 - DNA, 1381 bp, Abies balsamea
acgaagttcatttacgttttgcttcaagaaggggtttggaattttggcagcagactagtaggaaagttttacgatttgcttccagaaggggttttggaattttggcagcagggtcatagtagcaggaaaggaagaaacagaagcaacaatggagagattgcaaaggatattttcaggggcaggcggcatgggaccgcccgcttccgatggccctatgctcgattcatctgagcaggtgtacatttcttcgctcgctctcctcaaaatgctcaaacacggtagagctggagtgcctatggaggtcatggggctgatgctcggtgagtttgttgacgagtacacagttagagttgtggatgtgtttgccatgccccagagtggtactggagtcagtgtagaggcagttgatcatgttttccagacaaacatgcttgacatgcttaagcagactggaaggcaagagatggttgtaggttggtaccattcacatccaggttttggctgctggctttcaggcgttgatataaatacacaacagagttttgaggctctcaatcaacgggcagttgctgtagtggttgatcctattcagagtgttaaggggaaggttgtgattgatgcattccgcttaatcaacccccagaccatgatgcttgggcaggagcctcggcaaacaacttcaaatcttgggcatctgaataagccatccatccaggcattgatccatggattgaatcgccattattattctattgccattaattatcggaaaaatgaactggaagaaaagatgctactcaatttacataaaaagaaatggactgatggtctgactctggaacggtttgattgccattccaagacaaatgaacagacagttcaggaaatgcttgatcttgcaatcaagtataacaaagctgtacaggaagaggatcagctatctcccgagaagcttgctattgcgaatgttggcagacaagatgccaaaaagcacctagaagagcatgtctctaatctgatgtcttcaaacatagttcaaacacttgggacaatgcttgatacagtggtgttttagcttttttttgtctttactggtttcccacgccagaaaatgcacatgaattatgagaagcaaacagaaaatcggaaggaatggtggtatctcacccctcaaatgtttacttgtttgttaaactcttggatgttagtttatgcaaaaggaatccaatcatttagacgctgagagattcattatgcagtttatgttccagtgagaggaacttgtttgacaaatttcaaatttcagattattctacaacattggctgatttatgaaatgatcttgaaattgggctgtaagcaaaaattactttcgtgaaat

SEQ ID NO: 1767 - DNA, 1143 bp, Cleome spinosa
aatcccatttccatggagagattgcagcggatcttcggcgccgggagcggtctgggccaccctccacctgattctccgacactcgacacgtcggagcaggtctacatctcttctctcgccctcctcaagatgcttaagcatggaagagctggggttcctatggaggttatggggttgatgcttggagagtttgtggacgagtatactgttcgagttgttgatgtatttgccatgcctcagagtggtactggtgttagtgttgaagctgttgatcatgttttccagactaatatgcttgacatgctcaaacagactggaagacctgagatggtggtcggttggtatcattcccaccctggatttggctgctggctttctggtgttgacataaatacacaacagagttttgaagctttgaatcaacgagctgtagcagtggtggtagatccaatccagagtgtcaaagggaaggttgtgatcgatgcattccgtctgataaatcctcaaaccatgatgcttggccaagaaccccgacaaacaacatcaaaccttggccacctgaataaaccgtcaatccaggctttgattcatgggttgaacagacattactactccatagccataaactataggaagaacgagctcgaggagaagatgctgcttaacctccacaagaagaaatggacagatggtctgacactaagacggtttgacacccactccaaaacaaatgaacagaccgttcaggagatgttgaacttagccatcaaatacaacaaggccgtacaagaggaagacgaattgccaccggagaaactggcgattgcaaacgttggaaggcaagatgcgaagaagcaccttgaagagcatgtctccaacttgatgtcttccaacatcgtccagacacttggaactatgctggacactgtcgttttctagacccagctcttctcatggcttttgtcgatggattaacaataacctcagcttgttgttatccctcttccaaggggaaggaagagaaggatgatgaacacttgtctctcccttgagatgttattgtttgtgttttctgcatcatgttggataatctctcttatatgtaagatcatgccaaggttaaagaatctgatatgagaccaa

SEQ ID NO: 1768 - DNA, 1199 bp, Eschscholzia californica
aaactcaaaaactgataggatctactgatctacagagagagaatcaatggagagacttcagagaattttagccggagcaggaggtatgggacacccaccgccggattcaccattgctggattcatcagaacaagtttacatatcttctctcgctcttctcaagatgcttaagcacggaagagctggagtaccaatggaagtaatgggtttgatgttgggagattttgttgatgaatacactgttagggttgttgatgtattcgctatgcctcagagtggtactggtgttagtgtcgaagctgtcgatcatgttttccagactaatatgcttgatatgctcaagcaaactggcagacctgagatggtggtaggatggtatcattcccatcctggatttggctgttggctttctggtgttgatattaatacacagcagagttttgaagctttgaatcaaagagctgttgctgtggtggtagacccaatacagagtgtgaaaggaaaggtggtaattgatgccttccgcttgatcaatcctcaaactatgatgcttggtcaagaacctcgtcaaacgacctctaaccttggtcacctcaacaagccatccattcaggcattgatccatggattgaaccggcattattactcaatagccattaattacaggaaaaatgagctcgaggagaaaatgctattgaatctacacaagaagaagtggaccgatgggttgacacttcagagatttgatacccattccaaaactaacgagcagactgttcaggaaatgctaggcctggctgtaaaatacaacaaggctgttcaagaagaggacgagttgcccccagagaagcttgcaattgcgaatgtgggtagacaggatgcaaaaaagcacctcgaggaacatgtctccaacttgatgtcttcgaacattgttcagactttgggaaccatgcttgacacagtcgtattttaaggattatctctctaagaagaagaaaattgtacttctgatgctgtccatagaattactttcttgttcttggcctagctaaaacactatcctacgctattggtttttactcgaacgatactgtcttctccattgtactatgaattttcgaagtaggtggaatggtgaatcattgttgaagttaaaacagagtacaagttcaatttggatgtattaccttttaatcact

SEQ ID NO: 1769 - DNA, 1173 bp, Euonymus alatus
actttgctcatcaagcaattcatctcagagagaggatggagagattgcagaggatattcggcggaggaatgggaggcatgggtcagccgcatccggattctccgctcttggactcgtcggagcaagtctacatctcgtcgctggccctcctcaagatgctgaagcatgggagagccggggttcctatggaggttatgggcctcatgcttggggaattcgtcgacgagtatactgtcagggtcgtcgatgtcttcgccatgccccagagcggtaccggcgttagtgtcgaggccgtcgaccacgtcttccagaccaacatgctcgacatgctgaagcagactggcagaccagagatggttgttggttggtaccattcgcatccagggtttggttgctggctttctggtgttgatataaacactcagcagagttttgaggcattgaatcaaagggctgttgctgtagtggtcgatccgattcagagtgttaaagggaaggtagttattgatgcattccgcctcattaaccctcaaacgatgatgcttggccaagagccacgtcaaacaacatctaatcttgggcatctgaacaaaccatcaattcaggctttgattcatgggctgaaccgacattattactccatagccataaactatagaaaaaatgaacttgaggagaagatgcttctgaacctgcataagaagaagtggactgatggcttgaccctgcgtcggtttgatagccattctaaaacaaatgagcaaactgtgcaggacatgcttaacttggccataaaatataacaaggcagttcaagaagaagatgaattgtccccagagaaacttgctattgcaaatgtggggaggcaagatgcaaagaagcatctggaagagcatgtatcaaatttgatgtcttcaaatataattcagactcttgggaccatgcttgatactgttgtattctagggtgatttgataatgttttacatcaaactctttcaattttcaagcctgatttagggttatggttacgtttggagaatctactgtaaaactctcttaaagtgggcctaatccagtggtgaaagatgatattgttcttgcgtaagccttaactaggcaatcattttatgttcacggctattgaatatcctaatgaatgttaaatgctctt

SEQ ID NO: 1770 - DNA, 1234 bp, Euonymus alatus
taacatttcttgctaatcaattaatctcagattcaaagctttactgagcaaacaaaggcagaagaagatggagagattgcagaggatattcggcggaggaatgggagggatgggtcagccgcatccggattctccgctgctcgattcgtcggagcaagtctacatatcctccctggcgctcctcaaaatgctgaagcatgggagggccggggttcctatggaagtcatgggcctcatgcttggggagttcgtcgacgagtatactgtcagagtcgtcgatgtctttgccatgccccagagcggtaccggcgttagtgtcgaggccgtcgaccacgtcttccaaaccgacatgctcgacatgctcaagcagactggcagaccagagatggttgttggctggtaccattcccatcccggatttggttgctggctttctggtgttgatataaacactcagcagagttttgaggcattgaatcaaagggctgttgctgtagtggttgatccgattcagagtgttaaggggaaagtagtcattgatgcattccgtctcattaaccctcaaacaatgatgcttggccaagagccacgtcaaacaacatctaatcttgggcatcttaacaaaccatcgattcaggctttgattcatgggctaaacaggcattactattccatagccataaactataggaaaaatgaacttgaggagaagatgcttctcaaccttcacaagaagaagtggactgatggcttgaccctgcgtcggtttgatacccattctaaaacaaatgaacaaactgtgcaggacatgcttaacttggccataaaatataacaaggcagttcaagaagaagatgaattgtccccagagaaacttgccattgcaaatgttgggaggcaagatgcaaagaagcatctggaagagcatgtgtcgaacttgatgtcttcaaatatagttcagactcttggaaccatgcttgatactgttgtattctagggtgatttgatgatgtttcacattaaagcactttgattttcaagcctgattttggcacatatggttatgtttggagaatgtcctgtaaaactctcttaaagttgctcagacattggacatgataatgtaatggtggcgaaagatcagattgttcttgcataacccttaactaggcaacagttttatattggcttgtgtcatggctattgaacgaatgttaaatgcatttcgtgatta

SEQ ID NO: 1771 - DNA, 1224 bp, Elaeis guineensis
ttgaagcctacggcaggtatgctcataaattaaagcctggggaagggagttgcgtatccagcgaaggatagggcgccggagaagacagagagagaagggatggagaggctgcatcggatcttctcgggcgcgggagggatgggacacccgcccaccgactccccgctgctcgacacggccgagcaggtgtacatctcctcgctcgccctcctcaagatgctcaagcacgggagggctggggtaccgatggaggtgatggggctgatgctgggggaattcgtggacgaatacacggtccgggtggtggacgtgttcgcgatgccgcagagcgggactggcgtcagtgtcgaggccgtcgaccacgtcttccagaccaacatgctcgatatgctcaagcagaccggaagatctgaaatggtagtaggctggtaccattctcatccaggctttggttgttggctctctggggttgatataaatacacagcagagtttcgaagccttgaatccaagggcagttgcggttgtggtagatccaatccagagtgttaaagggaaagttgtcatcgatgctttccgcctcatcaatcctcagaccatgatgctaggccaagaacctcgccagactacttccaatgtcgggcatctcaacaagccgtccattcaggcattaatccatgggttgaatcgacattactactctatagctataaattatcggaaaaatgagcttgaagaaaagatgttactgaacctgcacaaaaagaagtggactgatggattgactttgcagcggttcgatacccattcaaaaactaacgagcagaccgtgcaggaaatgctgaatttagccatcaagtacaacaaagcggttcaggaggaagacgagttgccaccggagaagcttgcaattgcaaatgtgggaaggcaagatgcgaagaagcatttggaagagcatgtctcgaacttgatgtcatcaaacatagttcagactctgggagccatgcttgacactgtcgtgttctaataggtccatgttgcagaagacacgattttcttcatcgaaccaagtcccatcattaattttctcaaaatgaatctcgtgttggctttggagttatgatgatattgttgttatgccaatagcaaatttcaggagtaagaagggccttaacgtttgaagctagttaaccaaaaaaaaaaaaaactaacgtaggaacgttac

SEQ ID NO: 1772 - DNA, 1523 bp, Pseudotsuga menziesii
gtttttggttgcagaaggggttttgggattttggcagcaaggtcgtagcagcagcataagaaaaatcataagcaactatggagagattgcaaaggatattttcaggggcagggggcatgggaccgcccgccgatggccctatgctcgattcatctgagcaggtctacatttcttcgcttgcccttctcaaaatgctcaaacacggtagagctggagtgcctatggaggtcatgggactgatgcttggtgaatttgttgacgagtacacagttcgagttgtggatgtgtttgccatgccccagagtggtactggagtcagtgttgaggcagttgatcatgttttccagacaaacatgcttgacatgcttaagcagactggcaggcaagagatggttgtagggtggtaccattcacatccaggttttggatgctggctttcaggcgttgatataaatacgcaacagagtttcgaggctctcaatcaacgcgcagttgctgtagtggtcgatcctattcaaagtgttaaggggaaggttgtgatcgatgcattccgcttaatcaatccccagactatgatgcttgggcaggagccccgacaaacaacttcaaatcttgggcatctgaacaagccatctatccaggcattgatccatgggttgaatcgtcattattattctattgccattaattaccggaaaaatgaactggaagagaagatgctactcaatttgcataaaaagaaatggactgatggtctgactctgcaacgctttgattgccattccaagacaaatgaacagacagttcaggaaatgcttgatcttgcaatcaagtataacaaagctgtacaagaagaggatcaactatcccctgaaaagcttgctattgcaaatgttggcaggcaggatgccaaaaagcacctagaagagcatgtctctaatctgatgtcttcaaacatagttcaaacacttgggacaatgcttgatacagtggtgttttagccttttttctttcgttactggttttaccaggccataaaacgcacatgaattctgagaagcaaccgaaatcggaaggaatgctggtatctcacctttctaaaatgtttacttcttgttaaactcttggattttagtttatgcaaaaggaatccaatcatttggatgctgggagattcacactatgtagtttatattccagtgagaatggaatttgattgacaaattccaaattatgctacagcattggttggttgatttataagatgatcttgaaattgggaaatcagcacaagtgatgttcagatacttacttcgtattaattctttgaatgttagaaggctgtgtagattaagaggtttcgagtcttaaacttggacatgcggtgatttttcaatgttagaaggctctgtagattaagaggttttgagtcttaacttggacatgcggttgattacatgtggacatgtttgttatctttcacaaagatgtgatggcatgacatgggtgcactttagagctcg

SEQ ID NO: 1773 - DNA, 1375 bp, Amborella trichopoda
tctttcttccttgcctgtgactcaagaaaagaactgagttctattttacttctcgtaatgaaataaagttccttactgcccattagagacaaagagttgtaagaagtaagaatggaacgcctacagagaatcttctctggtgctggaagtatggcacacccgcctccagattcacctctcctcgactcttctgaacaggtctacatctcctcccttgctcttctcaagatgctcaaacatggaagagctggagttcccatggaagttatgggcctgatgcttggtgagtttgtggatgaatataccgtgcgagttgtggatgtgtttgcaatgccccaaagtggaactggagtgagtgtcgaagctgttgatcatgtttttcagacaaatatgctagatatgctcaagcagactggaagacctgagatggttgtgggctggtaccattcacatccaggctttggttgttggctttctggggtggacataaatacccaacagagttttgaggccttgaaccaaagggcagttgcagtggtcgtagacccaatccaaagtgtcaaaggtaaggttgttattgatgcttttcgcttgatcaatcctcagaccatgatgcttggccaagagccacgacaaaccacttcgaaccttgggcacctcaacaagccatccattcaggccttgatccatgggctcaacaggcactactactctatagccatcaattacagaaagaatgaactagaagagaagatgttacttaacctccataagaagaagtggactgatggtttgacactgcaacggtttgatgtccattcaaaaactaatgagcagactgtgcaggagatgctgaacttggctattaagtacaacaaagcagttcaggaagaggatgaattgcccccagaaaagctcgccattgccaatgttggaaggcaagacgccaagaagcatttggaggagcatgtttcgaacttgatgtcttcaaacataattcagactctgggaacaatgcttgacacagtggttttctagagagagaatacttgacgcagtggttttctagagggtgtgtcccttaccttttcccaaactctctgatagttaccctgcaagggaagatttatgatttccctcttgggatgtatcatgaatctacgacttgcagctctgtgacaacaggctacactcttaagccatttttcacattattctttgcgtctgcactgtttcatttgatatttcttgctaatgtcacaactggggtttcagagaaagaattgctttatgcggcacaaaaccagaccgcaaaaaaatttcaaattctacaagccacgttactggaactcaatacagtctggcatattgggtg

SEQ ID NO: 1774 - DNA, 1127 bp, Amorphophallus konjac
ggagaagcacaaccacgccgtaaagaagtcgaggtggaaaaaggttggaaagggagaccgagggagagagagagtgttgaggaaggcggtcgccatggagagactgcagagaattttctccggcgccgggggatggggcacccgccgtccgacacgccgctactggactcctcggagcaggtctacatatcctccctcgcgctgctcaagatgctcaagcacgggagggcgggggttcccatggaggtgatggggctgatgctgggagagttcgtggacgagtacacggtgcgggtggtagatgtgttcgcgatgccccagagcgggacggggttagcgtcgaggctgtcgatcacgtcttccagaccaacatgcttgacatgctcaagcagactggcagacctgaaatggtggtgggatggtatcactcacatccaggctttggctgttggctttctggtgttgacataaatacacagcagagttttgaagctttaaatcagagggctgttgcagtagtgatagatcccattcaaagtgttaaagggaaggtggttatcgacgccttccgcttgatcaatccacaaactatgatgctaggccaagagccccggcagactacatcaaacctcggacacctcaataagccatccattcaggcactaatccatgggctgaaccggcattactactctatagcaataaattacaggaaaaatgaactcgaggagaagatgttgttgaacctgcacaagaaaaagtggactgatggtttgaccttacagcgatttgatactcattcgaaaaccaatgagcagactgttcaggagatgttaaacctggccatcaaatacaacaaagcagtgctggaggaggacgagctaccaccagagaagctggcaattgcaaatgtggggaggcaagatgcgaagaagcatctcgaggagcacgtctccaacttgatgtcgtcaaacatagtccagactctaggaaccatgctggacaccgtcatattttagattgaaacttgtatcactagtgttgaattttccttatttacttttctcttgtctgtattaatctgctcaatattcattttgtgtttcaaggaactctataaattatca

SEQ ID NO: 1775 - DNA, 945 bp, Amborella trichopoda
  misc_feature (800)..(800): n is a, c, g, or t
  misc_feature (818)..(818): n is a, c, g, or t
  misc_feature (875)..(875): n is a, c, g, or t
  misc_feature (893)..(893): n is a, c, g, or t
  misc_feature (904)..(904): n is a, c, g, or t
  misc_feature (911)..(911): n is a, c, g, or t
  misc_feature (932)..(932): n is a, c, g, or t
  misc_feature (942)..(942): n is a, c, g, or t
aagaagtaagaatggaacgcctacagagaatcttctctggtgctggaagtatggcacacccgcctccagattcacctctcctcgactcttctgaacaggtctacatctcctcccttgctcttctcaagatgctcaaacatggaagagctggagttcccatggaagttatgggcctgatgcttggtgagtttgtggatgaatataccgtgcgagttgtggatgtgtttgcaatgccccaaagtggaactggagtgagtgtcgaagctgttgatcatgtttttcagacaaatatgctagatatgctcaagcagactggaagacctgagatggttgtgggctggtaccattcacatccaggctttggttgttggctttctggggtggacataaatacccaacagagttttgaggccttgaaccaaagggcagttgcagtggtcgtagacccaatccaaagtgtcaaaggtaaggttgttattgatgcttttcgcttgatcaatcctcagaccatgatgcttggccaagagccacgacaaaccacttcgaaccttgggcacctcaacaagccatccattcaggccttgatccatgggctcaacaggcactactactctatagccatcaattacagaaagaatgaactagaagagaagatgttacttaacctccataagaagaagtggactgatggtttgacactgcaacggtttgatgtccattcaaaaactaatgagcagactgtgcaggagatgctgaacttggctattaagtataacaaagcagttcaggaagaggatganttgcccccagaaaagctngccattgccaatgttggaaggcaagacgccaagaagcatttggaggagcatgtttcnaacttgatgtcttcaaanataattcagantctgggnacaatgcttgacacagtggtnttctagaganaga

SEQ ID NO: 1776 - DNA, 1403 bp, Phaseolus coccineus
ggtttctcgtgagagtagagaataaaactaactgaaatagatcgttcaatcaccattttctagttcattgcttctgtagtttcaacttcaacttcaaattctcagggaagcgaattcagttaatttcaaatctcaaatccgaatcaaaatttggaagtgagattcgcgatggagcggcttcagcgaatgttcgcaggtgcaggtggagcgctggggcaccctcccccagattccccaactctcgattcctccgagcaggtctacatctcctcactcgcgctcctcaagatgctcaagcacgggagggctggggttcccatggaggtgatgggtttgatgctgggagagttcgtggacgagtacactgttcgtgtggttgatgtcttcgcaatgccgcagagtggcactggtgttagcgttgaagccgttgatcatgtttttcagactaatatgcttgatatgctcaaacaaactggacgaccagagatggttgtcggctggtaccattcgcatcctggatttggctgctggctctctggtgttgatatcaatacacaacagagttttgaggctttgaatcagcgtgcagtggctgtggttgtagatccaatacaaagtgttaaaggcaaagtggttattgatgcttttcgattgatcaatccacagactatgatgcttggtcaagagccaaggcagacaacatctaatctgggacatctgaataaaccatctattcaagcattgatccatgggttgaaccggcattactactccatagccattaactaccggaaaaatgaacttgaagagaagatgttgcttaatctccacaagaagaaatggactgatggtttgacacttcaacattttgatacacattccaaaactaatgaacagactgtacaggaaatgctgagcttagctatcaaatataacaaggctgttcaagaggaagatgagctgcctccagaaaagcttgcaatagctaatgttggaaggcaagatgcgaagaagcaccttgaagagcacgtctcaaatttgatgtcttccaacatcgttcaaactctcggaatgatgcttgatactgttgtcttttagagttgttattttggaccttctggtttctctactctagcatggtaaggatgcaaattgagttgttaaaattcctatttcctaatccttctcaaacaatatttgaagacactagacagttatattctttggacgagctgaaaaggtcaagaaagtaaaactccgcacatagtttgtgtggtgtctccctaagtattacttactgggtatcttttaatgttattgctggatttatcttctataaaatttgtcaaaacaaaatttcaattatgttttaaaatactataagaagcagttaacattgcgta

SEQ ID NO: 1777 - DNA, 1328 bp, Cedrus atlantica
aaaaacaagtgacatgatcaacagaaagcactagcgggtgggagttcgtttacgatttgctcgaagagaaggggttttgagattttggcttcagggtagaggagtagcacaagaagaaacaggagcagcaatggagagattgcaaaggatattttcaggggctggaggtatgggaccgcccgccccagatggccctatgctcgattcatctgagcaggtctacatttcttcgctcgctcttctcaaaatgctcaaacacggtagagctggagtgcctatggaggtaatggggctgatgcttggtgagtttgttgatgagtacacagttcgagttgtcgatgtctttgccatgccccagagtggtactggagtcagtgtagaggcagttgatcatgttttccagacaaacatgcttgacatgcttaagcaaactggcaggcaagagatggttgtagggtggtaccattcacatccaggttttggatgctggctttcaggcgttgatataaatacgcaacagagttttgaggctctcaatcaacgggcagttgctgtagtggttgatcctattcaaagtgttaaggggaaggttgtgattgatgcattccgcttaatcaatccccagactatgatgcttggacaggagccccgacaaacaacttcaaatcttggacatctgaataagccatcgatccaggcattgatccatgggttgaatcgccattattattctattgccattaattatcggaaaaatgaacttgaagaaaagatgctactcaatttacataaaaagaaatggactgatggcctgactctggaacgctttgattgccattctaagacaaatgaacagacagttcaggaaatgcttgatcttgcaatcaagtataacaaagctgtacaagaagaggatcagttatctcctgaaaagcttgctattgcaaacgttggcagacaagatgccaaaaagcacctggaagagcatgtctctaatctgatgtcttcaaacatagttcaaacacttgggacaatgcttgatacagtagtgttttagcttttttgtctttactggatttgccaagccagaaaatgcacaggaattatcagaagcaacagaaaatgggaaggattggtggtatcgcacccctctaaaatgtttacttattgttgaactattggatgttagtttatgcaaaaggaatccattcatttggattctgagagatttattatgcaatttatgttccagtgaatggaatttgattgacatatgtcaaattatatgccacagcattggttggtttataagatgattttgaactggg

SEQ ID NO: 1778 - DNA, 1201 bp, Vigna unguiculata
attcaaaactcaaatccgaatcaaaatttggaagtgagattcgcgatggagaggcttcagcgaatgttcgcaggtgcaggtggagcgctagggcaccctcccccagattccccaactctcgattcctccgagcaggtctacatctcctctctcgcgctcctcaaaatgctcaagcacgggagggccggggttcccatggaggtgatgggcttgatgctgggagagttcgtggacgagtacaccgttcgtgtagttgatgtatttgcaatgccgcagagtggcactggtgttagtgttgaagccgttgatcacgtttttcagactaatatgcttgatatgctcaagcaaactggacgaccagagatggttgtcggctggtaccattcgcatcctggtttcggctgttggctctctggtgttgacatcaatacgcaacagagttttgaggctttgaatcagcgtgcagtggctgtggttgtagatccaatacaaagtgttaaaggcaaagtggtgattgatgcttttcgattgatcaatccacagactatgatgcttggtcaagaaccaaggcagacaacatccaatctgggacatctgaataaaccatcgattcaagcattgatccatgggttgaaccggcattactactccatagccattaactacaggaaaaatgaacttgaagagaagatgttgcttaatctccacaagaagaaatggactgatggtttgacacttagacattttgatacacattccaaaactaatgaacagactgtacaggaaatgctgagcttagctatcaaatataacaaggctgttcaagaggaagatgagctgcctccagaaaagcttgcaatagctaatgtgggaagacaagatgcaaagaagcaccttgaagagcacgtctcaaatttgatgtcttccaacatcgttcaaactctcggaatgatgcttgatactgttgtcttctagagttgttattttggaccttctggtttctctagcatggtaaggatgcaaattgagttgttaaaattcctgtttcctaattcttctcaaaccatatttgaagacactagacagatatattctttggacgagctgaaaaggtcaagaaagtaaaactcaacacatagtttgtgtgggtgtctccctaagtattacttctttaatgtttattgccggatttatcttctat

SEQ ID NO: 1779 - DNA, 1286 bp, Vigna unguiculata
  misc_feature (1270)..(1270): n is a, c, g, or t
catgagaaagcattgaaatagttcaatcaccattccttagctcattgcttcaaatcctcagtcaagcgcattcaaaactcaaatccgaatcaaaatttggaagtgagattcgcgatggagaggcttcagcgaatgttcgcaggtgcaggtggagcgctagggcaccctcccccagattccccaactctcgattcctccgagcaggtctacatctcctctctcgcgctcctcaaaatgctcaagcacgggagggccggggttcccatggaggtgatgggcttgatgctgggagagttcgtggacgagtacaccgttcgtgtagttgatgtatttgcaatgccgcagagtggcactggtgttagtgttgaagccgttgatcacgtttttcagactaatatgcttgatatgctcaagcaaactggacgaccagagatggttgtcggctggtaccattcgcatcctggtttcggctgttggctctctggtgttgacatcaatacgcaacagagttttgaggctttgaatcagcgtgcagtggctgtggttgtagatccaatacaaagtgttaaaggcaaagtggtgattgatgcttttcgattgatcaatccacagactatgatgcttggtcaagaaccaaggcagacaacatccaatctgggacatctgaataaaccatcgattcaagcattgatccatgggttgaaccggcattactactccatagccattaactacaggaaaaatgaacttgaagagaagatgttgcttaatctccacaagaagaaatggactgatggtttgacacttagacattttgatacacattccaaaactaatgaacagactgtacaggaaatgctgagcttagctatcaaatataacaaggctgttcaagaggaagatgagctgcctccagaaaagcttgcaatagctaatgtgggaagacaagatgcaaagaagcaccttgaagagcacgtctcaaatttgatgtcttccaacatcgttcaaactctcggaatgatgcttgatactgttgtcttctagagttgttattttggaccttctggtttctctagcatggtaaggatgcaaattgagttgttaaaattcctgtttcctaattcttctcaaaccatatttgaagacactagacagatatattctttggacgagctgaaaaggtcaagaaagtaaaactcaacacatagtttgtgtgggtgtctccctaagtattacttctttaatgtttattgccggatttatcttctanaaaaaaaaaggaaaaa

SEQ ID NO: 1780 - DNA, 1267 bp, Eucalyptus grandis
ctcccaaaagcccagacacgggctttggcttgcagcaaaagattcgtctcctttcttctcctcctcttctccatcggttcacagcagcaacagagaatcccgaagttggatgtccggtggtatggagaggcttcagagaatgttcgccggcgccggaggtggtctgggccacccgccccccgactccccgaccctcgattcatccgagcaggtctacatctcctccctcgccctcctcaagatgctcaagcacgggagggctggggttcccatggaagtgatggggttgatgcttggggagtttgtggacgagtacaccgtccgagtcgtcgatgtgtttgctatgccgcagagtggtaccggtgtcagtgtcgaggcggtcgatcatgtgttccagaccaacatgctcgacatgctcaaacagactggaagaccagagatggtggtaggttggtaccactctcatcctggctttggatgttggctttctggtgtggacatcaacactcagcagagttttgaggctttaaatcagcgtgcggttgcagtagtggtggatcccatccagagtgtcaaagggaaggttgtgattgatgccttccgtttgatcaacccgcaaaccatgatgcttggccaagaacccaggcagacaacctccaaccttggacatctcaacaaaccgtccatccaggcattgatccatgggctgaacagacactattactcaattgccatcaattacagaaagaatgaacttgaggaaaaaatgctacttaatcttcacaagaagaaatggacagatggcttgacgcttcatcgttttgacacacattctaaaaccaatgaacagactgttcaggagatgctgaatttggcaatcaagtataacaaggcagtgcaggaggaggatgaattgccaccagagaagctggcgattgcgaatgtgggaaggcaagatgccaagaagcacctcgaggagcacgtttccaaccttatgtcttccaacatagttcagaccttagggaccatgcttgataccgtagtcttctaaggccctccgaatcgggcatcttatgtcacctgcattctgcacaactctgtatcatcttttgcggcggtgttccgggactaattattacattggcttgatcagtagacgctgcagcttgtaagaaatctagccctttgttctctgcgttgcttgtatccccattcaaacaattcagttatcaatttgttcttatccaaaaaaaaaaaaaaaaaacgg

SEQ ID NO: 1781 - DNA, 1263 bp, Eucalyptus grandis
caaaagattcgtctcctttcttctcctcctcttctccatcggttcacagcagcaacagagaatcccgaagttggatgtccggtggtatggagaggcttcagagaatgttcgccggcgcgggaggtggtctgggccacccgccccccgactccccgaccctcgattcatccgagcaggtctacatctcctccctcgccctcctcaagatgctcaagcacgggagggctggggttcccatggaagtgatggggttgatgcttggggagtttgtggacgagtacaccgtccgagtcgtcgatgtgtttgctatgccgcagagtggtaccggtgtcagtgtcgaggcggtcgatcatgtgttccagaccaacatgctcgacatgctcaaacagactggaagaccagagatggtggtaggttggtaccactctcatcctggctttggatgttggctttctggtgtggacatcaacactcagcagagttttgaggcattaaatcagcgtgcggttgcagtagtggtggatcccatccagagtgtcaaagggaaggttgtgattgatgccttccgtttgatcaacccacaaaccatgatgcttggccaagaacccaggcagacaacctccaaccttggacatctcaacaaaccgtccatccaggcattgatccatgggctgaacagacactattactcaattgccatcaattacagaaagaatgaacttgaggaaaaaatgctacttaatcttcacaagaagaaatggacagatggcttgacgcttcgtcgttttgacacacattctaaaaccaatgaacagactgttcaggagatgctgaatttggcaatcaagtataacaaggcagtgcaggaggaggatgaattgccaccagagaagctggcgatcgcgaatgtgggaaggcaagatgccaagaagcacctcgaggagcacgtttccaaccttatgtcttccaacatagttcagaccttagggaccatgcttgataccgtagtcttctaaggccctccgaatcggcatcttatgtcacctgcattctgcacaactctgtatcatcttttgcggcggtgttccgggactaattattacatcggcttgatcagtagacgctgcagcttgtaagaaatctagccctttgttctctgctttgcttgtatccccattcaaacaattcagttaccaatttgttcttatccaagaaagggaaaggaaaggagacggtttatccgcgagcctctgtgacatgatc

SEQ ID NO: 1782 - DNA, 1419 bp, Lotus japonicus
gtggaaagaaagcttccagtaacaattctcagtgttctcttgttcctcttggttgttgcttcatcttcaacttcaactctcaatccaattcaaatccttcaaatcccaaatcggaagcaaaatcttagggttttgacatggagaggcttcaacgaatgttcgccggtgcaggtggcgcactagggcatccacccccagattccccaactctcgattcctccgagcaggtctacatctcttcgctcgcacttctcaagatgctcaagcacggaagagctggggttcctatggaggtgatgggtctgatgttgggggagttcgtggatgagtacactgttcgtgttgttgatgtctttgcaatgccgcagagtggaactggtgttagtgttgaagctgttgatcatgttttccagactaatatgcttgacatgcttaagcaaactggaagacctgagatggtggttggctggtaccattcacatcctggatttggatgttggctgtctggtgttgacatcaatacacagcagagttttgaggctttgaatcagcgagcagtggctgtagttgtagatccaatacagagtgttaaaggaaaagtggtgattgatgcttttcgattgatcaatccccagacaatgatgcttggtcaagaaccaaggcagacaacatccaatttggggcatcttaacaaaccatccattcaagcattgatccatggattgaacaggcattattattccatagctattaattacagaaagaatgaacttgaggagaagatgctgcttaatctccacaagaagaaatggactgacggcctgacacttcatcgttttgacacacattccaaaactaatgaacagactgttcaggaaatgctgagtttagctgtcaaatacaacaaggctgtccaagaggaagatgagctttcccctgagaagcttgcaatagcaaatgtgggaagacaagatgccaagaagcaccttgaagagcatgtctcaaacttgatgtcttccaacatcgttcaaactcttggaatgatgcttgatactgttgtcttctagagttgtcattttggaccctctggtttctctagcaactttagggtgcaagttatttatgaaaatttcagtttcttatttcttcttgaactgaatttgaagacaaatgtattctttggatgagctgaaaaggtcaagaaagtaaaacatagcactagcagtttgtggcagattctcttcctcaggattacttggtatctttgatgttatcttattgcagaattttacaggacatagttttcagggcttaagattttgttcaaatttaagcgtctaagctgttaacattttctttttagtatatgaaacacaatccttttgttggtataaaatgagaagtggaattcatggtttc

SEQ ID NO: 1783 - DNA, 1254 bp, Pinus pinaster
ataaacacagccacatataagtacccacggttcatactagtccgtcttacgatttacttgaaaaataagccgagggtttggtttctcaggagttcataccagaaacaaaagcagaagcagcagccatggagagattgcagaggattttttcaggagcagggggaatgggaccgcccgcttcagatggccccatgctcgattcctccgagcaggtctacatttcttcgctcgcccttctcaaaatgctcaaacacggtagagctggagtgcctatggaggtcatggggttgatgcttggtgagtttgttgatgagtacacagtccgagttgtggacgtgtttgccatgccccagagtggtactggagtgagtgtagaggcagttgatcatgtttttcagacaaacatgcttgacatgcttaagcaaactggcaggcaagagatggttgtaggttggtaccattcacatccaggttttggatgctggctttcaggtgttgatattaatacacaacagagtttcgaggctctgaatcaacgagcagttgctgtagtggttgatcccattcaaagtgttaaagggaaggttgtgattgatgcattccgattaatcaatccccagactatgatgcttgggcaggagccccgtcaaacaacttcaaatcttgggcatctgaataaaccatccatccaggcattaatccatggcttgaatcgacactactattctattgcaattaattatcggaaaaatgaactggaagaaaagatgctactcaatttacataaaaagaaatggacagatggtctgactctgcaacgctttgattgccattctaagacaaatgaacagacagttcaggaaatgcttgatcttgcaatcaagtataacaaagccgtacaagaagaggatcaactacctcctgaaaagcttgccattgcaaatgttggcagacaagatgccaaaaagcacctagaagagcatgtgtctaatctgatgtcttcaaacatagttcaaacacttggcacaatgcttgatacagttgtgttttagttttttttttcttttcttttcttgtttgaccgagtcagaaaatggacataatttatgacgagcagcaaatgacaaagaatgatggtgtcacacctctaaaatgtttacttaatgtcaaactcttcagaatgtccatttatgcaaaagaaatccgatctttggatgccattatgtagctatgtttgaattaatggaatttgat

SEQ ID NO: 1784 - DNA, 1198 bp, Pinus pinaster
aaactcaagtctataatttgggcagagaggaggttttgggattttggaagcagattcatttcagataagaagaagcagaagcaggttcatttcagtagcataagaagaagcagaagcagcaatggagagattgcaaagaatattttcaggggcagggggcatgggaacacctgcctcggatggccctatgctcgattcatctgagcaggtctacatttcttctcttgctctcctcaaaatgctcaaacacggtagagctggagtacctatggaggtcatggggctgatgctcggcgagtttgttgatgagtacacagtcagagttgtggatgtgtttgccatgccccagagtggtactggagtcagtgtagaggcagttgaccatgttttccagacaaacatgcttgacatgcttaagcagactggcaggcaagagatggttgtagggtggtaccattcgcatccaggttttggatgctggctttcaggtgttgatataaatacgcaacagagtttcgaggctctcaatcaacgggcagttgctgtagtggttgatcctattcaaagtgttaaggggaaggttgtgatcgatgcattccgcttaatcaatccccagactatgatgcttgggcaggagcctcgacaaacaacttcaaatcttgggcatctgaataagccatctatccaggcattgattcatgggttgaatcgccattattattctattgccattaattaccggaaaaatgaactggaagaaaagatgctactcaatttacacaaaaagaaatggactgatggtctgactctgcaacgctttgattgccattctaagactaatgaagagacagtgcaggaaatgcttgatcttgcaatcaagtataataaagctgtacaagaagaggatcagctctctcctgaaaagctggctattgcaaatgttggcagacaagatgcgaaaaagcacctagaagagcatgtctctaatctgatgtcttcaaacatagttcaaacacttgggacaatgctcgatacagtggtgttttagttcttttgtcttaattggttttaccaagccagtgcacgtgaatcatgagaaacaacagaaaatgggaagcaatgatggtatcgtaccactctaaaagtttactttttgttgaactcttggatgttagcttaatgcaaaaggaattcaatc

SEQ ID NO: 1785 - DNA, 1165 bp, Podocarpus macrophillus
ggtatatacagactcgcaagggttaaggaattccttctgcaaactttcggaagttcatatggagaggttgcagagaatattttcgggggctggggggatgggaccgcccgctacagacggccccatgctggactcttcagagcaagtctacatttcttccctcgccctcctcaagatgctcaaacacggtagagctggagtgccaatggaggtaatgggactgatgcttggtgaattcgttgacgagtacacagtgcgagttgtagatgtatttgctatgccccaaagtggtactggagttagtgtagaagcagttgatcacgtctttcagacgaacatgcttgacatgcttaagcagactggcagaccagagatggttgtaggatggtaccattcacatccaggttttggatgctggctttcaggtgtcgatatcaacacacagcagagctttgaggccctcaatcaaagagcagttgctgtggtggtggatcctattcaaagtgtaaaggggaaggttgtgattgatgcattccgtttaattaatcctcagactatgatgcttggccaggagcctcgacaaacaacttcaaatcttgggcatctgaataaaccatccatacaagccttgatccatggtttgaatcgacattactattctattgcaattaactataggaaaaatgaattggaagaaaaaatgctactcaacttgcataaaaagaagtggactgatggtctgactctgcgacgctttgattgtcatgcaaagacaaatgaacaaacagttcaggaaatgcttgatcttgcaataaaatacaacaaagctgtacaggaagaggatgagctacctccagaaaagcttgctattgcaaatgttgggagacaagatgctaaaaagcatctagaggagcatgtctcaaatctaatgtcttcaaacatagttcaaaccctagggacaatgcttgataccgtcgttttctaaatctttttgcacatgcttatattatcaagtttcagaatcaagtgaacatgttattctctatcctctccttccatcagatgaaacaggcagcctttaagaaggtggatcacattattgacatggctatttcttgtgagatcttttggatgagtcatgatatattactaaacatttcgggaa

SEQ ID NO: 1786 - DNA, 1153 bp, Silene vulgaris
accaccagattcgcctacactcgacacctctgagcaagtctacatctcttcccttgctctcctgcaaatcgaatcgaaatcgaacgaacccgtaaaaatggacagattaacgcgaatgttcgcaggagcaggaggagcattaggacatccaccaccagattcgcctacactcgacacctctgagcaagtctacatctcttcccttgctctcctcaagatgctcaaacacggtagggcgggggtgccgatggaggtgatggggttgatgttgggggagtttgtggatgagtatacggttagagttgttgatgttttcgcaatgccgcaaagtgggactggtgttagtgttgaagctgttgatcatgttttccagactaatatgcttgatatgcttaaacaaaccggccgaccagagatggttgtaggatggtaccattcccatcctggttttggctgctggctctctggagttgacatcaacacccaacagagttttgaagctctaaatcaaagagctgttgccgtggtggtagatcccatacagagtgtcaagggcaaagtagtgattgatgccttccgtctgatcaatccccaaaccatgatgcttggtcaagagcctcgacaaacaacatccaaccttgggcaccttaataaaccgtcaattcaggcgttgatccacgggttgaacagacactattactccatagcaattaactacaggaagaatgaacttgaggagaaaatgttgctgaacctacacaaaaagaaatggactgatgggttgactcttcagagatttgatgctcattccaaaaccaatgagcagactgttcaggaaatgctgagcttagccatcaagtataacaaagccgtccaggaagaggatgagttgtctcctgagaagctagcgattgctaatgtgggaagacaagatgcaaagaagcatctcgaagaacacgtctccaacttgatgtcctccaacattgttcagacgttggggaccatgctagatactgttgtgttctagcttaatcttcattttcagctggacattcgactgttgtgttttcccttttcttgtaatcaaaggtcatgtccatcatcaccttgtctcagaacttggaatatttgagcatttttctagagactcaga

SEQ ID NO: 1787 - DNA, 1579 bp, Picea glauca
aaatttactttaaggctttatatacggaggaaagaacccaccatgcatagttcatttacaatttgctggaagagggggttttgggattttggcagcagggttatagtagcagcataagaagcagaaccagcaatggagagattgcaaagaatattttcaggggcagggggcatgggaccgcctgctaccgatggccctatgctcgattcatcagagcaggtctacatttcttctctcgctctcctcaaaatgcttaaacacggtagagctggagtgcctatggaggttatggggttgatgcttggtgagtttgttgacgagtacacagtccgagttgtggatgtgtttgccatgccccagagtggtactggagtcagtgtagaggcagttgaccatgttttccagacaaacatgcttgacatgcttaagcagactggcaggcaagagatggttgtaggttggtaccattcacatccaggtttcggatgctggctttcaggtgttgatataaatacgcaacagagtttcgaggctctcaatcaacgggcagttgctgtagttgtcgatcctattcaaagtgttaaggggaaggttgtgatcgatgcattccggttaatcaatccccagactatgatgcttgggcaagagccccgacaaacaacttcaaatcttgggcatctgaataagccatctatccaggcattgatccatgggttaaatcgccattattattctattgccattaattaccggaaaaatgaactggaagaaaagatgctactcaatttacataaaaagaaatggactgatggtctgactctgcaacgctttgattgccattctaagacaaatgaacagacagttcaggaaatgcttgatcttgcaataaagtacaataaagctgtacaagaagaggatcaactatctcctgaaaagctggctattgcaaatgttggcagacaagatgccaaaaagcacctagaagagcatgtctctaatctgatgtcttcaaacatagttcaaacacttgggacaatgcttgacacagtggtgttttagttcttttgtttttattggttttaccaagccagtgcacatgaatcatgagaaacaacagaaaatgggaagcaatggtggtatcgtacccctctaaaggtttacttattgttaaactcttggatgttagtttatgcaaaaggaatccaatcatttggacgctgagagattcattatgcagtttatattccattgaatggaatttgattgacaaatttcaaattatgctacagcattggttggttgatttactagatatcttgaaatttggctgtaagcacgagttatattcaaatatttacttccaagtaattctttgaatgttataagaatgtgtgtaaattaagtggttttgagccctaacttggactagtgatgattacatgtggacatgtttgaactgtttcacaatgatgtgattgcatgatatgggtcattgcccttggtctggtggtttcatgtaattattctgtgctacatgtatcagtgtactttacagctcaatatggtatgtagatgcata

SEQ ID NO: 1788 - DNA, 1469 bp, Picea glauca
ttcatttacgatttactctgaaggagaaaccgaggttgggagttctcaaggagttcataccagaaaaaaagtagaagcagtagccatggagagattgcagaggatattttcaggggcagggggaatgggaccgcccgctccagatggccctatgctcgattcctccgagcaggtctacatttcttcgctcgctcttctcaaaatgctcaaacacggtagagctggagtgcctatggaggtcatggggttgatgcttggtgagtttgttgatgagtacacagttcgagttgtggatgtgtttgccatgccccagagtggtactggagtcagtgtagaggcagttgaccatgttttccagacaaacatgcttgacatgcttaagcagactggcaggcaagagatggttgtaggttggtaccattcacatccaggtttcggatgctggctttcaggtgttgatataaatacgcaacagagtttcgaggctctcaatcaacgggcagttgctgtagttgtcgatcctattcaaagtgttaaggggaaggttgtgatcgatgcattccggttaatcaatccccagactatgatgcttgggcaagagccccgacaaacaacttcaaatcttgggcatctgaataagccatctatccaggcattgatccatgggttgaatcgccattattattctattgccattaattaccggaaaaatgaactggaagaaaagatgctactcaatttacataaaaagaaatggactgatggtctgactctgcaacgctttgattgccattctaagacaaatgaacagacagttcaggaaatgcttgatcttgcaataaagtacaataaagctgtacaagaagaggatcaactatctcctgaaaagctggctattgcaaatgttggcagacaagatgccaaaaagcacctagaagagcatgtctctaatctgatgtcttcaaacatagttcaaacacttgggacaatgcttgacacagtggtgttttagttcttttgtttttattggttttaccaagccagtgcacatgaatcatgagaaacaacagaaaatgggaagcaatggtggtatcgtacccctctaaaggtttacttattgttaaactcttggatgttagtttatgcaaaaggaatccaatcatttggacgctgagagattcattatgcagtttatattccattgaatggaatttgattgacaaatttcaaattatgctacagcattggttggttgatttactagatatcttgaaatttggctgtaagcacgagttatattcaaatatttacttccaagtaattctttgaatgttataagaatgtgtgtaaattaagtggttttgagccctaacttggactagtgatgattacatgtggacatgtttgaactgtttcacaatgatgtgattgcatgatatgggtcattgcccttggtctggtggtttcat

SEQ ID NO: 1789 - DNA, 1221 bp, Fragaria vesca
ccaaaagcaaaggaaaagtgaaatcaggtatggagaggctgcagagaatgttcgccggtgccggaggacctttgggccaccctccgcccgattcccccaccctggattcctccgagcaggtctacatctcctccttggccctcctcaagatgctcaagcacggaagagctggggttcctatggaggtcatgggattgatgctgggagagtttgtggatgattacactgttaaagttgtggatgtgtttgccatgccgcagagtggaactggtgtcagcgtcgaagccgtggatcatgtcttccagactaatatgcttgatatgctcaagcaaactggccggccagagatggttgttgggtggtaccattcacatcctggatttggatgttggctatctggtgtagacattaatacccagcagagctttgaagctttgaatcaacgggctgtagctgtagtggtggatccaattcagagcgtgaaagggaaggtagtcatcgatgcattccgccttatcaacccacaaactatgatgcttggccaagaaccacggcagaccacatccaatcttgggcatctaaataagccatcaattcaggccttgatccatggattaaatcgtcattactactccatagcaattaattacaggaagaatgaactcgaggagaaaatgttgcttaaccttcacaagaagaaatggacagatgggctgacacttaagcggtttgacactcactcaaaaacaaatgagcaaacagttcaggagatgttaaatctagctgttaaatacaacaaggcagtgcaggaggaggatgagctgccaccagagaagcttgcaattgcaaatgtgggaagacaagatgccaagaagcacctcgaggagcatgtctccaacttgatgtcctcaaacattgtccagaccttgggcacgatgcttgatactgtggtgttctaaaatttagtaagctagtttgcataaccgaacctacagtaccaaatcgtttttatattgtttaaacagtatggagatgtaaggctagttttagccaaattggtatgtgcatgaaattacaccttcctgctggttttattcacttcacttgaagtttgtattctcagtttgtttgctattgttacagttggtttagggagcatctgtaacgatgcaagtgttgctgcgaaattggattagtaaaatgctgagttctcattttcca

SEQ ID NO: 1790 - DNA, 1475 bp, Trigonella foenum-graecum
ctgctgtgtattgatgtcaacaccagacaaccaacagccaaatccaggatgtgaatggtaccagcctacaaccatctctggtcttccagtttgttgagcatatcaagcatattagtctgaaaacatgatcaacagcttcaacactaacaccagttccactctgtagcaatagcaatagttcttatttctcaatccctccttgtttcaccttgacttcaaaaatctcactgaaacaacttcaaatttcaaatccgtaacaaaaccctaacacagattcatcgattcatcatggaaaggcttcaacgaatgttcgcaggtgcaggtggaaccctaggtcatccacctccagattccccaaccctagattcatccgagcaagtctacatctcatccctcgcactcctcaagatgcttaaacacggaagggctggtgttcccatggaggttatgggtttgatgctgggagaatttgtggatgagtatactgttcgtgttgttgatgtgtttgctatgccacagagtggaactggtgttagtgttgaagctgttgatcatgtttttcagactaatatgcttgatatgctcaaacaaactggaagaccagagatggttgtaggctggtaccattcacatcctggatttggctgttggttgtctggtgttgacatcaatacacagcagagttttgaggctttgaatcagcgagctgtggctgtagttgtggatccaattcaaagtgttaaaggaaaagtggtgattgatgcttttcgattgatcaatccacagacaatgatgcttggacaagaaccaaggcagacaacatctaatctggggcatctgaataaaccatccattcaggcattgatccatgggttgaaccggcattattattccatagccatcaattacaggaagaatgaacttgaggagaagatgctgcttaatcttcacaaaaagaaatggactgatggtttgacacttaggcgatttgatacacattccaaaactaatgaacagactgttcaggaaatgctgagcttagctaccaaatacaacaaggctgttcaggaggaagatgagctgtcccctgagaagcttgcaatagcaaacgtgggaagacaagatgccaagaagcacctcgaagagcatgtctcaaatttgatgtcttctaacatcgttcaaactctaggaatgatgcttgatactgttgtcttctaaagttgtcattttgaaacttgttaatctagcacgttaaggagacaaattattatttacaattcaggtttcctaattattctcagactatatattttgaatacagatgtattctttggacgagctgaaaaggtcaagaaagtaaaaacttagcacttagtttctttgttgtctccatcgatgttactaggtatcctttgtatgatattgcaggattttatgttcaggtatgttttaaaatatcatataaaacacattac

SEQ ID NO: 1791 - DNA, 1008 bp, Valeriana officinalis
aaagcactgtgattctcaacgaaatcgaatggagagattgcagaggatgttcgccggtgccggaggtgcgttaggccaccctccaccggattcgcctactctcgattcatcggagcaagtctatatctcttcgctcgctctgttgaagatgcttaagcacgggagagctggagttcctatggaagttatggggttgatgcttggggaattcgtcgatgaatacactgttcgtgtagttgatgtatttgctatgcctcagagtggtaccggtgttagtgttgaagcagttgatcacgttttccagactaacatgctcgatatgctcaaacaaactggaaggcctgaaatggtggttggttggtaccattctcatcctggtttcggatgttggctctctggtgttgacattaacactcaacagagttttgaagccctaaatcagcgagcagtagcagtggtggtggatccaatccagagtgtaaaggggaaagttgtgattgatgcctttcggttgataaacccacaaacgatgatgcttggtcaagagccacgtcagacaacttcaaatcttggtcatctcaacaaaccatcaatccaagcattaattcatggtttgaacaggcattattactcgatcgccatcaattacagaaagaacgagctcgaggagaaaatgcttctaaatctccacaagaaaaagtggactgacggtctgacacttcagcgattcgatactcattccaaaacaaacgagcaaaccgttaaggaaatgttgagtttggccataaagtacaacaaagcagtgcaagaagaagatgagttgacaccagagaagctggcaatagcaaatgttggaaggcaggacgctaagaagcatctagaagaacatgtttccaacttgatgtcttcaaacattgtccaaactcttggaaccatgcttgacactgttgtcttctaaacttacctcaatttcttcttctctctttttcagttgatcgtcatgtactc

SEQ ID NO: 1792 - DNA, 1472 bp, Phaseolus coccineus
gtttttcgtgagagtagagataaacttctgaaatagatcgttcaatcaccattttctagttcatcgcttctgtagtttcaacttcaacttcaaattctcagggaagcgaattcagttaatttcaaatctcaaatccgaatcaaaatttggaagtgagattcgcgatggagcggcttcagcgaatgttcgcaggtgcaggtggagcgctggggcaccctcccccagattccccaactctcgattcctccgagcaggtctacatctcctcactcgcgctcctcaagatgcttaagcacgggagggctggggttcccatggaggtgatgggtttgatgctgggagagttcgtggacgagtacactgttcgtgtggttgatgtcttcgcaatgccgcagagtggcactggtgttagcgttgaagccgttgatcatgtttttcagactaatatgcttgatatgctcaaacaaactggacgaccagagatggttgtcggctggtaccattcgcatcctggatttggctgctggctctctggtgttgatatcaatacacaacagagttttgaggctttgaatcagcgtgcagtggctgtggttgtagatccaatacaaagtgttaaaggcaaagtggttattgatgcttttcgattgatcaatccacagactatgatgcttggtcaagagccaaggcagacaacatctaatctgggacatctgaataaaccatctattcaagcattgatccatgggttgaaccggcattactactccatagccattaacggccggaaaaatgaacttgaagagaagatgttgcttaatctccacaagaagaaatggactgatggtttgacacttcaacattttgatacacattccaaaactaatgaacagactgtacaggaaatgctgagcttagctatcaaatataacaaggctgttcaagaggaagatgagctgcctccagaaaagcttgcaatagctaatgttggaaggcaagatgcgaagaagcaccttgaagagcacgtctcaaatctgatgtcttccaacatcgttcaaactctcggaatgatgcttgatactgttgtcttttagagttgttattttggaccttctggtttctctactctagcatggtaaggatgcaaattgagttgttaaaattcctatttcctaatccttctcaaacaatatttgaagacactagacagttatattctttggacgagctgaaaaggtcaagaaagtaaaactccgcacatagtttgtgtggtgtctccctaagtattacttactgggtatcttttaatgttattgctggatttatcttctaaaaaaaaaacaaaaatttcaattatgttttaaaatactataagaagcagttaacattacgtaaacacattgaaatatacattttgtagtctataaatgcaagatctacattaagctccacatatcgacaattagattaca

SEQ ID NO: 1793 - DNA, 1095 bp, Beta vulgaris
aagaagcacatcgaagagagagagaaaatggacagactcactagaatgttcgccggtgcaggaggagctttaggccacccaccacctgattccccaactctcgacacctctgaacaagtctacatctcttctctcgctcttctcaagatgctcaaacacggacgagctggtgttccaatggaagttatgggattgatgttgggtgaatttgtagatgaatacacagttagggttgttgatgtctttgctatgccacaaagtgggactggagttagtgttgaagctgttgaccatgttttccagacgaatatgcttgatatgcttaaacaaactggaaggccagagatggttgtgggatggtaccattcgcatcctggatttggttgttggctgtctggtgtggatatcaacacgcaacagagctttgaagccttgaatcaaagagctgttgctgtagtggtggatcctatacaaagtgtcaaggggaaggtggtcattgatgcctttcgattgatcaatccacagacgatgatgcttggtcaagagcctcggcagacaacgtccaaccttgggcatcttaacaaaccatcaattcaggcattgatccatgggttgaacagacattactattccatagccattaactacaggaagaatgaacttgaggagaagatgttgctgaaccttcacaaaaagaaatggactgatggattgacacttaagagatttgatgctcattcaaaaaccaacgagcagactgtccaggaaatgctgaatctagctatcaagtataacaaagcagttcaggaggaagatgagttgtccccagagaagctagcaattgcaaatgtgggaaggcaagatgcaaagaagcatctggaagaacatgtctcaaacttaatgtccgccaacatcgttcagactttgggcaccatgctagacactgttgtgttttaataccttacatattaaaatttatctatagacaattttctagttttttctgcttgcatcatctgtgatatgaatccactgctccgttcatcctaattttggattgttacattattaagtgaattggaacatgttggacaa

SEQ ID NO: 1794 - DNA, 1442 bp, Medicago truncatula
attttacttcgattaaaatccgaaccagagctagaaatattaaagtgtatcaaaagttcttatttctcaatccctctttacttcaccatcgactcccacttcaacttcaaaaatctcacttcaaatttcaaatccaaaacaaaaccccaacgcagattcctcgattcatcatggaaaggcttcaacgaatgttcgcaggtgcaggtggagccctaggtcatccaccaccagattccccaaccctagattcatccgaacaagtctacatctcctccctcgctcttctcaagatgcttaaacacggaagggctggggttcctatggaggttatgggtttgatgcttggagaatttgtggatgagtatacagttcgtgttgttgacgtgtttgcaatgccacaaagtggaactggtgttagtgttgaagctgttgatcatgtttttcagactaatatgcttgatatgctcaaacaaactggaagacctgagatggttgttggttggtaccattcacatcctggatttggctgttggttgtctggtgttgacatcaatacacaacagagttttgaggctttgaatcagcgagccgtggctgtagttgtggatccaattcaaagtgttaaaggaaaggtggtgattgatgcttttcgattgatcaatccacagacaatgatgcttggacaagaaccaaggcagacaacttccaatctgggacatctgaataaaccatccattcaggcgttgatccatgggttgaaccggcattattattccatagccatcaattacaggaagaatgaactcgaggagaagatgctgcttaatcttcacaaaaagaaatggactgatggcttgacacttaggcgatttgatacacattccaaaactaatgaacagactgttcaggaaatgctaagcttagctaccaaatacaacaaggctgttcaagaggaagatgagctgacacctgagaaacttgcaatagcaaatgttggaagacaagatgccaagaagcacctcgaagagcatgtctcaaatttgatgtcttctaacatcgttcaaactcttggaatgatgcttgatactgttgtcttctagagttgtctttttggaacttatggttaatctagcactttaaggagacaagttgttatgtacaattcaggtttcctgattattctcagactatattttgaatacagatgtattctttggacgagctgaaaaggtcaagaaagtataactagcacttagtttatttggtgtctccattgatattacttggtatactttaattgtattattatattgcaggattttatgttcaggtatttttaaaataccatagaaaacacgttacataaaggaataccaacagactcaccctagatttgtagtcccttgtgaatgtgaacgcaagcaatgtctaaactaagctac

SEQ ID NO: 1795 - DNA, 1419 bp, Cicer arietinum
aaagttctgaattcgtaacaccgatctccgaatcagagatagaagcgttaagtaggcatcaagcaaggagcaatagttccaaatcatttccttcaaatctcagtgaaaccatttccttcaaattccaaatccgaacagaaatttcgtgaatcaacatggaaagacttcaacgaatgttcgcaggtgcaggtggaacgttagggcatccacctccagattccccaaccctcgattcctccgagcaagtctacatctcttccctcgctcttctcaagatgcttaagcacggaagggctggggtacccatggaggttatgggtttgatgcttggagaattcgtggatgaatatactgttcgtgttgttgatgtttttgctatgccacagagtggaactggtgttagtgttgaagctgttgatcatgtttttcagactaatatgctcgatatgctcaaacaaactggacgaccagagatggttgttggttggtaccattcacatcctggatttggctgttggttgtctggtgttgacataaatactcaacagagttttgaggctttgaatcagcgagcagtggctgtagttgtggatccaatacaaagtgttaaaggaaaggtggtgattgatgcttttcgattgatcaatccacagacaatgatgcttggacaagaaccaagacaaacaacatccaatctggggcatctgaataaaccgtccattcaagcattgatccacgggttgaaccgacattattattccatagccatcaattacaggaagaatgaacttgaggagaagatgctgcttaatcttcacaagaagaaatggactgatggtttgacacttaggcgttttgatacacattccaaaactaatgaacagactgttcaggaaatgctgagcttagctaccaaatacaacaaggctgtccaagaggaagacgagttaccccctgagaagcttgcaatagcaaatgtgggaagacaagacgccaagaagcacctcgaagagcatgtctcaaatttgatgtcttctaacatcgttcaaactcttggaatgatgcttgatactgttgtcttctagagttgtcattttgaaccttctggtttaatctagcatgttaaggagacaagttcttatttataactcgggtttcctaattattctcagactatatttgaatacagatgtgttctttggacgagctggaaaggtcaagaaagtaaaacttagcacttagtttatgtggtgtcttcctcggtattattaggtttcctttaattgtatcatactgcaggattttatgttttatagattatcacacgaaaaatgtcagctatgttttaaaataccatgttaaacacataatattacataaagacatatttaaatttaattgtagatatagtcttcttac

SEQ ID NO: 1796 - DNA, 1154 bp, Cucumis sativus
aaagaaagttaaaagtcttgcatgcccggcagccggatcagatcgacgctgagggaaaactttacgaatggagcgcctacagagaatgttcgccggtgccggaggttcactgggccaccctccgccggactcgcccactcttgattcgtcggagcaggtctacatctcatccctcgcgcttctgaagatgcttaagcacggaagagctggggttcccatggaggtgatgggtctgatgttgggggaatttgttgacgagtacaccgtgcgcgtggtcgatgtatttgctatgccgcaaagtggtacgggtgttagtgtcgaagctgttgatcatgtattccagaccaatatgcttgacatgcttaaacaaactggacgtcctgagatggttgtaggatggtaccactctcatcctggatttggttgttggctgtctggtgtcgacatcaacactcaacagagttttgaagctcttaatcagcgagctgttgctgtagttgtggatccaatccaaagtgtcaagggaaaggtggttatcgatgcctttcgtctaattaatccccagacaatgatgcttggtcaagaaccacgtcaaacaacatcaaacctcggccatcttaataagccatctattcaagcattaatccatggattgaatcgccattattactctattgcaattaactataggaaaaatgaacttgaagagaagatgttgcttaatcttcacaagaagaaatggactgatggcctaacacttcgacgatttgatacacactcgaaaactaatgagcagactgtccaggaaatgctgaacttggctatcaagtacaacaaggcagtacaagaggaagatgagttgccaccagaaaaacttgcaattgcaaacgtgggaaggcaagatgctaagaagcacctggaagaacatgtctccaatttgatgtcatcgaacatcatacagacattaggaacaatgctcgatacagttgtgttctaatcgaactatggtcgttaaagaactctacatcccctgccaggaacattcagaagattcttcattcaaagttgcagggtctgtgattgttaaacgcgtttgttttaaactctttgtcctgcctgtctttcactctcatcacattaatattttattggat

SEQ ID NO: 1797 - DNA, 1275 bp, Cucurbita pepo
aaagttcgagtcttgcttgttcatctgacgggaagatcgacgctgagggaaaactttaggaatggagcgattgcagagaatgttcgctggcgccggaggttcactggggcacccgccgccagactcgcccactctggattcgtcggagcaggtctacatctcctcgctcgctcttctgaagatgctcaaacatggaagagctggggttcccatggaggtgatgggtctgatgttgggggaatttgttgatgagtacaccgtgcgtgtggtcgatgtatttgctatgccgcaaagtggtactggtgttagtgttgaagctgttgatcatgtattccagaccaatatgctcgacatgcttaaacaaactggacgccctgagatggttgtaggatggtatcactctcatcctggatttggatgttggctctccggtgtcgacatcaatactcaacagagttttgaagctcttaatcagcgagctgttgccgtagttgtggatccaatccaaagtgtcaaggggaaggtggttatcgatgcctttcgattaattaatccccagacaatgatgcttggccaagaaccacgacagacaacatcaaacctcggccatcttaataaaccatctattcaagcattaatccacggattgaatcgccattattactccatagctattaactataggaagaatgagcttgaagagaagatgttgcttaatcttcacaagaagaaatggactgatgggctaacacttcgacgatttgacacacactcgaaaactaatgagcagacagtccaggaaatgctgaacttggctattaagtacaacaaggcggtgcaggaggaagatgagttgccaccagagaaacttgcaattgcaaatgtgggaagacaagatgctaagaagcacctggaagaacatgtctccaatttgatgtcatcaaacatcatacaaacgttaggaacgatgctcgacacggttgtgttttaatcgaactatgttcgttaaagaatggcacttcccctgcaggaagtagttgtgagctctatgaactgtttatcaagcaaaatggtgttcgaactcttccatagctacgaacccgtctagcttttatttggatattttattggatcttaggatgaaggataatttgagaagttctgtaagggggttcctttgaatcataatgtgacctcaatattctggactagaggtggtttcgtgttttacaggacagcttttggtgattcagaatgttagaatgaatgtcatga

SEQ ID NO: 1798 - DNA, 1009 bp, Euphorbia peplus
agttgttggaaatttgggcatggaaagactgcagagaatgttcggcggtgcaggaggtggtttgggtcaccctcctcccgattctcctactcttgatacctctgagcaagtctacatctcctctctcgccctcctcaaaatgctcaaacacggaagagctggagtcccgatggaagtaatgggattgatgcttggggagtttgtcgatgaatatactgtccgtgttgttgacgtctttgctatgcctcagagtggtactggtgttagtgttgaagctgttgatcatgtctttcagactaacatgcttgatatgctcaaacagactggaaggccagaaatggttgttggttggtatcattcccatccaggatttggctgttggctctctggtgttgacattaacacacaacagagttttgaagctcttaatcaacgggctgtagcagttgtggtggacccaatacagagtgttaaagggaaagtggtcattgatgcttttcgattgattaaccctcagacaatgatgttaggccaagaaccacgacaaacaacttctaaccttgggcatcttaacaaaccatccattcaggcgctgatccatggattgaacagacactattactcgatagccatcaactacagaaagaatgagcttgaggaaaaaatgcttcttaacctgcacaagaagaaatggacagatggattgacacttcaacgtttcgatactcactctaaaacgaatgagcagactgttcaggagatgttgagcttagctgtgaaatacaacaaggcagtgcaagaggaagatgagctgtctcctgagaaattagcgattgcaaatgtgggaaggcaagatgcaaaaaagcacctcgaagaacacgtctctaacttgatgtcctcgaacatagtccagactttgggtaccatgcttgacactgttgttttctaggttatccttttctttcttctgtattatttgttattctgtccagaatcctcttctttttag

SEQ ID NO: 1799 - DNA, 1313 bp, Cucumis melo
ttttgctccacctccttaatcttcatttttaagaaccagaggagggaagccttgtcgcgaaagaaagttcaagtcttgcaatcccggcagccggatcagattgacgctgagggaaaactctacgaatggagcggttacaaagaatgttcgcgggagccggaggttcattggggcacccgccgccggactcccccactcttgattcgtcggagcaggtctacatctcctcgctcgcgcttctgaagatgcttaagcacggaagagctggggttcccatggaggtgatgggtctgatgttgggggaatttgttgacgagtacaccgtgcgcgtggtcgatgtatttgctatgccgcaaagtggtacgggtgtcagcgtcgaagctgttgatcatgtattccagaccaatatgcttgacatgcttaaacaaactggacgccctgagatggttgtgggatggtaccactctcatcctggatttggatgttggctctctggtgtcgacatcaatactcaacagagttttgaagctcttaatcagcgagctgttgctgtagttgtggatccaatccagagtgtcaagggaaaggtggttattgatgcctttcgtctaattaatccccagacaatgatgcttggccaagaaccacgtcaaacaacatcaaacctcggccatcttaataaaccatctattcaagcattaatccatggattgaatcgccattattactctattgcgattaactataggaaaaatgaacttgaagagaagatgttgcttaatcttcacaagaagaaatggactgatggcctaacacttcgacgatttgatacacactcgaaaactaatgagcagactgtccaggaaatgctgaacttggctatcaagtacaacaaggcagtacaagaagaagatgaattgccaccagaaaaacttgcaattgcaaacgtgggaaggcaagatgctaagaagcacctggaagaacatgtctccaatttgatgtcatcaaacatcatacagacattaggaacaatgctcgatacagttgtgttctaatcaaactaaagtcattaaagaactctacgtcccctgccagaaaaacacttcgaggattcctcgtccaaagttgcagggtctgtgattgttaaacgcttttgttttaaaacccttcattccacctatcttttctctttcatcacattaatattttattggatcttagaacgagaggtgttagtcgtttacacgacagctatttgtttcaatatgcttgggatgtgaatgagaagatatagtgtttataattcaaaaaaa

SEQ ID NO: 1800 - DNA, 1162 bp, Tropaeolum majus
agagaagaaaacccacctacaagtaagattcccgatcggctaacttgagaaaacgagaaaaacatcagctatggagagattgcagaggatgttcgccggtgccggcggtgctttaggtcacccaccaccggattcccctactctggacacgtcggagcaggtgtacatctcctccctcgctctcctcaaaatgctcaagcacggaagggctggggttcctatggaagtcatgggtttgatgcttggagagtttgttgacgagtacacagttcgtgttgttgatgtgtttgccatgcctcaaagtggtactggtgttagcgttgaagccgttgaccatgttttccagactaatatgcttgatatgctcaaacagactggaagaccggagatggttgttggttggtaccattctcatcctggatttggctgttggctttctggtgttgacataaacacccagcagagttttgaagccttgaatcaaagggcagtagcagtggtggtagatcctattcagagtgtcaaaggaaaggtggtgattgacgcattccgtttaatcaacccacaaactatgatgcttggccaagaaccacgacagacaacatccaatcttgggcatcttaacaagccatcaattcaggcattgatccatggactgaacagacactattactcaatagccattaattacaggaagaatgagctcgaggaaaagatgctactcaaccttcataaaaagaaatggactgatggactgacactccgcagattcgacacccactccaaaactaatgaacagactgttcaggagatgcttgggttggccattaaatacaacaaagcggtgcaagaggaggatgaactgtccccagagaagcttgccattgccaatgtgggaagacaagatgcgaagaagcatctcgaagaacatgtctccaacttgatgtcttcaaacataattcagacattgggaaccatgctcgacacggttgtcttctagaggagctgttttcatttcggactcttttaacacttttcagtagagaagtcgtgaacatattctacatttgttttgtttcttgcatccaactggaccaatttttaatatttctgttgcttctggtattataatattattacagtaatttcagtttttttatat

SEQ ID NO: 1801 - DNA, 1485 bp, Cajanus cajan
ttagacagaacagaagtattgaagtagagctatttgagtaacattcatcttgttcctctgttggtggcttcaggttcaggttccgcttcaagttcaaattctcagtgaaaccaattcagttcagttaaaatttcaaatccgaagcgagattcgccatggagaggcttcagcgaatgtttgcaggtgcagggggagcgctagggcaccctcccccagattccccaactctcgattcctctgagcaggtctacatctcctcactcgcgctcctcaagatgctcaagcacggaagggccggggttcccatggaggtgatgggtttgatgctgggagagttcgtggacgagtacaccgtccgtgtggttgatgtcttcgcaatgccccagagtggcactggtgttagtgttgaagctgttgatcatgtcttccagactaatatgcttgacatgctcaaacagactggacgacctgagatggttgttggctggtaccattcacatcctggatttggctgttggctctctggtgttgacatcaatacccagcagagttttgaggctttgaatcagcgtgcagtggctgtggttgttgatccaatacaaagtgttaaaggcaaagtggtgatcgatgcttttcggctgatcaatccacaaactatgatgcttggtcaagaaccaaggcagacaacatccaatctaggacatctgaataaaccatccattcaagctttgattcatgggttgaaccggcattactattccatagccattaattacaggaagaatgaacttgaggaaaagatgttacttaatcttcacaagaagaaatggactgatggtttgacacttcgacggtttgatacacattccaaaactaatgaacaaactgtacaggaaatgctgaacttagctatcaaatataacaaggctgttcaagaggaagatgagctgcctccagaaaagcttgctatagcaaatgtgggaagacaggatgcgaagaagcatcttgaagagcacgtctcaaatttgatgtcttccaacatcgttcaaactctgggaatgatgcttgatactgttgtcttctagagtcgttattcaggaccttctggtttctctagcgtggtaaagagacaaattgagttattacaattcctgttttctaattcttttgaaactatatttgaggacggatatattctttggacgagctgaaaaggtcaagaaagtaaaactcagagcatagtagtttggttggtgtctcccccattattactattactgggtatctttattgttattgctggatgttatcttctataaatttgtctttatcaacacaaaatgtctgttatgttttaaaataccataagaatctcggttaacattacgtaaacaatgaaaacaatgcccttgcaaccacccccaacaaaaaaaagaaaaaaagaaaaaagtttaagctccaaataccaaatattagattacagat

SEQ ID NO: 1802 - DNA, 1282 bp, Platanus occidentalis
tgaactttggtcgaattgcttaaagcccaagttacattcagattggaatcgggaaataatggagaggttgcagaggatgttcgccggcgcagctggagggctgggggtggggcatccacctccggacactccgcttctcgattcatcggagcaagtctacatctcttccctggcccttctcaagatgcttaaacacggaagagctggggttccgatggaagtgatggggttgatgctgggggagttcgtggacgagtatacagtccgtgttgtcgatgtctttgcgatgcctcagagcggtactggtgtcagtgtcgaggccgttgatcatgtcttccagactaatatgctcgatatgctcaagcaaactggcagaccagagatggtggtaggatggtatcattcacatcctggatttggctgctggctttcgggtgtggatattaatacacaacagagctttgaagctctaaatcaacgagctgttgcagttgtggttgacccaatccagagtgtaaaaggaaaggtggttattgatgccttccgattgattaacccacaaaccatgatgcttggccaagagccacggcagacaacatccaatgttgggcatctgaacaaaccatccattcaggctttgatccatgggttgaacaggcattattactctattgcgattaactatagaaagaatgaacttgaggagaaaatgttactgaacctacacaaaaagaagtggactgatgggttaatgctacaacgatttgatacacattccaaaacaaatgaacaaactgttcaggagatgctgagtctagccatcaaatacaacaaggcagttcaggaagaggatgagttgccacctgagaagctggcaattgcaaacgtgggcaggcaagatgctaagaagcatttggaagaacatgtctctaacttgatgtcatcaaacatagttcagactttgggcaccatgttagacacagttgtattctaattgttgggaaaaggattggccttagtaacaaggtcctttgtttgcataactccagtggatgggatatttgattggttttaacagtgatttattgcacgttgattgtttgactttcatctagtcactttgccatcttttccttgaagaaatgtactaaatgaattgttacagttgtctgatcattcagtttttgtgaatggtagatacttcagttgatcattctagtttttgtgaatggtagatacttcagtccaggtacaatgagttggggcctggtgaaggcatacg

SEQ ID NO: 1803 - DNA, 1151 bp, Papaver somniferum
aaactaaacaagatctgtgggataagaatctcgattactctcggctatctactgtaagacgtctgatcgaaatcctgagcaaaagagtaaatcaaatcaacaatggagagattacaaaggatattagcaggtgcaggaggaatgggaggacatccacctccagattcaccactcttagattcatctgagcaagtttacatttcttctcttgcactcctcaagatgcttaaacatggaagagctggagttcctatggaagttatgggattgatgcttggggagtttgtagatgagtatactgttcgtgtcgttgatgttttcgctatgcctcagagtggtactggtgttagtgttgaagctgttgacccagtgttccagactaatatgctagatatgcttaagcagactggcagaccagagatggttgtaggatggtatcactcgcatcctggatttggttgttggctctctggtgttgatattaatacacagcagagttttgaagctttgaatcagagagctgttgccgtggttatagaccctatacaaagtgttaagggtaaggtagtcatcgatgccttccgtttgatcaatcctcaaaccatgatgttgggacaagagccacgacagacaacatcaaaccttggatatctcaacaagccgtccattcaagctttgatccatggtttgaataggcattactattcaatagcgattaactacaggaaaaatgagcttgaggaaaagatgttgctcaatcttcataagaagaagtggactgatgggttgactctgcagcagtttgattctcattcaaaaaccaatgagcagactgtagaggaaatgcgaagcctggccatcaaatacaacaaggctgttcaagaggaggatgagttgtccccagagaagcttgctattgccaatgttggaaggcaggatgctaaaaagcacctggaagagcatgtcaataacttgatgtcatcaaacattatccagaccctgggaaccatgcttgacaccgttgtgttttaggaatatcaatctataagtttctttcccaggttattgagatttcagatttactcttttgttattaagtagtgtccgtggaagttaacattgggaaatgtttaatgttggtggaagttaaa

SEQ ID NO: 1804 - DNA, 1229 bp, Petunia hybrida
aaagctaattttgagtctcagtagtcttgttcccaaagaaatctaaaagaactttcatgtcgggtatggaaagattgcagcggatgttcgccggagctggcggcgcgttaggtcacccgccaccggattctccaactctagattcttctgagcaagtttacatctcttctcttgctctcctcaaaatgcttaaacacgggagggctggagtacctatggaagtcatgggattgatgttgggggaattcgtcgatgagtatacggttcgagtagtggatgtgtttgcgatgccgcagagtggtactggagtgagtgttgaagctgttgatcatgttttccagactaatatgcttgacatgctcaagcagactgggagacctgagatggttgttggctggtaccattcacatcctggatttggctgctggctttctggtgttgacatcaatactcagcagagttttgaagcacttaatcaacgagcagtggctgtcgtggtggatcctattcagagtgttaaagggaaggtggttattgatgcgtttcgcttgatcaatccccaaactatgatgcttggccaagagccacggcagacaacatcaaatctgggtcatctgaacaaccatctattcaagcattgatccatggtttgaacagacactactactcaatagccataaactacagaaagaatgaacttgaagagaagatgctactgaatcttcacaagaagaaatggacagatggactcacgcttcagcgttttgatgctcattccaaaactaatgaacagacagttcaggagatgttaaaccttgcggtcaagtacaataaagcagtgcaggaggaggatgagttgcccccggaaaagctagctattgcgaatgtaggaagacaagatgcaaagaagcatcttgaagagcatgtctcgaatttgatgtcttcaaacattgtccagacattgggaacaatgcttgacacggttgtcttctgaaggtcgtttccagcccctcatggagttgggtttgattgtctcattttcctctgctgtcgcatctagtgtttctgttatccagaaatttaatcaaacacattacagagatgggtgatatttctttcttcagtgttctgttttagattcctacatattactccattcgactttggtttatgttgctgtaatacgtaaggtatgatctagtttgtttcaacaattaagactatgcctt

SEQ ID NO: 1805 - DNA, 1244 bp, Musa acuminata
ggagatcgatcgatcattccacggcgaagggtttgagtcgcgcggcagcgagagaaaggagagaaagcggggaagggaagaggagaagggggaggatatgcaggggatggagagactgcatcggatcttctcgggtgccggcggtatgggccacccgcctcccgattcccctcagctcgactccgccgagcaggtctacatctcttccctcgccctcctcaagatgctcaagcacgggagggccggaatgcctatggaggtgatggggctcatgctgggggagttcgtggacgagtacaccgtccgggtcgtcgacgtcttcgcgatgcctcagagcgggacgggcgtcagcgtggaggccgtcgatcacgtcttccagaccaacatgcttgacatgctcaagcagacaggaagacctgaaatggttgtcggatagtaccattctcacccaggctttggttgttggctttctggtgttgacataaacacgcagcagagttttgaagccctgaatccgagggcaattgctgttgtagtagacccgatccagagcgtaaagggtaaggtggtcattgatgctttccgcttgattaacccccagactatgatgcttggccaggagcctcgtcaaacaacatccaatgttgggcatctcaacaaaccatccattcaggcattgatccatgggttgaaccggcattactattctatagccataaattaccggaagaatgagctcgaggagaagatgttgctgaaccttcacaaaaagaaatggacggatggattgatacttcgcccatttgacacccattcgaaaaccaatgagcagaccgtccaggaaatgttggatttggctatcaaatataacaaagcagtccaggaggaggatgagcttccacctgaaaagttggctattgtaaatgtgggaaggcaagatgcgaaaaagcatctggaagaacatgtctctaacttgatgtcatcaaacataattcagactctgggtactatgttggacaccgtcgtgttttgatagcggtttcgagttgaggacttgttttgctttcaactcagcaaaatcatttatcattccggttcccttttgttgccaaggaaaacgtttgttgtcgatgcctagtgtttcaatggaacatcagggcctgtactagcaagtagtctaattgtagtcctcgaccaactacgttgcagtggttatattattagcacaatgtactactggttgg

SEQ ID NO: 1806 - DNA, 1377 bp, Picea glauca
agttcatttacgatttactctgaaggagaaaccgagggtttgggagtttctcaaggagttcataccagaaacaaaagtagaagcagtagccatggagagattgcagaggatattttcaggggcagggggaatgggaccgcccgctccagatggccccatgctcgattcctccgagcaggtctacatttcttcgctcgctcttctcaaaatgctcaaacacggtagagctggagtgcctatggaggtcatggggttgatgcttggtgagtttgttgatgagtacacagttcgagttgtggatgtgtttgccatgccccagagcggtactggagtgagtgtggaggcagttgatcatgtttttcagacaaacatgctcgacatgcttaagcagactggcaggcaagagatggttgtagggtggtaccattcacatccaggttttggatgctggctttcaggtgttgatatcaatacgcaacagagttttgaggctccaatcaacgggcagttgctgtagttgtcgatcctattcaaagtgttaaggggaaggttgtgatcgatgcattccggttaatcaatccccagactatgatgcttgggcaagagccccgacaaacaacttcaaatcttgggcatctgaataagccatctatccaggcattgatccatgggttgaatcgccattattattctatagccattaattaccggaaaaatgaactggaagaaaagatgctactcaatttacataaaaagaaatggactgatggtctgactctgcaacgctttgattgccattctaagacaaatgaacagacagttcaggaaatgcttgatcttgcaataaagtacaataaagctgtacaagaagaggatcaactatctcctgaaaaactggctattgcaaatgttggcagacaagatgccaaaaagcacctagaagagcatgtctctaatctgatgtcttcaaacatagttcaaacacttgggacaatgcttgacacagtggtgttttagttcttttgttttattggttttaccaagccagtgcacatgaatcatgagaaacaacagaaaatgggaagcaatggtggtatcgtacccctctaaaggtttacttattgttaaactcttggatgttagtttatgcaaaaggaatccaatcatttggacgctgagagattcattgaaattgggcattgaaattggattatttggacattatactcctcttgattattaggatgttatagattattaggatgttatagagttaaaaatgtaatattgggcattgatattggattatttggacattatactcaggaaaaagtagtaatattgtaaattgagtatgggtatatgtcttatgagtgt

SEQ ID NO: 1807 - DNA, 1322 bp, Pinus taeda
agagcgacatataagtacccatggttcatactagtccgtcttacgatttacttgaagaataagccgagggtttggtttctcaggagttcataccagaaacaaaagcagaagcagcaaccatggagagattgcagaggattttttcaggagcagggggaatgggaccgcccgcttcagatggccccatgctcgattcctccgagcaggtctacatttcttcgctcgcccttctcaaaatgctcaaacacggtagagctggagtgcctatggaggtcatggggttgatgcttggtgagtttgttgatgagtacacagtccgagttgtggatgtgtttgccatgccccagagtggtactggagtgagtgtagaggcagttgatcatgtttttcagacaaacatgcttgacatgcttaagcagactggcaggcaagagatggttgtaggttggtaccattcacacccaggttttggatgctggctttcaggtgttgatattaatacacaacagagtttcgaggctcttaatcaacgagcagttgctgtagtggttgatcccattcaaagtgttaaagggaaggttgtgattgatgcattccgattaatcaatccccagactatgatgcttgggcaggagccccgtcaaacaacttcaaatcttgggcatctgaataaaccatccatccaggcattaatccatggcttgaatcgacactactattctattgctattaattatcggaaaaatgaactggaagaaaagatgctactcaatttacataaaaagaaatggacagatggtctgactctgcaacgctttgattgccattctaagacaaatgaacagacagttcaggaaatgcttgatcttgcaatcaagtataacaaagccgtacaagaagaggatcaactacctcctgaaaaacttgccattgcaaatgttggcagacaagacgccaaaaagcacctagaagagcatatctctaatctgatgtcttcgaacatagttcaaacacttggcacaatgcttgatacagttgtgttttagtttttctttttctttttcttttcttgttttaccgagtcagaaaatggacataatttatgagcagcagcaaatgacaaagaatgatggtgtcacacctctaaaatgtttacttaatgtcaaactcttcagaatgtccatttatgcaaaagaaatccgatcttttggatgccattatgtagctatgtttgaattaatggaattcgattgacaaatttcattatcccacagcattggtgattgataagatgtgattcgttgtaagattaatgtacattt

SEQ ID NO: 1808 - DNA, 1272 bp, Pseudotsuga menziesii
ccgagggtttgatatcttctcaagagttcataccagaaacagcaacagcagccatggagagattgcagaggatattttctggggcaggtggaatgggaccacccgctacagatggccacatgctcgattcctccgagcaggtctacatttcttcgctcgcccttctcaaaatgcttaaacatggtagagctggagtgcctatggaggtcatggggttgatgcttggtgagtttgttgatgagtacacagttcgagttgtggatgtgtttgccatgccgcagagtggtactggagtgagtgtagaagcagttgatcatgtttttcagacaaacatgcttgacatgcttaagcagactggcaggcaagagatggttgtagggtggtaccattcacatccaggatttggatgctggctttcaggtgttgatatcaatacacaacagagtttcgaggctcttaatcagcgagcagttgctgtagtggttgatcctattcaaagtgttaaggggaaggttgtgattgatgcattccgcctaatcaatccccagactatgatgcttgggcaggaaccccgacaaacaacttcaaatcttgggcatctgaataaaccatccatccaggcattaatccatggcttgaatcggcattattattctattgccattaattatcggaaaaatgaactggaagaaaagatgctactgaacttacataaaaagaaatggactgatggtctgactctgcaacgcttcgattgtcattctaagacaaatgaacagacagtacaggaaatgcttgaccttgcaatcaagtataacaaagctgtacaagaagaagatcaactatctcctgaaaagcttgctattgcaaatgttggcagacaagatgccaaaaagcacctagaagagcatgtctctaatctgatgtcttcaaacatagttcaaacacttggtacaatgcttgatacagttgtgttttagtttttttgtcttttctggttttacagagtcagaaattggacacgatttgtgagaagcagcagcaaatggcaaagaatggtgttagtggtatagtacctctgaaatgttgacttaatgttaaactcttgaatgtctgtttatgcaaaagcaatccgatcatttggatgctgagagattcactatgcagttatgtttgtgttaatggaattcgattgacaaatttcaaattattgcacagcatcggtggatttataagctgatcttttcagcaagattaatgtacattttgaac

SEQ ID NO: 1809 - DNA, 1301 bp, Sciadopitys verticillata
cttctcaggctctacgatctggttcccgcaaatttttgcttgaaagaggaaggtttttgaggacgatggagagattacagaggattttttccggggccggtggcatgggaccacctgctacagatggccctatgcttgattcgtcagagcaggtctacatttcatcacttgccttgctcaaaatgctcaagcacggtagagctggggtgccgatggaagtaatgggactgatgcttggtgagtttgtggacgactacacagttagagttgtggatgtatttgccatgccccagagtggtactggagtcagtgtagaagcagttgatcatgtttttcagacgaacatgcttgacatgctcaaacagactggcaggccagagatggttgtaggatggtaccattctcatcctggttttggatgttggctttcaggtgttgatatcaatacgcaacagagttttgaggcgctcaatcaacgggcagttgctgttgtggtggatcctattcaaagtgttaaggggaaggttgtgattgatgcattccgattaatcaatcctcaaactatgatgcttggccaggagcctcggcaaacaacttccaatctagggcatctgaataaaccatccatacaggcattgatccatggtttgaatcggcattattattctatcgctatcaactatcggaaaaacgaactagaagaaaagatgctgctcaacttacacaagaagaaatggaccgatggtcttaccctgcagcgctttgattgtcatgctaaaacaaacgaacaaacagttcaggaaatgcttgaccttgcaatcaagtataacaaggctgtacaagaagaggatcagctgcctcctgaaaaacttgctattgcaaatgttggcagacaagacgctaaaaaacatctagaagagcatgttgcaaatctgatgtcttcaaacatagttcaaaccctagggaccatgcttgatacagttgttttctaaagtccttatactttatttcaggtacaaaatcaaataaaaatcttttactttcatgttgagcatgcagaacaagaaaccgtaacagatggcagaagtagacgttcttaaagattgtgatttagtttttgaactttttggataagttacgatgaaactatatttatcaaaagaatcggaattgaacttgtaaagataaattttgcagtggccatcgcatgatacaagtgagtatatttatcagcttgttatttacatggcccacaagtacactagtaagggtgggatttcatcgagtatattgtgctaaac

SEQ ID NO: 1810 - DNA, 1398 bp, Sciadopitys verticillata
gttttcagtgcaaattgtatctctaaatatatacagtttttatttcaaatcagcgtatatctcctagtaatcctctgcaatttttggtcgaggcgaaggtaatatcagccgatggagagattacagaggattttctctggcgcggggggcatgggaccgcccgctacagacggccctatgctcgattcgtcagaacaagtctatatttcctctcttgccttgctcaaaatgctcaaacatggtagagctggagtgccaatggaggtaatgggacttatgcttggtgagtttgttgatgagtacactgttcgagttgtagatgtatttgctatgccccaaagtggtactggagtcagtgtagaagcagttgatcacgtttttcagacgaacatgcttgacatgcttaagcagactggaagaccagagatggttgtaggatggtaccattcacatcctggttttggatgctggctctcaggtgttgatatcaatactcagcagagttttgaagctcttaatcagcgagcagttgctgtggttgtggatcctattcaaagtgttaagggaaaggttgtgattgatgcattcaggttgatcaaccctcagactatgatgctcggccaggaaccccgacaaacaacttcaaaccttgggcatctgaataaaccatccatccaagcattgattcatggtttgaatcggcattattattctattgctattaactatcgaaaaaatgaattggaagaaaagatgctactcaacctacacaagaagaaatgggctgatggtctgaccttgcaacgctttgattgtcattctcagacaaatgaacagacagttcaggaaatgcttgatcttgcaatcaagtataataaggctgtacaagaagaggaccagctacctcctgaaaagcttgctatagcaaatgttgggagacaagatgctaaaaagcatcttgaggagcatgtatcgaatctgatgtcatcaaacatagttcaaaccctaggaactatgcttgacacagttgttttctaagttatttgtggttcaccagttttttcaaatcacaaaatctagtaatcatctttggctttcacatttacacatatattagaagcatacagcagaaggaagaggtggttaccaacctctgatggttactcattttcagaatttcagatagtttacaataaactgtatattcaaggaatgatggatttgaatgctaagggattattgtgttttatgttgatagactttgattgaaaaaatctggtctgagcaccatagtcatggattgaccacctgctgttttaaatggggcctaagcgtacttatggtctcttatttctacattgtatcaattctttggttttttaagtaattgcacaatgc

SEQ ID NO: 1811 - DNA, 1393 bp, Picea glauca
ggactccagaccagtctacacaaaaagaaacaagcagagcaatctatatagaaaagaacccacgatttataaggagttcatttacgatttactctgaaggagaaaccgagggtttgggagtttctcaaggagttcataccagaaacaaaagtagaagcagcagccatggagagattgcagaggatattttcaggggcagggggaatgggaccgcccgctccagatggccccatgctcgattcctccgagcaggtctacatttcttcgctcgctcttctcaaaatgctcaaacacggtagagctggagtgcctatggaggtcatggggttgatgcttggtgagtttgttgatgagtacacagttcgagttgtggatgtgtttgccatgccccagagcggtactggagtgagtgtggaggcagttgatcatgtttttcagacaaacatgcttgacatgcttaagcagactggcaggcaagagatggttgtagggtggtaccattcacatccaggttttggatgctggctttcaggtgttgatatcaatacgcaacagagtttcgaggctcttaatcagcgagcagttgctgtagtggttgatcctattcaaagtgttaaggggaaggttgtgattgatgcattccgcttgatcaatccccagactatgatgcttgggcaggagccccgacaaacaacttcaaatcttgggcatttgaataaaccatccatccaggcattgatccatggcttgaatcggcattattattctattgccattaattatcggaaaaatgaactggaagaaaagatgctactcaacttacataaaaagaaatggactgatggtctgactctgcaacgcttcgattgccattctaagacaaatgaacagacagttcaggaaatgcttgatctcgcaatcaagtataacaaagctgtacaagaagaggatcaactaactcctgaaaagcttgccattgcaaatgttggcagacaagatgccaaaaagcacctagaagagcatgtctctaatctgatgtcttcaaacatagttcaaacacttggtacaatgcttgatacagttgtgttttagtttttttattcttgtcttttctggttttatttaccgagtcagaaaatggacacgatttatgagaagaagcagtaaatgtcaaagaatagtggtattgtacctctaaaatgtttacttaatgttaaactcttgaatgtcagttatgcaaaaggaatccaatcatttcgatgctgagagattcattatgcagttatgttcgagtcaatggaattcaattgacaatttcaaattatcctacagcattggtggatttataagctgatctttgttgcaagattaatgtacattttgaatgaatgcc

SEQ ID NO: 1812 - DNA, 1418 bp, Musa acuminata
gagatcgatcgatcattccacggcgaagggtttgagtcgcgcggcagcgagagtaaggagagaaagcaaggaagggaagaggagaagggggaggatatgcaggggatggagagactgcatcggatcttctcgggtgccggcggtatgggccacccgcctcccgattcccctcagctcgactccgccgagcaggtctacatctcttccctcgccctcctcaagatgctcaagcacgggagggccggagtgcctatggaggtgatggggctcatgctgggggagttcgtggacgagtacaccgtccgggtcgtcgacgtcttcgcgatgcctcagagcgggacgggcgtcagcgtggaggccgtcgatcacgtcttccagaccaacatgcttgacatgctcaagcagacaggaagacctgaaatggttgtcggatggtaccattctcacccaggcttcggttgttggctttctggtgttgacataaacacgcagcagagttttgaagccctgaatccaagggcaattgctgttgtagtagacccgatccagagcgtaaagggtaaggtggtcattgatgctttccgcttgattaacccccagactatgatgcttggccaggagcctcgtcaaacaacatccaatgttgggcatctcaacaaaccatccattcaggcattgatccatgggttgaaccggcattactattctatagccataaattaccggaagaatgagctcgaggagaagatgttgctgaaccttcacaaaaagaaatggacggatggattgatacttcgcccatttgacacccattcgaaaaccaatgagcagacagtccaggaaatgttggatttggctatcaaatataacaaagcagtccaggaggaggatgagcttccacctgaaaagttggctattgtaaatgtgggaaggcaagatgcgaaaaagcatctggaagagcatgtctctaacttgatgtcatcaaacataattcagactctgggtactatgttggacaccgtcgtgttttgatagcggtttcgaggtgaggacttgttttgctttcaactcagcaaaatcatttatcattccggttcccttttgttgccaaggaaaatgtttgttgtcgatgcctagtgtttcaatggaacatcagggcctgtactagcaagtagtctaattgtagtcctctaccaactacgttgcagtggttatattattagcacaatgtactactggttggtttttttgggtactattttgcccctttctaagtgaccatcataaactatttttttggcaatatcatgatgccttctttatatgttttctgttgctactgcccatgttggatatgaggtgtgaaagtatcgacattatcaaaacatggatatttaatgccttgcttgttttaaaat

SEQ ID NO: 1813 - DNA, 1480 bp, Musa acuminata
gtccgtttgattcgcatcggagggccagtacggcaatcgggggcgctgcgaggggacgtcggcttgctcgtcttttaccaaaatatcacaagttaccaaggaattctccccaggagaaaggggttgtgcgaagcctcgacgaataataacagaagcaagagagggagagaaagggaaggaaggaaggaagaagagggatatgcaagggatggagagattgcatcggatcttctcgggtgccggcgggatgggccatccgcccacagattccccccaactcgactccgccgagcaggtctacatctcttccctcgccctcctcaagatgctcaagcatgggagagccggggtgcccatggaagtgatgggactcatgctgggggagttcgtggacgagtacacggtccgggtcgtcgacgtcttcgcgatgccgcagagcgggacgggcgtcagcgtggaggccgtggatcacgttttccagaccaacatgctcgacatgctcaagcagaccggaagacctgaaatggtggttggatggtaccactctcacccaggctttggttgctggctttctggtgttgacataaacacacagcagagttttgaagcactcaatccaagggcaattgctgttgtagtagacccaatccagagtgtcaagggtaaggtggtcattgatgctttccgcttgatcaaccctcagacaatgatgcttggccaggagcctcgccaaacaacatccaatgttgggcatctcaacaaaccatctattcaggcactgatacacgggttgaaccggcattactattctatagcaataaattaccgcaagaatgagctggaggagaaaatgttgctgaaccttcacaaaaagaagtggactgatggattgatacttaggccatttgacacccattccaaaactaacgagcagactgtccaggaaatgttggatttggctatcaaatacaacaaagcagtacaagaggaggatgaacttccaccagaaaaattggctattgttaatgtgggaaggcaggatgccaaaaagcatctggaagagcatgtctccaacttgatgtcatcaaacataatccagactctggggactatgttggacactgtcgtgttttgatggcagatttcattcagaggacaacacttggttctgattgaattattgaatgctcctatgctttttctacaaagaaaaaattccatcgatgctagtgtttaaatcaaacattggggactgcaagttatcttcttgtagtcctctatcctactacttaacacattgcagtggttatgatgtattggttattcttactctttgcccatctcacttgcattgaagtctgtttcatggcaatatcctgcaactttcttttttgtgtgtttagctgtcagttctggttactgaaatgctaagtcagtggcatcaataaaatctactactgctgatgatagtttaattgtg

SEQ ID NO: 1814 - DNA, 1109 bp, Manihot esculenta
tggtttactcatcactgaaatcttgtcttgctacagaagataacaccaagttcctctgattggctaccgagataggagagagtgagaggaaatgtccggcatggagagactgcagagaatgtttgcgggtgcaggaggcgctttaggtcacccaccccccgattctccaacacttgattcatcggagcaggtctacatctcctctctcgccctcctcaaaatgctcaaacacggaagagctggggtccccatggaagtgatgggcttgatgctgggagagtttgtggatgaatacactgttcgtgttgttgatgtctttgctatgcctcaaagtggtactggtgttagtgttgaagctgttgatcacgtgttccagactaacatgcttgatatgctcaaacaaactggaaggccagagatggttgttgggtggtaccattcccatcctggatttggctgttggctctctggcgttgatataaacacacagcagagttttgaagctctgaatcaacgggctgtagcagtggtcgtggatccaattcagagtgttaaagggaaggtggtgattgatgcttttcgtttgattaacccacagacaatgatgcttggccaagaaccacggcagacaacttccaaccttggacatctgaataaaccatccattcaggcattgatccatggattgaacaggcactattactcgatagccattaattacaggaagaatgaactagaggaaaaaatgcttcttaaccttcataaaaagaaatggacagatggattgacactcaagcggtttgatactcattctaaaaccaatgaacagactgttcaggagatgctgaatttagctattaagtacaacaaggcagtgcaagaggaagatgagctgcctcctgagaagctggcaatcgcaaatgttggaaggcaggatgcgaagaagcacttagaagaacacgtgtctaatttgatgtcttccaacatagttcagacattgggtaccatgctcgacacagttgtgttctaaagtatacttagttattttcttccattctcttggaatcctttatttggttaccttttgtattgtatgttacaaatagtta

SEQ ID NO: 1815 - DNA, 1208 bp, Manihot esculenta
attgatgggagaagtcctgtcttgctacaaaagaaaactccatagcgatagatcctttgtttgcttagctagaaagtgaaagcgagaaaatgtccggcatggagagactgcagagaatgtttgcgggtgcaggaggcgctctaggtcacccaccccctgattctccaactcttgattcatcggagcaggtctacatctcctctcttgccctcctcaaaatgcttaaacacggaagagctggggtccccatggaagtgatgggcttgatgttgggagagtttgtggatgaatacactgtacgtgttgttgatgtctttgcaatgcctcaaagtggtactggtgttagtgttgaagctgttgatcatgtgtttcagactaacatgcttgatatgctcaaacagactggaaggccagagatggttgttgggtggtaccattcccatcctggatttggctgttggctatctggcgttgatataaacacacaacagagttttgaagctctgaatcaacgggctgtggcagttgtggtggatccaattcagagtgttaaaggaaaagtggtgatagatgcttttcgcttgattaatccacaaacaatgatgcttggccaagaaccacggcagacaacttccaaccttggccatctgaataaaccatccattcaggcattgatccatggattgaacaggcattattactcaatagccattaattacagaaagaatgaattggaggaaaaaatgcttcttaaccttcacaaaaagaaatggacagatggattgacactcaagcggtttgatactcattctaaaaccaacgaacagactgttcaggaaatgctgaacttagctattaaatacaacaaggcagtgcaagaggaagatgagctgccacctgagaagctagcaattgcaaatgtgggaaggcaagatgcaaagaagcaccttgaagagcatgtgtctaacttgatgtcttccaacatagtccagactttgggtaccatgctcgatacagttgtgttctagaccaatactttttacttgcgttgctgtattctatgtctcaagtaaaacaaatatcggattttatatttttttaatttgcttttaactcggttatttttgttgtcatactagactatgtcgtggattcccgtttggtaagttgaggaaacaatttaaaagtctgttttagcttgctgtttg

SEQ ID NO: 1816 - DNA, 1221 bp, Populus trichocarpa
gaagttagcagcccctatcttgctcagaaagaaaacctcaacaatctgtgtttggctagagagaaagaaaccaagaaagttaaataataataataatgtcaggtatggagagactgcaaagaatgtttgcaggtgcaggaggcgcgctgggtcatccaccaccagattctcccactctcgattcctccgagcaggtctacatctcctctcttgccctcctcaaaatgcttaagcacgggagagctggggtaccgatggaggtgatgggtttgatgcttggagagtttgtggatgaatatacagttcgtgttgtcgatgtattcgcaatgccacaaagtggtactggtgtgagtgttgaagctgttgatcatgtgttccagactaacatgcttgacatgcttaaacagactggaagaccggagatggttgtggggtggtaccattcacatcctggatttggctgttggctctctggtgttgatataaatacccagcagagttttgaagctttgaatcaacgtgctgtggcagtggtggtggatccaattcagagtgttaaaggaaaggtggtaattgatgcctttcgtttgattaacccacaaacaatgatgcttggccaagaaccacggcagacaacttccaatcttgggcatctgaataagccatccattcaagctttgatccatggattgaacagacattactactccatagccattaattacagaaagaatgaacttgaggaaaagatgcttcttaacctgcacaagaagaaatggacagatggtttgacacttaggcggtttgatactcattcaaaaaccaatgagcagactgttcaggaaatgctgagcttagctattaaatacaacaaggcagtgcaagaggaagatgagctgccacctgaaaagctggcaattgcaaatgtaggaaggcaagatgcgaagaaacaccttgaagaacatgtctcaaatttgatgtcctccaacatagttcagacattgggcactatgcttgacactgttgtgttttagacctgactttatgtcattctgtactctgtttcaagtagaacgatcttgattcagaatttacttttacatttcctttcctttcattgtttgttatgttgtactgtactagttgtcatggtggatatttggaagacagttcaatcacggggatcaatagtgtcattttattatctgcttcatgatgtta

SEQ ID NO: 1817 - DNA, 1029 bp, Euphorbia esula
  misc_feature (8)..(10): n is a, c, g, or t
  misc_feature (823)..(823): n is a, c, g, or t
  misc_feature (999)..(1000): n is a, c, g, or t
gtctttcnnntgctacaaaagaaaaacccaacttcacctgtgagagttttacagacaaatgtccggcatggaaagactacagagaatgttcgccggtgccggaagtggtttgggtcatccgcctcccgattctccaactcttgattcctccgagcaagtctacatctcctctctcgccctcctcaagatgctcaaacacggaagagctggagtccccatggaagtaatgggattgatgcttggggagtttgtggatgaatatacagtccgtgtagttgacgtctttgcaatgccacagagtggaactggtgttagtgttgaagctgttgatcatgtgtttcaaacaaacatgcttgatatgctcaaacagaccggcaggccagaaatggttgtgggttggtatcattcccatcctggatttggctgctggctctctggtgttgatataaacacacaacagagttttgaagctctaaatcaaagggcagtagcagtagtggtggacccaatacagagtgtgaaagggaaagtggtgattgatgcttttcgattgattaaccctcaaactatgatgttaggccaagaaccccggcagactacttctaaccttggccatcttaataaaccctccattcaggcactgatccatggattgaacagacactattactcaattgccatcaactacagaaagaatgagcttgaggaaaaaatgcttcttaacctccacaagaagaaatggactgatggattgacccttcaacgtttcgattctcactctaaaactaatgagcagactgttcaggagatgttgagcttagcngtgaaatataacaaggcagtgcaagaagaagatgagctttcacctgagaaattagcgattgctaatgtgggaaggcaagatgctaagaagcaccttgaagaacacgtctctaacttgatgtcctccaacatagtccagactttggggactatgcttgacactgttgttttctaggnnaatccttttctttctttctgtattattta

SEQ ID NO: 1818 - DNA, 1219 bp, Fagopyrum esculentum
tctcaattggcttcagatcccagacaacaccaatggagagattgcagagaatgttcgccggtgccggaggaggactcgggcaccctccccgagactctccaaccttagatacctccgagcaagtttacatctcttctcccgctcttctcaagatgctcaaacacggtagagctggtgttcctatggaagttatgggtctgatgctgggcgaatttgtcgacgagtatacggttcgggttgtggatgtatttgcgatgccgcaaagtggtacaggcgttagtgtcgaagctgttgaccatgtttttcagactaatatgcttgatatgcttaaacagaccggaaggccagaaatggttgtaggatggtaccattcacatccagggtttggttgttggctatctggggttgatattaatactcagcagagttttgaagctttaaaccaaagggctgtagcagtagtggtggatccaattcagagtgtcaaggggaaggtggtgattgacgctttccgtttgattaacccccaaacaatgatgctaggccaggaacctcgtcagacaacctccaatctcgggcatcttaataagccctcgattcaggctcttatccatgggttgaataggcactactactccattgccatcaactacaggaaaaatgaacttgaggagaagatgctgttgaaccttcacaagaagaaatggaccgatgggcttacactgcagagatttgatgtccactccaaaaccaatgagcagactgttcaggaaatgctcagcttagcagtcaaatacaacaaagcggttcaagaagaagacgagttgccccctgagaagttggctatagccaacgttgggaggcaggatgcaaagaagcacctcgaagagcacgtctccaacttgatgtcctcgaacatagttcagacactcggtactatgttagacactgttgtcttctaatcaagttgttatttgttgagtatcaagctcaatttcttggacatggagattgtgagctggcacaaacttggtagttcttaaaaagtaccaataactttgaaattttacatccttttcacgcttatttgtctaaaggtcttttccttttgatttcagtactgtatttccttcgtttttaagtatgaattctcaagtatatatttccgcaatgcttgatgcggtatctccttgaatgcatgaattccagcgttgcgtct

SEQ ID NO: 1819 - DNA, 1317 bp, Fagopyrum esculentum
cacaaaaagaaatcaggcatttcatactataaatccggtttgcatctaagaaatcagggcagtgactgcgttttagcttgagatcacaatcgaaccatggagagactgcagagaatgttcgccggtgccggaggaggactcggccaccctccgccggactctccaaccctagatacctccgagcaagtctacatctcttcccttgctcttctcaagatgctcaagcacggaagagctggtgttcctatggaagtcatgggtctgatgctgggtgaatttgtggatgagtatacggttcgggttgtggatgtgtttgcgatgccgcagagtggtaccggcgtgagtgtagaagctgttgaccatgtttttcagacgaatatgcttgatatgcttaaacagaccggaaggccagagatggttgtagggtggtaccattcacatccagggtttggctgctggctctctggggttgacattaatactcagcagagttttgaagctttaaaccaaagagctgtagcagtagtggtggatccgattcagagcgtcaaggggaaggtggtgattgatgctttccgtttgattaatccccaaaccatgatgctcggtcaggaacctcgtcagacaacctccaatcttgggcatctaaataagccctcaattcaggctcttatccatggattgaataggcattactactcgattgccatcaactacaggaaaaatgaactcgaggagaagatgcttttgaaccttcacaagaagaaatggaccgatgggcttacactgcaaagatttgatgtccactccaaaaccaatgagcagactgtgcaggaaatgctgaacctagcagtgaaatacaacaaagcggttcaagaagaagacgagttgcctcctgagaagttggctatagccaatgtgggcagacaggatgccaagaagcatctcgaagagcacgtctctaatttgatgtcttccaacatagttcagacactcggtaccatgttagacaccgttgtcttctaatcaaactgttatttgttcagtatcaagctcctcagtttgtcggatgaggtggttgtgagccagaacaagcttactgtttgtgtagatcaagtgtactactttgacattttacgcatttccattattttcgctcttaaatgactttatgatttcagtactgcatttcccttttcagttgtgattcggtgcttgttgtattagacatgaaagagaacgtatgattagttggtcgattctttgagaaaactttagtctttctagaactataataagatgttttgttgtcgttgt

SEQ ID NO: 1820 - DNA, 1196 bp, Fagopyrum esculentum
ggggttacgtctaagaaatcagggcactcagtccgttttagcttgagatcacaaacgaaccatggagagactgcagagaatgttcgccggtgccggaggaggactcggccaccctccgccggactctccaaccctagatacctccgagcaagtctacatctcttcccttgctcttcttaagatgctcaaacacggaagagctggtgttcctatggaagtcatgggtctgatgctgggtgaatttgtggatgagtatacggttcgggttgtggatgtgttcgcgatgccgcagagtggtaccggcgttagtgtagaagctgttgaccatgtttttcagacgaatatgcttgatatgcttaagcagaccggaaggccagagatggttgtagggtggtaccattcacatccagggtttggctgttggctctctggggttgacattaatactcagcagagttttgaagctttaaaccaaagagctgtagcagtagtggtggatccgattcagagtgtcaagggaaaggtggtgattgatgctttccgtttgatcaatccccaaaccatgatgctcggtcaggaacctcgtcagacaacctccaacctcgggcatctaaataagccctcgattcaggctcttatccatggattgaataggcactactactccattgccatcaactacaggaaaaatgaactggaggagaagatgcttttgaaccttcacaagaagaaatggacggatgggctgacgctgcaaagatttgatgttcactccaaaaccaatgagcagactgtgcaggaaatgctgaatctagcagtgaaatacaacaaagcggttcaagaagaagacgagttgcctcctgagaagttggctatagccaatgtggggagacaggatgcgaagaagcatctagaagagcacgtctctaatttgatgtcttccaacatagttcagacactcggtaccatgttagacaccgttgtcttctaatcaaattgttatttgctcgatatcaagctcctcaatttgtcggattaggttgttgtgagccagaacaaacttactgtatttccgttttcaattgtgatttgtgattcagtgcttgatgtcttgtctactcgattgatgagatgcgtatattagttgattcaagagatgcatttagaataagaaatagattggcatttattatgac

SEQ ID NO: 1821 - DNA, 1561 bp, Sequoia sempervirens
aaaatataagcgtggattgcaaaattgttgggaatccccgttctcattgcttgccaattggaattaaaggaggattcacaggcgggatttacaagtcttcccaggtttttcaatctggttcctgcaaatttcagttgttgctctcaagaggaaggctccacaagacaatggagagattacagaggattttttcaggggcgggtggcatgggaccgcctgctacggatggccccatgcttgattcatccgagcaggtctacatttcatcacttgccttgcttaaaatgctcaagcacggtagagctggagttccaatggaagttatgggactgatgcttggtgaatttgttgatgagtacactgttcgtgttgtggatgtatttgccatgccccagagtggtactggagtcagtgtagaagctgttgatcatgtttttcagaccaacatgcttgacatgcttaaacagactggcagaccagagatggttgtaggatggtaccactctcatcctggttttggatgctggctttcaggcgttgatatcaatacacaacagagttttgaggcacttaatcagcgggcagttgctgtggtggttgatcctattcaaagtgttaaggggaaagttgtgattgatgcattccgcctaatcaatcctcaaactatgatgcttggccaggagcctcggcaaacaacttccaatctagggcatttgaataagccatccatccaggcactgatccatggtttgaatcgacattattattctattgctatcaattatcggaaaaatgaacttgaagaaaagatgcttctcaacttacacaagaagaaatggactgatggtctgaccctccaacgctttgattgtcatgctaaaacaaatgaacaaacagttcaggaaatgcttgacctcgcaatcaagtataacaaagccgtacaagaagaggaccagctgcctccggaaaaacttgctattgcaaatgttggcagacaagatgccaaaaaacatctagaggagcacgttgcaaatttgatgtcttcaaatatagttcaaaccctaggcaccatgcttgatacagttgttttttaagttttaggaagttacagaatcaagtgaacatccttttgtttcattttgtgcatccatcagaagaaacacatagcatcttggagaagtgggtcatgcctctaagatggtgactcgattttttatgactgagaccatattatcaaatgaatcaggaaattggatgcttatatattgtgttcggtttactttttagttaaagggatttgatgtgcaaaatgaaaaaatgatgaaatgatgttagtaaatccatcaactggttactggcatgagtcatgagtacagtagtaatggaacggatccattgagttgaactattcggttcatgaaaatactatatacagtttatgtacaaactcgaagaaatttgattaaccaaaattgaagctagggaacgtgtggaattatgacctggcgatttgctccaggtgtgggacatccacataccagcaatgaccgtaaatttactt

SEQ ID NO: 1822 - DNA, 1340 bp, Glycine max
agttaccgcttagataaaacatctaagtattgaagtagggcaccgaataaggattttctggttttgttgttggtgggtttcagcgttccgcttcaacttcaaattctcagtgaaaccaattcagttcagtccaaatcccaaatccgaagtgagatttgcgatggagaggcttcagcgaatgttcgcaggtgcaggtggagctctagggcaccctcccccagattccccaactctcgattcctccgagcaggtctacatctcctcactcgctctcctcaagatgctgaagcacggaagggctggggttcccatggaagtgatgggtttgatgcttggagaattcgtggacgagtacaccgttcgtgtggttgatgtcttcgcaatgccgcagagtggtactggtgttagtgttgaagctgttgatcatgtttttcagactaatatgcttgacatgctcaaacaaaccggaagaccagagatggttgttggctggtaccattcgcatcctggatttggctgttggctctctggtgttgacatcaatacacagcagagttttgaggctttgaatcagcgtgcagtggctgtggttgtagatccaatacaaagtgttaaaggcaaagtggtgattgatgcttttcgattgatcaatccacagacaatgatgcttggtcaagaaccaaggcagacaacatccaatttgggacatctgaataagccatccattcaagcattgatccatgggttgaaccggcattactattccatagccattaattacaggaagaatgaactcgaggagaagatgttgcttaatcttcacaagaagaaatggactgatggtttgacacttcggcattttgatacacattctaaaactaatgaacagactgtacaggaaatgttgaacttagctatcaaatataacaaggctgttcaagaggaggatgagctgcctccagaaaagcttgtaatagcaaatgtgggaagacaagatgcaaagaagcacctcgaagagcatgtgtcaaatttgatgtcttccaacattgttcaaactcttggaatgatgcttgacactgttgtcttctagagtcattattttggacctgctggtttctttggctgtggtaaggagacaatttgagttattacaattactgtttccttattcttctcactatatttgaagacactagacagatatattctttggacaggctgaaaaggtcaagaaagtaaaactcagcacataatttgtgtggtgtctccctctgtattactgggtatcttttaatgttatttctggattttatcttctataaaattgtccctatcaaaac

SEQ ID NO: 1823 - DNA, 1365 bp, Citrullus lanatus
gtaatttcgattcaacgttttccacttccgcaatcgcccatttcaagaaccagacgagagaagtcttgttgcgaaagaaagttcaagtcttgcatgtccggcagccggaaagatcgacgctgagggaaaactttacgaatggagcggctacagagaatgttcgccggtgccggaggttctttggggcacccgccgccggactcgcccactcttgattcgtcggagcaggtctacatctcctcgctcgcgcttctaaagatgcttaagcacggaagagctggggttcccatggaggtgatgggtctgatgttgggggaatttgttgacgagtacaccgtgcgtgtggtcgatgtatttgctatgccgcaaagtggtacgggtgttagtgtcgaagctgttgatcatgtattccagaccaatatgcttgacatgcttaaacaaactggacgccctgagatggttgtaggatggtaccactctcatcctggatttggatgttggctctctggtgtggacatcaatactcaacagagttttgaagctcttaatcagcgagctgttgccgtagttgtggatccaatccaaagtgtcaagggaaaggtggttattgatgcctttcgtctaattaatccccagacaatgatgcttggccaagaaccacgacaaacaacatcaaaccttggccatcttaataaaccatctattcaagcattaatccatggattgaatcgccattattactctattgcaattaactataggaaaaatgaacttgaggagaagatgttgcttaatcttcacaagaagaaatggactgatgggttaacacttcgacgatttgatacacactcaaaaactaatgagcagactgtccaggaaatgctgaacttggctgtcaagtacaacaaggcagtacaagaggaagatgagttgccaccagagaaacttgcaattgcaaacgtcggaaggcaagatgctaagaagcacctggaagaacacgtctccaatttgatgtcatcaaacatcatacagacattaggaacgatgctcgatacagttgtgttttaatcgaactgtcattgttaaagatccggacatcccgtgcgcgaaacacttcgaagattcttcgttcaaagttgcagggtttgtgactattaaacaagctaaagagtgtttaaaactcctccattgctacgaattcctacatatctttcactttcatcacattaatattttattcgatcttaagatgagtagtggtttcgtttttacaaaacagctattgattaccatgataatcaataattatttggaccttgtgtaattgtgtcaaactagtgtaatatcattttctttttcaattaa

SEQ ID NO: 1824 - DNA, 1347 bp, Picea glauca
atatatatagaaaagaacccacgatttataaggagttcatttacgatttactctgaaggagaaaccgagggtttgggagtttctcaaggagttcataccagaaacaaaagtagaagcagtagccatggagagattgcagaggatatttcaggggcagggggaatgggaccgcccgctccagatggccccatgctcgattcctccgagcaggtctacatttcttcgctcgctcttctcaaaatgctcaaacacggtagagctggagtgcctatggaggtcatggggttgatgcttggtgagtttgttgatgagtacacagttcgagttgtggatgtgtttgccatgccccagagcggtactggagtgagtgtggaggcagttgatcatgtttttcagacaaacatgctcgacatgcttaagcagactggcaggcaagagatggctgtagggtggtaccattcacatccaggttttggatgctggctttcaggtgttgatatcaatacgcaacagagttttgaggctcttaatcagcgagcagttgctgtagtggttgatcctattcaaagtgttaaggggaaggttgtgattgatgcattccgcttgatcaatccccagactatgatgcttgggcaggagccccgacaaacaacttcaaatcttgggcatttgaataaaccatccatccaggcattgatccatggcttgaatcggcattattattctattgccattaattatcggaaaaatgaactggaagaaaagatgctactcaacttacataaaaagaaatggactgatggtctgacttgcaacgcttcgattgccattctaagacaaatgaacggacagttcaggaaatgcttgatcttgcaataaagtacaataaagctgtacaagaagaggatcaactatctcctgaaaaactggctattgcaaatgttggcagacaggatgccaaaaggcacctagaagagcatgtctctaatctgatgtcttcaaacatagttcaaacacttgggacaatgcttgacacagtggtgttttagttcttttgtttttattggttttaccaagccagtgcacatgaatcatgagaaacaacagaaaatgggaagcaatggtggtatcgtacccctctaaaggtttacttattgttaaactcttggatgttagtttatgcaaaaggaatccaatcatttggacgctgagagattcattatgcagtttatattccattgaatggaatttgattgacaaatttcaaattatgctacagcattggttggttgatttactagatatcttgaaatttggctgtaagcacgagttatattcaaatattta

SEQ ID NO: 1825 - DNA, 1199 bp, Fagus grandifolia
ctggaccttggctgtcactcagttaagttagggacactccaattcagctccagagaaatcttgctaagaaagaaaactcagagaaagcagatgtcaggcatggaaaggttgcagcgaatgttcgccggtgccggaggcggtttgggccaccctcctcccgattcccccactctcgattcgtccgagcaagtctacatctcttccctcgccctcctcaaaatgcttaagcacggaagagctggggttcccatggaagttatgggcttgatgcttggggagtttgtggatgagtacactgttcgtgtcgtcgatgtgtttgcgatgccgcagagtggtactggggttagtgttgaagctgtggatcatgtcttccagactaacatgctcgatatgcttaaacagactggacgacctgagatggttgtagggtggtaccattcacatcctggatttggatgttggctctctggggtggacataaacacacagcagagctttgaagctttaaatcaacgagctgtggccgtggtggtggatccaattcagagtgtaaaagggaaggtggtgattgatgcctttcgtctgattaacccacaaaccatgatgcttggccaagaaccacgacagacaacatccaaccttggacatcttaataaaccatccatccaagcattgatccatgggttgaatcggcattattattcgatagcaattaattacaggaagaatgaacttgaagagaagatgttgcttaaccttcacaagaagaaatggactgatggcttgacactaaagcggtttgatacccattctaaaactaatgagcagactgttcaggagatgctaaacttagctatcaaatacaacaaggcagtgcaagaggaagatgagttacccccagaaaagcttgcaatagcaaatgtgggaaggcaagatgccaagaagcaccttgaagaacatgtctccaacttgatgtcctcaaatataattcaaactctgggaacgatgctcgatacagttgtgttctagagtccactgttttcgttgcaagagatgggtttgtttcgttgaacatggcaatcatatcgctaggccatatgatttctgttactcttgtacctctatatcggttatacttttatctaatttgattggatttcttcatttgacgctttgtggtgatacgttggccattaatc

SEQ ID NO: 1826 - DNA, 1271 bp, Theobroma cacao
ctaggccaactggatcaacaatatttcaaagaagcccaaacatatgggccacttgaaaaattggaccggaccgacatgatgagccctctatataataacctttttacagtgcaggaggaccgagaagtctttttcttttgtcttgctgccaaagaaaagttgccagaactccgatcgacaatgtcaggcatggagaggttgcagaggatgttcgccggtgctggaggcgcgttgggtcacccgcctccggattcgccgactctggattcttctgagcaggtctacatctcctctctcgccctcctcaaaatgctcaagcacggaagagctggggttcccatggaagttatgggtttgatgttgggagagttcgttgatgagtacactgtgcgagtcgttgatgtctttgcaatgccacagagtggtactggtgttagtgtagaagctgtggatcatgttttccaaacaaatatgcttgatatgctcaaacaaacgggaaggccagagatggtggtggggtggtaccattcacaccctggatttggctgttggctttctggtgtggacataaacacacagcagagttttgaagctttgaatcaaagggctgtagcagttgtggtggacccaattcagagtgttaaagggaaggtggtgattgatgcattccgtttgatcaacccacaaaccatgatgcttggccaagaaccacggcagacaacatccaatcttgggcatcttaataagccatctatccaagcattgatccatgggctaaatagacattattactctatagccattaactacaggaagaatgaacttgaggaaaagatgctcttgaatcttcataagaagaagtggacagatggattgacacttaggcgttttgatacccattccaaaaccaatgaacagactgttcaggaaatgctcaatttagctataaaatacaacaaggcagtgcaggaggaagatgaattacctccggagaagctcgcaatagccaatgttgggcgacaagatgccaagaagcacttagaggaacatgtctcaaacttgatgtcctcgaacatagttcagactttgggaactatgcttgacactgtcgtgttttagactcatggtatctgtatactccttttcaagttgaggaatttcatctatgttgatgccttgtattgttggtcaagcacactgtttgtgttattttgtgaaaattcaaagtgacttcaagttgcctaattatatttatgtgaatgcttgcttga

SEQ ID NO: 1827 - DNA, 1219 bp, Ricinus communis
ggaaaatattggaaaaagtatctgcaactcatataaataccagaaaagcagaactctttatttcaagtcttgtcttgttaccaaagaaaaacccctccccaaataaatcttgtgtgtttgttaaccgagaaagtacgagaaagtgaaagagaaatgtcaggcatggagcgattgcaaagaatgtttgcaggtgcaggaggcgctttaggtcacccacctcccgattctcccactcttgattcatcggagcaagtatatatatcctctctcgccctcctcaaaatgctcaagcacggaagagctggggttcctatggaagtgatgggattgatgcttggagagtttgtggatgaatatactgttcgtgttgttgatgtttttgcaatgccacaaagtggtactggtgttagtgttgaagctgttgatcatgttttccagactaatatgcttgatatgctcaaacagactggaaggccagagatggttgttggatggtaccactctcatcctggatttggctgttggctctctggtgttgatataaacacccaacagagtttcgaagctctaaatcaacgagctgtggcagttgtggtggatccaattcagagtgttaaagggaaagtggtgattgatgcttttcgtttgattaacccgcaaacaatgatgcttggccaagaaccgcggcagacaacttctaaccttgggcatctgaataaaccatccattcaggcgttgatccatggactgaacaggcactattattcgatagctattaattacagaaagaatgaacttgaggaaaaaatgcttcttaacctgcacaaaaagaagtggacagatggattgacactaaagcggttcgatactcattctaaaaccaatgagcagactgttcaggagatgctgaacttggctattaaatacaataaggcagtgcaagaggaagatgagctaccacctgagaagctagtaattgcaaatgtgggaaggcaagatgcgaagaagcatcttgaagagcatgtttctaatctgatgtcttccaacatagttcaaactttgggtaccatgctcgacacagttgttttctagtgtcatgtctttctgtattctctctagagtcctcacctttcttcattgattcaggtagaatccttttcctttcctgaactcgaagtagaacattgaatatgtactttatattggatttatttagttg

SEQ ID NO: 1828 - DNA, 1266 bp, Castanea mollissima
gccgaagcaaaagcagagtagagagaaagagcatcagaaatcttgagaagaaagaaaactcagaagagagagagagaccctatatgtcaggtatggagagattgcagcgaatgttcgccggcgccggtggtggtttgggccatccgccaccagattcaccgactctcgattcgtcggagcaagtctatatctcttccctcgctctcctcaaaatgctcaaacacgggagagctggggttcccatggaggttatgggattgatgcttggggagtttgtggatgagtacactgttcgagttgtggatgtgtttgcgatgccgcagagtggtaccggtgttagtgttgaagctgtcgatcatgtattccagactaacatgcttgatatgcttaaacagactggccgaccagagatggttgttgggtggtaccattcacatcctggatttggatgttggctctctggagtggacataaatacacagcagagttttgaagctttaaatcaacgagctgtggctgtggtggtggatccaattcagagtgtaaaagggaaggtggtgattgatgcctttcgtctgattaaccctcaaaccatgatgcttggtcaggaaccacgacagacaacatccaaccttgggcatcttaataaaccatccatccaagcattgatccatgggttgaatcggcattattattcgatagcaattaactaccgaaagaatgagctcgaggagaagatgttgcttaaccttcacaagaagaaatggactgatggcttgacacttaagcgatttgatacccattctaaaactaatgagcaaactgttcaggagatgctaaacttagctatcaaatacaacaaggcagtgcaggaggaagatgagttaccaccagaaaaacttgcaattgcaaatgtgggaaggcaagatgccaagaagcaccttgaagaacatgtctccaacttgatgtcttcaaatataattcaaaccctgggaaccatgctcgatacggttgttttctagagttcatcatttcaagtcctagccttttagatatatctagaggcaattaggaaactattgcatcagatggatctgttttctgtgaacatgttggcaatcagcttataattgctagaaagaccaatgctggtcaagaaagtgatgaatggaagttttagcaccatatgatttctggttttcttgtattcctgtatcggttatacttttgtctaatttgattcttcattcaaatacgttggtcgct

SEQ ID NO: 1829 - DNA, 1357 bp, Eucalyptus grandis
cctcccgtttcgtcctgcttcctctctcctacacatcggttcacagctgctacagagaaactcgagaggacgaagagagagagagaggaggggcgcggtcgcggtttgatcccgaacttggatgtccggtatggagaggcttcagaggatgttcgccggcgccggaggtgctctgggccacccgcccccggactccccgaccctcgattcctccgagcaggtctacatctcctccctcgccctcctcaagatgctcaagcacgggagggctggggttcccatggaagtgatgggcttgatgcttggggagtttgtggacgagtacaccgtccgagtcgtcgatgtgtttgctatgccgcagagtggtaccggtgttagtgtcgaggccgtcgatcatgtgttccagaccaacatgcttgacatgctcaaacagactggaagaccagagatggtggtaggttggtaccactctcatcctggctttggatgttggctttctggtgtggacatcaacactcagcagagttttgaggctctaaatcagcgtgcggttgcagtagtggtggatcccatccagagtgtcaaagggaaggtggtgattgatgccttccgtttgatcaacccacaaaccatgatgcttggccaagaacccaggcagacaacctccaaccttggacatctcaacaaaccgtccatccaggcattgatccatgggctgaacagacactattactcaattgccatcaattacagaaagaatgaacttgaggaaaaaatgctacttaatcttcacaagaagaaatggacagatggcttgacgcttcgccgttttgacacgcattctaaaaccaatgaacagactgttcaggagatgctgaatttggcaatcaagtataacaaggcggtgcaggaggaggacgaattgccaccggagaagctagcgatcgcaaatgtgggaaggcaagacgccaagaagcaccttgaggagcacgtctccaacctcatgtcttccaacatagttcagaccttagggaccatgctggataccgtagtcttctaaggccctccgaattggcatcttatgttacctgcatcctgcacaactctgtatcatcttttgtggcggtgttccgggactaattgttacgttggcttgatcggtagacactgcggcttgttagaaatttagccctttgttctcttctttgcttgtatccccattcaaacaattcagttaccaatttgttcttatccaagaaagggaaaggaaaggagacggtttatccgacgagcctctgtgacatgatctcttatactaaataacggggcaggtctcctgtctcctttcactggggga

SEQ ID NO: 1830 - DNA, 1209 bp, Euphorbia peplus
atacgtataaagagtagtctttctggtctgtgttgctagaaaagaaaaacccagcttgagatttacagaacatgtccggcatggaaagactacagagaatgttcgccggtgccggaggtggtttgggtcatccacctcctgattctcccactcttgattcctccgagcaagtctacatctcctctcttgccctcctcaaaatgctcaaacatggaagagctggggtccccatggaagttatgggattgatgcttggcgagtttgtggatgaatatactgttcgtgttgttgatgtctttgcaatgccacagagtggtactggtgttagtgttgaagctgttgatcatgtgtttcagacaaacatgcttgatatgctcaaacagaccggcaggccagaaatggttgttggttggtatcattcccatcctggttttggctgctggctatccggtgttgatataaacacacaacagagttttgaagctctaaatcaacgcgctgtagcagttgtggtggacccaatacagagtgttaaagggaaagtggtcattgatgcttttcgattgatcaaccctcaaacaatgatgttaggccaagaaccacgacagacgacttctaatcttgggcatcttaataaaccatccattcaggcattgatccatggattgaacagacactattactctatagccatcaactacagaaagaatgagcttgaagaaaaaatgcttcttaacctgcacaagaagaaatggacagatggattgacacttcaacgtttcgatactcactctaaaacgaatgagcagactgttcaggagatgttgagcttagcggtcaaatacaacaaggcagtgcaagaggaagatgagctgtctcctgagaaattagcaattgctaatgtgggaaggcaagatgcaaagaagcacctcgaagaacatgtctctaacttgatgtccgccaacatagtgcagactttgggtaccatgctagacactgttgttttctaggtgatccttctctttctgtattatgatcctctttttctttagtgcttcactgtttaagtagaatcaatgatcttggttgtgcattacatactacatttttcttgcactccttttatgttatgctggaaccttgattgttggcttcacattcgaatattggtagctggttggaaacaatttagctgttgaaaagtgactg

SEQ ID NO: 1831 - DNA, 1198 bp, Ipomoea batatas
tcggggaggattttaattccacagtagtcgtgttcccaaagaaatcgaagcggctaaagcatagcggaagaagagagtaaaacttaaacaatcatgtcgggaatggaaaggctgcagcgtatgttcgccggagccggcggtgcgttaggtcatccgccgccggattctcctactctcgattcatcggagcaagtctacatctcttctctcgcgctcctcaagatgctcaaacacgggagagccggggttccgatggaagtcatgggattgatgttgggggaatttgtggatgagtacactgtccgcgtggtagatgtgttcgctatgccacagagcgggaccggagtgagtgttgaagctgttgatcatgtcttccagaccaatatgcttgacatgctcaagcaaactggcaggccagagatggttgttggttggtatcattcacatcctggtttcggctgttggctttcgggtgtggacatcaatactcagcagagttttgaagctcttaatcaaagagcggttgcggtggtggtggatcccatccaaagtgttaaaggaaaggtggtgattgatgcctttcgtttgatcaacccccaaactatgatgcttggccaagagccacggcagacaacatctaacttgggacatctaaacaaaccatccattcaggcattgatccatggtctgaacaggcattattactccatagcaatcaattatagaaagaatgaacttgaagagaagatgctactgaatcttcataagaagaaatggacggatggattaacactccagcgatttgatgcccactccaaaaccaatgaggagacagtccaggaaatgctaaatcttgctatcaaatacaataaagcagtccaggaagaggatgagttgccaccagagaagctggccattgcaaatgtgggaaggcaagacgccaagaagcatctcgaagaacatgtgtcaaatttgatgtcatcaaatattgttcagacactgggaaccatgctggacacggttgtcttctagaattcttgcttaaaaactccacagattgttatttgagatggtgaaacagagacaatgttgaccagtttctccttggtgttattgtaactttgaagtgatttaagagagatttgttgtcatatactcttgtgtttattgtctgctcacaaatctttacttttgaagc

SEQ ID NO: 1832 - DNA, 1201 bp, Ipomoea nil
gaggattttaattccacagtagtcgtgtttccaaagaaatcgaagcggctaaagcatagcggaagagagagtaaatcttaaaccaatcatgtcgggaatggaaaggctgcagcgtatgttcgccggagccggtggtgcgttaggtcacccgccgccggattctcctactctcgattcatcggagcaagtctacatctcttctctcgctctcctcaagatgctcaaacacgggagagccggggttccgatggaagtcatgggattgatgttgggggaatttgtggatgagtacacggtccgcgtggtcgatgtgttcgctatgccacagagcgggaccggagtgagtgttgaagctgttgatcatgtcttccagaccaatatgcttgacatgctcaagcaaactggcaggccagagatggttgttggttggtatcattcacatcctggtttcggctgttggctttcgggtgtggacatcaatactcagcagagttttgaagctcttaatcaaagagcggttgcagtggtggtggatccgatccaaagtgttaaaggaaaggtggtgattgatgcctttcgtttgatcaacccccaaaccatgatgcttggccaagagccacggcagacaacatctaacttgggacatctaaacaaaccatccattcaggcattgatccatggtctgaacaggcactattactccatagcaatcaattatagaaagaatgaacttgaagagaagatgttactgaatctccataagaagaaatggacagatggattgacactccagcgatttgatgcccactccaaaaccaatgaggagacagtccaggaaatgctaaatcttgctatcaaatataataaagcagtccaggaagaggatgagttgccaccagagaagctggccattgcaaatgtgggaaggcaagacgccaagaagcatctcgaagaacatgtgtcaaatttgatgtcatcaaacattgttcagacactgggaactatgctggatacagttgtcttctagaattcttgctaaaaaaactctacacattgttatttgagatggtgaaacagagacaatgttgaccagtttgtccttggtgttattgtaactttgaagtgatttaagagagatttgttgtcatatgctcttatgtttattgtctgttcacaaatctgtacttttgatgcaaatcat

SEQ ID NO: 1833 - DNA, 1248 bp, Actinidia deliciosa
attcttgccgtcaaagaaatcgaatccgatcggtataaaagcactcgctagagagagagagaagcaatgtcggggatggagagattgcagagaatgttcgccggagccggaggagcgttgggccatccgccggtggactctccgacgctcgattcgtcggagcaagtctacatctcctcactcgccctcctcaaaatgctcaagcacgggagggctggggttcctatggaggtgatggggttgatgctgggtgaatttgtggatgagtacaccgttcgcgtggttgatgtgtttgcgatgccacagagtggtactggtgtcagtgttgaagccgttgatcatgttttccagactaacatgctcgatatgctcaaacaaaccggaagaccagagatggtggttggttggtatcattcgcatcctgggtttggctgttggctttctggtgtggacatcaatactcaacagagttttgaagctcttaatcaacgtgccgtggctgttgtggtggatcctatacagagtgttaaagggaaggtggtcattgatgcctttcgtttaattaacccacaaactatgatgcttggccaagaaccaaggcaaacaacttccaatctcgggcatctgaacaagccatccattcaagcattgatccacgggctgaataggcattattactccatagccattaattacaggaagaatgagcttgaggagaaaatgttactgaaccttcacaagaagaaatggactgatggtttgacacttcaacgatttgatgcccattccaaaaccaatgaacagactgttcaggagatgctaaatctagccgttaaatataacaaggcagtgcaggaggaggatgagttgccaccggaaaaactagcaatagcaaatgtgggaaggcaggatgccaagaaacatcttgaagaacacgtgtccaacttgatgtcttcaaacatagttcagactttgggcaccatgcttgacacagttgtgttctagggttcagtttttgactctccacccaatgaaaggatatttcgttcacttttgggcatgttatttaattagatacaacgcgttctttctgtgtcatttcttgtaacattacattcaatcgagtccccttctctattcctattctatcgtccccttctctttctttctgttttactggcagataatttgaagatttgggttccatcaattacttgaactgatagaaatgcgtcatcattttagtag

SEQ ID NO: 1834 - DNA, 1200 bp, Mimulus guttatus
aaacaaaattctacacagcaaaaaagaaaaagaaaaagaaaaggaaattcagtcggggaaaaactagatggccggcatggaaagactacaccgaatgttcgccggagccggcggcgccctcggccacccaccgccagactccccaacactcgattcgtccgaacaagtctacatctcgtccctcgcccttcttaagatgctcaaacacggcagggctggggtgccgatggaagtgatgggtctgatgctgggggagtttgtggacgagtatacagttcgtgtggtggatgttttcgccatgccccagagtggaaccggggttagtgtcgaggccgtggatcacgttttccagactaatatgcttgacatgcttaagcaaactggcagacctgagatggtcgtcggttggtaccattcacatccaggatttggatgctggctttctggtgttgatatcaatactcagcagagttttgaagctttgaatcagagggcggtggcagtggtggtcgatccaatccagagtgtgaaggggaaggttgtaattgatgccttccgtctaattaacccccaaaccatgatgcttggtcaagagccacgacagacaacatccaaccttgggcatctcaacaaaccgtctattcaagctctgatccatggtttgaacaggcattattactccatagcaataaattacaggaagaatgaacttgaggagaagatgcttctgaatcttcacaagaagaaatggacagatggtttgactcttcagcggtttgatacccactcaaagactaatgagcagactgtccaggagatgctaagtctagctgttaaatacaataaagcagttcaggaggaggatgagttgtcgccagaaaaactagcgatcgccaatgtgggaaggcaagacgcgaagaagcatctagaagaacacgtctcgaacttgatgtcttcaaacattgttcagacattgggtacaatgctggacacagttgtcttctagttttttcggggttttttttattgcataaatactgatatgctctctggtttttactttgctctatgttccttaacatttattcgtatgaaatctacggtgatttagcctatttgcatgtaatgaaatcgatatatttgtgcatcttttcttaaatgctcggattgtcaactctccctgcggcgttggtttatgac

SEQ ID NO: 1835 - DNA, 1302 bp, Quercus alba
aatataaaaaacgccgaagccaaagcaaaagcagagtagagagaaagagcatcagagaaatcttgataagaaagaaaactcagaagagagagagagagagaaacacaccctatatgtcaggtatggagagattgcagcgaatgttcgccggcgccggtggtggtttgggccatccgccaccagattcaccgactctcgattcgtcggagcaagtctatatctcttccctcgctctcctcaaaatgctcaaacacgggagagctggggttcccatggaggttatgggattgatgcttggggagtttgtggatgagtacactgttcgtgtcgtcgatgtgtttgcgatgccgcagagtggtactggcgttagtgttgaggctgtcgatcacgtattccagactaacatgctcgatatgcttaaacagactggacgaccagagatggttgttgggtggtaccattcacatcctggatttggatgttggctctctggagtggacataaatacacagcagagttttgaagctttaaatcaacgagctgtggctgtggtggtggatccaattcagagtgtaaaagggaaggtggtgattgatgcctttcgtctgattaaccctcaaaccatgatgcttggtcaagaaccacgacagacaacatccaaccttgggcatcttaataaaccatccatccaagcattgatccatgggttgaatcggcattattattcgatagcaattaactacagaaagaatgagctcgaggagaagatgttgcttaaccttcacaagaagaaatggactgatggcttgacacttaagcgatttgatacccattctaaaactaatgagcaaactgttcaggagatgctaaacttagctatcaaatacaacaaggcagtgcaggaggaagatgagttaccaccagaaaaacttgcaattgcaaatgtgggaaggcaagatgccaagaagcaccttgaagaacatgtctccaacttgatgtcttcaaatataattcaaaccctgggaaccatgcttgatacagttgttttctagagttcatcgtttcaaatcctagccttagatatatctagaggcaattaggaaactattgcatcagatgggtttgttttctgtgaacattttggcaatcagcttataattgctagaaagaccaatgctggtcaagaaagtgatgaatggaagttttagcaccatatgatttctggttttcttgtattcctgtatcagttatacttttgtctaatttgattcttcattcaaatacattggtcgttaatcccaa

SEQ ID NO: 1836 - DNA, 1222 bp, Populus trichocarpa
agtctctgtcttgctcacaaagtaaagctctcgagaataatttgtgtttggctggagagaaatgtcaggtatggagagactgcaaagaatgtttgcaggtgcaggaggtgcgttgggccatccaccaccagattctccaacacttgattcctctgagcaggtctacatctcctctcttgccctcctcaaaatgcttaaacacggcagagctggggtaccgatggaagttatgggtttgatgcttggagagtttgtggatgaatatacagttcgcgttgttgatgtattcgccatgccacaaagtggtactggtgtgagtgttgaagctgttgatcatgtgtttcagactaatatgattgacatgcttaaacagactggaaggccggagatggttgtggggtggtaccattcacatcctggatttggctgttggctttccggtgttgatataaatacccagcagagttttgaagctctgaatcaacgtgctgtggcagtggtcgtggatccaatccagagtgttaaaggaaaggtggtaattgatgccttccgtttgattaacccacaaacaatgatgcttggccaagaaccacggcagacaacttccaatcttgggcatctgaataagccatccattcaagcattgatccatggattgaatagacattattactcaatagccattaattacagaaagaatgaacttgaggaaaagatgcttcttaatcttcacaagaagaaatggacagacggtttgacacttaagcggtttgatactcattcaaaaaccaatgagcagactgttcaggaaatgctgaacttagctattaaatacaacaaggctgtgcaagaggaagatgagctgccacctgaaaagctggcaattgcgaacgtgggaaggcaagatgcgaagaaacaccttgaagaacatgtctcaaacttaatgtcttccaacatagttcagacattgggtactatgctcgacacggttgtgttctagatctggcctttcatttctcattctgtattctctgtttcaagtcgaacaatcttggttcatagtgtaccttttggttttttgccatttcgttttttgttatgctgtactggttgagttgtcattgtggatttatggaaggcagttcaatcacttgatacacttgtgctattgtctgcttcatgatgttagatcgcggggtgttccttctgggcccctgtttgc

SEQ ID NO: 1837 - DNA, 1219 bp, Fragaria vesca
agaaaagaaagcacttgtatttagaacccaaaccagcaaagaaaggtgcttctgaatgtcagggatggagagactacagaggatgttcgccggcgccggaggagctctgggtcacccacccccggattcgcccactctcgattcctcagaacaggtctacatctcctcgctcgcgctgttgaagatgctaaagcacggaagagcgggggtgcctatggaggtcatgggcttgatgctgggagagtttactgatgagtatactgttaaggttgtggatgtgtttgctatgccgcagagtggtactggtgttagtgtcgaagcagtcgatcacgtgttccagactaacatgctcgatatgctcaagcagaccggaaggccggagatggttgtagggtggtaccattcgcatcctggattcggctgttggctatctggtgtggacattaatacacagcagagcttcgaagctttgaatcaacgtgctgtggctgtggtggtggatcccattcagagtgtgaaggggaaggtggtcattgatgccttccgccttatcaacccacagactatgatgcttggtcaagaacctcggcagaccacatccaatcttggccatcttaataaaccatctattcaagctttgatccatggtttaaaccggcattattactctatagcaatcaattacaggaagaatgaactcgaggagaagatgttgcttaaccttcacaagaagaaatggactgatgggctgaccctaaaacgttttgatactcattcaaaaacaaatgagcaaactgttcaggagatgttgagcctagctgtcaagtacaacaaggccgtgcaggaggaggatgagttgtctccagagaagcttgctattgcaaatgtgggaagacaagatgccaagaagcacctagaagaacatgtctccaacttaatgtcctcaaacatagtccagaccttgggaaccatgctcgatactgttgtgttctagacttcagcatgcaagtgtgcacaactgattttcagtactgaacatgtaagtctggtttaagacaaacttaaaatgtatgcacgagagtttctgtttcctgactttcattcccagttaacaagttttaccatgtttttattatttactgtatgaaattgattgcattgcttcactatcatcatcaactatcaaagaataacagatttttacagcaatgcgaaacac

SEQ ID NO: 1838 - DNA, 1200 bp, Nicotiana tabacum
  misc_feature (87)..(87): n is a, c, g, or t
  misc_feature (283)..(283): n is a, c, g, or t
  misc_feature (307)..(307): n is a, c, g, or t
  misc_feature (328)..(328): n is a, c, g, or t
  misc_feature (829)..(829): n is a, c, g, or t
ggccattacggccggggagatcaaagaaattaccgtcggagtagtcttgttctcaaagaaatccccaaaagcaaaacccagaaaacnatcaatgtctggaatggaaagattgcagcggatgttcgccggagctggtggcgcgttaggccacccgccaccggactctcccactctggactcttctgagcaagtttacatctcttctcttgctctcctcaagatgcttaaacacgggagggctggagttcctatggaagtgatgggattgatgttaggggaattngtggatgagtatacggtgcgcgtngtggatgtgtttgcaatgccncagagtggtactggagtgagtgttgaagctgttgatcatgttttccagaccaatatgcttgacatgctcaagcagactggcagacctgagatggttgttggttggtatcattcacatcctggatttggctgctggctttctggtgttgacatcaatactcagcagagttttgaagcactgaatcaacgagcagtggctgtggtggtggaccctattcaaagtgttaaagggaaggtggtaattgatgcctttcgcttgatcaatccccaaactatgatgcttggccaagagccacgtcagacaacatcaaatctgggacatttgaacaaaccatctatccaagcattgatccatggtttgaacagacactactactcaatagccataaactacagaaagaatgaacttgaagagaagatgctactgaatcttcacaagaagaaatggacagatggactcacactccagcgttttgatgctcattccaaaaccaatgagcanacagttcaggagatgttaaaccttgctgtcaagtataataaagcagtgcaggaggaggatgagttgcctccagaaaagctagccattgcaaatgtaggaaggcaagatgccaagaagcatcttgaagagcacgtctcgaatttgatgtcttcaaacattgtccagacattgggaaccatgcttgacacagttgtcttctgatcttcgtttctcgaaagtctgcaaaaattgtgtttgaagtcgtgaaagaggaacatgttttttgcaattttgttttttttttgaatgtgaccagtaccttcattataactctgtgatagcagctgttattcgatatgtttatgtcatcttaagatgacttctggcttgtc

SEQ ID NO: 1839 - DNA, 1143 bp, Brassica juncea
ataagatccaaaagcagctcagagggagacgacggaactgatttcagctgagattatggagagattacagcgaatcttcggcgccggtggcggtttgggtcacgcatcgcctgattctccgactctcgatacgtcggagcaagtttacatctcttctctcgccctcctcaagatgctcaagcacggaagagctggagttcctatggaagtaatgggattgatgcttggagagttcgtggatgagtacactgttcgcgtagtggatgtttttgctatgcctcagagtggtactggtgttagcgttgaagctgttgatcatgttttccagactaatatgctcgacatgcttaaacaaactgggagacctgaaatggtggttggttggtatcattcacatcctgggtttggatgctggctttctggtgttgatattaacactcaacagagttttgaagctttgaaccagcgagctgtggcagtggtggttgatcccattcaaagtgtgaaggggaaagttgtgattgatgcgttccgctccataaacccgcagaccattatgcttgggcaagagcctcgtcaaacaacgtctaaccttgggcatctgaacaaaccatcgatccaggctttgattcatggattgaacagacactactactcaatagccatcaactataggaagaacgagctcgaggagaagatgttgctaaacctccacaagaagaaatggacagatggtctgacgctaagacgctttgacacccactccaagacaaacgaacagactgtgcaagaaatgttgagcttggctgctaaatataacaaggcggtacaagaggaagacgagttgtcaccggagaaactggcgatcgtgaatgtgggaaggcaagacgcaaagaagcatctggaagaacatgtttccaacttgatgtcatccaacattgttcagacactaggaaccatgcttgacactgttgtcttctagagaacttcttcactttaccagccaggagtactctgcttcagccagtttggctggaaagttgagcttcgttcttctgcatctcttttattttctgttgaatcaactcttttatgtattttgtatgtgacttcgttcttttcattaaggctatggattgattt

SEQ ID NO: 1840 - DNA, 1229 bp, Brassica juncea
tccgtctctgtcttgttaacaaagaaaactctctcaagcttttctataagatctctccttcttgtacccccagaagaagaccactgatttgttctaaccatggagagactacagcgaatattcggcgccggtggcggtctaggccacgcctctccagattctccgactctcgatacctcggagcaagtttacatctcctctctcgccctcctcaagatgctcaaacacggtagagctggagttcccatggaggtaatgggattgatgctcggggagttcgtggatgagtatactgtacgagttgtggatgttttcgcgatgcctcagagtgggactggtgttagtgttgaagctgttgatcatgttttccagactaatatgctcgacatgcttaaacagaccggaagacctgaaatggtggtgggttggtatcattcacatcctgggtttggatgctggctttctggtgttgatattaatactcagcagagttttgaagctttgaaccagcgagctgtggctgtggtggttgatcccattcaaagtgtgaaggggaaagtagtgattgatgcgttccgctcgataaacccgcagaccattatgcttgggcaagaacctcgtcaaacaacgtcgaaccttgggcatctgaacaaaccatcgatccaggctttgattcatggattgaacagacactactactcaatagccatcaactataggaagaacgagctcgaggagaagatgttacttaacctccacaagaagaaatggaccgatggtctgacgctaagacgctttgacactcactccaagacaaacgaacagactgtgcaggaaatgttgagcctggctgccaaatataacaaggcggtacaagaggaggacgagttgtcaccagagaaactggcgatagtgaatgtgggaagacaagatgcaaagaagcatctggaagaacatgtttccaacttgatgtcatccaacattgttcagacactaggcaccatgcttgacactgttgtcttctagagaggagcttcttcactttcccaaccagcttttatcttctgcttctctttgttttctgttgaattttctctttatgtcccatctcctagcacttgataaggttgtattgtactatctggtttcgttctttccatgaatgccatggatagattactatttcattcaaaactgaatagtggtacttcaaatttcagaatgtttca

SEQ ID NO: 1841 - DNA, 1258 bp, Arabidopsis lyrata
cgtcttgtcttgttaacaaagaaaactgcgaaggttttttaataagatcccattgttgtagcaaacccagaagaagaaactctcgaagaagacgactaattgattcatctgattatggagagactacagcgaatcttcggagctggtggcggtttgggccacgcatcgcctgattctccgactctcgatacatcggagcaggtctacatctcttctctcgctctcctcaagatgctcaagcacggaagagctggtgttcctatggaagtcatgggattgatgcttggagagttcgtggatgagtacactgttagagttgtggatgtttttgcgatgcctcagagtggtactggtgttagtgttgaagctgttgatcatgttttccagactaatatgctcgacatgcttaagcagactggaagacctgaaatggttgttggttggtatcattcacatcctggatttggctgctggctttctggggttgacattaatacccaacagagttttgaagctttgaaccagcgagctgtagcagtggtggtagatccgattcagagtgtgaagggaaaggtggtgattgatgcgttccgctccattaatccacagaccattatgcttgggcaggaaccccgtcaaaccacatcgaaccttgggcacctaaacaaaccatcgatccaggccttgattcatgggttgaacagacactattactcaatagcgatcaactacaggaagaacgagcttgaggagaagatgttactgaacctccacaagaagaaatggacagatggtctgacgctaagaccctttgacacccactccaagacaaatgaacagacggtccaggagatgttgagcttggctgctaaatataacaaggcggttcaagaggaggacgagttgtcaccagagaagctggcaattgtgaatgtgggaagacaagacgcaaagaagcatctggaagaacatgtttccaacctcatgtcatccaacattgttcagacactaggcactatgctcgacactgttgtcttctagagagcttacttctccagcgcttcaaatcattgagctttgttcttctgcatctccttggtttctttctactgaatgttctctttttatctcttatcaactaggcattttacaaggttgtattgtactatgtgatttcgttcgtttaaggccagggattgatttatatttctttgcattatattttcctcccatttttagattttatgctgcaactttc

SEQ ID NO: 1842 - DNA, 1308 bp, Arabidopsis thaliana
gatccatcttcgtctgtcttgttaacaaagaaaactgagaaaggttttcttataagatcccattcttgtagcaaaaacccagaagaacaaactttcgaagaagacgactaatcaattcatctgattatggagagactacagagaatcttcggagctggtggcggtttaggtcacgcatcgcctgattctccgactctcgatacatcggagcaggtttacatctcttctctcgctctcctcaagatgcttaagcacggaagagctggtgttcctatggaagtcatgggattgatgcttggagagtttgtggatgagtacactgttagggttgtggatgtttttgcgatgcctcagagtggtactggtgttagtgttgaagctgttgatcatgttttccagactaatatgctcgacatgcttaaacagaccggaagacctgagatggtggttggttggtatcattcacatcctggattcggctgctggctttctggggttgacattaatactcaacagagttttgaagctttgaatcagcgagctgtagcagtggtggtagatccgattcagagtgtgaaaggaaaggtggtgattgatgcgttccgctccataaatccacagaccattatgcttgggcaggaaccccgtcaaacaacatcgaaccttgggcacttgaacaaaccatcgatccaggctttgattcacgggttgaacagacactattactcaatagcaatcaactataggaagaacgagcttgaggagaagatgttactcaacctccacaagaagaaatggacagatggtctgacgctaagacgctttgacacccactccaagaccaacgaacagacggtccaggagatgttgagcttggctgctaaatataacaaggcggttcaagaggaggacgagttgtcaccagagaagctggcaattgtgaatgtgggaagacaagatgcaaagaagcatctggaagaacatgtctcgaacctcatgtcatccaacattgttcagacactaggcactatgctcgacactgttgtcttctagagagcttacttctccagccgcttcaagtcattgagctttgttcttctgcatctctttggcttctactgaatgttctctttttatctgctagctttttacaaggttgtactgtactatgtgatttcgttcgttaagggcagggatcgatttctatttctttgcatattattttcagattttattttcctcccatttttagattttatgctgcaactttcaagttaagtgcttttgataagaatatgcaatttccct

SEQ ID NO: 1843 - DNA, 1168 bp, Brassica oleracea
  misc_feature (437)..(437): n is a, c, g, or t
  misc_feature (671)..(671): n is a, c, g, or t
  misc_feature (689)..(689): n is a, c, g, or t
  misc_feature (935)..(935): n is a, c, g, or t
  misc_feature (1017)..(1017): n is a, c, g, or t
  misc_feature (1041)..(1041): n is a, c, g, or t
  misc_feature (1082)..(1082): n is a, c, g, or t
  misc_feature (1095)..(1095): n is a, c, g, or t
tccgcggacgcgttcggatctctcattctttgtacccaggcgaagaagacgacgattgattcaatctgattatggagagactacagcgaatcttcggcgccggcggcgggttaggccacgcatctccagattctcccactctcgatacctcggagcaggtttacatctcctctctggccctcctcaagatgctcaaacacggtagagctggagttccgatggaggttatggggctgatgctcggagagttcgtggatgagtacactgtgagggttgtggatgtattcgcgatgcctcagagtgggactggtgttagtgttgaagctgttgatcatgttttccagactaatatgcttgacatgcttaaacagactgggagacctgaaatggtggtgggttggtatcattcgcatcctgggtttggctgctggctttcnggtgttgacattaatactcaacagagttttgaagctttgaaccaacgagctgtagctgtggtggttgatcctattcagagtgtaaagggtaaagtggtgattgatgccttccgctcgattaaccctcagaccattatgcttgggcaagagcctcgccaaacaacgtccaaccttggtcacctgaacaaaccatcgatccaggccttgattcatggattgaacagacactattantcaatagccatcaactanaggaagaacgagctcgaggagaagatgttactaaacctccacaagaagaaatggacagatggcctgacgctaagacgctttgacactcactccaagacaaacgaacagaccgttcaggaaatgttgagcttggctgctaaatataacaaggcggtacaagaagaggacgagttgtcaccagagaaactggcgatcgtgaatgtgggaagacaagacgcaaagaagcatctggaagaacatgtttcnaacttgatgtcttccaacattgttcagacactaggcaccatgcttgacactgttgtcttctagagaacttcacttttccagncagctttgttcttctgcatctctntgttttctttctgttgaatcttctctttatgtcctatctcntagcacttgatanggttgtattgtactatctggtttccttctttccatgaaggctatggattgattttacttcattcaaaactaag

SEQ ID NO: 1844 - DNA, 1586 bp, Brassica rapa
aacaaagaaaactctctctctctctctctctctctcgagcttttctataagatcccagacgaagaagagacgattgatttgttctaaccatggagagactacagcgaatattcggcgccggtggcggtctaggccacgcctctccagattctccgactctcgatacctcggagcaagtttacatctcctctctcgccctcctcaagatgctcaaacacggtagagctggagttccgatggaggttatgggattgatgctcggagagttcgtggatgagtacactgtgagagttgtggatgtattcgcgatgcctcagagtgggactggtgttagtgttgaagctgttgatcatgttttccagactaatatgcttgacatgcttaaacagactggcagacctgaaatggtggtgggttggtatcattcgcatcctgggtttggctgctggctttccggtgttgatattaacactcaacagagttttgaagctttgaaccagcgagctgtagctgtggtggttgatcctattcagagtgtgaagggcaaagtggtgattgatgccttccgctcgattaaccctcagaccattatgcttgggcaagagcctcgtcaaacaacgtccaaccttgggcacctgaacaaaccgtcgatccaggcattgattcatggattgaacagacactattactcaatagccatcaactacaggaagaatgagctcgaggagaagatgttactaaacctccacaagaagaaatggacagatggtctgacactaagacgctttgacactcactccaagacaaacgaacagacggtgcaggaaatgttgagcttggctgctaaatataacaaggcggtacaagaagaggacgagttgtcaccagagaaactggctatcgtgaatgtgggaagacaagacgcaaagaagcatctggaagaacatgtttccaacttgatgtcttccaacattgttcagacactaggcaccatgcttgatactgttgtcttctagagagcttcttcactcgcttgccagtagtactctgtttcaatcagttgagctttgttcttcttctgcgtctctgtgttttctgttgaatcttctctttatgttttatctcctagcacttgataaggttgtattgtactatctgacttcgttcttttcattaaggccatgggttaatttatatttctttcagaactaaatatgctgaaatttcagaatgttagagcaaataggaatcaaaacgtctaaaatattaatatcttgctggttagtatacaaaattgtgccaaaggatttgtgaagacgggagcttcatgttaagaagcaaacagaaactaaagcgtgctccaaaggcaagccacagggcatggactattagcggtcttcgggcatcaaacaagtccggctttgaatatagaccagtcactcaaacagagcacagtggttttggaatctttgaatagagggctggttaaaacccggtgtcgaaacaagtcatgaagacctttgagaccatggttcttgcaaaagggatgtagctcaagctataccaaataagaccagagaactcaa

SEQ ID NO: 1845 - DNA, 1778 bp, Brassica rapa
gtcttgtcttgttaataaagaaaagactctcgaggaggttttataagatccaacaaagcagctcagagaggaagaagacgactgattttagctgagattatggagagattacaacgaatcttcggcgccggtggcggtttgggtcacgcatcgcctgattctccgactctcgatacgtcggagcaagtttacatatcctctctcgccctcctcaagatgctcaagcacggaagagctggagttcctatggaagtgatgggattgatgcttggagagttcgtggatgagtacactgttagggttgtggatgtttttgcgatgcctcagagtggtactggtgttagcgttgaagctgttgatcatgttttccagactaatatgctcgacatgcttaaacaaactgggagacctgaaatggtggttggttggtatcattcacatcctgggtttggatgctggctttctggtgttgatattaatactcagcagagttttgaagctttgaaccagcgagctgtggcagtggtggttgatcccattcaaagtgtgaaggggaaagttgtgattgatgcgttccgctccataaacccgcagaccattatgcttgggcaagagcctcgtcaaacaacgtctaaccttgggcatctgaacaaaccatcgatccaggctttgattcatggattgaacagacactactactcaatagccatcaactataggaagaacgagctcgaggagaagatgttgctaaacctccacaagaagaaatggacagatggtctgacgctaagacgctttgacacccactccaagacaaacgaacagactgtgcaagaaatgttgagcttggctgctaaatataacaaggcggtacaagaggaagacgagttgtcaccggagaaactggcgatcgtgaatgtgggaaggcaagacgcaaagaagcatctggaagaacacgtttcgaacttgatgtcatccaacattgttcagacactaggaaccatgcttgacactgttgtcttctagagaacttcttcactttaccagccaggagtactctgcttcagccagtttggctggaaagttgagcttcgttcttctgcatctcttttattttctgttgaatcaactcttttatgtattttgtatgtgacttcgttcttttcattaaggctatggattgatttccattcttgcagttattcaaaaaaatttctcattattagaatttaaaagctgcaactttcgagtgtgtgcacttgagctgcagttactcgtaactgaggtggttaatatacttccaacttcgaggaaactcaaaaaaaaggaaccacacccaaatctacgttatattccacatcaaaacatacaaaaaactgtgctacgaattgtgaagacatcatgttaagaagcaagtataaaccaaaacgagatccaaagataagccatagaacattgacaataagagcttttagcgttcttcttcgtgcatcaaacaagtccagctttgaacattgactagtcattaaaacagagcacagtggtttcttgggaccaaaattctctgtgtatatagggctgcttaaaactcggtgtcaaaacaagtcatgaacacctttgagaccatggtcctcgcaaaagggatgtagctcaagctatacctgcagtacaagatgaatgacactttttgtgacaaactcagaaaaccatacaagtagtcttcggttcaccaatgcattcttagctcgagctaatatatgtttcgaaagagtaaatta

SEQ ID NO: 1846 - DNA, 1043 bp, Ocimum basilicum
aagacttcaccggatgtttgccggcgcaggcggcgccctcggccacccgccgccggactctccgaccctcgactcctccgaacaagtctatatctcgtctctcgccctccttaaaatgctcaaacacggcagggctggagtgccgatggaggtcatggggctgatgctgggggagtttgtggacgagtacacggtgcgtgtggtggacgtttttgcgatgcctcagagtggaaccggtgtcagtgtagaggcggtcgatcacgttttccagactaatatgcttgacatgcttaagcaaactggcagacctgagatggttgttggttggtaccattcacatcctggctttggatgttggctttctggagttgacatcaacactcaacagagttttgaagctttaaatcagagggcagtagctgtggtggtagatccaattcagagtgttaaaggaaaggtggtaattgatgccttccgcctcatcaacccccaaaccatgatgctgggtcaagaaccacgccaaactacttcgaatgtaggccaccttaataaaccatctattcaggctttgattcatgggttgaacaggcattattactccatagccattaattaccggaagaacgagcttgaggagaagatgctcctgaatcttcacaaaaagaaatggacagatggattgaccctccagcggtttgacacccactccaaaacaaatgagcagacagtccaggagatgctaaatctagccatcaagtataataaagctgttcaagaggaggatgagttgccacccgaaaaactggctattgctaacgtgggaaagcaagatgcaaagaagcatctcgaagagcatgtctcaaacttgatgtcgtcaaacattgttcagacattggggactatgctggacacggttgttttctagattttggagttgagagaagatgcgaaatatttcattttaacagaatgtatgtggcttcctccttagactttatatagactccgatgttcatcaaagatctcttaaatagtttcccttt

SEQ ID NO: 1847 - DNA, 1125 bp, Brassica napus
gagcttttctataagatcccagacgaagaagagacgattgatttgttctaaccatggagagactacagcgaatattcggcgccggtggcggtctaggccacgcatctccagattctcccactctcgacacctcggagcaggtttacatctcctctctcgccctcctcaagatgctcaaacacggaagagctggagttccgatggaggtgatggggttgatgctcggagagttcgtggatgagtacactgtgagagttgtggatgtattcgcgatgcctcagagtgggactggtgttagtgttgaagctgttgatcatgttttccagactaatatgcttgacatgcttaaacagactggcagacctgaaatggtggtgggttggtatcattcgcatcctgggtttggctgctggctttccggtgttgatattaatactcaacagagttttgaagctttgaaccagcgagctgtagcagtggtggttgatccgattcagagtgtgaagggtaaagtggtgattgatgccttccgctcgattaaccctcagaccattatgcttgggcaagagcctcgtcaaacaacgtccaaccttgggcacctgaacaaaccgtcgatccaggcattgattcatggattgaacagacactattactcaatagccatcaactacaggaagaatgagctcgaggagaagatgttactaaacctccacaagaagaaatggacagatggtctgacactaagacgctttgacactcactccaagacaaacgaacagacggtgcaggaaatgttgagcttggctgctaaatataacaaggcggtacaagaagaggacgagttgtcaccagagaaactggctatcgtgaatgtgggaagacaagacgcaaagaagcatctggaagaacatgtttccaacttgatgtcttccaacattgttcagacactaggcaccatgcttgacactgttgtcttctagagagcttcttcacttttgcagccagctttgttcttcttcatctctttgttttctgttgaatcttctctttatgtcctctcctagcacttgataaggttgtattgtactatctggtttcgttctttccatgaaagctatggattga

SEQ ID NO: 1848 - DNA, 1147 bp, Brassica napus
tttctataaagatctctcattctttgtacccaggcgaagaagacgacgatcgattcaatctgattatggagagactacagcgaatcttcggcgccggcggcgggttaggccacgcatctccagattctccgactctcgacacctcggagcaggtttacatctcctctctggccctcctcaagatgctcaaacacggtagagctggagttccgatggaggttatggggctgatgctcggagagttcgtggatgagtacactgtgagggttgtggatgtattcgcgatgcctcagagtgggactggtgttagtgttgaagctgttgatcatgttttccagactaatatgcttgacatgcttaaacagactgggagacctgaaatggtggtgggttggtatcattcgcatcctgggtttggctgctggctttctggtgttgatattaacactcaacagagttttgaagctttgaaccagcgagctgtagctgtggtggttgatccgattcagagtgtgaagggcaaagtggtgattgatgccttccgctctattaacccgcagaccattatgcttgggcaagagcctcgtcaaacaacgtccaaccttggacacttgaacaaaccgtcgatccaggccttgattcatggattgaacagacactattactcaatagccatcaactacaggaagaacgagctcgaggagaagatgttactaaacctccacaagaagaaatggacagatggcctgacgctaagacgctttgacactcactccaagacaaacgaacagaccgttcaggaaatgttgagcttggctgctaaatataacaaggcggtacaagaagaggacgagttgtcaccagagaaactggcgatcgtgaatgtgggaagacaagacgcaaagaagcatctggaagaacatgtttccaacttgatgtcttccaacatcgttcagacactaggcaccatgcttgacactgttgtcttctagagaacttcacttttccagtcagctttgttcttctgcatctctctgttttctttctgttgaatcttctctttaagtcctatctcctagcacttgataaggttgtattgtactatctggtttcgttctttccatgaaggctatggattgatttctac

SEQ ID NO: 1849 - DNA, 1188 bp, Brassica napus
gggaggttttataagatccaaaccagctcgactgatttgagctgagattatggagaggttacagcgaatcttcggcgccggtggcggtctgggtcacgcatcgcctgattctccgactctcgatacgtcggagcaagtttacatctcttctctcgccctcctcaagatgctcaagcacggaagagctggagttcctatggaagtgatgggattgatgcttggagagttcgtggatgagtacactgtacgtgttgtggatgttttcgctatgcctcagagtggtactggtgttagcgttgaagctgttgatcatgtcttccagactaatatgctcgacatgcttaaacagacgggaagacctgaaatggtggttggttggtatcattcacatcctgggtttggatgctggctttctggtgttgatattaatactcagcagagttttgaagctttgaaccagcgagctgtggcagtggttgttgatccaattcaaagtgtgaaggggaaagtggtgattgatgcgttccgctcgattaacccgcagaccattatgcttgggcaagagcctcgtcaaacaacgtctaacctcgggcatctgaacaaaccatcgatccaggctttgattcatggattgaacagacattactactcaatagccatcaactataggaagaacgagctcgaggagaagatgttgctaaacctccataaaaagaaatggacagatggtctgacgctaagacgatttgacacccactccaagacaaacgaacagacggtccaggaaatgttgagcttggctgccaagtataacaaggcggtacaagaggaagacgagttgtcaccggagaaactggcgatcgtgaatgtgggaagacaagacgcaaagaagcatctggaagaacacgtttccaacttgatgtcatccaacattgttcagacactaggcaccatgcttgacactgttgtcttctagagaacttctttgctttaccagccaggagtactctgcttcagtcagtttggctggaaagttgagcttccttctgcatatctttgatttctgttggatcaactcttttatatctcatctcctagcaagcatctgataagattgtattgtactatgtggtttcgttcttttcattaaggccatggattgatttctataaattcttgcatttattc

SEQ ID NO: 1850 - DNA, 1095 bp, Brassica napus
attatggagagattacaacgaatcttcggcgccggtggcggtttgggtcacgcatcgcctgattctccgactctcgatacgtcggagcaagtttacatatcctctctcgccctcctcaagatgctcaagcacggaagagctggagttcctatggaagtgatgggattgatgcttggagagttcgtggatgagtacactgttagggttgtggatgtttttgcgatgcctcagagtggtactggtgttagcgttgaagctgttgatcatgttttccagactaatatgctcgacatgcttaaacagactgggagacctgaaatggtggttggttggtatcattcacatcctggatttggatgctggctttctggtgttgatattaatactcaacagagttttgaagctttgaaccagcgagctgtggcagtggtggttgatcccattcaaagtgtgaaggggaaagttgtgattgatgcgttccgctccataaacccgcagaccattatgcttgggcaagagcctcgtcaaacaacgtctaaccttgggcatctgaacaaaccatcgatccaggctttgattcatggattgaacagacactactactcaatagccatcaactataggaagaacgagctcgaggagaagatgttgctaaacctccacaagaagaaatggacagatggtctgacgctaagacgctttgacacccactccaagacaaacgaacagactgtgcaagaaatgttgagcttggctgctaaatataacaaggcggtacaagaggaagacgagttgtcaccggagaaactggcgatcgtgaatgtgggaaggcaagacgcaaagaagcatctggaagaacacgtttcgaacttgatgtcatccaacattgttcagacactaggaaccatgcttgacactgttgtcttctagagaacttcttcactttaccagccaggagtactctgcttcagccagtttggctggaaagttgagcttcgttcttctgcatctcttttattttctgttgaatcaactcttttatgtattttgtatgtgacttcgttcttttcattaaggctatggattgatttccaa

SEQ ID NO: 1851 - DNA, 984 bp, Brassica napus
ctataagatcccagacgaagaagagacgattgatttgttctaaccatggagagattacagcgaatcttcggcgccggtggcggtctaggccacgcatctccagattctcccactctcgatacctcggagcaggtttacatctcctctctcgccctcctcaagatgctcaaacacggtagagctggagttccgatggaggtgatggggttgatgctcggagagttcgtggatgagtacactgtgagggttgtggatgtattcgcgatgcctcagagtgggactggtgttagtgttgaagctgttgatcatgttttccagactaatatgcttgacatgcttaaacagactgggagacctgaaatggtggtgggttggtatcattcgcatcctgggtttggctgctggctttccggtgttgatattaacactcaacagagttttgaagctttgaaccagcgagctgtagctgtggtggttgatcctattcagagtgtgaagggtaaagtggtgattgatgccttccgctcgattaacccgcagaccattatgcttgggcaagagcctcgtcaaacaacgtccaaccttggacacttgaacaaaccatcgatccaggcattgattcatggattgaacagacactattactcaatagccatcaactacaggaagaacgagctcgaggagaagatgttactaaacctccacaagaagaaatggacagatggcctgacgctaagacgctttgacactcactccaagacaaacgaacagaccgttcaggaaatgttgagcttggctgctaaatataacaaggcggtacaagaagaggacgagttgtcaccagagaaactggctatcgtgaatgtgggaagacaagacgcaaagaagcatctggaagaacatgtttccaacttgatgtcttccaacattgttcagacactaggcaccatgcttgatactgttgtcttctagagagcttcttca

SEQ ID NO: 1852 - DNA, 1158 bp, Catharanthus roseus
tataacaggaatggagagattacagcggatgttcgccggcgccggtggagccttgggccacgccccaccggactctcccacactcgattcttcggagcaggtttatatctcctccttggcccttctgaagatgctcaaacacggaagagctggggtgccaatggaagtcatggggctgatgcttggggattttgtggatgagtacacggttcgtgtggtggatgtatttgctatgccgcaaagtggtacaggtgtcagtgtcgaagcggtggatcacgtctttcaaacaaatatgcttgatatgcttaagcaaactggcaggccggaaatggtggtgggctggtatcattctcatcctggatttggatgttggctttctggggttgatatcaatactcaacagagttttgaagctctaaaccaaagagctgtggctgttgtggtggatcccattcaaagtgttaaaggaaaggtggtaattgatgccttccgtttgattaatcctcagactatgatgcttggtcaagagccacgacaaacaacatccaaccttgggcatcttaataaaccatcaatccaggctctgatccacggtttgaatagacattattactcaattgccataaactatagaaagaacgaactcgaggagaaaatgttattgaatcttcacaagaaaaaatggacagatggattgacactccagcgatttgatacccattctaaaaccaatgagcagacagttcaggagatgctaaacttagctatcaaatacaataaagcggtacaggaggaggatgagttgccaccggagaagttggcgattgcaaatgtcgggaggcaagacgccaagaagcatctagaagagcacgtttctaacctcatgtcatcaaatattattcagaccctgggaacaatgctcgacaccgttgttttctgaagagttttttttttcccctctcttctgagatttgagaaccctaccacggttatcagaattttttttttaatgagttatgcaagtaatgaaatgttttgggttgtatcctaatggaccataagatttttattaggtcacatcaatcattcctagttgttcttgttcttgtgttcatcagaaatagaaacataatcaattatacggtgataaaaattctc

SEQ ID NO: 1853 - DNA, 1149 bp, Cephalotaxus harringtonia
ggcttctcaggttttacagtcaggttcctgcaaactttagttcttcctcaaaagaggtaggttctggaagacaatggagagattacagaggattttttcaggggcaggtggcatgggaccgcctgctacagatggccccatgcttgactcgtcagagcaggtctacatttcatcacttgccttgctcaaaatgctcaagcacggtagagctggagtgccaatggaggtaatgggactgatgcttggcgagtttgttgacgagtacactgttcgagttgtcgatgtctttgccatgccccagagcggtactggagtcagtgtagaagcagttgatcacgtttttcagacaaacatgcttgacatgctcaaacaaactggcagaccagagatggttgtcggatggtaccactctcatcctggttttggatgctggctttcaggtgttgatatcaatacacaacagagttttgaggcgctcaatcaacgggcagttgctgtggtggtggatcctattcaaagtgttaaggggaaggttgtgattgatgcattccgcttaataaatcctcaaactatgatgcttggccaggagcctcgacaaacgacttctaatttagggcatctcaataaaccatccatccaggcattgatccatggtttgaatcgacattattactctattgctatcaattatcggaaaaatgagcttgaagaaaagatgctgctcaacttacacaaaaagaaatggacggatggtcttaccctgcaacgctttgattgtcatgctaaaacaaatgaacaaacagttcaggaaatgcttgaccttgcagtcaagtataacaaagctgtacaagaagaggaccagctacctcctgaaaaacttgctattgcaaatgttggcagacaagatgccaaaaagcatctagaagagcatgttgcaaatttgatgtcttcgaacatagttcaaaccctaggcaccatgcttgatacagttgttttttaacttttggaagttacaaaatcaaatgaacatctttttgtttcattttgtgcatacaaaagaagaaaaagatgcctctaagatggtgacttattttttgagctattggattgttttatgttgaaactatattatcaaaggaatcaggaaac

SEQ ID NO: 1854 - DNA, 1141 bp, Chelidonium majus
gattttagccggagcaggagggatgggtcatccacctccagattcaccgttgttggattcttcagagcaagtgtatatctcttcgcttgccctacttaagatgctgaaacacggaagagctggggttccaatggaagttatgggtttaatgcttggagactttgtggacgagtatactgtccgtgtcgtcgatgtcttcgctatgccccagagcggtacaggtgttagtgtagaggcagttgatcatgttttccagactaacatgcttgatatgctcaagcagactggcagaccagagatggtggtaggatggtaccattcacatcctggatttggctgttggctttctggtgttgatattaatacgcaacagagttttgaagctttgaatcaaagagctgttgcagtggttgtggacccaatccagagtgttaagggaaaggtggttattgatgctttccgtttgatcaatcctcaaaccatgatgcttggccaggagccaaggcagacgacttccaaccttggtcatctcaacaaaccatccattcaagcgttgatccatgggttgaacagacattattactcgatagccattaattacaggaagaatgagcttgaggagaaaatgcttctaaatctacacaagaagaaatggactgatggcttgactcttcagagatttgacacccattcgaaaaccaacgagcagactgttcaggagatgctagggctggccataaaatataataaagctgttcaggaggaggatgagttgtcgccggagaagcttgcaattgcgaatgtgggcaggcaagatgccaaaaagcacctagaagagcatgtctctaacttgatgtcgtctaacatagttcagaccttgggaaccatgctagacacagtcgtattctaagtttcatccatttgactgaaggttgacactcctcctggacttcccataatttactcctttgtactagtggaacctaaaattgaaagaagtgatgtgagacacttttaaccttctggaggtattttattgggttcacacatacccttgtcctttgtttgaacttttcatgcaattagaacgaatcaatatcagaatacaattagtaaacagttttttagtgctggatcatat

SEQ ID NO: 1855 - DNA, 1168 bp, Eucalyptus grandis
aacggtttgatcccgaacttggatgtccggtggtatggagaggcttcagagaatgttcgccggcgccggaggtggtctgggccacccgccccccgactccccgaccctcgattcatccgagcaggtctacatctcctccctcgccctcctcaagatgctcaagcacgggagggctggggttcccatggaagtgatggggttgatgcttggggagtttgtggacgagtacaccgtccgagtcgtcgatgtgtttgctatgccgcagagtggtaccggtgtcagtgtcgaggcggtcgatcatgtgttccagaccaatatgcttgacatgctcaaacagactggaagaccagagatggtggtaggttggtaccactctcatcctggctttggctgttggctttctggtgtggacatcaacactcagcagagttttgaggctttaaatcagcgtgcggttgcagtagtggtggatcccatccagagtgtcaaagggaaggttgtgattgatgccttccgtttgatcaacccacaaaccatgatgcttggccaagaacccaggcagacaacctccaaccttggacatctcaacaaaccgtccatccaggcattgatccatgggctgaacagacactattactcaattgccatcaattacagaaagaatgaacttgaggaaaaaatgctacttaatcttcacaagaagaaatggacagatggcttgacgcttcgtcattttgacacattctaaaaccaatgaacagactattcaggagatgctgaatttggcaatcaagtataacaaggcggtgcaggaggaggacgaattaccaccagagaagctagcgatcgcgaatgtgggaaggcaagatgccaagaagcacctcgaggagcacgtctccaaccttatgtcttccaacatagttcagaccttagggaccatgcttgataccgtagtcttctaaggccctccgaattggcatcttatgttacctgcattctgcacaactctgtatcatcttttgtggcggtgttccgggactaattattacatcggcttgatcagtagacgctgcagcttgttagaaatctagccctttgttctatgctttgcttgtatccccattcaaacaattcagttaccaatttgttcttatccaagaaagggaaa

SEQ ID NO: 1856 - DNA, 1645 bp, Linum usitatissimum
ccacgcgtccgctttgctccatccgccttaaccgcgaaaaagagtatctagaacagactttccggtatggagaggctccaaagaatgttcgccggcgccggtggtggtttgggccaccctcctcctgattctccgacgcttgatacatcggagcaggtctatatctcctccctcgctctcctcaagatgctaaaacacggacgagctggagttcccatggaggtgatgggtctgatgctaggggagtttgtggatgaatatacagttcgtgtggttgatgtgtttgctatgcctcagagcggtactggggttagcgttgaagcggttgaccatgttttccagactaatatgcttgatatgctcaaacagactggaaggccagagatggtggttggttggtaccactcccatccagggtttggttgttggctctcaggtgttgatattaacacacagcagagttttgaagctctcaatcaacgagctgttgctgtggtggttgatcctattcagagtgttaaagggaaagtggtgattgatgctttccgttcaatcaatcctcaaaccatgatgcttggccaagaaccacgacagacaacttccaatgttggccatctgaacaaaccatcaattcaggcacttatccatggactgaacagacattactattctattgccatcaattaccgaaagaatgaacttgaggaaaaaatgcttctcaacctgcacaagagcaagtggactgatggattgacactcaggagattcgaccgtcattcaaagaccaatgagcagactgttcaggagatgttgaaattggccagtaagtacaacaaagcagtgcaagaagaagacgagctgtcacctgagaagctggcaatcgcaaacgtagggaggcaggacgcaaagaaacacctggaagaacatgtctttaatttgatgtcttccaacatagttcagaccttgggtaccatgctcgacactgttgttttttagactttaacagcagccccatccaaaagaaagaatacatccctggacacattaatgacgtctttttatgtttatagcatattatgtatggtgttgtggaagtatgaatgaatgtatgaacattgaattatttttctctctctctctctcgcatctgccttttttatcagagcacactataaagaaaagttcacttagcattcttcttttttacaaagcagcaattggttgaagaagtttgctccagcttcttccggtctgcctctggttggtcggccagcgacaagttggcgactctggcgctactgtgttggttgacattggttattgtgtggtgatggctgtgaagaagtttagaggagaaaacgaaagaaaatactctcaagctagaaagtaaaatacaagctttcatacgagagaaatactggaattctggaacgcaagagaatcgtgagaggctatcaaatcgggtggataggcgcaagtttggcatcgtggcggtggaaaagttgacattgaggggaagggttggcggtggctttagactctcatccggaagggtttttaaagaagtgataacctcggcgttttgtttcacattgtggatattacttataccctgttcatataatgttaaaatggatgttttacc

SEQ ID NO: 1857 - DNA, 1289 bp, Arachis hypogaea
gagatcaaagacttaaaacacaagctttcaagtccaaatcaattgagatctgaaaagaagagagaatctcgagagagttgagaatcatggagcggcttcagagaatgtttgcaggtgcaggaggggcgctagggcacccaccaccagattcccccacactcgattcttccgagcaggtctatatctcttcgctcgccctcctcaagatgctcaagcacggaagagctggggttccaatggaagtgatgggtttgatgcttggggaattcgtggatgagtataccgtacgcgttgttgatgtgtttgcgatgccacagagtggaactggtgttagtgttgaagctgttgatcatgtcttccaaactaacatgcttgatatgctcaaacagactggacgaccagagatggttgttgggtggtaccattcacatcctggatttggatgttggctttctggtgtggacatcaatacacaacagagttttgaggctttgaatcagcgtgccgtggccgttgtcgtagatccaatacaaagtgttaaaggaaaagtagtgatcgacgctttcagattgatcaatccacagactatgatgcttggccaagaaccgaggcagacgacttccaatctggggcacctgaacaaaccatccattcaagcgttgatccatggattgaacaggcattactattccatagccattaactacaggaagaatgaacttgaggagaagatgttgctaaatcttcacaagaagaaatggaccgatggtttgacacttcagcactttgatacacattctaagactaatgagcagactgttcaggagatgctgaaccttgccgtgaaatacaacaaggcagtccaagaggaagatgagctgcccccggaaaagcttgcgatagcaaatgtgggaagacaagatgcgaagaagcaccttgaagagcatgtctcgaatttgatgtcttccaacatcattcaaactctaggaatgatgcttgataccgttgtcttctagagttgttattttcggatctttcaatttctctattgtgattactaattagttagaaaactggtaatttattcactagtagttttacaattatcccaaaaccatatttgaagacagatgtattccttggacgagctgaagaggtcaagaaattaaaacagttcatattttttccggtgacccccatagcattactatttactgtgtgtccttggagttacgatacctgaactcatcaatcatcattgttacataaaggaaagattgctattgtta

SEQ ID NO: 1858 - DNA, 1290 bp, Papaver somniferum
acaagacttgcgggatacaaaatccgattaggaggtctgatcgaaatcatagacagtgagaagaagagtaaatcaaatcaataatggagggattgcaaaggttattagcaggaggaatgggaggacaaccacctccagattcaccactcttggattcatctgagcaagtttacatatcttctcttgcactcctcaagatgcttaaacatggaagagctggggttccgatggaagttatgggattgatgcttggggagtttgtagatgaatatactgttcgtgtggttgatgttttcgcaatgcctcagagtggtactggtgttagtgttgaagctgttgaccctgtgttccagactaatatgctggatatgcttaagcagactggcagaccagagatggttgtaggatggtatcactcgcatcctggatttggttgttggctctctggtgttgatattaatacacagcagagttttgaagctttgaatcagagagctgttgccgtggttatagaccctatacaaagtgttaagggtaaggtagtcattgatgccttccgtttgatcaatcctcaaaccatgatgttgggacaagagccacgacagacaacatcaaaccttggatatctcaacaagccgtccattcaagctttgatccatgggttgaacaggcattactattcaatagcaattaattacaggaaaaatgaacttgaggagaagatgttgctgaatcttcataagaagaagtggactgatgggttgactctgcagcagtttgattctcattcaaaaactaatgagcagactgtagaggaaatgcgaagcctggccatcaaatacaacaaggctgttcaagaggaggatgagttgtctccggagaagcttgctattgctaatgttggaaggcaagatgctaaaaagcacctggaagagcatgtcaataacttgatgtcatcgaacattatccagaccctgggaaccatgcttgacactgtaattttttaggagtaatggaggatatgtgatgtggaaaggtgcaggaagggttctgatactacagtagcttatttagattgatcaggtctctaggcatttcagacgcaggaagggtttggtgtggaagcagaatagcactcaaatacctactaattgtagttaacagatgatacaccatttactgtaaagagtgtatgaacatctaatttttagcttgttttttgagaacaacttgttttgagaacgagtaggtctttttgtaaacaaacttggtttttgagaatccatacag

SEQ ID NO: 1859 - DNA, 1107 bp, Raphanus sativus
  misc_feature (943)..(943): n is a, c, g, or t
  misc_feature (983)..(983): n is a, c, g, or t
gacgcccgatttcatctaatccatggagagattacagcgaatcttcggcgccggcgggggtctaggtcacgcatctcccgattcccccactctcgacacctcggagcaagtctacatctcctctctcgccctcctcaagatgctcaaacacgggagagctggagttcctatggaggttatgggattgatgctgggagagttcgtggatgagtacactgtgagagttgtggatgttttcgccatgcctcagagtgggacaggtgttagtgttgaagctgttgatcatgttttccagactaatatgctcgacatgcttaaacagactggaagacctgaaatggtggtgggttggtatcattcgcatcctgggtttggatgctggctttccggtgttgatattaatactcaacagagttttgaagctttgaaccagcgagctgtagctgtggtggttgatcctattcagagtgtgaaggggaaagtggtgattgatgccttccgctcgataaaccctcagaccattatgcttgggcaagagcctcgtcaaacaacgtccaaccttggccaccttaacaaaccatcgatccaggccttgattcatggattgaacagacactattattcgatagccatcaactacaggaagaacgagctcgaggagaagatgttactaaacctccacaagaagaaatggacagatggtctgacgctaagacgctttgacactcactccaagacaaacgaacagaccgtgcaggaaatgttgagcttggctgctaaatataacaaggcggtacaagaggaagacgagttgtcaccggagaaactggcaattgtgaatgtgggaagacaagacgcaaagaagcatctggaagaacatgtttccaacttgatgtcttccaacattgttcagacactaggcaccatgcttgacactgttgtnttctagagagcttattcacatctccagtcagctttgtttntcttctgcatctccttattttcagttgaatcctctctttatatcctatctcctagcatttgataagttgtattgtactatctgaaatcgttcttttcattaatgccatggattaattctgttac

SEQ ID NO: 1860 - DNA, 1189 bp, Raphanus sativus
gaggttttataagatccaaaagcagctggactcagaagaagaagacgactgattttagctgagattatggagagattacagcgaatcttcggcgccggtggcggtctgggtcacgcatcgccagattctccgacactcgacacgtcagagcaagtttacatctcttctctcgccctcctcaagatgctcaagcacggaagagctggagttcctatggaagtgatgggattgatgcttggagagttcgtggatgagtacactgttagggttgttgatgttttcgctatgcctcagagtggtactggtgttagcgtcgaagctgttgatcatgtcttccagactaatatgctcgacatgcttaaacagactggaagacctgagatggtggtgggttggtatcattcacatcctggatttggatgctggctttctggtgttgatattaatactcagcagagttttgaagctttgaaccagcgagccgtggcggtggtggttgatcccattcaaagtgtgaaggggaaagtggtcattgatgcgttccgctcgataaacccgcagaccattatgcttgggcaggaacctcgtcaaacaacgtcgaaccttgggcatctgaacaaaccatcgatccaggccttgattcatggattgaacagacactactactcaatagccatcaactataggaagaacgagctggaggagaagatgttactaaacctccacaagaagaaatggacagatggtctgacgctaagacgctttgacacccactctaagacaaacgaacagactgttcaggaaatgttgagcttggctgctaaatataacaaggcggtacaagaggaggacgagttgtcaccggaaaaactggcgattgtgaatgtgggaagacaagacgcaaagaagcatctggaagaacatgtttccaacttgatgtcgtccaacattgttcagacactaggcaccatgctcgacactgttgtcttctagagaacttgttcactttaccagccggagtactctgcttcagtcattttggctggaaagttcagcttcgttgttttgcatctcttttgtttctgttgaatcaacgctttatgacttatctcctagcaagcatctgataagattgtattgtactaagtggtttcactctttttattaaggctatggattgatttctatt

SEQ ID NO: 1861 - DNA, 1167 bp, Raphanus sativus
  misc_feature (284)..(284): n is a, c, g, or t
  misc_feature (323)..(323): n is a, c, g, or t
  misc_feature (344)..(344): n is a, c, g, or t
cccagagaagaacacgactgattttcatctgtgagattatggagagattacagcgaatcttcggtgccggcgggggtctaggccacgcctctcctgattcccctactctcgacacctcggagcaagtctacatctcctctctcgctctcctcaagatgctcaaacacgggagagctggagtgcctatggaggtgatggggttgatgctgggagagttcgtggatgagtacactgttagggttgtggatgttttcgcgatgcctcagagtgggactggtgttagngttgaagctgttgatcatgttttccagactaatatgctngacatgcttaaacagactggnagacctgaaatggtggtgggttggtatcattcacatcctgggtttggatgctggctttccggtgttgatattaatactcaacagagttttgaagctttgaaccagcgagctgtcgcagtggtggttgatcctattcagagtgtgaagggtaaagtggtgattgatgcgttccgctcgataaaccctcagaccattatgcttgggcaagagcctcgtcaaacaacgtccaaccttggacacctgaacaagccatcgatccaggccttgattcatggattgaacagacactattattcaatagccatcaactacaggaagaacgagctcgaggagaagatgttactaaacctccacaagaaaaaatggactgatggcctgacgctaagacgctttgacactcactccaagacaaacgaacagaccgttcaggaaatgttgagcttggctgctaagtataacaaggcggtgcaagaggaggacgagttgtcaccagagaaactggcgattgtgaatgtgggaagacaagacgcgaagaagcatctggaagaacatgtttccaacttgatgtcttccaacattgttcagacactaggcaccatgcttgacactgttgtcttctagagagcttcttcacttttccagccagtaattgctatggttcaatcagttggctagaatgttgagctttgttcttcttatgcatctctttgttttctgttgaatcttctcttatgtcctatctcctagcacttgataagtttgtattatactatccggtttcgttctttctatgaaggccatggattgattactatttcattca

SEQ ID NO: 1862 - DNA, 1397 bp, Glycine max
acataaaacataaatgtattgtagtatagcaccgagtaagatttttcttgttcctttgttggtgggtttcctttccgcttcaggttcagcttcaacttcaaattctcagtgaaaccaattcagctgagtccaaatcccaaatccgaatcaaaatccgaagtgagatttgcgatggagaggcttcagcgaatgtttgcaggtgcaggtggagcgctagggcaccctcccccagattccccaactctcgattcctccgagcaggtctacatctcctcactcgctctcctcaagatgcttaagcacggaagggctggggttcccatggaggtgatgggtttgatgcttggagaattcgtggacgagtacaccgttcgtgtggttgatgtcttcgcaatgccgcagagtggcactggtgttagtgttgaggctgttgatcacgtttttcagactaatatgcttgacatgctcaaacaaactggaagaccagaaatggttgttggttggtaccattcccatcctggatttggctgttggctctctggtgttgacatcaatacacagcagagttttgaggctttgaatcagcgtgcagtggctgtggttgtagatccaatacaaagtgttaaaggcaaagtggtgattgatgcttttcgattgatcaatccgcagacaatgatgcttggtcaagaaccaaggcagacaacatccaatctgggacatctgaataaaccatccattcaagcattgatccatgggttgaaccggcattactattccatagccattaattacaggaagaatgaacttgaggagaagatgttgcttaatcttcacaagaagaaatggactgatggtttgacacttcggcattttgatacacattccaaaactaatgaacagactgtacaggaaatgctgaacttagctgtcaaatataacaaggctgttcaagaggaagatgagctgcctccagagaagcttgcaatagcaaatgtgggaagacaagatgcaaagaaacatctcgaagagcatatctcaaatttgatgtcttccaacatcgttcaaactctcggaatgatgcttgatactgttgtcttctagagtcattattttggaccttctggtttctgtagctgtgctaaggagacaatttgagttattacaatcactgtttccttattcttctcaaactatatttgaagacactagacatatattatttggacgggctgaaaaggtcaagaaagtaaatctcagcacatagtttgtgtggtgtctccctcagtattactggatatcttttaatgttatttctggattttctcttctacaaaattgtctatcaaaacaaaatgtcagttatgttttaaaataccataagaaaaaaatcgttggtt

SEQ ID NO: 1863 - DNA, 1342 bp, Taxus baccata
aaaattttgatacatacaaagaccacgatgttagctttaaggtaagttgtaaatcaaaaccgttatttcccagatttagtgacactggagccttacccacatactttgaaggccgatttatcctcttattaacctttttcccgacccgaccagagcaattaatcaacaaggccgttggtttgataaccagttaggttcctgcaaactttagttattcctcaaaagacttaggttctgaagacaatggagagattacagaggattttttcaggggcaggtggaatgggaccacctgctacagatggccccatgcttgattcttcagaacaggtctacatttcgtcacttgccttgctcaaaatgctcaagcatggtagagctggagtgccaatggaggtaatgggactgatgcttggtgagtttgtcgatgagtacactgttcgagttgtggatgtatttgccatgccccagagcggtacgggagtcagtgtagaagcagttgatcacgtttttcagacaaacatgctcgatatgctgaaacagactggcagaccagagatggtcgtaggatggtaccactctcatcctggttttggatgctggctttcaggtgttgatatcaatacacagcagagttttgaggcactaaatcaacgagcagttgctgtggttgtggatcctattcagagtgttaaggggaaggttgtgattgatgcattccgcctaataaatcctcaaactatgatgcttggccaggagcctcggcaaacgacttccaatttggggcatctgaataaaccatccatccaggcattgatccatggtttgaatcgacattattattctattgctatcaattatcggaaaaatgagcttgaagaaaagatgctgctcaacttacacaagaagaaatggacagatggtcttaccctgcaacgttttgattgccatgctaaaacaaatgaacagactgttcaggaaatgctcgatcttgcagtcaagtataacaaagctgtacaagaagaggaccagttacctcctgaaaaacttgctattgcaaatgttggcagacaagatgccaaaaaacatctagaggagcatgttgcgaatttgatgtcttcaaacatagttcaaaccctaggcacaatgcttgatacggttgttttttaagtttttagaagtttcaaaatcaaatcaacgtttttttgtttcattttgtgcatccaaaagaagagacacagaacaggttgggtcatgcctctaagatgtatacttatttattgaactattggattgctgattgaaactatattattgaaagaatcaggaaattggatgactt

SEQ ID NO: 1864 - DNA, 1377 bp, Eutrema parvulum
ttttagtggtctacaatatataaaaagaaaatattggagggtttatatgtaaatagtttcggctaatgatactcctacaatcgaataagatccatctccgtcttgtcttgttaataaagaaaactctcgaggtttttataagagccccgattcttgtagctcagcaatccagaagaagacgactgattttatctgattatggagagattacagcgaatcttcggcgccggtggcggtttgggtcacgcatcgcctgattctccgaccctcgatacgtcggagcaggtttacatctcttctctcgccctcctcaagatgctcaagcacggaagagctggggttcctatggaagtcatgggattgatgcttggagagttcgtggatgagtacactgttcgagttgtggatgttttcgcgatgcctcagagtggtactggtgttagcgtggaagctgttgatcacgttttccagactaatatgctcgacatgcttaaacagactggaagacctgaaatggtggtgggttggtatcattcacatcctggatttggctgctggctttctggggttgatattaatactcaacagagttttgaagctttgaaccagcgagctgtagcagtggtggttgatccgattcaaagtgtgaagggcaaagtggtgattgatgcgttccgctcgataaacccacagaccattatgcttgggcaagaacctcgtcaaacaacgtcgaaccttgggcacctgaacaaaccatcgatccaggccttaattcatggattgaacagacactattactcaatagccatcaactataggaagaacgagctggaggagaagatgttattaaacctccacaagaagaaatggacagatggtctgacgctaagaccctttgacacccactccaagacaaacgaacagacggtgcaggaaatgttgagcttggctgctaaatataacaaggcggtacaagaggaggacgagttgtcaccagagaaactggcgatcgtgaatgtgggaagacaagacgcaaagaagcatctggaagaacatgtttccaacttgatgtcatccaacattgttcagacactaggcaccatgcttgacactgttgtcttctaaaaagcttctcacttttcaagccagtagtactctgcttcaatcatttggctagaaagttgagttttgttcttcttctgcatcgctttgatttctgtcgaatcttgtctttatgtcttatcgactagtatttgataaggttttattgtactatgtgacttcgtttgtttcatcaaggccaaggattgatttctatttcttgcagttggttcagattttttctttcatttgtagatttcaagctgcagctttgga

SEQ ID NO: 1865 - DNA, 1365 bp, Medicago truncatula
gtaatgtcctatttaaccatactgtgtttttctcttcttctctcggtgagtgtttttaacacacacaaaacaaaccattcttaacttgttaacaaagaaaaggttccatttttcatcaattgtcgattccaaagcaatcatgtcaggtatggaaagacttcaaagaatgtttgcgggtgcaggtggagcactcggaggtcatccaccaccggattccccgaccctagattcatctgagcaagtttacatctcttcccttgctcttctcaaaatgctcaaacacggtagggctggtgtacctatggaagttatgggtttgatgttgggggagtttgtggatgagtatactgttagggttgttgatgtttttgctatgcctcagagtggtactggtgttagtgttgaagctgttgatcatgtttttcaaactaacatgcttgatatgttgaaacaaactggaagaccagagatggttgtaggttggtatcattcacatcctggatttggctgctggctttctggagtggacattaacacacaacagagttttgaggctttaaatcaacgggcagtggctgttgtggtcgatcctattcagagtgttaaaggcaaggtggtcattgatgctttccggctgattaatccacaaactatgatgctgggtcaagaaccacgacagacaacctccaacttgggccatctgaacaagccatctatccaagctcttatccatggcttgaaccgacattattactcaatagcaatcaattacaggaagaatgagcttgaagagaagatgttgcttaaccttcataagaagaaatggactgatggtttgacactcaggcgatttgattcacattctaaaactaatgaacaaactgttcaggagatgctgagtttagcaaccaagtacaacaaggcggtgcaggaggaagacgagctgtcaccagaaaaacttgcaattgccaatgttggaaggcaggatgctaagaagcaccttgaggagcatgtttctaatttaatgtcatcaaacattgttcagactttgggaatgatgctcgacacagttgtgttctagagttaggattgtccactgtattttctttcatgatgtccagcaatatttcattaacactcgttacctgtttgttaacactttttttattacaaagttatttgcatgtgttcatttcaaatgttttagagttaaatgcttcaggatgaaattcgtgttaagagtcttagagtgcacttgatttctgttttgtttatgcttttgatacattgtaatgtccatcatcgaccttgcattaccattactgacacctccaagaactacaacacaattaccactaattttgc

SEQ ID NO: 1866 - DNA, 1169 bp, Aquilegia formosa
aaagaactcacgaactagaacgagatcgagaagaagaagaatggaaagattgcaaaggattttggctggagcaggaggaatgggaggacatccaccacctgattcaccaataatggattcatctgaacaagtttatatctcttctcttgctttactcaagatgcttaaacatggtagagctggtgttccaatggaagttatgggattgatgttaggtgattttgttgatgagtatactgttcgtgttgttgatgtttttgctatgcctcaaagtggtactggtgttagtgttgaagctgttgatcctgttttccaaactaagatgcttgatatgcttaagcaaactggaagacccgagatggttgtaggatggtatcattcacatcctggatttggttgttggctttcgggtgtcgatattaacacacagcagagctttgaacaattgaatcagagagctgttgcagtggttgtggacccaattcagagtgttaaaggaaaggtggtcattgatgccttccgtttgatcaacccacaaaccatgatgctgggccaagaaccaaggcaaacaacatccaatcttggacatctcaacaagccatcgattcaagcattgatccatgggttgaacaggcattactactcaatagccatcaattacaggaagaatgaacttgaggaaaagatgttgctaaatctgcataagaagaagtggaccgatgggctgacgcttcagcgattcgatactcattccaaaaccaatgagcaaactgtgcaggaaatgttgaatctggccgtcaagtacaataaggctgttcaggaggaagatgagttgtctcctgagaagcttgcaattgctaatgtaggcaggcaagacgccaagaagcaccttgaggagcatgtttccaacttgatgtcttccaacatcgttcagactcttggaacaatgttggacactgttgtattttaaagctcattcgtcacgaacaaggttcatatgacatgggctaagaacaggcgtagctttgaactgaattttattttccccaagtgcattttgttcaagtgaaccttaaagttgaagaatgatatgtataatgtcagtactgttgaagtgagctattttttacctctatctatggtttcagataatgttattcttatttggt

SEQ ID NO: 1867 - DNA, 1325 bp, Vaccinium corymbosum
tacgcggggcttgctatcaaagaaaagaaaacaagtttggatcagggaagaaaagcagaaatcaagagagaggaaccaatgtctgggatggagagattgcagagaatgttcgccggtgccggaggcgcgttgggacacccgccgccggactcgccgactctcgattcatcggagcaagtttacatctcttcactcgccctccttaaaatgctcaagcacggaagggctggagtgccaatggaagtgatggggttgatgttgggggaatttgtggatgagtacactgttcgtgtcgttgatgtattcgcaatgcctcagagtggtactggtgttagtgttgaagccgttgatcatgtttttcagactaatatgcttgatatgctcaaacaaactggaagaccggaaatggtggttggatggtatcattcccatcctggatttggctgctggctctctggtgtagacattaacactcaacagagttttgaagctttgaatcaacgtgctgtggcagttgtggtggatcccatacagagcgtcaaggggaaagtggtcattgatgcattccgtttaatcaacccacaaactatgatgcttggccaggagccgaggcagacaacatccaaccttggtcatctgaacaagccatccattcaagcattaatccatgggctgaacaggcattattactcaatagccataaattacaggaagaatgaacttgaggagaaaatgttactgaaccttcacaagaagaagtggactgatggattgacgctccagcgatttgatacccattcaaaaaccaatgagcagactgttcaggagatgttgaatctagctattaagtataacaaggcggtgcaggaagaggatgagttgcctccggagaagcttgctattgcaaatgtgggaaggcaggatgctaagaaacatctcgaagaacatgtctccaatttgatgtcttccaacataattcagactttgggcaccatgctcgacacagttgtgttctaaggttcagtctttttattctccatccaattgtacttcagcggcggtcgaagttaaacgatgtgggtatgatcaactccttggcacttgaaatgcttccttcagaatgaaagagggtaaaggtactgtgaaaatgtgatactgttgtgaaatagggcttcggtcttgactcttgcatagctctcttccatttcgaatcttttttataaagccacaattagttgatttcagatgcttgtgttttatggaatctttccttcagcatttgattatgctcttcttgaatgtttctatttgtttgaagaacgcga

SEQ ID NO: 1868 - DNA, 1304 bp, Gossypium raimondii
cataaggatttacagagagctgcaaaccgaaagggacagaaaaaaatcagagaaattctcacttgtcttgctaccaaagaaaagttcccaaaaactccgatcgacgatgtccggtatggaacgattgcacaggatgttcgccggcgctggtggtgcgttgggtcacccgccgccggattcgccgactctcgattcgtcggagcaggtctacatctcctctttggccctcctcaaaatgctcaagcacggaagagctggagttcccatggaagttatgggtttgatgttgggagagtttgtcgatgagtacaccgtacgtgttgtggatgtctttgcgatgccacagagtggtactggtgtcagtgttgaagctgtggatcatgttttccaaacaaatatgcttgatatgctcaaacaaactggaagaccagagatggtggtgggttggtaccattcacatcctggatttggctgctggctttctggtgttgacataaacacacagcagagttttgaagctttgaaccaaagggctgtagcagtggtggtggacccaattcagagtgttaaagggaaagtggtgatcgatgcattccgcttgatcaacccacaaaccatgatgcttggccaagaaccacgtcagacaacatctaatctcgggcatcttaataagccatctattcaagcattaatacatgggctaaacagacattactactccatagccattaactaccggaagaatgaactcgaggaaaagatgctgttgaatcttcacaagaagaagtggacagatggactgacacttagacgtttcgatactcattccaaaactaatgagcagactgttcaggaaatgctgaatttagctataaaatacaataaggcagtgcaggaggaagatgaattacctcctgagaagctggcgatcgcaaatgtcggccgacaagatgccaagaagcacttagaggaacatgtctcgaacttgatgtcgtcaaacatagttcagacattgggaactatgctcgacacggtggtgttctaaaactcttttagcacctgtatactcttttttcatattcaggaactatcatagcttgttggtcaaaaactgccattgtattgtgaaatttgaaagggactatcatgttgtctcattaatctctctgttatcccctctgatgtgtaagtgggattgtgaagatgtttaacttttgttacttgccttctgatagttttctgagattcttcatattgcaattattgctcaagttttttaaaaccagaccagtggctcagctcaa

SEQ ID NO: 1869 - DNA, 1090 bp, Helianthus annuus
cctttcagttccggggagatcttgtcgtgttacccaagaaattctaatctgttgatcggaacgcaatgtcagggatggaacggctacagaggatgttcgccggagccggaggcgcgttaggtcatccaccacctgactctccgacgctcgatacatcggagcaagtttacatctcctcactagccctcctcaagatgcttaaacacgggagagcgggagtgcctatggaagtgatgggattgatgcttggtgaatttgttgatgagtatacggttcgggtggtggatgttttcgctatgccacagagtggtactggtgttagtgttgaagcggttgatcatgtatttcagactaatatgcttgatatgcttaaacaaactgggagaccagagatggtggttggatggtaccattcacatcccggatttggttgttggttatctggagttgacatcaacacacaacagagttttgaagctctaaatcaaagagccgttgcagtggtggtggatccaatccagagtgtgaaagggaaggttgtgatcgatgccttccgccttataaacccgcaaaccatgatgctcggccaagaaccacgccaaacaacatccaaccttggccatcttaataaaccgtccatccaagcactgattcacgggttgaatagacactactattcgatagctattaattacaggaagaatgaacttgaagagaagatgttattgaaccttcacaagaagaagtggactgatggattgaaactcgaacgatttgatgcccattcaaaaaccaatgaacagactgtccaggagatgctgagtctagccatcaaatataacaaggcggttcaggaagaagacaaactgtctccggagaagctagcaattgcaaatgtgggaagacaggatgcaaagaaacatctagaagaacatgtctccaatctcatgtcatccaatatcattcagacattaggtacaatgctcgacacggtttctttctagagttctgatcattcgtgttttggtacattattgaccgtgcttttgtacttgatttaatatctttttacaagactcgtgtacacatg

SEQ ID NO: 1870 - DNA, 1172 bp, Aquilegia formosa
aaagaactcacgaactagaacgagatcgagaagaagaagaagaagaagaatggaaagattgcaaaggattttggctggagcaggaggaatgggaggacatccaccaccagattcaccaataatggattcatctgaacaagtttatatctcttctcttgctttactcaagatgcttaaacatggtagagctggtgttccaatggaagttatgggattgatgttaggtgattttgttgatgagtatactgttcgtgttgttgatgtttttgctatgcctcaaagtggtactggtgttagtgttgaagctgttgatcctgttttccaaactaagatgcttgatatgcttaagcaaactggaagacccgagatggttgtaggatggtatcattcacatcctggatttggttgttggctttcgggtgtcgatattaacacacagcagagctttgaacaattgaatcagagagctgttgcagtggttgtggacccaattcagagtgttaaaggaaaggtggtcattgatgccttccgtttgatcaacccacaaaccatgatgctcggccaagaaccaaggcaaacaacatccaatcttggacatctcaacaagccatcgattcaagcattgatccatgggttgaacaggcattactactcaatagccatcaattacaggaagaatgaacttgaggaaaagatgttgctaaatctgcataagaagaagtggaccgatgggctgacgcttcagcgattcgatactcattccaaaaccaatgagcaaactgtgcaggaaatgttgaatctggccgtcaagtacaataaggctgttcaggaggaagatgagttgtctcctgagaagcttgcaattgctaatgtaggcaggcaagacgccaagaagcaccttgaggagcatgtttccaacttgatgtcttccaacatcgttcagactcttggaacaatgttggacactgttgtattttaaagctcattcgtcatgaacaaggttcatatgacataggctaagaacaggcgtagctttgaactgaattttattttccccaagtgcattttgttcaagtgaaccttaaagttgaagaatgatatgtataatgtcagtactgttgaagtgagccattttttacctctatctattgtttcagataatgttattctta

SEQ ID NO: 1871 - DNA, 1167 bp, Phaseolus coccineus
ggaaagaagcattctttcttttcgtgaaacaaaagaaaactaagatttgaggttccttgtcccttccatcaccatcatcgtcatgtcagggatggagaggcttcagaggatgtttgcgggtgcaggcggagccctagggcaccctccaccagattcccccaccctcgattcctccgagcaggtttacatctcctctctcgcgcttctcaaaatgctcaaacacggaagagctggggtacccatggaagtgatgggtctgatgttgggggagttcgtggatgagtacaccgtgcgcgttgtggatgtgtttgcgatgcctcagagtgggaccggtgttagcgttgaagccgttgatcatgttttccagactaatatgcttgatatgttgaagcagactggaaggccggagatggttgtggggtggtatcactcgcatcctggatttgggtgttggctttctggagtggatattaatacccaacagagttttgaggctttaaatcaacgtgcagtggctgtggtggtggatcccattcagagtgttaaaggcaaagtggtaattgatgctttccggctgattaatccacaaactatgatgctgggtcaggaaccacggcagacaacttccaacctgggccatctaaacaagccatctatccaagctctgatccatggcttgaatagacattattattccatagcaattaattacagaaagaatgaacttgaagagaagatgttgcttaaccttcacaaaaagaagtggactgatggtttgacactcaggcgctttgattcacattctaaaactaatgaacagactgtccaggagatgctaagtttagcatccaagtacaacaaggcagtgcaggaagaagatgagctgccaccagaaaaactcgcaattgcaaatgtgggaaggcaagatgctaagaagcacctcgaagagcacgtttccaatttgatgtcatcaaacattgttcagactttgggaatgatgctcgacacagttgttttctagagttagcattgtctaatgtattcctccttacaccaacatttcattgtccaatgtatttcttgacatgttttttaacagaaattgttttatcacaggtatttgtattttgtgttctttaaaatgcaggagcaaagttacatagttaa

SEQ ID NO: 1872 - DNA, 1085 bp, Brassica napus
gacgactgatttgatctgataatggagagattacagcgaatcttcggcgccggcggcggattaggtcacgcatcgcctgattctccgactctcgatacctcggagcaggtttacatctcctctctcgccctcctcaagatgctcaaacacgggagagctggggttccaatggaagtgatggggttgatgcttggagagtttgtggatgagtacactgtgagggttgtggatgttttcgctatgcctcagagtgggactggtgttagtgttgaagctgttgatcatgttttccagactaatatgctcgacatgcttaaacaaactggaagacctgaaatggtggtgggttggtatcattcacatcctgggtttggatgctggctttctggtgttgacattaacactcaacagagttttgaagctttgaaccagcgagctgtagcagtggtggttgatccgattcagagtgtgaagggtaaagtggtgattgatgcgtttcgttcgataaacccgcagactattatgcttgggcaagaacctcgtcagacaacgtccaaccttggccacctgaacaaaccatccatccaggctttgattcatggattgaacagacattactattcaatagccatcaactataggaagaacgagctcgaggagaagatgttactaaacctccacaagaagaaatggacagatggtttgaccctaagaccctttgacacccactccaagacaaacgaacagaccgtgcaggaaatgttgaacttagctgctaagtataacaaggcggtacaagaggaggacgagttgtcaccagagaaactggcgattgtgaatgtgggaagacaagacgcaaagaagcatctggaagaacatgtttccaacttgatgtcttccaacattgttcagacgctaggtaccatgcttgacactgttgtcttctagaggtcgtctgcacttttttctcttctgcatcattctgttgaatcaactctttatgtgtgttctcctagcacttgataaggttggtattgtactctgtgattcctattttcttgcacctatttcagtttctttctctc

SEQ ID NO: 1873 - DNA, 1313 bp, Gossypium hirsutum
cgaaagggacagaaaaaaatcagagaaattctcacttgtcttgctaccaaagaaaagttcccaaaaactccgatcgacgatgtccggtatggaacgattgcacaggatgttcgccggcgctggtggtgcgttgggtcacccgccgccggattcgccgactctcgattcgtcggagcaggtctacatctcctctttggccctcctcaaaatgctcaagcacggaagagctggagttcccatggaagttatgggtttgatgttgggagagtttgtcgatgagtacaccgtacgtgttgtggatgtctttgcgatgccacagagtggtactggtgtcagtgttgaagctgtggatcatgttttccaaacaaatatgcttgatatgctcaaacaaactggaagaccagagatggtggtgggttggtaccattcacatcctggatttggctgctggctttctggtgttgacataaacacacagcagagttttgaagctttgaaccaaagggctgtagcagtggtggtggacccaattcagagtgttaaagggaaagtggtgatcgatgcattccgcttgatcaacccacaaaccatgatgcttggccaagaaccacgtcagacaacatctaatctcgggcatcttaataagccatctattcaagcattaatacatgggctaaacagacattactactccatagccattaactaccggaagaatgaactcgaggaaaagatgctgttgaatcttcacaagaagaagtggacagatggactgacacttagacgtttcgatactcattccaaaactaatgagcagactgttcaggaaatgctgaatttagctataaaatacaataaggcagtgcaggaggaagatgaattacctcctgagaagctggcgatcgcaaatgtcggccgacaagatgccaagaagcacttagaggaacatgtctcgaacttgatgtcgtcaaacatagttcagacattgggaactatgctcgacacggtggtgttctaaaactcttttagcacctgtatactcttttttcatattcaggaactatcatagcttgttggtcaaaaactgccattgtattgtcaaatttgaaagggactgtcatgttgtctcattaatctctctgttatcccctctttgatgtgtaagtgggattgtgaagatgttaacattatggtaattgccttcttatagattcatgaaatcttacaaaaataaaaaaacatcgttgtgtggccgttaccaatcacccatattagatgattaaataagtgcagagtaaaaagtctcttggaac

SEQ ID NO: 1874 - DNA, 1126 bp, Flaveria ramosissima
agccaatgtcagggatggaacgactacagaggatgttcgccggagccggtggcgctttaggtcacccaccaccggactctccgactctcgatacatcggagcaagtttacatctcttctctagcccttctcaagatgcttaaacatgggagggcgggagtgcctatggaagttatggggttgatgctgggtgaatttgttgatgagtatacggttcgtgtggtggacgttttcgctatgccgcagagtggaactggtgttagcgttgaagccgttgatcatgttttccagactaacatgcttgatatgcttaaacaaactgggagaccagagatggtggttggctggtaccattcgcatcctggatttggttgttggttatccggagttgacatcaacacacaacagagttttgaagctcttaatcaaagagctgttgcagtggtggtggatccaatccagagtgtgaaagggaaggttgtgattgatgccttccgccttattaacccacaaaccatgatgctcggccaagaaccacgtcaaacaacatccaaccttggtcatcttaataaaccatccatccaagcactgattcatgggttgaacagacattactattcaatagctattaattacaggaagaatgaacttgaagagaagatgctattgaacctacataagaaaaagtggactgatggattgaagcttgaacgattcgatacccattcaaaaaccaatgagcaaaccgtgcaggagatgctgagtctggccatcaaatataacaaagcggttcaggaagaagacgaactgtctccagagaagctagcaattgcaaatgtgggaaggcaagatgcaaagaaacatctagaagaacatgtctcaaatctcatgtcatccaacatcattcagactttaggtacaatgcttgacacagtttctttctagtgtgtcctttctggtcattcggtatacttgattagctatatacttgtaagctatatgctctatttttttacaactctctgacttctgctttcattttattcacgaccacggttgagcatgtaaaaagtcatatataaccttcgaaactttttatatttattaattttattttactattaaat

SEQ ID NO: 1875 - DNA, 1162 bp, Actinidia deliciosa
gccgtcaaagaaatcgaatcccgatcggtataaaagcactcgttagagagcgagagaagccatgtcggggatggagagattgcagagaatgttcgccggagccggaggagcgttgggccaccctccggtggactcgccgacgctcgattcgtcggagcaagtctacatctcctcactcgccctcctcaaaatgctcaagcacgggagggctggggttcctatggaggtgatggggttgatgctgggtgaatttgtggatgagtacacggttcgcgtcgttgatgtgtttgcaatgccgcagagtggtactggtgttagtgttgaagccgttgatcatgtattccagactaacatgctcgatatgctcaaacaaactggaagaccagagatggtggttggatggtatcattcgcatcctgggtttggctgttggctctctggtgtggacatcaatactcaacagagttttgaagctcttaatcagcgagctgtggctgttgtggtggatcctatacagagtgttaaggggaaggtggtcattgatgccttccgtttaattaacccacaaactatgatgcttggccaagaaccaaggcaaacaacttccaatctcgggcatctgaacaagccatccatccaagcattgatccacgggctgaataggcattattactccatagccattaattacaggaagaatgagcttgaggagaaaatgttactgaaccttcacaagaagaaatggactgatggtttgacacttcaacgatttgatacccattccaaaaccaatgagcagactgttcaggagatgctaaatctagctgttaaatataacaaggcagtgcaggaggaggatgagttgccaccagaaaaactagcaattgcaaatgtgggaaggcaggatgccaagaaacatcttgaagaacacgtgtccaacttgatgtcttcaaacatagttcagactttgggcaccatgcttgacacagttgtgttctagggttcagttttcgactctccacccaatgacaggatatttcgctcatttttgggcttgtggtttaattagatacagcacgttatttctttgtcatttcttgtaacattacgttcaatcaagttcccgttccttattcctattctatcttccccttctctttct

SEQ ID NO: 1876 - DNA, 1307 bp, Orobanche aegyptiaca
ttctcacattgtcgtgtccccaaagaaagctacttcgaaagaataacgaaaaaaattaatctgtgaaagagagtccccgaaatggccggcatggaaagactgcaccgtatgttcgccggagccggtggtgcccttggccaccctcctccagactcccctaccctcgattcctccgaacaagtatacatctcgtctcttgctcttctcaagatgctgaaacacggtagggctggtgtgccgatggaagtgatgggtctgatgcttggtgagtttgtggatgagtacacggttcgtgtggtggacgtttttgctatgccccagagtgggactggggtcagtgttgaagccgtggatcacgttttccagactaatatgcttgacatgctaaagcaaaccggaagacctgagatggttgttggttggtaccattcacatccaggattcggatgctggctctcaggtgtagatatcaatactcagcagagttttgaagctttgaatcagagagcagtggcagtggtggtggatccaattcaaagtgtaaaagggaaggtggtaattgatgcctttcgactcattaacccccaaaccatgatgcttggtcaagagccacgtcagacaacgtccaacttagggcatcttaataaaccatctatccaagccctgatccatggtttgaacaggcattattactccatagccataaattataggaaaaatgaacttgaggagaagatgcttctgaatcttcacaagaaaaaatggacagatggtttgacccttcagcggtttgatgcccactccaagacaaacgaacagactgtccaggagatgctaaatttagccggtaagtataataaagccgtccaggaggaggatgagttaacaccagaaaaattagcaatcgctaatgtgggaaggcaagatgccaagaagcatctggaagaacatgtctcgaacctaatgtcttcgaacattgttcagacattggggacaatgctggacactgttgtattctagattttgaggttgatttcatatgaacatttcatgttcaaggattgtgtctgatgttctcctcctaaacattgccgacttttactatgtctgttgtcttgtatccgatatgcttctcgattctaatttcccgtatttatggattccattattgttttttatagatgtacccatgttggatcattattgttttgtggcctcgtactttagatttggcatctagtttctgttgtgtttgcttttccccactattgttgagcgaaatgttgtataaatccgaattgatgttg

SEQ ID NO: 1877 - DNA, 2488 bp, Arachis hypogaea
atagcatcctgcagatacaagaaacctcaaaaacctttctgtcttcgttaacaagaaaggaagaagaaaacacaaggcttcttctttgccatttttttctctctttagattttgaatctgtagttgatgtcaggtatggagaggctacagaggatgtttgcgggtgcaggtggagcactgggccacccaccaccggattcccccaccctcgattcctccgagcaagtctacatctcttcactcgcacttctcaaaatgctcaaacacggaagggctggggttccaatggaagttatgggcttgatgttgggggagtttgtggatgagtacacggttcgtgttgtggatgtgtttgctatgccgcagagcgggactggcgtcagtgttgaggctgttgatcatgtgtttcagaccaatatgcttgatatgctcaagcaaactggaagacctgagatggttgttggttggtatcattcacatcctggatttggttgctggctttccggagtggacatcaatacacaacagagttttgaggctttaaatcaaagggccgtggctgtggtggtggaccctattcagagtgttaaaggcaaggtggtcattgatgctttccggctgattaatccacaaactatgatgttgggtcaggaaccacggcagacaacctctaaccttggccatcttaataagccgtctatacaagctctgatccatggcttgaatcggcattattactcaatagcaattaactacaggaagaatgagcttgaagagaagatgttgcttaatcttcacaagaagaaatggactgatggtttgacactcagacaatttgattctcattcaaaaactaatgaacagactgttcaagagatgctatcattagccaccaagtacaacaaggcagtgcaggaggaagacgagttaccgccagaaaaactcgcaattgctaacgtggggaggcaagatgctaagaagcaccttgaggagcatgtctccaatttgatgtcttccaacattgttcagaccttgggaatgatgctcgacacggtcgtgttctagaggctagagctagcatcatccaatgtgttcttcccgatcatgtcaagctatattttatttgcgctttctagacttgctaccaggaattatttatttagcacgcgttttctgcttttataatatggttgtttcaaatggaagaagagcaagttgcttgttacacaatgatagtgtcctttttgttttttaatatctataaatgacaaggggacattcatgattcttgattatgcagacattgaggtttcagtcattctttacaataacaatgttttgtagatttagttgaaacatgcacaaattggcttgaaagattataaagtcacatactctaataaaagttgaacatagtgaagaaagaacaaaatggtaatattgaaaactaaaatggaggggcgtccctgttaaagaattcagccatgcttgtgatcagttcctttgccttgtcacattcaagatcatgtatgtgaaatgcatgacctttcccttcagtctcctcaatctccaccaccccggtccaaccgcttcgactcaaggcctcatagtaaagcctccctctatccttcagtacatccttctctgctatgcacacaaacactctccgacaacccaaccaagccaagctaggtgcatcctccgccattgggttaacccacaggttgtcactctctggcattgatgggcatataaacggccacaatcgatcaactaactcccttttacctagttctaacacttctgatccaatcggagttgaaccccaaaaatatgggtgactcaaacaagcccctagaatatctatgccaagattcatatcagggtgcccagccatcataactatgttatgaactatgttagcaccggcactatcacccgccaaaaatactctttcaaaatcagcatgctcatttaaccaaggctcaggtccattgttcttcccatgagaagccacccattgcagtgcagtccaagcgtcatcatatgcggcgggaagaggatgttccggtgctagcctatactgaacagaaactgccacaacgttggccttggagaccaaagcagtaaggtagttatgatatgctgcattaaagggtgagttgacacaaaaggcaccaccatggaagtagatcacgatagggagcttgtggttatgggtgctttgtggtggggggaggaagagacgtgcggcgatgttgttttgcgagtcaagtgtgatgtctttggatgagacaacactgtgagggtaaagggaaggtgggacaatatctgttcccctaagcctttcaacacgaccgtcggtaaagacacgaataatatgagggaattcttgagctatttgtggttgctcatcggttatggttgttgagtttgtgctgctttccatggagttgaggattggagagtaattcagtgaggatcccgt

SEQ ID NO: 1878 - DNA, 1222 bp, Capsicum annuum
agtcttgttctcaaagaaatctcaaaaagcaaaaaagaaaaaaaatccaatcgccggagcttcgagcatgtcgggaatggagagattacagcggatgttcgccggagctggcggcgcgttaggccacccgccaccagattctcctacactcgactcttccgaacaagtttacatctcttctcttgctctcctcaaaatgcttaaacacgggagggctggagtccctatggaagtgatgggactgatgttaggggaattcgtcgatgagtatacagtgcgtgttgtggatgtgtttgcaatgcctcagagtggtactggcgtgagtgttgaagctgttgatcatgttttccagaccaatatgctagacatgctcaagcagactgggagacctgagatggttgttggttggtatcattcacatcctggatttggctgctggctttctggtgttgacatcaatactcagcagagttttgaagcactgaatcaacgagcagtggctgtggtggtggatcctattcagagtgttaaagggaaggtggtaattgatgcctttcgcttgatcaatccccaaacaatgatgcttggccaagagccacgtcagacaacatcaaatctgggacatctgaacaaaccttctattcaagcattgatccatggtttgaacagacactactactcaatagccataaactacagaaagaatgaacttgaagagaagatgctactgaatcttcacaagaagaaatggacagatggactcacgctccagcgttttgataatcattccaaaaccaatgagcagacagttcaggagatgttaaaccttgctgtcaagtataataaagcagtgcaggaggaggatgagttgcccccagaaaagctagctattgcaaatgtaggaaggcaagatgcaaagaaacatctcgaagagcatgtctcgaatttgatgtcctcaaatattgtccagacattgggaaccatgcttgacactgtcgtcttctgaagtttgtttctcaatagtctgcgatagtcgtgtttgaagtgaaatagaaacatttctttttttgccttatttctaatgagacctggtactttgttttactatgtgatagcagctgttacacaatatggttatgttatcttaagatgacttcagacatgtagtgatcatcttcccactgaaccattttcctaaaaataaaaaagacctcgtgccgaa

SEQ ID NO: 1879 - DNA, 1239 bp, Capsicum annuum
gcacgaggcacaatagtagtcttgttctcaaagaaatctcaaaaagcaaaaaagaaaaaaaatccaatcgccggagcttcgagcatgtcgggaatggagagattacagcggatgttcgccggagctggcggcgcgttaggccacccgccaccagattctcctacactcgactcttccgaacaagtttacatctcttctcttgctctcctcaaaatgcttaaacacgggagggctggagtccctatggaagtgatgggactgatgttaggggaattcgtcgatgagtatacagtgcgtgttgtggatgtgtttgcaatgcctcagagtggtactggcgtgagtgttgaagctgttgatcatgttttccagaccaatatgctagacatgctcaagcagactgggagacctgagatggttgttggttggtatcattcacatcctggatttggctgctggctttctggtgttgacatcaatactcagcagagttttgaagcactgaatcaacgagcagtggctgtggtggtggatcctattcagagtgttaaagggaaggtggtaattgatgcctttcgcttgatcaatccccaaacaatgatgcttggccaagagccacgtcagacaacatcaaatctgggacatctgaacaaaccttctattcaagcattgatccatggtttgaacagacactactactcaatagccataaactacagaaagaatgaacttgaagagaagatgctactgaatcttcacaagaagaaatggacagatggactcacgctccagcgttttgataatcattccaaaaccaatgagcagacagttcaggagatgttaaaccttgctgtcaagtataataaagcagtgcaggaggaggatgagttgcccccagaaaagctagctattgcaaatgtaggaaggcaagatgcaaagaaacatctcgaagagcatgtctcgaatttgatgtcctcaaatattgtccagacattgggaaccatgcttgacactgtcgtcttctgaagtttgtttctcaatagtctgcgatagtcgtgtttgaagtgaaatagaaacatttctttttctgccttatttctaatgagacctggtactttgttttactatgtgatagcagctgttacacaatatggttatgttatcttaagatgacttcagacatgtagtgatcatcttcccactgaaccattttcctaaaaataaaaaagacctcgtgccgaa

SEQ ID NO: 1880 - DNA, 1059 bp, Lippia dulcis
cgacagagtacggacgggaacaataaatactagaaaaataagaaaagaaaaggtaggaatttaaatctgtgagagaagaaatcaaatgtccggcatggaaagactgcaccggatgttcgccggcgccggcggatccctcggccacccaccgcctgactcgcctaccctcgattcatctgaacaagtttacatctcatcccttgctctgctaaagatgctcaaacacggcagggctggggtgccgatggaagtgatgggcctaatgctgggtgaatttgtggacgagtatacagtgcgtgtagtggacgttttcgcgatgcctcagagtgggactggagtcagtgttgaggccgtggaccacgtttttcagactaatatgcttgacatgctcaagcaaactggcagacctgagatggtggttggatggtaccattcacatccaggatttggatgctggctttctggtgttgacattaacactcagcagagttttgaagctttgaatcagagggcagtggcagttgtggtggatccaattcagagtgttaaagggaaggtggttattgatgcctttcgtctgattaacccgcaaaccatgatgcttggtcaagaaccaaggcagacgacgtccaacctagggcatcttaacaaaccttctatacaagctctgattcatggtttgaatcggcattattactcaattgccataaactacaggaaaaatgaactcgaggagaagatgttgttgaaccttcacaagaaaaaatggacagatgggttaacacttcagcgctttgatgaccactcgaaaacaaatgagcagactgtccaggagatgctcaacctagctgtgaaatacaacaaagcagttcaggaggaagatgaactttcaccggagaagctcgctattgccaatgtgggaaggcaagacgcgaagaagcatctggaagaacacgtctcgaacctcatgtcttcaaacattgttcagacacttgggacgatgctcgacaccgtcgtcttctagatcacctgttcaagaaccaccatatatctttgctc

SEQ ID NO: 1881 - DNA, 1227 bp, Solanum tuberosum
gtcgctcgcagtagtcttgttctcaaagaaatccaaaaagcaaagcaaaacccaatcggagagcatgtctggaatggaaagattgcagcggatgttcgccggagctggcggcgcgttgggacacccgccaccggactctccaactctggactcttctgagcaagtctacatctcttctcttgccctcctaaagatgcttaaacacgggagggctggagttcctatggaggtgatgggattgatgttaggggatttcgtcgatgagtatacagtgcgtgtagtggatgtgtttgcaatgcctcagagtggtactggtgtgagtgttgaagctgttgatcatgtttttcagaccaatatgcttgacatgctcaagcaaactgggagacctgagatggttgttggttggtatcactcacatcctggatttggctgctggctttctggtgttgacatcaatactcagcagagttttgaagcactgaatcaacgagcagtggctgtggtggtggatcctattcagagtgttaaagggaaggtggtaattgatgcctttcgcttgatcaatccccaaactatgatgcttggccaagagccacgacagacaacatcaaatctgggacatctgaacaaaccatctattcaagcattgatccatggtttgaacagacactactactcaatagccataaactacagaaagaatgaacttgaagagaagatgctactgaatcttcacaagaagaaatggacagatggacttgctctccagcgttttgatgctcattccaaaaccaatgagcagacagttcaggagatgttaaaccttgctgtcaagtataataaagcagtgcagcaggaggatgagttgtccccagaaaagctagctattgcaaatgtaggaaggcaagatgcaaagaagcatcttgaagaacatgtctcaaatttgatgtcttcaaacattgtccagacattgggaaccatgctcgacactgttgtcttctgaagttcatttctcccaactctggaaaagttgtgtttttagtagtgaaataggaacaattctttctgctgtttttttcctaagaaaatgagacctagtactttgtttctctgtgatagcagctgttatacaatatggttatgttatcttaagatgacttcggacataatagtgttttatcttctttactgaaccattttcctaattcagtgcctctcaatttcaag

SEQ ID NO: 1882 - DNA, 1177 bp, Raphanus sativus
gactgatttcatctgagattatggagagattacagcgaatcttcggcgccggcgggggtctaggccacgcatctcccgattccccaactctcgacacctcggagcaagtctacatctcctctctcgctctcctcaagatgctcaaacacgggagagctggagtgcctatggaggtgatggggttgatgctgggagagttcgtggatgagtacactgttagagttgtggatgtattcgcgatgccgcagagtgggactggtgtgagtgttgaagctgttgatcatgtttttcagactaatatgcttgacatgcttaaacagactggcagacctgaaatggtggtgggttggtatcattcacatcctgggtttggatgctggctttccggtgttgatattaatactcaacagagttttgaagctttgaaccagcgagctgtagctgtggtggttgatcctattcagagtgtgaagggtaaagtggtgattgatgctttccgctcgataaaccctcagaccattatgcttgggcaagagcctcgtcaaacaacgtccaaccttggccacctgaacaaaccatcgatccaggccttgattcatggattgaacagacactattattcaatagccatcaactacaggaagaacgagctcgaggagaagatgttacttaacctccacaagaagaaatggacagatggcctgacgctaagacgctttgacacccactccaagacaaacgaacagacggtgcaggaaatgttgaacttggctgctaagtataacaaggcggtacaagaggaggacgagttgtcaccggagaaactggcgattgtgaatgtgggaagacaagacgcaaagaagcatctggaagaacatgtttccaacttgatgtcttccaacattgttcagacactaggcaccatgcttgacactgttgtcttctagagagcttcttcacttttccagccagtaattgctatggttcaatcagttggctagaatgttgagctttgttcttcttatgcatctctttgttttctgttgaatcttctcttatgtcctacctcctagcacttgataagtttgtattgtactatccggtttccttctttctatgaaggccatggattgattactatttcattcaaaactaaatagtggtacttcaaattcca

SEQ ID NO: 1883 - DNA, 1198 bp, Raphanus sativus
ggctctcgaggttttataagatccaaaagcagctccgaagaagaagaagaagccgactgattttacctgagattatggagagattacagcgaatcttcggcgccggtggcggtctgggtcacgcatcgcctgattctcccacgctcgatacgtcggagcaagtttacatctcctctctcgccctcctcaagatgctcaagcacggaagagctggagttcctatggaagtgatgggattgatgcttggagagttcgtggatgagtacactgttagggttgttgatgttttcgctatgcctcagagtggtactggtgttagcgtcgaagctgttgatcatgtcttccagactaatatgctcgacatgctcaaacagactggaagacctgagatggtggtgggttggtatcattcacatcctggatttggatgctggctttctggtgttgatattaatactcaacagagttttgaagctttgaaccagcgagccgtggcagtggtggttgatcccattcaaagtgtgaaggggaaagtggtgattgatgcgttccgctcgataaacccgcagaccattatgcttgggcaggaacctcgacagacaacgtcgaaccttgggcatctgaacaaaccatcgatccaggccttgattcatggactgaacagacactactattcaatagccatcaactataggaagaacgagctcgaggagaagatgttactaaacctccacaagaagaaatggacagatggtctgacgctaagacgctttgacacccactccaagacaaacgaacagacggttcaggaaatgttgaacttggctgctaaatataacaaggcggtacaagaggaggacgagttgtcaccggaaaaactggcgatcgtgaatgtgggaagacaggacgcaaagaagcatctggaagaacatgtttccaacttgatgtcatccaacattgttcagacactaggcaccatgctcgacactgttgtcttctagagaacttgttcactttaccagctaggagtactctgcttcagtcattttggctggaaagttaagcttcgttcttctgcatctcttttgtttctgttgaatcaactctttatgacttatctcctagcaagcatctgataagattgtattgtaccaagtggtttcgttcttttcatcaaggctatggattgatttctatt

SEQ ID NO: 1884 - DNA, 1136 bp, Rhizophora mangle
aactctacttgtgttaccaaaccccagcgtcctgtttgcctagagagaaagctcgagaaagtgaaaaggaaaacgtatctccggcatggataggctccagagaatgttcgccggcgcgggaggctcgttggctcacccaccgccggattctccaactcttgattcttccgagcaggtctacatctcctcgctcgccctcctcaagatgctcaaacacggaagagctggagtgcccatggaagttatgggtttgatgcttggagagtttgtggacgaatacactgttcgtgttgtcgatgtctttgctatgccccagagtggtactggtgttagcgttgaagctgttgaccatgtgttccagactaatatgctagatatgcttaaacagaccggaagaccagagatggtcgtcggatggtaccattcacatcctggatttggatgttggctttctggtgttgatataaacacacagcagagttttgaagctcttaatcaacgggctgtggcagtggtggtggaccctattcagagtgttaaagggaaggtagtgattgatgcttttcgtttgataaatccacaaacaatgatgctcggccaagaaccacgacagacaacttccaaccttgggcatctgaataaaccatctattcaagcactgatccatggattaaacagacactactactcgatagccattaactataggaagaatgaacttgaggaaaagatgcttcttaacctgcacaagaagaaatggactgatggattgacacttcggcggtttgattatcattctaaaaccaatgagcaaacagttcaggagatgctaaacctggccattaaatataacaaggctgtgcaagaggaggatgagctgccacctgagaagctagcaattgtaaatgttggaaggcaagattcaaagaagcatcttgaagagcatgtctccaaccttatgtcttccaacattgttcagaccttgggtaccatgcttgacacagtcgtgttctagggacatttttcaattttcgcttctctcttctgtctgtttcaggtagaacgaacctggattttttgtttcacactgcagtcgatttctagttctttcttctgttacatcatactgggcgtaa

SEQ ID NO: 1885 - DNA, 1536 bp, Sequoia sempervirens
gggagaataggctgttgatattatttttcttccagttttaggctaccgcacggtcatatcaggcatggagagattgcagaggatattttcaggcgcgggcggcatgggaccgcctgctacagatggccctatgctggattcctcagagcaggtctacatttcgtcgctcgccctccttaaaatgctcaagcacggtagagctggagtaccgatggaggttatgggactgatgcttggtgaatttgttgatgagtacacagttcgagttgtagatgtatttgctatgccccaaagtggtactggagtaagtgttgaagcagttgatcatgtttttcagacaaacatgcttgacatgcttaagcagactggcagacaggagatggttgtaggatggtaccattcacatcctggttttggatgttggctatcaggtgttgatattaacacccagcagagctttgaggctcttaatccacgagctgttgctgtggttgttgatcctattcaaagtgtaaagggaaaggttgtgattgatgcattccgcttaatcaatccacaaactatgatgcttgggcaggagcctcgacaaacaacttccaatcttgggcatctgaataaaccatcaattcaagcattgatccatggtttgaatcgacattattattctattgctattaactatcgaaaaaatgagttagaagaaaagatgttactcaacttacataagaagaaatgggctgatggtctgaccctgcaacgctttgattgtcatgctaagacaaatgaactgacagttcaggaaatgcttgatcttgcagtcaagtataataaagctgtacaagaagaggatcaactacctcctgaaaagcttgctattgccaatgtagggagacaagatgctaaaaagcatctggaggaacatgtatcgaatctgatgtcttcaaacatagtacagaccctagggaccatgcttgatacggttgttttctaacttgattgtgtctagtatcattgaggtcccagaaacaagtaaacatcttttgctttcacatctctgcatttatcaaaataagcaggcatcaaatgaaaggagtgttgaccaaacctctgagatctttatttattagaatttagaatgagactgcatattcaaggaatcaaggatttgtcaaaatttggtcaaagctcaatagtcatggatccgacggctgagatttcacatcactatggttcaaactgcaattgaagtgaaatgattgtgattgacagactatcaagtgtacaatattagtatatcgattattttgatgtttgaggtgtttttgaaatttaaatgtatgcaaaaagcacacatgaaaacaaagattggtgttttaaccttgatgttgattggtgggtgtttattcttttgtagtctaattgtttaatattttcttgtagtagctgctatatcaagaatcagaaacttgtcagctgagatgctgacagataaattaaggaaggtgatatttaccagagatgaactctggacctggg

SEQ ID NO: 1886 - DNA, 1252 bp, Solanum phureja
gatcaaagaaatttacagtcgctcgcagtagtcttgttctctaagaaatccaaaaagcaaagcaaaacccaatcggagagcatgtctggaatggaaagattgcagcggatgttcgccggagctggtggcgcgttgggacacccgccaccggactctccaactctggactcttctgagcaagtctacatctcttctcttgccctcctaaagatgcttaaacacgggagggctggagttcctatggaggtgatgggattgatgttaggggatttcgtcgatgagtatacagtgcgtgtagtggatgtgtttgcaatgcctcagagtggtactggtgtgagtgttgaagctgttgatcatgtttttcagaccaatatgcttgacatgctcaagcaaactgggagacctgagatggttgttggttggtatcactcacatcctggatttggctgctggctttctggtgttgacatcaatactcagcagagttttgaagcactgaatcaacgagcagtggctgtggtggtggatcctattcagagtgttaaagggaaggtggtaattgatgcctttcgcttgatcaatccccaaactatgatgcttggccaagagccacgacagacaacatcaaatctgggacatctgaacaaaccatctattcaagcattgatccatggtttgaacagacactactactcaatagccataaactacagaaagaatgaacttgaagagaagatgctactgaatcttcacaagaagaaatggacagatggacttgctctccagcgttttgatgctcattccaaaaccaatgagcagacagttcaggagatgttaaaccttgctgtcaagtataataaagcagtgcagcaggaggatgagttgtccccagaaaagctagctattgcaaatgtaggaaggcaagatgcaaagaagcatcttgaagaacatgtctcaaatttgatgtcttcaaacattgtccagacattgggaaccatgctcgacactgttgtcttctgaagttcatttctcccaactctggaaaagttgtgtttttagtagtgaaataggaacaattctttctgctgttttttttcctaagaaaatgagacctagtactttgtttctctgtgatagcagctgttatacaatatggttatgttatcttaagatgacttcggacgtaatagtgttttatcttctttactgaaccattttcctaattcagtgcctctcaatttcaagactattt

SEQ ID NO: 1887 - DNA, 1505 bp, Glycine max
cttggccgaaacgtcaacctttgcgacgtcgtatttaagcgtctctggaaaaccataagcgaagcaagcaatcatttcttcgtttcttttcgtgaaacaaaagaaaacaaaagattaggttttgtgatgtcgggcatggagaggcttcagaggatgttcgcgggtgcaggtggagcgctgggccatcccccaccggattcccccaccctcgattcctccgagcaggtctacatctcctccctcgcccttctcaaaatgctcaaacacggaagagctggggtacccatggaagtgatgggtctgatgttgggggagttcgtggatgagtacaccgttcgcgttgtggatgtgtttgcgatgcctcagagtgggaccggtgtcagcgttgaagctgttgatcatgtttttcagactaatatgcttgatatgttgaagcaaactggaaggccggagatggttgtggggtggtatcactcgcatcctggatttgggtgttggctttctggagtggacattaatacgcaacagagttttgaggctttaaatcaacgggcagtggctgtggtggtggaccccattcagagtgtgaaaggcaaagtggtaattgatgctttccggctgattaatccacaaactatgatgctaggtcaggaaccacgacagacaacttccaacctgggccatctaaacaagccatctatccaagctctgatccatggcttgaatagacattattactccatagcaattaattacagaaagaatgaacttgaagagaagatgttgcttaaccttcacaaaaagaagtggactgatggtttgacactcaggcattttgattcacattctaaaactaatgaacagactgttcaggagatgctaagtttagcagccaagtacaacaaggcagtgcaggaggaagatgaactgccaccagaaaaacttgcaattgcaaatgtggggaggcaagatgctaagaagcaccttgaagagcatgtttccaatttgatgtcatcaaacattgttcagactttgggaatgatgcttgacacggttgttttctagagttagctagcatcgtccattgtattgttccttactatagttagcaacatttcattaatactcttgacatgtttgttaacagaaattgttttattgtaagtttttgcattttgtgttttctttaaaatgcaggagcaaagctacattacatgttagaggatgaaaatcatattttaatctctctaaatgtaatggaggtcttcgtgatcgtgcgccagttttatttgtttatttggcagccgtaggattttacatataaacaaagtgttgattcagttgtaattggaatcgcggagcaactaaaactgcgtgtgaactttagtactataatttacaatattgagtgaattgttattcctgaaatagtaaggatcagtcaaactggtttctaaaataaataaaatagcaaattagtttctaaatttgtaaattattaatcc

SEQ ID NO: 1888 - DNA, 1432 bp, Glycine max
tgatcgaaacgtcaacgtctgcgacgtcgtatttaaccgtctccgggagccataagcgaagcaacgtttcttcctcttcccagttccctgcaacattaacaagagcacaacagaacagagggagcacacaatctttcttcattcttttcgtgaaacaaaagaaaactgaaattaggttttcatgtcgggcatggagaggcttcagaggatgttcgctggtgcaggtggagcgctgggtcatcccccaccggattctcccaccctcgattcctccgagcaggtctacatctcctccctcgcccttctcaaaatgctcaaacacggaagagctggagtaccgatggaagtgatgggtctgatgttgggggagttcgtggatgagtacaccgttcgcgttgtggatgtgtttgcgatgcctcagagtgggaccggtgttagcgttgaagctgttgatcatgtttttcagactaatatgcttgatatgttgaagcagactggaaggccggagatggttgtggggtggtatcactcgcatcctggatttgggtgttggctttctggagtggacattaatacacaacagagttttgaggctttaaatcaacgggcagtggctgtggtggtggaccctattcagagtgttaaaggcaaagtggtaattgatgctttccggctgattaatccacaaactatgatgctgggtcaggaaccacgacagacaacttccaacctgggccacctaaacaagccatctatccaagctctgatccatggcttgaatagacattattactcgatagcgattaattacagaaagaatgaacttgaagagaagatgttacttaaccttcacaaaaagaagtggactgatggtttgacactcaggcattttgattcacattctaaaactaatgaacagactgttcaggaaatgctaagtttagcagccaagtacaacaaggcagtgcaggaggaagatgagctgccgccagaaaaacttgcaattgctaatgtggggaggcaagatgctaagaagcaccttgaagagcatgtttccaatttgatgtcatcaaacattgttcagactttgggaatgatgcttgacacggttgttttctagagttagcatcgtccaatgtattattccttactatagtcagcaacatttcattaatactcttgacatgtttgttaacagaagttgttttatcatgagtttttgcattttgtgtgttcttacgaatgcaggagcgaagttacatgttagaggatgagaatcatattttaattttaatctctctaaatgtaatggagatcttcgtgatcgtgcgctagttttattccgcattaggattttacatataaacaaagtgttgattcagttgtaagtagaaacacggagcaattaaaactgcatgtgaattattatccc

SEQ ID NO: 1889 - DNA, 1116 bp, Helianthus annuus
gcggggatgcatatttgtcggtaaaaaccttcagttccggggagatcttgtcttgttacccaagaaattcaaatctgttgatcggaacgcaatgtcagggatggaacggctacagaggatgttcgccggagccggaggcgcgttaggtcatccaccacctgactctccgacgctcgatacatcggagcaagtttacatctcctcactagccctcctcaagatgcttaaacacgggagagcgggagtgcctatggaagtgatgggattgatgcttggtgaatttgttgatgagtatacggttcgggtggtggatgttttcgctatgccacagagtggtactggtgttagtgttgaagcggttgatcatgttttccagactaatatgcttgatatgcttaaacaaactgggagaccagagatggtggttggatggtaccattcacatcccggatttggttgttggttatctggagttgacatcaacacacaacagagttttgaagctctaaatcaaagagccgttgcagtggtggtggatccaatccagagtgtgaaagggaaggttgtaatcgatgccttccgccttataaacccgcaaaccatgatgctcggccaagaaccacgccaaacaacatccaaccttggccatcttaataaaccgtccatccaagcactgattcacgggttgaatagacactactattcgatagctattaattacaggaagaatgaacttgaagagaagatgttattgaaccttcacaagaagaagtggactgatggattgaaactcgaacgatttgatgcccattcaaaaaccaatgaacagactgtccaggagatgctgagtctagccatcaaatataacaaggcggttcaggaagaagacaaactgtctccggagaagctagcaattgcaaatgtgggaagacaggatgcaaagaaacatctagaagaacatgtctccaatctcatgtcatccaatatcattcagacattaggtacaatgctcgacacggtttctttctagagttctgatcattcgtgttttggtacattattgaccgtgcttttttacttgatttaatatctttttacaagactcgtgtacacatg

SEQ ID NO: 1890 - DNA, 1734 bp, Eutrema halophilum
gatccatcatctccgtcttgtcttgttaataaagaaaactctcgaggttttataagatctccccattgttgtagccagcaacccagaagaacacgactgatttatctgattatggagagattacagcgaatcttcggcgccggtggcggtttgggtcacgcatcgcctgattctccgaccctcgacacgtcggagcaggtttacatctcttctctcgccctcctcaagatgctcaagcacggaagagctggggttcctatggaagtcatgggactgatgcttggagagttcgtggatgagtacactgttcgagttgtggatgtctttgcgatgcctcagagtggtactggtgttagtgtggaagctgttgatcatgttttccagactaatatgctcgacatgcttaaacaaaccggaagacctgaaatggtggttggttggtatcattcacatcctggatttggctgctggctttctggtgttgacattaacactcaacagagttttgaagctttgaaccagcgagctgtagcagtggtcgtagatccgattcaaagtgtgaagggcaaagtggtgattgacgcgttccgctcgataaatccacagaccattatgcttgggcaagaacctcgtcaaacaacatcaaaccttgggcacctgaacaaaccatcgatccaggccttgattcatggattgaacagacactattattcaatagccatcaactataggaagaacgagctcgaggagaagatgttactaaacctccacaagaagaaatggacagatggcctgacgctaaggcgctttgacacccactcccagacaaacgaacagacggtgcaggaaatgttgaacttggctgctaagtataacaaggcagtacaagaagaggacgagttgtcaccagagaaactggcgatcgtgaatgtcggaagacaagacgcaaagaagcatctggaagaacatgtttccaacttgatgtcatccaacattgttcagacacttggcaccatgcttgacactgttgtcttctagagatcttctcacttttccagccagtagtactttgctttaatcatttggctcctaagttgagctttgttcttcttctgcaatttaatttctgttgaatcttctccttatgtcttatctcctagcatttgacaaggttgtattgtactatgtgattttgcattaagccaatggattgatttctattcttgcagtgatttcagatttttctctcgttttccgaaatgaaggggcaaagtatgagtgttttgtataaatacacttatcgaaacccttatatatggttgatatactttattattccgggaagaaactcaacaaagaaggaaaaagggagaaagctaccgcacccaatctacgttaaattccacatcataatatacaaaaaactgtagtaggatttgtgaagacaggaacttcatcttcagaaagagcaagtagaaaccaaaacgagctcaaagataagccataggtggactactagcgcttttagtgttcttggtgcatcaaacaagtcaagctttgaatacatttggaggagaccgaccaatcgttcaaacagagcacaattgttgagggacgaaaaattgttgagtccatgtgtatatggctctgcttaaaactcggtgtcgaaacaagtcatgaagacctttgagaccatggtccttgcaaaagggatgtagctcaagctatacctgc

SEQ ID NO: 1891 - DNA, 1018 bp, Eutrema halophilum
atcgtcttgtaattcatggagagattgcagcgaatcttcggcgcggggagcggtttaggtcacccatcgcctgattctccgactctcgatacgtcggagcaggtttacatctcttctctcgccctcctcaagatgctcaaacatggaagagctggggttccaatggaggtcatgggattgatgctcggagagttcgtggatgagtacactgttcgagttgttgatgtatttgcgatgcctcagagtggtactggtgttagtgtggaagctgttgatcatgttttccagactaatatgctcgacatgcttaaacagactggcagacctgagatggtggttggttggtatcattcgcatcctggatttggctgctggctttctggtgttgacattaatacccaacagagttttgaagctttgaatcagcgagcagtagcagtggtggtagatccaattcaaagtgtcaagggcaaagtggtgattgatgcgttccgctcgattaatccacagaccatcatgcttgggcaagaaccccgtcaaacaacttcaaacctcggccacctgaacaaaccatccatccaggccttgattcatggattgaacagacactattactcaatagccattaactataggaagaacgaacttgaggagaagatgctactcaacctccacaagaagaaatgggcagatggtctgaatctaagacgatttgacactcactccaagactaacgaacagaccgtccaggagatgttgagcttggcagcgaaatataacgaggcggtacaagaggaggacgaattatcacctgagaaactggcgatagtgaacgtggggagacaagacgccaagaagcatctagaagaacatgtctccaacttgatgtcgtcaaacattgttcagactctaggcaccatgctcgacaccgttgtcttctagacaggccgcttcttacttgttgaatatgattttcccagataattcttggtttttttttcttcttctgaatctcttt

SEQ ID NO: 1892 - DNA, 1369 bp, Triphysaria pusilla
cgtgtttccaaagaaatctacactaaaagcaaaacgaaaagaaaatctgtgagaaaatacacgacaacggccggcatggaaagaatacaccggatgttcgccggcgctggtggctctctcggccatcctccgccggactcccctacactcgactcctccgaacaagtatacatctcatctcttgctcttctcaagatgctgaaacacggtagggctggtgtgccgatggaagtgatgggtctgatgctgggggagtttgtggacgagtacactgtgcgtgtggtggacgtattcgcaatgcctcagagtggaactggggtcagtgttgaagccgttgatcatgttttttcagacgaatatgcttgacatgctcaagcaaactggcagacctgagatggtagttggttggtatcattcacatccaggatttggatgctggctctctggtgtagacatcaacactcagcagagttttgaagctttgaatcagagagcagtggcagtagtggtggaccccattcaaagtgttaaaggcaaggtggtaattgatgcctttcgtctcattaacccccaaacaatgatgctcggtcaagagccacgtcagacaacttccaacttagggcatctcaataaaccatctatccaagccctgatccatggtttgaacagacattattactccatagccataaattacaggaagaatgaacttgaggagaagatgcttctgaatcttcacaagaaaaaatggacagacggtttgaccctccagcggtttgatgcccactccaaaaccaatgaacagaccgtcgaggagatgctaaatctagcagttaaatataataaagcagttcaggaggaggatgagctatcagctgagaaactagcgattgctaatgttggaagacaagatgccaagaagcatctcgaagaacacgtatcgaacctcatgtcttcaaacattgttcagacattggggacaatgctggacacggtcatcttctagatttttgggtttggatgacggtacgtgacttacctactgatatttctcatcaacgtgacagctcatctaagttactctagtaaagaatccgtgtcacaagtactttcatgctcttgaaaatttgctcttcaatttatattatcagaactaagctcgagtcaagttgcaggaaagaggaaagaatcaagtcgcaaatattttcatgctcttgaattttcatgcttttcaatacccaattattgataaactatgaatttacttatggtatgtgttctatataaatcatattctatgtctattgttataaaatcgtctgtttaaaaaacaaattatcatttgtcaattttttttcatgatgggact

SEQ ID NO: 1893 - DNA, 1174 bp, Phalaenopsis aphrodite
ctataatcgtaaggcttctaccgattttctctggcgctgagtcgatgggtccatccgccacccgattctccgctcctcgactcatccgaggcaggtctacatctcatcgcttgctctctcagatgcttaagcacggcagggcggggtgcccatggaggtgatgggcttatgctcggagaattcgtggatgaatataccgttcgagtggtcgatgtcttcgccatgcctcagagcggcactggagtcagtgttgaggccgtcgatcacgtcttccagaccaacatgctcgatatgctaaagcagaccggaaggcctgagatggtggtagggtggtaccattcccatcctggatttggttgttggctgtctggcgttgatattaacacccagcagagctttgaagccttgaatccgagagctgttgctgttgtggtcgaccccatccagagtgttaaagggaaggtggtgatcgatgctttccgtttgatcaacccgcagaccatgatgctcgggcaagagcctcgccagaccacttccaacttgggacatctcaacaaaccctccatccaggcactcattcatgggctgaaccggcactactactctatagccatcaattatcggaaaaatgagctggaagagaaaatgcttctgaatctgcataagaagaaatggacggatggcttaacgttgagacgatttgatgcccattcaaaaaccaatgagcaaacggtgcaggagatgctaaacttagctataaaatataacaaagcggtccaagaggaggatgaactgccgccggagaaattggccatcgcgaacgtgggcaggcaagatgcaaagaagcatttggaggagcatgtctccaatctaatgtcctccaatatagtccagaccctcggtactatgcttgatacggtagtcttctagtcttcctacatctcacctcaccattttgttttatgcttccctggaatcaactcttattgacagtctctctgtgcattgtttacttcatcagttgaatgtctcctttataattgtttggaactgctttaattaatagtagaggaggagacgttattcaggttactttggtgtggctttctttgtatgaacggaggacttgtccgatgcgcttttaatagaatgaatgtgttgcgactgcctttag

SEQ ID NO: 1894 - DNA, 1225 bp, Zostera marina
accagattgaatttcttttgttttgctccccaagaaattctgcttttgttattctccgctgattcaaaccctaagccgaccttcgatcgaaatcaggagtgaggaagatggagagattgcaaagaatgctttcaggtgcacatcctccgtcagattctccgctactggactcgtcggaacaggtctacatctcgtcactcgcactgcttaagatgctcaaacacggaagagctggggttcctatggaagtcatgggtctgatgcttggtgaatttgtggatgaatatactgttcgagtcgtagatgtgtttgccatgccgcagagtggtactggtgtgagtgttgaagcagttgatcatgtttttcaaactaacatgcttgatatgctaaagcaaaccggcagacctgaaatggttgttggttggtaccattcccatccaggttttggctgttggctttccggtgttgacattaacacgcaacagagctttgaagcgttaaatcaaagggcagtggcggtggtggttgatccaatccaaagtgtgaaaggaaaggttgttattgatgctttccgtctgatcaatccgcaaacaatgatgcttggccaagagccacgtcaaacaacatccaatcttggatatctgaacaaaccatctatccaagcactcatccatggcttgaaccgacattattattctattgccatcaattacaggaaaaacgaacttgaggagaaaatgttactgaacttgcataagaagaaatggactgatggcttgaccctgcgtagatttgatacacattccaatactaatgagcaaactgtgcaggagatgctgaatttggcaatcaaatacaacaaggcagttcaggaagaggatgaacttccaccagaaaaacttgcaatcgccaatgtaggaaagcaagatgccaagaagcatttggaggagcacgtctcgaatctgatgtcatcgaacattatccaaactttaggcacaatgcttgacactgttgtcttctaagccttgcatttgatttcaatgtacttgtatttgaagatcctagagtactacaaaagaaggtttcatattgctcaaactcaaactgctgttctcaagtattttctatccttattcccttcatcgaatcttaatcaatttcctaggattattattttaaatcaaatgagtacaattttttatttcgcaaaccctgattgtttttg

SEQ ID NO: 1895 - DNA, 1304 bp, Trigonella foenum-graecum
cacacacataaaaaatcattcttaacttgttgacaaagaaaacaaattctatattttcatcaattttcagttccaacaatcatgtcaggtatggaaagacttcaaagaatgttcgcgggtgcaggtggagctctaggcggccatccaccaccggattcccccacgctagattcatctgagcaagtttacatctcctctctcgctcttctcaaaatgctcaaacacggtagggctggtgttcctatggaagttatgggtttgatgttgggggagtttgtggatgagtatactgtaagggttgttgatgtttttgctatgcctcagagtggtactggtgttagtgttgaagctgttgatcatgtttttcaaactaatatgcttgatatgttgaaacaaactggaagaccggagatggtcgtaggttggtatcattcacatcctggattcggctgctggctttctggagtggatattaacacacaacagagttttgaggctttaaatcaacgggcagtggctgtcgtggtggatcctattcagagtgttaaaggcaaggtggtgattgatgctttccggttgattaatccacaaactatgatgctgggtcaagaaccacgacagacaacctccaacctgggccatctgaacaagccatctatccaagctcttatccatggcttgaacagacattattactcaatagcaatcaattacaggaagaatgagcttgaagagaagatgttgcttaaccttcataagaagaaatggaccgatggtttgacactcaggcgatttgattcacattctaaaactaatgaacaaactgttcaggagatgctgagtttagcaaccaagtacaacaaggcagtgcaggaggaagatgagctgccaccagaaaaactagcaattgccaatgtgggaaggcaggatgctaagaagcaccttgaagagcatgtttctaatttaatgtcatcaaacatcgttcagactttgggaatgatgctcgacacagttgtattctagagttaggattttcgagtattgtattttccttcatgatgtccggcaatatttcattaacactctttgagctgtttgttaacggattgttttttattacaaggttatttgcttttgtacgtgttcgtctcaaatgtttcagaactagaatcatatttttatctatggagatcctggggactctgcccaagagtcttagaatgcacttgatattattattttttgtttatgtttgtgatactttggtgtgaaaatccttaaccaaggcttatccctcaataatc

SEQ ID NO: 1896 - DNA, 1292 bp, Vaccinium corymbosum
aaaatgtctgggatggagagattgcagaggatgttcgccggtgccggcggtgcgttgggacacccgccgccggactcgccgactctcgattcagcggagcaagtttacatctcttccctcgccctccttaaaatgctcaagcacggaagggctggagtgccgatggaagtgatggggctgatgttgggggaatttgtggatgagtacactgttcgtgtcgttgatgtatttgcaatgccgcagagtggtactggtgttagtgttgaagccgttgatcatgtttttcagactaatatgcttgatatgctcaaacaaactggaagaccggaaatggtggttggatggtatcattcacatcctggatttggctgctggctctctggtgtggacattaacactcaacagagttttgaagctttgaatcaacgtgccgtggcagttgtggtggatcccattcagagcgtcaaggggaaagtggtcattgatgcgttccgtttgatcaacccacaaactatgatgcttggccaggagccgaggcagacaacatccaaccttggtcatctgaacaagccatccattcaagcattaatccacgggctgaacaggcattattactcaatagccataaattacaggaagaatgaactagaggagaaaatgttactgaaccttcacaagaagaagtggactgatggattgacactccagcgctttgatacccattcaaaaaccaatgagcagactgttcaggagatgctgaatctagctattaagtataacaaggcagtgcaggaagaggatgagttgccaccagagaagctagctattgcaaatgtgggaaggcaggatgctaagaaacatctcgaagaacacgtctccaatctgatgtcttccaacataattcagactttgggcaccatgctcgacacagttgtgttctaaggtttagttttttgttctccatcctattgtacttcagcggcagttgaagttgaaaaccgatgtgggtacgatctactccttgcaattgaaatgcttcctttagaacgaaagaaagggggaggtaaaggtactgtggaaatgtgatactgttgcgaaataggggtttggtcttgcttgcgtagctctcttcctgatttgtatttctagttcattccatttcaaatctttctcataaagtcagaattagtagatttcatatgcttgtttgacggaatctttccttcagcatatgattatatgtttttgttgaaaaatgtacacaatcacccctaaggtgtgttttggaacct

SEQ ID NO: 1897 - DNA, 1357 bp, Gossypium raimondii
acatgggaccaaggtttcatttgtcttgctaccaaagaaaagttttctgaaaactccgatcgacaatgtcaggattggaccgtttgcaaaggatgttcgccggtgctggcggcgctttgggtcatccgccgccggattccccgacccttgattcttcggagcaggtctatatctcctctctcgccctcctcaaaatgctcaagcatggaagagctggagttcccatggaagttatgggtttgatgttgggagagtttgttgatgagtacactgtgcgtgtcgtggatgtctttgcaatgccacagagtggtaccggtgttagtgtcgaagctgtggatcatgttttccaaacgaatatgcttgacatgctcaaacaaactggaaggccagagatggttgtgggttggtaccattcacatccaggattcggctgctggctttctggtgtcgacataaacacacagcagagttttgaagctttgaatcaaagggctgtagcagtggtggtggacccaattcagagtgttaaggggaaggtggtaattgatgcattccgtttgatcaatccacaaaccatgatgcttggccaagaaccacgtcagacaacttcaaatctagggcatcttaataagccatctatccaagccttgatccatggactaaatagacactactactctatagccattaactacagaaagaatgaacttgaggaaaagatgctattgaatcttcataaaaagaagtggacagatggactgacacttcggcgttttgatacccattcgaaaaccaatgaacagactgttcaggaaatgctgaatttagctataaaatacaacaaggcagtgcaggaggaagatgaattaccccctgagaagctagcaatagcaaatgttgggagacaagatgccaagaagcacttagaggaacacgtctcaaacttgatgtcctcaaacatagttcagactttgggaactatgcttgacactgttgtgttctagactcttagcatctgtattaacttctttaagttaatgaattgcatctatattgatatcatatattgttggtcaagtgcactgttcatgcattgttgtgaagattcaaagagactatcatgttgattcattaaaattttttatgctttcttctctctcaccctccctcactctgtgtatgtgttgagatttcattagcattttggcatatgtttatgtgtttatgcctatattcagcgttttgtgttgagacacatcattttgaaaaaggtatctcataaaagaacctttaaaaaagaaaaggtggagaaaaagaaactgaagggcaatcttaacaagtgcctatttcccgaata

SEQ ID NO: 1898 - DNA, 1168 bp, Ambrosia trifida
ccccttgcacataaacacatttagaaaacacttgtgtttggagatcttgtcttgttaccaaagaaaactccatactctgttgatcaacaatgtcagggatggaacgcctacaacgaatgttcgccggagccggcggcgccttaggccacccaccaccggactctccgactctcgacacctcagagcaagtttacatctcttctttagccctattaaagatgcttaaacatgggagagctggagtgcctatggaagttatgggattgatgcttggggaatttgttgatgagtatacggttcgggtggtcgatgttttcgctatgccccagagtggtactggtgttagtgttgaagctgttgatcatgtttttcagactaatatgcttgatatgcttaaacaaactggcagaccagagatggtggtcggctggtaccattctcatcctggattcggttgttggttatctggagtcgacatcaacacacaacagagttttgaagctctaaatcaaagagctgttgcagtggtggtggatccgatccagagtgtcaaagggaaggtcgtgattgacgccttccgtcttatcaacccccaaaccatgatgcttggccaagaaccacgccaaacaacttccaatcttggtcatctcaataaaccatcaatccaagcactgatccatgggttgaacaggcactactattcaatagctattaattacaggaagaatgaacttgaggagaagatgctgttgaatctccataagaagaagtggaccgatggattaaaacttgaacggtttgatacccattcaaaaaccaatgagcagactgtccaggaaatgctgactctagccatcaaatataacaaagcggttcaggaagaggacgaactatctccagagaagttagctattgcaaatgtgggaaggcaggatgcaaagaaacatcttgaagagcacgtctcgaatctcatgtcatccaatatcattcagacacttggtacgatgctcgacaccgtctctttctagagtctactctgtattttctgtttggcagttggcacaatgattaaccattttcttgcaagtcattagtagggaaaaaagagttgacttcatagttttttattaccaactcttattatcttgatgttcgatgcaaaaaagaa

SEQ ID NO: 1899 - DNA, 1134 bp, Cirsium arvense
aaaagagagcttaatcgccggtgaaagaatatgtcaggtatggagcggctacagagaatgttcgccggtgccggcggcgcgttaggtcacccgccaccggattctccgactcttgatacatcggagcaagtttacatctcttcacttgccctattaaagatgcttaaacacggtagagctggagttcctatggaagtcatgggtttgatgcttggggaatttgtggatgagtatacggttcgtgtggtggatgtgtttgctatgcctcagagtggtactggtgttagtgtggaagctgttgatcatgttttccaaactaatatgcttgatatgcttaaacaaaccggaagacctgaaatggtggttggatggtaccattcacatcctggatttggatgttggttatctggagttgacatcaacacacaacagagttttgaagctctgaatcaacgagcggttgcagtggtggtggatccaatccagagtgttaaggggaaggttgtgatagatgcattccgcctaattaacccccaaaccatgatgcttggccaagagccccgtcaaacaacttccaatcttggtcatctcaataaaccatccatccaagcactgatccatggtctgaacaggcattattactcgatagccattaattacaggaagaataaactcgaggagaagatgctactgaaccttcacaaaaagaagtggaccgatggtttgacacttgaacgctttgatacccattcaaaaaccaacgagcagaccgtccaggaaatgttgagtttggctattaaatataacaaagcggttcaggaagaggacgagctacctccagagaaactagcgattgcaaatgtgggaagacaggacgcaaagaagcatctagaagagcacgtgtcgaacttaatgtcgtccaacatcattcagacgttgggcaccatgctcgacaccgttgtcttctaaactcacgattctatgctatattttccatgtattatgtactctttgcaagtgattttagaaagcaactgttcaagtttgtttatgagaccatgatgcttttattcttacatttttaccctctgaaatccggatattgttctgtgcttgtgggttattgacttagac

SEQ ID NO: 1900 - DNA, 1147 bp, Cirsium arvense
gaaagaatatgtcaggtatggagcggctacagaggatgttcgccggcgccggcggcgcgttaggtcacccgccaccggattctccgactcttgatacatcggagcaagtttacatctcttcacttgccctattaaagatgcttaaacacgggagagctggagttcctatggaagtcatgggtttgatgcttggggaattcgtggatgagtatacggttcgagtggtggatgtgtttgctatgcctcagagtggtactggtgttagtgtggaagctgttgatcatgttttccaaactaatatgcttgatatgcttaaacaaaccggaagacctgaaatggtggttggatggtaccattcacatcctggatttggttgttggttatctggagttgacatcaacacacaacagagttttgaagctttgaatcaacgagcggttgcagtggtggtggatccaatccagagtgttaaggggaaggttgtgatagatgcattccgtctaattaacccccaaaccatgatgcttggccaagaaccacgtcaaacaacttccaatcttggccatctcaataaaccgtccatccaagcacttatccatggtctgaacaggcattattactcgatagccattaattacaggaagaataaactcgaggagaagatgctactgaaccttcacaagaagaagtggactgacggattgacacttgaacgctttgatacccattcaaaaaccaacgagcagaccgtccaggaaatgctgagtttggctatcaaatacaacaaagcggttcaggaagaggacgagctacctccagagaaactagcgattgcgaacgttggaaggcaggacgcaaagaagcatctagaagagcacgtgtcgaacttaatgtcgtccaacatcattcagacgttgggtaccatgctcgacaccgttgtcttctagactcgagatgctatcttatattttccatgtattatgtactctttgcaagtgattctagaaagcaactgttcaagttcgtttatgagactatgatgcttttattcttacatttttaccctctgaaatccggatattgttctgtgctttgtgggttatcgacttagacatgttggtcgttaaatattagccatgtcggctgt

SEQ ID NO: 1901 - DNA, 1114 bp, Cirsium arvense
cgggaaaagagcaaactccggcaaaagaatatgtcaggtatggagcggctacagaggatgttcgccggcgccggtggagccttaggtcatccgccaccagattctccgactcttgatacatcggaacaagtttacatctcttcccttgccctcctaaagatgcttaaacacggtagagctggagttcctatggaagtcatggggttgatgcttggggaattcgtggatgagtatacggttcgtgtagtagatgtgtttgctatgcctcagagtggtactggtgttagtgttgaagctgttgatcatgttttccaaactaatatgcttgatatgcttaaacaaaccggaagacctgaaatggtggttggatggtaccattcacatcctggatttggttgttggttatctggagttgacatcaacacacagcagagttttgaagctctgaatcaacgagcggttgcagtggtggtggatccaatccagagtgttaagggaaaggttgtgattgatgctttccgactaattaacccccaaaccatgatgcttggccaagagccacgtcaaacaacttccaatcttggccatctcaataaaccatccatccaagcattgatccatggtttgaacaggcattattactcgatagccattaattacaggaagaataaacttgaggaaaagatgcttttgaaccttcacaaaaagaagtggaccgatggattgacacttgaacggtttgatacccattccaaaaccaatgagcagaccgtacaggaaatgctgagtttggctatcaaatataacaaagcggttcaagaagaggacgagctaccaccagagaagctagcaatcgcgaatgttgggaggcaggatgcaaagaagcatctagaagagcatgtgtcgaacttaatgtcgtccaacatcattcagacgttgggtaccatgctcgacactgttgtcttctaaacttgaaatactatattttcccgtgtattatgtacttttgcaagtgatttttagaaagcaacagttgtttgtttatgagattatgaatgcttttattcttaaattttattctctaaaagtatggatatttttcttaacaaaaaag

SEQ ID NO: 1902 - DNA, 1261 bp, Citrus sinensis
aaaaaaaaaaaaaaaaatcatatcgacgagaaggttttgaggaattgaaaaaaagctagaacatgtcaggtatggagcgattgcaaagaatgttcgctggtgccggtggcgccttgggtcacccgccaccagactccccgactcttgattcatcggagcaggtctacatctcctcactcgcgctcctcaagatgctcaaacacggtagagctggtgtgcccatggaggtcatgggtctgatgctgggagagtttgtggacgagtacacagttcgggttgttgatgtgtttgctatgccacaaagtggaactggtgttagtgttgaagctgttgatcatgtgttccagactaacatgcttgacatgctcaagcagactggaagaccagaaatggttgttggatggtatcactcacatcctggatttggttgctggctctctggtgttgacataaacacacagcagagttttgaagctttgaatcaaagggctgttgctgtggttgtggatccaatccagagcgtgaaagggaaggtagtgattgatgccttccgcttgattaatccccaaaccatgatgcttggccaagaaccacggcagacaacttccaatcttggtcatcttaataagccatccatccaagcattgatccatggcttgaatagacattattattctattgccatcaattacaggaagaatgaacttgaagaaaagatgctactaaatctgcacaagaagaaatggactgatggattaacacttcatcgctttgattgccattccaaaaccaatgaacagactgtccaggagatgttaaatttggctgtcaaatataacaaggcagttcaagaagaagacgagctgccgccagagaagctggccattgctaatgtgggaaggcaagatgcaaagaagcaccttgaggaacatgtctccaacttgatgtcctcaaacatagttcaaactttgggaaccatgcttgatacagtcatattctagatgttggtttgttttctgtagttttcactagcttcactcttgtttgactatttgtatggcatttacagtttgaatttgtgctttataatttaacattttaattctgaaggcctatccttttgtcatggatgtgctggtttgtgctgaaacgtagtatatgattgtggcttactttttatgtggttggacaattcattgctgtattttgcactcagttttgatgctaggcaatgcaaaaattagttttgagttttaaaaaa

SEQ ID NO: 1903 - DNA, 1611 bp, Citrus clementina
aaaatatcatcgcctgcctttccccggaaaaaaaaaaaaagaaaaaagaaaaaaaaatcatatcgacgagaaggttttgaggaattgaaaaaaagctagaacatgtcaggtatggagcgattgcaaagaatgttcgctggtgccggtggcgccttgggtcacccgccaccagactccccgactctcgattcatcggagcaggtctacatctcctcactcgcgctcctcaagatgctcaaacacggtagagctggtgtgcccatggaggtgatgggtctgatgctgggagagtttgtggatgagtacacagttcgggttgttgatgtgtttgctatgccacaaagtggaactggtgttagtgttgaagccgttgatcatgtgttccagactaacatgcttgacatgctcaagcagactggaagaccagaaatggttgttggatggtatcactcacatcctggatttggttgctggctctctggtgttgacataaacacacagcagagttttgaagctttgaatcaaagggctgttgctgtggttgtggatccaatccagagcgtgaaagggaaggtagtgattgatgccttccgcttgattaatccccaaaccatgatgcttggccaagaaccacggcagacaacttccaatcttggtcatcttaataagccatccatccaagcattgatccatggcttgaatagacattattattctattgccatcaattacaggaagaatgaacttgaagaaaagatgctactaaatctgcacaagaagaaatggactgatggattaacacttcatcgctttgattgccattccaaaaccaatgaacagactgtccaggagatgttaaatttggctgtcaaatataacaaggcagttcaagaagaagacgagctgccgccagagaagctggccattgctaatgtgggaaggcaagatgcaaagaagcaccttgaggaacatgtctccaacttgatgtcctcaaacatagttcaaactttgggaaccatgcttgatacagtcatattctagatgttggtttgttttctgtagtttcactagcttcactcttgtttgactatttgtatggcatttacagtttgaatttgtgctttataatttaacattttaattctgaaggcctatccttttgtcatggatgtgctggtttgtgctgaaacgtagtatatgattgtggcttactttttatgtggttggacaattcattgctgtattttgccctcagttttgatgctaggcaatgcaaaatagttttgagttataatttagtgtggatttcttcgctttaagaacttgatgtacaaatagataaccatctgcattttgaaaaaatatgtggacattccaaatcctgatgatcttccagtagcctatagaaccaaatattaagtaaacaaaagaaaggcaacggttatgaagtacatacgctgaggatgccgctttttagaatcacatgctagtggggttattaattcctgatgaggaagtattgtttagagagtattctacggtttatgaaagaagctaggcgcttgaccaagctcttagccttgtcggaatcgggataaaacctcctccggc

SEQ ID NO: 1904 - DNA, 1263 bp, Gossypium hirsutum
aagaaagtcttctgaaaactccgatcgacaatgtcaggattggaccgtttgcaaaggatgttcgccggtgctggcggcgctttgggtcatccgccgccggattccccgacccttgattcttcggagcaggtctatatctcctctctcgccctcctcaaaatgctcaagcatggaagagctggagttcccatggaagttatgggtttgatgttgggagagtttgttgatgagtacactgtgcgtgtcgtggatgtctttgcaatgccacagagtggtaccggtgttagtgtcgaagctgtggatcatgttttccaaacgaatatgcttgacatgctcaaacaaactggaaggccagagatggttgtgggttggtaccattcacatccaggattcggctgctggctttctggtgtcgacataaacacacagcagagttttgaagctttgaatcaaagggctgtagcagtggtggtggacccaattcagagtgttaaggggaaggtggtaattgatgcattccgtttgatcaatccacaaaccatgatgcttggccaagaaccacgtcagacaacttcaaatctagggcatcttaataagccatctatccaagccttgatccatggactaaatagacactactactctatagccattaactacagaaagaatgaacttgaggaaaagatgctattgaatcttcataaaaagaagtggacagatggactgacacttcggcgttttgatacccattcgaaaaccaatgaacagactgttcaggaaatgctgaatttagctataaaatacaacaaggcagtgcaggaggaagatgaattaccccctgagaagctagcaatagcaaatgttgggagacaagatgccaagaagcacttagaggaacacgtctcaaacttgatgtcctcaaacatagttcagactttgggaactatgcttgacactgttgtgttctagactcttagcatctgtattaacttctttaagttaatgaattgcatctatattgatatcatatattgttggtcaagtgcactgttcatgcattgttgtgaagattcaaagagactatcatgttgattcattaaaattttttatgctttcttctctaaaaataaaacatcattataaaaaatagaacattagcttagcaatcagggaaacggaaaggatcattggggggtttatctagggtttctgaaaaatccagcaaatgtaattgaaaaacgaaaatagaaaaggagaaagtgg

SEQ ID NO: 1905 - DNA, 1312 bp, Vigna unguiculata
gtatttaatcatatctccgtcttcactgaggaaccataattatcagtaacataaggatagtttccaagagaggaagcaatctttgttttcgtgaaacaaaagaaaactaagatttgaggttcttctagcttccatcatcatcatcgtcatgtcggggatggagaggcttcagaggatgttcgccggtgcaggcggagccctagggcaccccccaccagattcccccacccttgattcctccgagcaagtttacatctcctctctcgcgcttctcaaaatgctcaaacacggaagagctggggtacccatggaagtgatgggtctgatgttgggggagttcgtggatgagtacaccgtgcgcgttgtggatgtgtttgcgatgcctcagagtgggaccggtgtgagcgttgaagccgttgatcatgtttttcagactaatatgcttgatatgttgaagcagactggaaggccggagatggttgtggggtggtatcactcgcatccgggattcgggtgttggctttctggagtggatattaacacccaacagagtttcgaggctttaaatcaacgtgcagtggctgtggtggtggatcccattcagagtgttaaaggcaaagtggtaattgatgctttccggctgattaatccacaaactatgatgctgggtcaggaaccacgacagacaacttccaacttaggccatttaaacaagccatctatccaagctctgatccatggattgaatagacattattactccatagcaatcaattacagaaagaatgaacttgaagagaagatgttgcttaaccttcacaaaaagaagtggaccgatggtttgacactcagacgctttgattcacattcgaaaactaatgaacagactgttcaggagatgctaaatttagcatccaagtacaacaaggcagtgcaggaagaagatgagttgccacctgaaaaactcgcaattgcaaatgtgggaaggcaagatgcgaagaagcacctggaagagcacgtttccaatttgatgtcatcaaacattgttcagactttgggaatgatgctcgacactgttgttttctagagttagcattgtccaatgtattcctccttacagcagcatttcattaaatacttctgacaagtttgtcaacagaaattgttttatcacgggtattcgtatttttgtgtgttctttaaaatgcaggagttacatgttagaggatgagaaagaaacatattttaatccctcttcttgatcatgagctaaaagttttatttatttgtttattcattcaccaaaacatca

SEQ ID NO: 1906 - DNA, 1314 bp, Vigna unguiculata
gggtatttaatcatatctccgtcttcactgaggaaccataattatcagtaacataaggatagtttccaagagaggaagcaatctttgttttcgtgaaacaaaagaaaactaagatttgaggttcttctagcttccatcatcatcatcgtcatgtcggggatggagaggcttcagaggatgttcgccggtgcaggcggagccctagggcaccccccaccagattcccccacccttgattcctccgagcaagtttacatctcctctctcgcgcttctcaaaatgctcaaacacggaagagctggggtacccatggaagtgatgggtctgatgttgggggagttcgtggatgagtacaccgtgcgcgttgtggatgtgtttgcgatgcctcagagtgggaccggtgtgagcgttgaagccgttgatcatgtttttcagactaatatgcttgatatgttgaagcagactggaaggccggagatggttgtggggtggtatcactcgcatccgggattcgggtgttggctttctggagtggatattaacacccaacagagtttcgaggctttaaatcaacgtgcagtggctgtggtggtggatcccattcagagtgttaaaggcaaagtggtaattgatgctttccggctgattaatccacaaactatgatgctgggtcaggaaccacgacagacaacttccaacttaggccatttaaacaagccatctatccaagctctgatccatggattgaatagacattattactccatagcaatcaattacagaaagaatgaacttgaagagaagatgttgcttaaccttcacaaaaagaagtggaccgatggtttgacactcagacgctttgattcacattcgaaaactaatgaacagactgttcaggagatgctaaatttagcatccaagtacaacaaggcagtgcaggaagaagatgagttgccacctgaaaaactcgcaattgcaaatgtgggaaggcaagatgcgaagaagcacctggaagagcacgtttccaatttgatgtcatcaaacattgttcagactttgggaatgatgctcgacactgttgttttctagagttagcattgtccaatgtattcctccttacagcagcatttcattaaatacttctgacaagtttgtcaacagaaattgttttatcacgggtattcgtatttttgtgtgttctttaaaatgcaggagttacatgttagaggatgagaaagaaacatattttaatccctcttcttgatcatgagctaaaagttttatttatttgtttatttattcaccaaaacatca

SEQ ID NO: 1907 - DNA, 1142 bp, Cynara scolymus
  misc_feature (41)..(42): n is a, c, g, or t
  misc_feature (96)..(96): n is a, c, g, or t
  misc_feature (218)..(218): n is a, c, g, or t
cgggatcaatcgtgtcgtgttccaagaaattgaaactcganngggaaagagcaacgccggtaaagaatatgtcaggtatggagcggctacagaggntgttcgccggcgccggtggagccttaggtcatccgccaccggattcgccgactcttgatacatcggaacaagtttacatctcttcccttgccctcctaaagatgctcaaacacgggagagcnggagttcctatggaagtcatggggttgatgcttggggagttcgtagatgagtatacggttcgtgtggtagatgtgtttgctatgcctcagagtggaactggtgttagtgtcgaagctgttgatcatgttttccaaaccaatatgcttgatatgcttaaacaaaccggaagacctgaaatggtggttggatggtaccattcacatcctggatttggttgttggttatctggagttgatatcaacacacagcagagttttgaagctctgaatcaacgagcagtcgcggtggtggtggatccaatccagagtgttaaggggaaggttgtgatagatgcgttccgcctaattaacccccaaaccatgatgcttggccaagagccacgtcaaacaacttccaatcttggccatctcaataaaccatccatccaagcactgatccatggtttgaacaggcactattactcgatagccattaattacaggaagaataaacttgaggagaagatgctattgaaccttcacaaaaagaagtggactgatggattgacacttgaacgctttgatacccattcaaaaaccaacgagcagactgttcaggaaatgctgagtttggctatcaaatacaacaaagctgttcaggaagaggacgaactacctccagagaaactagcgatcgcgaatgttgggaggcaggacgctaagaagcatctagaagagcacgtgtcgaacttaatgtcgtccaacatcattcagacgctgggtaccatgctcgacaccgttgtcttctaaagtttggaacactatattttccatgtattatgtacactttgaagcttctcttgcaagtgattttagaaagcaactgtcgtggttcgtttacgagactcgtgattttattcttaaatttttaccctcttaaaagtc

SEQ ID NO: 1908 - DNA, 1037 bp, Flaveria ramosissima
cgggggggagatcttgtcttgttacccaagaaaaccatcatcttgatcggagatcggatcatcggaagccaatgtcagggatggaacgactgcagcggatgttcgccggagccggcggcggtttaggccacccgccgccggactctccgacactcgacacatcggagcaagtctacatctcttctctagcccttctcaagatgcttaaacacgggagggcgggagtgcctatggaagttatgggattgatgcttggggaatttgttgatgagtatacggttcgtgtggtggatgttttcgctatgccgcagagtggtactggtgttagtgttgaagctgttgatcatgtgtttcagactaatatgcttgatatgcttaaacaaactgggagaccagagatggtggttggctggtaccattctcatcctggatttggttgttggttatctggagttgacatcaacacgcaacagagttttgaagctttgaatcagagagctgttgcggtggtggtggatccaatccagagtgtcaaaggaaaggttgtgattgatgccttccgccttatcaacccacaaaccatgatgcttggccaagaaccacgccaaacaacttccaatcttggccatctcaataaaccatccatccaagcgctgatccatgggttgaacaggcactattattcaatagctattaattacagaaagaatgaacttgaggaaaaaatgctattgaacctccataagaagaagtggactgatgggttgaagctagaacgatttgatacccattcaaaaaccaatgagcagaccgtgcaggagatgttgtctctagccatcaaatataacaaagcggttcaggaagaggacaaactgtctccagagaagctggctattgcaaatgtgggaaggcaggatgcaaagaaacatctcgaagagcacgtctcgaatctcatgtcatccaatatcattcagacacttggtacgatgctcgacactgtctctttctagaaccgcgcctgtagtttctgttatatt

SEQ ID NO: 1909 - DNA, 1086 bp, Flaveria ramosissima
agatcttgtcttgttacccaagaaaacccatcatcttgaatcttgatcggagatcggaagccaatgtcaggtatggaacgactacagcggatgttcgccggagccggcggcggtttaggccatccgccgccggactctccgacactcgacacatcggagcaagtctacatctcttctctagcccttctcaagatgcttaaacacgggagagcgggagtgcctatggaagttatgggattgatgcttggggaatttgttgatgagtatacggttcgtgtggtggatgttttcgctatgccgcagagtggtactggtgttagtgttgaagctgttgatcatgtgtttcagaccaatatgcttgatatgcttaaacaaactgggagaccagagatggtggttggctggtaccattctcatcctggatttggttgttggctatctggagttgacatcaacacgcaacagagttttgaagctttgaatcagagagctgttgcggtggtggtggatccaatccagagtgtcaaaggaaaggttgtgattgatgccttccgccttattaacccacaaaccatgatgcttggccaagagccacgccaaacaacttccaatcttggccatctcaataaaccatccatccaagcactgatccatgggctgaacaggcactactattcaatagctattaattacaggaagaatgaacttgaggagaagatgctattgaacctccataagaagaagtggactgatgggttgaaactagaacgattcgatacccattcaaaaaccaatgagcagaccgtgcaggagatgttgtctttggccatcaaatataacaaagcggttcaggaagaggacaaactgtctccagagaagctagctattgcaaatgtgggaaggcaggatgcaaagaaacatctcgaagagcacgtctcgaatctcatgtcatccaatatcatccagacacttggtacgatgctcgacactgtctctttctagaaccgcgtctgtagtttctgttttggcacattgattatccattctcttgtaagcgattcgagggaaaaaaaaaacaactttcac

SEQ ID NO: 1910 - DNA, 1076 bp, Flaveria ramosissima
agggagatctagtcttgttacccaagaaaaccatcatcttgaattttgatcggagatcggaagccaatgtcagggatggagcggctacagcggatgttcgccggagccggcggcggtttaggccatccgccaccggactctccgacactcgacacatcggagcaagtgtacatctcttctctagcccttctcaagatgcttaaacacgggagagcgggagtgcctatggaagttatgggattgatgcttggggaatttgttgatgagtatacggttcgtgtggtggatgttttcgctatgccgcagagtggtactggtgttagtgttgaagctgttgatcatgtttttcagaccaatatgcttgatatgcttaaacaaactgggagaccagagatggtggtcggctggtaccattctcatcctggatttggttgttggttatctggagttgacatcaacacgcaacagagttttgaagctctgaatcaaagggctgttgcagtggtggtggatccgatccagagtgtcaaagggaaggttgtgattgatgccttccgccttattaacccacaaaccatgatgcttggccaagaaccacgccaaacaacttccaatcttggccatctcaataaaccatccatccaagcactgatccatgggttgaacaggcactactattcaatagctattaattacaggaagaatgaacttgaggagaaaatgctattgaacctccataagaagaagtggactgatggattgaaactagaacgatttgatacccattctaaaaccaacgaacagaccgtccaggagatgttgtctctagccatcaaatataacaaagcggttcaggaagaggacaaactgtctccagagaagctagctattgcaaatgtgggaaggcaggacgcaaagaaacatcttgaagagcacgtctcgaatcttatgtcatccaatatcatccagacacttggtacgatgctcgacactgtctctttctagaagcacttctgtaggttatgttttggcacattgattaaccattctcttgtaagctactcaaggaaaaaaaa

SEQ ID NO: 1911 - DNA, 1150 bp, Lippia dulcis
aatagaaatcggcatttttttctgaattgaaatggcaggcatggagagacttcaccggatgttcgccggcgctggcggagctctcggacacccgccgccggactctccgacgctcgactcctccgagcaagtctacatttcgtctctcgcccttctcaaaatgctcaaacacggtagagcgggggtaccgatggaggtgatggggttaatgctggtggagtttgtggatgagtacacggtgcgtgtggtggatgtcttcgcgatgccgcagagtggaactggtgtcagtgtcgaggctgtcgatcacgtgttccagactaatatgcttgatatgctgaagcagaccggcagacctgagatggtggttggttggtaccactcacatcctggctttggatgttggctttcaggtgttgacattaacactcagcagagttttgaagctttgaatcagagggcagtagctgtggtggtagatccaattcaaagtgttaaaggaaaggtggtgattgatgccttccgactcattaaccctcaaaccatgatgttgggtcaagaaccacgacaaaccacttccaacgtggggcaccttaataaaccatctatccaggctttgattcatgggttgaacaggcactattactccattgccataaattaccggaagaacgaacttgaggagaagatgctcctcaatctccacaaaaagaaatggactgatggattgaccctccaacggtttgacacccactccaaaacgaacgagcagacagtccaggagatgctaaacctagcgatcaagtacaataaagcagtccaagaggaggatgagctgccacctgagaagctagcaatcgccaatgtgggaaagcaagacgccaagaagcatcttgaggagcatgtctcaaacttgatgtcttccaacatagtccaaactttggggactatgctggacacagttgttttctagatttcggattttgagagccagtcgaagcagtcgtttcttcagaaagtgtacgtgtctgtttattttctcctcggcctgatataaactccagtttcatgtaagagatcgattacctctgaaatagtgtccagatttatttgttgctcctccctcaattgtattcatatcaagttatggtac

SEQ ID NO: 1912 - DNA, 1514 bp, Cajanus cajan
gtcgtattaaagcgtctccggttaccaatatcaatcaccgaagcaaagttcagcactttaccagcaaacactcttccttttcgtgaaacaaaagaaaacctcgcattatgtccggcatggagaggctgcagaggatgttcgcgggtgcagggggagccctgggccaccccccacccgattcccccaccctcgattcctccgagcaggtttacatctcctccctcgcgcttctcaaaatgctcaaacacgggagggctggtgtgcccatggaagtgatgggtttgatgttgggcgagttcgtggacgagtacactgttcgcgttgtggatgtgttcgcgatgcctcagagtgggaccggtgttagcgttgaagccgttgatcatgtttttcagactaatatgctcgatatgttgaagcagactggaaggccggagatggttgtggggtggtatcactctcatcctggatttgggtgttggctttctggagtggatattaatacacaacagagttttgaggctttaaaccaacgggcagtggctgtggtggtagatcctattcagagtgttaaaggcaaagtggtgattgatgctttccggctgattaatccacaaactatgatgctgggtcaggaaccacgacagacaacttccaacctgggtcatctaaacaagccatctatccaagctctgatccatggcttgaatagacattattactccatagcaattaattacagaaagaatgagcttgaagagaagatgttgcttaaccttcataagaagaaatggactgatggtttgacactcaggcattttgattcacattctaaaactaatgaacagactgttcaggagatgctaaatttagcagcaaagtacaacaaggcagtgcaggaggaagacgagctgccaccagaaaaacttgcaattgcaaatgtgggaaggcaagatgctaagaagcaccttgaagagcatgtttccaatttgatgtcttcaaacattgttcagactttgggaatgatgctcgacacagttgttttctagagtttgcatagtccaatgtattctcccttaaaatggttagcaacatttcattaatactctggacaagtttgttaacagaaaacgtttcatccaagcttttgcattctgtgcgttcatttaaaatgtcgaagcaacacgagttagagaatgagaatcacacttcaatctctcttgatgtaatggatatcttcataatcctgtactagaattttatttatttatttggcagcagtaggattttctttctatataaacagtgttgattcagtcgtaagtgaaaacacactgagccattaaaaactgcgtgtgaaagcagtataaatttacaatatttctatgtaattaaagtaggatgttgtgtaaaagtcagtagtcttttatgacaggactgtataagcaaattacaaaacgaattacatagtatgaaactcgattcacaaatgaaatggaattacactaatggattgg

SEQ ID NO: 1913 - DNA, 1130 bp, Carthamus tinctorius
  misc_feature (1023)..(1023): n is a, c, g, or t
  misc_feature (1063)..(1063): n is a, c, g, or t
  misc_feature (1097)..(1097): n is a, c, g, or t
  misc_feature (1100)..(1100): n is a, c, g, or t
gggggaattgaaactccgatcgagaaaaagagctaatcgccggtgaaagaatatgtcaggtatggagcggcttcagaggatgttcgccggcgccggcggcgcgttaggtcacccgccaccggattcgccgactcttgatacatcggagcaagtttacatctcttcccttgccctcctaaagatgcttaaacacgggagagctggagttcctatggaggtcatggggctgatgcttggggaattcgtggatgagtatacggttcgtgtggtggatgtgtttgctatgcctcaaagtggtactggtgtcagtgtagaagcagttgatcatgttttccaaactaatatgcttgatatgcttaaacaaaccggaagacctgaaatggtggttggatggtaccattcacatcctggatttggttgttggttatctggagttgacatcaacacacagcagagttttgaagctctgaatcaacgagcggttgcagtggtggtggatccaatccagagtgttaaaggaaaggttgtgatagatgcattccgcctaattaacccccaaaccatgatgcttggccaagagccccgtcaaacaacttccaatcttggccatctcaataaaccatccatccaagcactgattcatggtctgaacaggcattattattcgatagccattaattacaggaagaataaactcgaggagaagatgctactgaaccttcacaaaaagaagtggaccgatggattgacacttgaacgctttgatacccattcaaaaaccaacgagcagaccgtccaggaaatgctgagtttggctatcaaatataacaaagcggttcaggaagaggacgagctacctccagagaaactagcgattgcaaacgttgggaggcaggacgcaaagaagcatctagaagagcacgtgtcgaacttaatgtcgtccaacatcattcagacgttgggtaccatgctcgacaccgttgtcttctaaacttgagatgctatgctatattttccatgtantatgtactctctgcaagtgattttagaaagcaactgttcnagtttgtttatgagactatgatgcttttattctngcnaaaaaaaaaataaaatcaagaaaagctcaa

SEQ ID NO: 1914 - DNA, 1305 bp, Sarracenia psittacina
gaaaaagcgaaaagaaagtgagagaaggaagaaggaaatgtcaggaatggagagattgcagagaatgttcgccggtgccggaggagcattgggacacccgccgcctgactcgccgacgcttgattcgtcggagcaagtgtacatctcatctctcgcgctccttaagatgctcaaacacggtagagccggggtacctatggaagtgatggggttgatgttgggtgaatttgtggatgaatacaccgttcgtgtcgttgatgtctttgcgatgccgcagagtggtactggcgtcagcgtcgaagccgttgatcatgttttccagactaacatgcttgatatgctcaaacaaactggaagacccgaaatggttgtcgggtggtatcattcacatcctggatttggctgttggctctctggtgtggacattaatactcaacagagttttgaagctctgaatcaacgtgcagtagctgttgtggtggatcccatacagagtgtaaaagggaaggtggtcattgatgcctttcgtttaattaaccctcaaactatgatgcttggccaagagcctagacaaacaacgtccaacctcgggcatctgaataagccatccattcaagcattgatccatgggctgaataggcactattactcaatagctattaattacaggaagaatgaacttgaggaaaaaatgttactgaatcttcacaagaaaaagtggactgatggattgacacttcagagatttgatacccattccaaaaccaatgagcagactgttcaggagatgcttaatcttgctattaagtataataaagcagtgcaagaagaggatgaattgtcaccggaaaaactagcaattgcaaatgtaggcaggcaggatgccaagaaacatctcgaagaaaatgtctccgatttgatgtcttccaacataattcagactctaggcaccatgctcgacacagttgtgttctagggttcagcattcgattgttttcctagttgcatgttaagtgacaattatataatttgggcatgatcacacttctggaactatcagaaatgctttgtcggttttcggtggaatcagaagtgggcaaaaaggtaatgtgggtaagtgaaggctattttgaaagagtagttgatcttactaagctatctgtcgctcgacttgttaccgtagcttggttcagtttggacttgtcatgaaaaaataagctaggtactgttctattgattttcgaactttgtttaggatattgttgttgaatgtctgttttccattaatgaaatcgatagttgcgt

SEQ ID NO: 1915 - DNA, 1042 bp, Tabernaemontana elegans
gacatgtccggaatggagagactacaacggatgttcgccggcgccggtggagccttaggccacgctcccccggactctccgactctcgattcttccgagcaggtctacatctcctccttggcccttctaaagatgctcaaacacggtagagctggggtgccaatggaagttatggggctgatgcttggggattttgtcgatgagtacacggtgcgtgtggtggatgtatttgctatgccgcaaagtggtaccggtgtcagtgttgaagcggttgatcacgtctttcaaacaaatatgcttgatatgcttaagcaaactggcaggccagaaatggtggttggctggtatcattcccatcctggatttggatgttggctttctggggttgacatcaatactcaacagagttttgaagctctaaatcaaagagccgtggctgttgtggtggatcccattcaaagtgtcaaagggaaggtggtaattgatgccttccgtttgattaatcctcagactatgatgcttggtcaagagccacgacaaacaacatccaaccttgggcatctcaataaaccatcgatccaggctttgatccacggtttgaacaggcattactactcaatagccatcaattatagaaagaatgaacttgaagagaaaatgttattgaaccttcacaagaaaaaatggacagatggattgactctccagcgatttgacacccattctaaaacgaatgagcagactgttcaggagatgctaaacttagctatcaaatataacaaagcagtccaagaagaggatgagttgccaccagagaagttggcaattgcaaatgttggaaggcaagacgcaaagaagcatctagaagagcatgtctctaacctcatgtcatcgaacattgttcagactctaggaacaatgctcgatacggttgtcttttagagtttttctttgagaacgtgtacttgtgagatttgagaaatctacagtaattggaccttttctttttgttattgtaactttgttggatgctttcggctgc

SEQ ID NO: 1916 - DNA, 1348 bp, Tragopogon dubius
taaggtcagtctttcactctctaccgttctattgcatcgcatcgcatcgaaagaagaacgaacgaacgacttcccatcgcactcgtcgcctcgtcggcatcatcaccgattcacctctatcgaccactgactcatcttcaggcttcagcgctgcagcgaccaaaatcgactcgtcggcgaccaactcgacttgtcggccaccaaaatcgaccatctgagtaccatccttcagtcacaaatcagatcttggcttgttaccaaagaaatctcttcatcggaagctaatggcaggaatggaacggctacagaggatgttcgccggcgcaggaggcgcgttaggtcacccaccaccggactctccgactctcgatacatcggagcaagtttacatctcctcccttgccctcctcaagatgcttaaacacgggagagcgggggttcctatggaagttatgggattgatgctcggggaatttgtggatgaatatacagttcgtgtggtggacgttttcgctatgccgcagagtggtaccggtgttagtgttgaagctgttgatcatgttttccagaccaacatgcttgatatgcttaagcaaactggcagaccagagatggtggttgggtggtaccattcacatcctggatttggttgttggttatctggagttgacatcaacacacaacagagttttgaagctctgaatcaacgagctgttgcggttgtggtggatccaatccagagtgtgaaagggaaggttgtgatcgatgccttccgcctaattaacccacaaaccatgatgcttggccaagaaccacgccaaacaacatccaatcttggtcatctcaataaaccatccatccaagcattgatccatggtttaaacaggcactactattcaatagccattaattacaggaagaataaacttgaggagaagatgcttttgaacctccataagaagaagtggactgatggattgacacttgaacgatttgacacccattctaaaaccaatgagcaaactgtccaggagatgttgagtctagcaataaaatataacaaagcggtgcaggaagaggacaaattgtcaccagagaagcttgcaattgcaaatgtgggaaggcaggatgctaagaaacatctagaagagcacgtctccaatttgatgtcatccaatatcattcagacactcggtaccatgcttgacaccgttgtcttctagacttaaacctcctcgtatctttctcaacttactagctttaaaactcaatttcatctctttctcttaagtacccttcatgtgtaattcaagtgtcaaaatatgtttactcttttgagatataagct

SEQ ID NO: 1917 - DNA, 1198 bp, Citrullus lanatus
gatcgggggtgatagtttacggaacttaagatcgagtgatagaggaatgtcagggatggaacgccttcagaggatgttcgccggtgccggtggtgcgttgggtcaccctcctccggattctcccaccttagattcttccgagcaggtctatatctcctccctcgcgctcctcaagatgctcaagcacggaagagctggggttcccatggaggtaatgggtttgatgctgggagagtttgttgacgagtacacggttcgtgttgttgacgtctttgctatgccccaaagtggtactggtgttagtgttgaagccgtcgatcatgtttttcagaccaacatgcttgatatgcttaaacagactggacggcctgagatggtcgtcggttggtatcattctcatccaggttttggttgttggctatccggtgttgatattaatacacaacagagttttgaggctctgaatcagagagctgttgctgtggttgtggatccaatccagagtgtaaaggggaaggtggtgattgatgcttttcgtctaattaacccacagactatgatgcttgggcaggaaccacgccaaacaacttccaatctcgggcatcttaacaaaccatctattcaagcattaatccatgggttgaaccggcattattactcgattgctataaactataggaagaatgagctcgaggagaagatgttactcaaccttcacaagaagaaatggactgatggtctaactcttcgccggtttgacacccattcaaaaaccaacgagcagacaattcaagaaatgctaaacctggctatcaagtacaacaaagcagtccaggaggaagatgagttgccccctgaaaagcttgcaatagcaaatgtgggcagacaagacgcaaagaaacaccttgaagaacatgtctccaaccttatgtcgtcaaacatcatccaaacattaggaacaatgcttgacacggtagtgttttgaagctccacactgtttgagcttaatgtttcattgttatttcctgcaactagaggggctctatttaaacaccattcagtgataaactacacgtccgttatgatcaaatcgggatgtcagattcttcaacagctattgattttgatctattcttgtaattcctatctccgttttttggttgatagaaacagagaaaatggtgaaatgcacctcttt

SEQ ID NO: 1918 - DNA, 1527 bp, Pinus taeda
agagagaggttttaggattttggcagcaggttcatttcagtgcagcaatggagagattgcaaaggatattttcaggggcagggggcatgggaccgcctgctacggatggccctatgctcgattcatctgagcaggtctacatttcttctcttgctctcctcaaaatgctcaaacacggtagagctggagtacctatggaggtcatggggctgatgctcggcgagtttgttgacgagtacacagtacgagttgtggatgtgtttgccatgccccagagtggtactggagtcagtgtagaggcagttgaccatgttttccagacaaacatgcttgacatgcttaagcagactggcaggcaagagatggttgtagggtggtaccattcgcatccaggttttggatgctggctttcaggtgttgatataaatacgcaacagagtttcgaggctctcaatcaacgggcagttgccgtagtggttgatcctattcaaagtgttaaggggaaggttgtgatcgatgcattccgcttaatcaatccccagactatgatgcttgggcaggagcctcgacaaacaacttcaaatcttgggcatctgaataagccatctatccaggcattgatccatgggttgaatcgccattattattctattgccattaattaccggaaaaatgaactggaagaaaagatgctactcaatttactggactgatggtctgactcttcaacgctttgattgccattctaagactaatgaacagacagtgcaggaaatgcttgatcttgcaatcaagtataataaagctgtacaagaagaggatcagctctctcctgaaaagctggctattgcaaatgttggcagacaagatgcgaaaaagcacctagaagagcatgtctctaatctgatgtcttcaaacatagttcaaacacttgggacaatgcttgatacagtggtgttttagttcttttgtcttaattggttttaccaagccagtgcacgtgaatcatgagaaacaacagaaaatgggaagcaatggtggtatcgtaccactctaaaagtttactttttgttgaactcttggatgttagtttaatgcaaaagaaattcaatcatttggatgctgatttattatgcagtgtatattccattgaatggaatttgatgggcaaatttcaaattttgctacagcaattggttggttcatttattagatatcttgaacgtcggccgtaagcacgggtgattttcaaatatttactgctaccactctaaaagtttactttttgttgaactcttggatgttagtttaatgcaaaaggaatccaatcatttggatgctgatttattatgcagtttatattccattgaatggaatttgatggacaaatttcaaattatgctacagcattggttggttgatttattagatatcttgaaggtgggctgtaagcacgagtgattttcaaatatttactgccaagtaattctttgaatgctagaaggttgtgtaaaaaaaaaaaaaaaa

SEQ ID NO: 1919 - DNA, 1356 bp, Brassica rapa
aagagtaatatataaacataaacacaacaacaccagtgggcaattaagttaaaaagcataattatagggtctattataacaaaaaggaaataatctaggactaaatatgtaaatagcttcgcctaaaggatccatgtccgtctttgtcttgttcctaaagaaaactctctcgacgaggtttaataggaaacattctcgtagctaaaagcaacctacgacgactgatttgatctgataatggagagattacagcgaatcttcggcgccggcggcggattaggtcacgcatcgcctgattctccgactctcgatacctcggagcaagtttacatctcctctctcgctctcctcaagatgctcaaacacggaagagctggggttcctatggaagtgatggggttgatgcttggagagtttgtggatgagtacactgtgagggttgtggatgtgttcgctatgcctcagagtgggactggtgttagtgttgaagctgttgatcatgttttccagactaatatgctcgacatgcttaaacagactgggagacctgaaatggtggtgggttggtaccattcacatcctgggtttggttgctggctttctggtgttgatattaatactcaacagagttttgaagctttgaaccagcgagctgtagcagtggtggttgatccgattcagagtgtgaagggtaaagtggtgattgatgcgtttcgttcgataaacccgcagactattatacttgggcaagaacctcgtcagacaacgtccaaccttggccacctgaacaaaccatccatccaggctttgattcatggattgaacagacattactattcaatagccatcaactataggaagaacgagctcgaggagaagatgttactaaacctccacaagaagaaatggacagatggtttgaccctaagaccctttgacacccactccaagacaaacgaacagaccgtgcaggaaatgttgaacttagctgctaagtataacaaggcggtacaagaggaggacgagttgtcaccagagaaactggcgattgtgaatgtgggaagacaagacgcaaagaagcatctggaagaacatgtttccaacttgatgtcttccaacattgttcagacgctaggtaccatgcttgacactgttgtcttctagaggtcgtctgcacttttttctcttctgcatcattctgttgaatcaactctttatgtgtgttctcctagcacttgataaggttggtattgtactctgtgattcctattttcttgcacctatttcagtttctttctctcatggtaagatcaaagtttgataatgggaataatttaaatcgggtcccagtttaaa

SEQ ID NO: 1920 - DNA, 1264 bp, Brassica napus
cgagtaactgagattcttgattcaaaccacatgtacaaggactaatattgacgaaatagaaatctatacaaatcatgtgtagtatataaacataaacacaacaaatcagtgggcaattaagttaaaaatcataattatagggtctattataacaaaaaggaaatattcgaggactaataatgtaaatagcttcgcctaaaggatccatgtccgtctttgtcttgttcataaagaaaactctctctcgacgaggtttataggaaacattcagaagaggaagacgacgactgatttgatctgataatggagagattacagcgaatcttcggcggcggcggcggattaggtcacgcatcgcctgattctccgactctcgatacctcggagcaggtttacatctcctctctcgctctcctcaagatgctcaaacacgggagagctggggttccaatggaagtgatggggttgatgcttggagagttcgtggatgagtacactgtgagggttgttgatgttttcgcgatgcctcagagtgggactggtgttagtgttgaagctgttgatcatgttttccagactaatatgctcgacatgctcaaacagactggaagacctgaaatggtggtgggttggtatcattcacatcctgggtttggctgctggctttctggtgttgatatcaatactcaacagagttttgaagctttgaaccagcgagctgtagcagtggtggttgatccgattcaaagtgtgaagggcaaagtggtgattgatgcgttccgctccataaacccgcagaccattatgcttgggcaagaacctcgtcagacaacgtccaaccttggccacctgaacaaaccatccatccaggccttgattcatggattgaacagacactattattcaatagccatcaactataggaagaacgagctcgaggagaagatgttactaaacctccacaagaagaaatggactgatggtctgaccctaagaccctttgacacccactccaagactaacgaacagaccgtgcaggaaatgttgaacttggctgctaagtataacaaggcggtacaagaggaagacgagttgtcaccagagaaactagcgatcgtgaatgtgggaagacaagacgcaaagaagcatctggaagaacatgtttccaacttgatgtcttccaacattgttcagacgctaggtaccatgcttgacactgttgtcttctagagaagctttgcccctcttctgcatctttctgttg

SEQ ID NO: 1921 - DNA, 1171 bp, Helianthus annuus
aagaatcaaactctgatcggaacagagcaaacgcaggtagcgaaaatgtcagggatggaacgactacagagaatgttcgccggcgccggtggcgcgttaggtcacccgccaccggattcaccgactcttgatacatcggaacaagtttacatctcgtcacttgctctcttgaagatgcttaaacacgggagagcgggagttccgatggaagttatgggattgatgcttggggaatttgtggatgagtatactgttcgtgttgtggatgtgtttgctatgcctcagagtggtaccggggttagtgttgaagctgttgatcatgttttccagactaatatgcttgatatgcttaagcaaaccggaaggcctgaaatggtggttggatggtaccattcacatcctggattcggctgttggctatctggagttgacatcaacacacaacagagttttgaagcgctgaatcaacgagccattgcggtggtggtggatccaatccagagtgttaaagggaaggttgtcatagatgccttccgtttaattaacccccaaaccatgatgcttggtcaagagccacgtcagacaacttccaatcttggccatctcaataaaccatccatccaggcgttgatccatggtttgaacaggcattattactcgatcgccattaattacaggaagaataaactcgaggagaagatgctacttaaccttcacaagaaaaaatggactgatgggctcacacttgaacgatttgatacccattctaaaaccaatgagcagactgtccaggaaatgctgagtctagctatcaaatataacaaagcggttcaggaagaggacgaattacctccggagaaactagcgatcgcaaacgttggaaggcaagatgccaagaaacatctggaagaacatgtgtcaaacttaatgtcatccaacatcattcagacattgggtaccatgctggacactgttgtcttttaagcttttcaaccatgtatcttgtaccttgatgtgtgaatctagcaacttgatattgtggatttatggcttagttacaactatttattttattaagatctataacattttaaagtgtgtttgtttttattatgatattgtcatccaactgctagtttgtgatccgattggattccatttacaccccttt

SEQ ID NO: 1922 - DNA, 1246 bp, Helianthus annuus
gatcttgtcttgttaccaagaaaactccattctctttgatcatcaactaatgtcagggatggaacggttacagcggatgttcgccggggccggcggcgcgttaggccacccgccaccggactctccgactctcgacacctctgagcaagtctacatctcttctctagcccttctcaagatgcttaaacatggcagagctggagtgcctatggaagttatgggattgatgcttggggaatttgttgatgagtatacggttcgggtggtcgatgttttcgctatgccgcagagtggtactggtgttagtgttgaggctgttgatcatgtttttcagactaatatgcttgatatgcttaaacaaactggaagaccagagatggtggttggctggtaccattctcatcctggattcggttgttggttatccggagttgacatcaacacgcaacagagttttgaagctctgaatcaaagagcggttgcagtggtggtggatccgatccagagtgtcaaagggaaggtcgtgatagacgccttccgtcttattaaccctcaaaccatgatgctcggccaagaaccacgacaaacaacttccaatcttggtcatctcaataaaccgtcaattcaagcactgatccatgggctaaacagacactactattcaatagctattaattacaggaagaacgaacttgaagagaagatgctattgaatctccataagaagaagtggactgatggattgaaacttgaacggtttgatgcccattcaaaaaccaatgagcagactgtccaggagatgctgactctagccatcaaatataacaaagcggttcaggaagaggacaaactatcttcagagaagttagctattgcgaatgtgggacggcaggatgcgaagaaacatcttgaagagcatgtctcgaatctcatgtcatccaacatcattcagacgcttggtacaatgctcgacaccgtctcgttctagaatctagtctgtgttttctgttttggcagttggtacattgattaaccaatttcttgtaaacgattcgagggaaaagaaacaacttttacaggtttttcttaaccaactattgttttcattatcttgatgtttggtgcacaccgtcatcttcatttgattcaagtacaactcaaatgggttgagctggttaaaagagtagatgattgttaaaagtgtatcagatttatataaccttttaaattactttatttcttggtt

SEQ ID NO: 1923 - DNA, 1073 bp, Arnica chamissonis
ttttctgtttgggggagatcttgtcttgttaccaaagaaatcaaatctcttgatcggaagctaatgtcagggatggaacggctacagaggatgttcgccggagcaggaggtgcattaggtcacccaccaccggactctccgacactcgatacgtcggagcaagtgtacatctcttctctagcccttctcaagatgcttaaacatgggagagcgggagtgcccatggaagttatgggattgatgctcggggaattcgtggatgagtatacggttcgcgtggtggacgtcttcgctatgcctcagagtggtactggtgttagtgttgaagccgttgatcatgttttccagaccaacatgcttgatatgcttaaacaaactgggagaccagagatggtggttggctggtaccattctcatcctggatttggttgttggttatctggagttgacatcaacacacaacagagttttgaagctctgaatcaaagagctgtggcagtggtggtagatccaatccagagtgtcaaagggaaggttgtgattgatgccttccgccttattaacccacaaaccatgatgcttggccaagaaccacgccaaacaacttccaatcttggccatctcaataaaccctccatccaagcattgatccatgggttgaacaggcactactattcaatagcaattaattacaggaagaatgaactggaggagaagatgctattgaacctccataagaagaagtggactgatggattgaaacttgaacgatttgatacccattcaaaaacaaacgagcagactgtccaggagatgttgactctagccatcaaatataacaaagcggttcaggaagaggacaaactgtctccagagaagctagctattgcaaatgtgggaaggcaggatgcaaagaaacatcttgaagagcacgtatcgaatcttatgtcatcaaatatcattcagactcttggtacgatgctcgacactgtctctttctagagtcaagtatgtactttctgtttggcacgtcgattaaccattctcttgtaggcgatttgagggcaaaaaaa

SEQ ID NO: 1924 - DNA, 1113 bp, Humulus lupulus
accgaaaaagaagcatcaaaacagtcttgttgccgaggaaaacttggggtatgtcaggtatggagaggcttcagagaatgttcgccggtgccggaggagctttgggccaccctccgccggattcccccactctcgactcctctgagcaggtctacatctcatccctcgcccttctcaagatgctcaaacacgggagagctggggttcctatggaagtcatgggtttgatgctgggagagttcgtggatgagtacactgttcgcgtcgttgatgtatttgcaatgcctcagagcggtactggtgttagcgttgaagctgttgatcacgtgttccagaccaacatgctcgatatgcttaaacagaccgggcgaccggagatggttgttgggtggtatcattcacatcctgggtttggctgttggctttctggtgtggacattaacacacaacagagttttgaagcattgaatcaacgcgctgtagctgttgtggtggatccaattcaaagtgtaaaaggaaaggtggtgattgatgcttttcgcctgatcaacccacaaaccatgatgcttggccaagagccacgtcaaaccacttccaatcttggccatctgaataaaccatccattcaagccttgatccatggtttgaaccgccactactactccatagctattaattacaggaagaatgagcttgaggagaagatgttgctgaatcttcataagaagaagtggactgatggtttaacacttaggcagttcgattctcactccaaaacaaatgaggagacagttcaggagatgctaactttggcggttaaatacaacaaggcagtacaggaagaagacgagttgcccccagagaagcttgcaattgcaaatgtgggaagacaggatgcgaagaagcacctagaagagcatgtctccaatttgatgtcttcgaacatcattcaaactttgggaacgatgctcgacactgttgtcttctagagttcctaaactaaagcaaaaatccttaatatcccacaaccatgtagctctacattctggttctgcttaaattagtcttactataaactagtcaatgtgtttagacatgagacgatttagtttc

SEQ ID NO: 1925 - DNA, 1226 bp, Mimulus guttatus
aaagaaatctaacttcgaaagttcgaaactctgattttagctgctcaaagcataaatcttgattcaaagaaaaggcaaatggcgggcatggaaagactacaccggatgtttgccggcgccggcggcgccctcggccatccgccgccggattccccaaccctcgactcatccgaacaagtctacatttcatctctcgccctcctcaaaatgctcaaacacggtagggcgggagtaccgatggaagtgatggggctgatgttgggtgaatttgtggacgagtacacggtgcgtgtggtggacgtctttgcgatgccgcaaagtgggacaggtgtcagcgttgaggccgtcgatcatgttttccaaactaacatgcttgacatgctcaagcaaactggcagacctgagatggtggttggttggtatcactcgcatcccggttttggatgctggctttctggtgtagacataaatactcaacagagtttcgaagctttgaatcagagggcagtagcggtggtcgttgatccaattcagagtgttaaagggaaagtcgtaatcgacgccttccgtctgattaacccacagactatgatgcttggtcaagagccacgacaaacaacatccaaccttggacatcttaataaaccatctatccaggctttgattcatggtttgaaccgacactattactccatagccataaattaccgaaagaatgaactcgaggagaagatgcttctaaatcttcacaagaagaaatggacggatggtttgaccctgcagcggtttgacgcccactccaaaacaaacgagcagactgtccaggagatgctaaagctagctgtcaaatacaacaaagcagttcaagatgaggatgaattgccaccggaaaaactagcaattgcgaacgtgggaaagcaagacgcaaagaagcatctcgaggagcacgtctcgaacttgatgtcttcaaacatcgttcagacattaggcacgatgctcgacacagttgttttctagagagagagagagagatatcacaaaatctttgatttggttgctagtttgactatgttgtatcaacatctgatcatttgtactcagcaacatttcccattccatgaaattcagctttttatggacatacaaaaaacgcaaattcgatagacataaccgtcgtctgaagcaaaatttattaaatgaatcgtaacttattatggttcgatact

SEQ ID NO: 1926 - DNA, 1220 bp, Carica papaya
aaagaacaagaaaagaaaataaacgaaaaaggaaagccgaggggctagaatgtcaggtatggagaggttgcagaggatgttcgccggagctggaggtgccttgggccatccaccaccggactcccctaccctagattcttcggagcaggtctacatttcctctcttgcacttctcaaaatgctcaagcacggaagggctggggtgccaatggaagttatgggcttgatgcttggagagtttgtggacgagtacacagttcgtgttgttgatgtttttgcgatgccacaaagtggaactggtgttagcgttgaagctgttgaccatgttttccagactaatatgcttgatatgctcaaacagaccgggagaccagaaatggtggtaggatggtaccattctcatcctggatttggctgttggctctctggtgttgacataaatactcagcagagttttgaagctttgaatcagcgagcagtagcagttgtggtagatcctattcagagtgttaaaggaaaagtggtgattgatgcattccgtttaataaacccacaaactatgatgcttggccaagaaccaagacagacaacatcaaaccttgggcatcttaataagccatcaattcaagccttgatccatggattgaacaggcattattactcaatagccattaattacaggaagaatgaacttgaagaaaagatgctgcttaaccttcataagaagaaatggactgatggattgacactacgtcggtttgacacccattcgaaaacaaatgaacagactgttcaggagatgctaaacttggccgtcaaatacaacaaggcagtgcaggaggaagatgaattgccaccagaaaagttggtaattgccaatgttgggagacaagatgccaagaagcaccttgaagagcatgtctctaacttgatgtcatccaacataatccagactttgggaactatgctcgatactgtggttttttagaggacttattgtcgtacttctcaactaggacagtactaaattcattttctacattaatatgagtttgttttctctcaattgcatcataaaggaccatttgttgtagcttattttctatgttggaattttatgtaaaccagtaacggatggatgggcatctcaacttcttctttttggtttcccctgaatgtagacaacgctttatttggattaaaatgaatgtcataaaaac

SEQ ID NO: 1927 - DNA, 1189 bp, Prunus persica
gaaaagaaagcggagctgcccaatccaaacactgaaagagaagagagaaagatagaagaaagagagaagagcgaagagaatgtcaggcatggagaggcttcagaggatgttcgctggtgccggaggaggtttgggccacccacctcccgactcgccgactctcgattcttccgagcaggtttacatctcctccctcgccctcctcaagatgctgaagcacggaagggcgggagttccaatggaggttatgggattgatgctcggagagtttgtggatgagtacactgtacgtgtggtcgatgtgtttgctatgccgcagagtggtactggtgttagtgtcgaagctgttgatcatgtcttccagactaacatgcttgatatgcttaagcagactggacgaccagagatggttgtggggtggtaccattcacatcctggatttggctgctggctatctggtgtcgacattaatacacagcagagctttgaagcattgaatcaacgtgctgtggctgtggtggtggatccaattcagagtgtgaagggaaaggtggtcattgatgccttccgtcttatcaacccacaaactatgatgcttggccaagaaccacgccagactacatctaatcttggacatcttaataagccatccattcaagcattgatccatgggttaaaccgacattattactccatagcaattaattacaggaagaatgaacttgaggagaaaatgttgctcaaccttcacaagaagaaatggactgatgggttgacacttaggcgctttgataatcattcaaagacaaatgagcaaactgttgaggagatgaagaacttggctgtcaaatacaacaaagcagtccaggaagaggacgagttacctccagagaagctcgcgattgcaaacgttggaaggcaggatgccaagaagcaccttgaagaacatgtctccaacctgatgtcctcaaacatagtccagaccttgggaacaatgcttgatacggttgtgttctagagagttcgaggtccaagtctggaaactgaggttgcattactgtgtgagtggggccactgataatctttattgctttgaaacagtgttggtatgcaagactagttttagctgaactaaaagatctccatgaaagttcaaccatgtggacataaatttacttatggattgtgt

SEQ ID NO: 1928 - DNA, 1063 bp, Helianthus annuus
gtttccaaagaaatcaaaactctgatcggaacagagcaaacgcaggtagcgaaaatgtcagggatggaacgactacagagaatgttcgccggcgccggtggcgcgttaggtcacccgccaccggattcaccgactcttgatacatcggaacaagtctacatctcgtcacttgctctcttgaagatgcttaaacacgggagagcgggagttccgatggaagttatgggattgatgcttggagaatttgtggatgagtatactgtccgtgttgtagatgtgtttgctatgcctcagagtggtaccggggttagtgttgaagctgttgatcatgttttccagactaatatgcttgatatgcttaagcaaaccggaaggcctgaaatggtggttggatggtaccattcacatcctggatttggctgttggctatctggagttgacatcaacacacaacagagttttgaagcgctgaatcaacgagccattgcggtggtggtggatccaatccagagtgttaaagggaaggttgtcatagatgccttccgtttaattaacccccaaaccatgatgcttggtcaagagccacgtcagacaacttccaatcttggccatctcaataaaccatccatccaggcgttgatccatggtttgaacaggcattattactcgatcgccattaattacaggaagaataaactcgaggagaagatgctacttaaccttcacaagaaaaaatggactgatgggctcacacttgaacgatttgatacccattctaaaaccaatgagcaaactgtccaggaaatgctgagtctagctatcaaatataacaaagcggttcaggaagaggacgaattacctccggagaaactagcgatcgcaaacgttggaaggcaagatgccaagaaacatctggaagaacatgtgtcaaacttaatgtcatccaacatcattcagacattgggtaccatgcttgacactgttgtcttttaagcttttcaaccatgtatcttgtaccttgatgtgtgaatctagcaatttggtattgtggatttatggctta

SEQ ID NO: 1929 - DNA, 1108 bp, Helianthus annuus
ctaatgtcagggatggaacggttacagatcttgtcttgttaccaaagaaaactccattctctttgatcatcaactaatgtcagggatggaacggttacagcggatgttcgccggggccggcggcgcgttaggccacccgccaccggactctccgactctcgacacctctgagcaagtctacatctcttctctagcccttctcaagatgcttaaacatggcagagctggagtgcctatggaagttatgggattgatgcttggggaatttgttgatgagtatacggttcgggtggtcgatgttttcgctatgccgcagagtggtactggtgttagtgttgaggctgttgatcatgtttttcagactaatatgcttgatatgcttaaacaaactggcagaccagagatggtggttggctggtaccattctcatcctggattcggttgttggttatccggagttgacatcaacacgcaacagagttttgaagctctgaatcaaagagctgttgcagttgtggtggatccgatccagagtgtcaaagggaaggtcgtgatagacgccttccgtcttattaaccctcaaaccatgatgctcggccaagaaccacgacaaacaacttccaatcttggtcatctcaataaaccgtcaattcaagcactgatccatgggctaaacagacactactattcaatagctattaattacaggaagaacgaacttgaagagaagatgctattgaatctccacaagaagaagtggactgatggattgaaacttgaacggtttgatgcccattcaaaaaccaatgagcagactgtccaggagatgctgactctagccatcaaatataacaaagcggttcaggaagaggacaaactatcttcagagaagttagctattgcgaatgtgggacggcaggatgcaaagaaacatcttgaagagcatgtctcgaatctcatgtcatccaacatcattcagacgcttggtacaatgctcgacaccgtctcgttctagaatctagtctgtgttttctgttttggcagttggtacattgattaaccaatttcttgtaaacaactcgagggaaaagaaacaacttttacagtt

SEQ ID NO: 1930 - DNA, 1237 bp, Vinca minor
gagttgtcttcttcccaaagtaacttctctatttctagagagagagagaagaaaaaaaatacctaaatgtcaggaatggagagattacaaaggatgtttgccggagccggcggatctttgagccacccaccaccggactcacccactctcgattcatcggagcaagtctatatttcatctttggccttactcaagatgctcaaacacggtagagctggggttccaatggaagttatgggtctaatgcttggcgattttgtggatgaatatacggttcgtgttgtcgatgtgtttgctatgcctcagagtggtacgggtgttagtgtggaagccgtggatcacgtttttcagactaatatgcttgatatgctcaagcaaactggaaggccagaaatggttgtcggttggtaccattctcatccaggatttggctgttggctttctggtgtggacatcaacactcaacagagtttcgaagctctaaatcaaagagccgtggctgttgtggttgacccgattcagagtgtcaaaggaaaggtggtaattgatgccttccgtttgatcaatccccaaactatgatgcttggtcaagagccacgacagacaacatccaaccttggacatctgaacaaaccctctatccaggcgttgatccacggtcttaacaggcattattactcaatagccatcaactatagaaagaatgagcttgaggagaaaatgttgttgaatcttcacaagaaaaaatggactgatggattaactcttcagcgatttgacgcccattctaaaaccaatgagcagacagttcaggaaatgctaaacttggcgatcaaatataacaaagcagttcaggaggaggatgaattgccaccagagaagttggcaatagcaaatgttggaaggcaagacgccaagaagcatctagaagagcacgtctcgaacctcatgtcgtccaacattattcagacccttggaacaatgattgatacagttgtcttctagagtgttcaatcttcgaattcatatctaacttaaattgtttgatgttgatttcgattgagcgggatatgagaaaccaactgccatcagacttctgtttcctattgaatatctatctgtattcaaacaactttatgtactttgatttaggagagtattaaagattatctacaaaattatatgaatcagaagtcagaagccggttacttgtctacctttcttcttaattccgtat

SEQ ID NO: 1931 - DNA, 1118 bp, Secale cereale
  misc_feature (503)..(503): n is a, c, g, or t
  misc_feature (515)..(515): n is a, c, g, or t
  misc_feature (556)..(556): n is a, c, g, or t
  misc_feature (759)..(759): n is a, c, g, or t
  misc_feature (775)..(775): n is a, c, g, or t
  misc_feature (787)..(787): n is a, c, g, or t
  misc_feature (792)..(792): n is a, c, g, or t
  misc_feature (829)..(829): n is a, c, g, or t
  misc_feature (843)..(843): n is a, c, g, or t
  misc_feature (846)..(846): n is a, c, g, or t
  misc_feature (867)..(867): n is a, c, g, or t
  misc_feature (869)..(869): n is a, c, g, or t
  misc_feature (888)..(888): n is a, c, g, or t
  misc_feature (895)..(895): n is a, c, g, or t
  misc_feature (927)..(927): n is a, c, g, or t
  misc_feature (936)..(936): n is a, c, g, or t
  misc_feature (942)..(942): n is a, c, g, or t
  misc_feature (950)..(950): n is a, c, g, or t
  misc_feature (961)..(962): n is a, c, g, or t
  misc_feature (986)..(987): n is a, c, g, or t
  misc_feature (989)..(989): n is a, c, g, or t
  misc_feature (992)..(992): n is a, c, g, or t
  misc_feature (994)..(997): n is a, c, g, or t
  misc_feature (999)..(999): n is a, c, g, or t
  misc_feature (1009)..(1009): n is a, c, g, or t
  misc_feature (1015)..(1015): n is a, c, g, or t
  misc_feature (1017)..(1017): n is a, c, g, or t
  misc_feature (1020)..(1020): n is a, c, g, or t
  misc_feature (1024)..(1025): n is a, c, g, or t
  misc_feature (1028)..(1028): n is a, c, g, or t
  misc_feature (1030)..(1030): n is a, c, g, or t
  misc_feature (1032)..(1032): n is a, c, g, or t
  misc_feature (1034)..(1034): n is a, c, g, or t
  misc_feature (1041)..(1041): n is a, c, g, or t
  misc_feature (1048)..(1048): n is a, c, g, or t
  misc_feature (1050)..(1052): n is a, c, g, or t
  misc_feature (1055)..(1055): n is a, c, g, or t
  misc_feature (1057)..(1059): n is a, c, g, or t
  misc_feature (1076)..(1077): n is a, c, g, or t
  misc_feature (1079)..(1079): n is a, c, g, or t
  misc_feature (1088)..(1088): n is a, c, g, or t
ccacgcgtccgagctgaagcaatggagcgactgcagagaatcttcagcggcgccaccgggatggggcagctggggagcgactcgccgctgctcgactcctccgagcaggtctacatctcctccctcgctctccttaagatgctcaagcacgggagggccggcgtgcccatggaggtgatgggcctgatgttgggcgagttcgtcgacgactacacggtcagggtggtggatgtcttcgccatgccgcagagtgggaccggcgtcagcgtcgaggccgtcgaccacgtcttccagaccaacatgctcgacatgctcaagcagaccgggagacctgaaatggtggtaggctgtaccactcgcatcctggatttggttgttggctttcgggagttgacatcaatactcagcagagttttgaagctttaaaccccagggcagttgctgttgtgatagatcccatccagagtgtgaaggggaaggtggtcattgatgcattccgtctnattaaccctcanaccatgatgcttggccaggagccaaggcagacaacatccantgtgggcacctaaacaaaccatctattcaggcacttattcacgggctgaacaggcactactactccattgcaatcaattaccggaaaaatgagcttgaggagaagatgctgctgaacttacacaaaaagaaatggactgatgggttgattttaaagaaatacgacgcccactcaaagaccaacgaggagactgaacaggaaangctgagtctggccatnaaatacaacaangcagngcaagaggaggatgagctgccgcctgagaaactagcnatagcaaatgttgngcngcaggatgcaaagaagcactngnaggagcatgtctcgaattngatgtcntcgaacattgtccaaaccctaggaaccatgcncgacacagnggtctnttagtctnccaccactggnngttccaactctatacacagaactnncngtnannnntnatggtaacancctaananaanacannaananantncaagagnttaggtntnnnttntnnnaatagcacacaagcganncnactatcaanatataaaacgtaataataaaataataaaac

SEQ ID NO: 1932 - DNA, 1037 bp, Cephalotaxus harringtonia
agcgatggagagattgcagaggatcttctcaggcgcgagcggcatgggagctcccgctacggacggctctatgcttgattcatcagagcaggtctacatttcatcgctcgccctcctcaaaatgctcaagcacggtagagctggagtgccaatggaggttatgggactgatgcttggtgattttgttgatgagtacacggttcgagttgtagatgtatttgctatgccccaaagcggtactggagtaagtgtcgaagcagttgatcatgtttttcagacaaacatgcttgatatgcttaagcagactggcagaccggagatggttgtcggatggtatcattcacatccaggttttggatgctggctgtcaggtgttgatatcaacacccagcagagttttgaggctcttaatcaaagagcagttgctgtggttgttgatcctattcaaagtgtgaaggggaaggttgtgattgatgcattccgcttaatcaatcctcagactatgatgcttggccaggagcctcgacaaacaacttcaaatcttgggcatttgaataaaccatccatccaagcattgatccatggtttgaatcgacattattattcaattgctattaattataggaaaaatgaactggaagaaaagatgctgctcaacttacataagaagaaatgggctgatggtctgaccctgcaacgctttgattgtcatgctaagacaaatgaacagacagttcaggaaatgcttgatcttgcagtcaagtataataaagctgtacaagaagaggaccagctaccacctgaaaaacttgctattgcaaatgtggggagacaagatgctaaaaagcatctggaggagcatgtctcgaacctgatgtcttcaaacatagttcaaaccctagggaccatgcttgatacagttgttttctaagctattgtgttcactagttcttcaagtcttagtaacaagtaaacatcttttgctttgacatctctgcatttatcagaagcagcagatggaaaatggaacaaatggg

SEQ ID NO: 1933 - DNA, 1064 bp, Tripterygium wilfordii
gattgcagaggatatttggcggaggaatgggagggatgggtcagccgcatcccgattctccgctgctcgactcctcggagcaagtctacatatcgtcgctggcgctcctcaagatgctgaagcatgggagggccggggttccgatggaggtcatgggcctcatgcttggagagttcgtcgacgagtatactgtcagagtcgtcgatgtcttcgccatgccccagagcggtaccggcgttagtgtcgaggccgtcgaccacgtcttccagaccgatatgcttgacatgctcaagcagactggcagaccagagatggttgttggttggtaccattcacatcccggatttggttgctggctttctggcgttgatataaacactcagcagagttttgaggcattgaatcaaagagctgttgctgtggtggtcgatccaattcagagtgttaaagggaaagtagttattgatgcattccgtctcatcaaccctcaaacaatgatgctcggccaagaaccacgtcaaacaacgtctaatcttgggcatctgaacaaaccatcgattcaggctttgattcatgggctgaacaggcattactactccatagccataaactatagaaaaaatgaacttgaggagaagatgcttctgaacctgcataagaagaagtggactgatggcttgaccctgcgtcgatttgatacccattctaaaacaaatgagcaaactgtgcaggacatgctcaacttggccatcaaatataacaaggcagttcaagaagaagatgaattgtccccagagaaacttgctattgcaaatgttgggaggcaagatgctaagaagcatctggaagagcatgtgtcgaacttgatgtcttcaaatatagttcagactctcggaaccatgcttgatactgttgtattctagggtgatttgatgttgttttacattaaacactttgattttcaagcctgatttaggcacatggttatgcttggagaaactcctgtaaaactctcttaaagttgcccagtcattggacataatgtaggggcggtgaaagatcat

SEQ ID NO: 1934 - DNA, 1172 bp, Amsonia hubrichtii
tatcacaagccaagcaattcttaaacaaactcaaaatatctgtactgcgtagatacacatgtcgggaatggagagattacaacggatgtttgccggcgccggcggagccttgggccacgctccaccggactccccaaccctcgattcttcagagcaggtctacatctcctccttggcccttctaaagatgctcaaacacggtagagctggggtgccaatggaagttatgggtttgatgcttggggattttgtggatgagtacacggtgcgtgtggtggatgtgttcgctatgccacaaagtggtacgggtgtcagtgttgaagcggtcgatcacgttttccagacaaatatgcttgatatgcttaagcaaactggcaggccagaaatggtggttggctggtatcattcccatcctggatttggatgttggctttctggggttgacatcaacactcaacagagttttgaagctctaaaccaaagagccgtggcagttgtggtggatcccattcaaagtgtgaaagggaaggtggttattgatgccttccgtttgattaatcctcagactatgatgcttggtcaagagccacgacaaacaacatccaatcttgggcatctcaataaaccgtcaatccaggcattgatccacggtttgaacaggcattattactcgatagccatcaattatagaaagaacgaacttgaggagaaaatgttgttgaatcttcataagaaaaaatggacagatggattgactctccagcgatttgacacccattctaaaaccaatgagcagactgtccaggagatgctaaacttagccgtcaaatataataaagcagttcaggaagaggatgagttgccaccagaaaagttggcgattgcaaatgttggaaggcaagacgcgaagaagcatttagaagagcatgtctctaacctcatgtcatcaaacattattcagaccctcggaacaatgctcgataccgtcgtcttttagagtttcatccttaagaatttgtgcttgtgagatttgagaatttctacagtttcagacctgttattactactgccattattatctttgtaactgactttgttgccttctttctgactgctgatgtttttatttaaccagatattccctaacagattctgcccaaataaatccacat

SEQ ID NO: 1935 - DNA, 1075 bp, Arnica chamissonis
tcggaaaatgtcagggatggaacgactacagagaatgttcgccggcgccggtggagcgttaggccacccgccaccagattctccgactctcgatacatcggaacaagtttacatctcttcccttgccctcttgaagatgcttaaacacgggagagcgggagttcctatggaagttatggggttgatgcttggggaatttgtggatgaatatactgttcgtgttgtagatgtgtttgctatgcctcagagtggtaccggtgttagtgttgaagccgtcgatcatgttttccagaccaatatgcttgatatgcttaagcaaactggaagacctgaaatggtggttggatggtaccattcacatcctggattcggctgttggctatcaggagttgacatcaacacacaacagagttttgaagctttgaatcaacgagccattgcagtggtggtggatccaatccagagtgttaaagggaaggttgtcatagatgccttccgcctaatcaacccccaaaccatgatgcttggtcaagaaccacgtcagacaacttccaatcttggccatctcaataaaccatccatccaagcattaatccatggtttgaacaggcattattactcaattgccattaattacaggaagaataaactagaggagaagatgctacttaaccttcacaagaagaaatggactgatggattgacacttgaaccatttgatacacattctaaaaccaatgagcagactgttcaggaaatgttgaatctagctatcaaatacaacaaagcggttcaggaagaggacgaattacctcccgagaaactagctatcgcaaatgtcggaagacaagatgccaagaaacatctggaagaacatgtctcaaacttaatgtcatccaacatcattcagacattgggtaccatgcttgacactgttgtcttctaaactttccaattatgtatcttataccttgatgtgttttttctagcaagttgattgttgtggatttgtggtttagttatcaactatttaatattgcgtttaattaagaattataacattttaaaataaaaa

SEQ ID NO: 1936 - DNA, 1210 bp, Coffea canephora
aaatcgagctcaaaagccctgtccggcagcagggaaaaagaaaactcctgagaaatctagaaaatagaccatgtcgggaatggaaagactgcaaagaatgttcgccggcgccgggggcgctttaggccaccctccaccggactctccgactctggattcatcggagcaagtctacatctcatctctcgcccttctcaagatgctgaaacacgggagagctggggtaccaatggaagtgatggggctgatgcttggggattttgtggatgagtatactgtgcgtgttgttgatgtgtttgcgatgccgcagagtggtactggagtgagtgttgaggctgtggatcatgttttccagaccaatatgcttgatatgctcaagcaaactggcaggccagaaatggtggttggttggtatcattcgcatcctggatttggatgttggctttctggtgtggacatcaatactcaacagagttttgaagctttaaatcaaagagccgtggcagttgtggtagatccaattcagagtgttaaaggaaaggtggtaattgatgcatttcggttgattaatcctcagactatgatgctcgggcaagagccacggcagacaacatccaaccttggtcatctaaacaaaccatcaatccaggcattgatccatggtttgaataggcattattactcaatagcaatcaactacagaaagaatgaacttgaggagaaaatgctacttaatcttcacaaaaagaaatggacagatgggttgacactccagaggtttgacacacattctaaaaccaatgagcagacagttcaggaaatgctaaacttagccatcaaatacaataaagcagttcaagaggaggatgagctgccaccagagaagttggcaattgcaaatgtgggaaggcaagatgccaagaagcatctcgaagagcacgtttctaacttgatgtcatcaaacattattcagaccttgggaaaaatgcttgatacagttggcttttaatgacttttctttaggaaatgccaaaatgcttgatatttgattctgctgtcctatgaatgtgatcacttatttatttattaaggttacagtcctcaatattcatgattcgcactgtctttctgatgttgcacttggattagagtgatcaaaacattttcatgaacagcattgatttgtattcagttgtcatcgtacatcttt

SEQ ID NO: 1937 - DNA, 1070 bp, Flaveria ramosissima
agcaaacacaggtaggcaaaatgtcaggaatggagcgactacagaggatgttcgccggcgccggcggcgcgttaggtcacccgccgccggattctccgactctcgatacatcggagcaagtttacatctcatcacttgcccttttaaagatgctaaaacacgggagagcgggggttcctatggaggttatggggctgatgcttggggagtttgtggatgagtatacggttcgtgttgtggatgtgtttgctatgcctcagagtggtactggtgttagtgtggaagctgtggatcatgtttttcagactaatatgcttgatatgcttaaacaaactgggagacctgaaatggtggttggatggtaccattcacatcctggatttggctgttggctatctggagttgacatcaacacacagcagagttttgaagctctgaaccaacgggccattgcagtagtggtggatccaatccagagtgttaaagggaaggttgtgatagatgcattccgcctaattaacccccaaaccatgatgcttggtcaagagccacgtcaaacaacttccaatcttggtcatctcaataaaccatccattcaagcattgatccatggtttgaacaggcattattactctatagccattaattacaggaagaataaactcgaggagaagatgctacttaaccttcacaagaaaaaatggactgatggactcacacttgaaccatttgatacccattctaaaaccaatgagcagactgtccaggaaatgctgaatctagctatcaaatataacaaagcagttcaggaagaggacgagctacctccggagaaactagcgatcgccaatgtcggaaggcaagatgccaagaaacatctggaagaacatgtctcaaacttgatgtcatccaacatcattcagacattgggtaccatgcttgacactgttgtcttctaaacttttcaatcatgtatcttgtaccttgatgtgtgtttctaggcaatctgatcgttgtggatttgtggcttagttataactattttatatattgcatttaattaaaaaata

SEQ ID NO: 1938 - DNA, 1167 bp, Flaveria ramosissima
tttccaaagaaattgaacctctgatcttcaaaacagcaaacacagctagagaaaatgtcaggaatggagcgactacagaggatgttcgccggcgccggcggcgcgttaggtcacccgccgccggattctccgactctcgatacatcggagcaagtttacatctcatcacttgcccttttaaagatgctaaaacacgggagagcgggggttcctatggaggtcatggggctgatgcttggggagtttgtggatgagtatacggttcgtgttgtggatgtgtttgctatgcctcagagtggtactggtgttagtgtggaagctgtggatcatgttttccagactaatatgcttgatatgcttaaacaaactgggagacctgaaatggtggttggatggtaccattcacatcctggatttggctgttggctatctggagttgacatcaacacacaacagagttttgaagctctgaaccaacgggccattgcagtggtggtggatccaatccagagtgttaaagggaaggttgtcatagatgcgttccgcctaattaacccccaaaccatgatgcttggtcaggagccacgtcagacaacttctaatcttggtcatctcaataaaccatccattcaagcattgatccatggtttaaacaggcactattactctatagccattaattacaggaagaataaactcgaggagaagatgctacttaaccttcacaagaaaaaatggactgatggactcacacttgaaccatttgatacacattctaaaaccaatgagcagactgtccaggaaatgctgaatttagctatcaaatataacaaagcagttcaggaagaggacgagctacctccggagaaactagcgatcgcaaatgtcggaaggcaagacgccaagaaacatctggaagaacatgtctcaaacttgatgtcatccaacatcattcagacattgggtaccatgcttgacactgttgtcttttgaacttttcaacaatgtatcttgtaccttgatgtgtgtttctagcaatctgatcgatgtggatttgtggtttagttataactatttatatattttgctatttcattaagaattaataaatcttacatgttttatgtcatatgttttaatgatatcttgcttattgtaaaaaaaaaa

SEQ ID NO: 1939 - DNA, 1191 bp, Guizotia abyssinica
actctgatcggaaaaatgtcagggatggaacgactacagagaatgttcgccggcgctggtggagccttaggtcatccgccactagattctccgactctcgatacatcggaacaagtatacatctcttcccttgcgctcttaaagatgctcaaacacgggagagctggagttcctatggaagttatgggattgatgcttggggaatttgtggatgagtatactgttcgtgttgtagatgtgtttgctatgcctcagagtggtactggtgttagtgttgaagctgtggatcatgttttccagactaatatgcttgatatgcttaaacaaacaggaagacctgaaatggttgttggatggtaccattcacatcccggatttggctgttggctatctggagttgacatcaacacacaacagagttttgaggctctgaaccaacgagccattgcagtggtggtggatccaatccagagtgttaaagggaaggttgtcatagatgccttccgcctaattaacccacaaaccatgatgcttggtcaagagccacgtcagacgacttctaatcttggtcatctcaataaaccatccatccaagcattgatccatggcttgaacaggcattattactcaatagccattaattacaggaagaataaactagaggagaagatgctacttaaccttcacaagaaaaaatggacagacggattgacacttgaaccatttgatacccattctaaaaccaatgagcagactgtccaggaaatgctgaatcttgctatcaaatataacaaagcggttcaggaagaggacgaattacctccggagaaactagcgatcgcaaatgtcggaaggcaagatgccaagaaacatctggaagaacatgtgtcaaacttgatgtcgtccaacatcatacagacattgggtaccatgcttgacactgttgtcttctaaacacttcaaccatgtatcgtgtaccttgatgtgtgtttcttgatcattgtggatttgtggtttagttataactattagtattgcagctaattaagaatcgtaatgttagtgtttcaataattatctccaagacaaattgtccatttatgcttcatactttatgcgttatatatttttttagttgcatataatatagaacgttttatcctattttaatatgagtatggtcttgttatt

SEQ ID NO: 1940 - DNA, 1122 bp, Tabernaemontana elegans
agaaaacgtaatgtcaggaatggagagattacagcggatgtttgctggtgccggcggatctttgagccatcctgcaccggactctcccactctcgattcatctgagcaagtctacatctcttctttggccctgctgaagatgctcaaacacggtagagcgggggtgccaatggaagttatggggctgatgctgggggattttgtggatgagtacacggtgcgtgtggttgatgtgtttgctatgcctcagagtggtacgggagttagtgtggaagctgtggatcacgtcttccaaactaatatgcttgatatgctcaagcaaactggcaggccggaaatggttgttggctggtatcattcccatccaggatttggctgctggctttctggtgtggacattaatacgcaacagagttttgaagctctaaatcaaagagccgtggcagttgtggtggaccccattcagagtgttaaaggaaaggtggtaattgatgccttccgcttgattaatcctcaaactatgatgcttggccaagagccacgacaaacaacatccaaccttgggcatctcaataaaccatctattcaggcattgatccacggtttgaataggcattattactcaatagccatcaactacagaaagaatgaacttgaggagaaaatgctattaaatcttcacaagaaaaagtggacagatggattgactcttcagcgatttgacacccattctaaaaccaatgagcaaactgttcaggaaatgcttaacttggccatcaagtataataaagcagttcaggaagaggatgagttgcccccggagaagttggcaattgcaaacgtgggaagacaggatgccaagaagcatctagaagagcacgtctctaacctcatgtcatcaaacattattcagaccctaggaacaatgcttgatacagttgtcttttagagttcaatcttggaatgcatatgtgagacctgatgtttgatgttgatttctcttgagcaggatgtgagaaggcgactgctaccagacattcttttcctcaacttatttgcattcatacaaaattctgtacttccattaaaacaaattatgacaaattatattaatcggaagtc

SEQ ID NO: 1941 - DNA, 2572 bp, Solanum lycopersicum
aaggtctataaatagataatttaaccttgctaaaaaatcaattaattattttcttatactcataaacttatataaaaaaaaatgtcatcatctagttcatccaagttgcaatctccaattaatggtaaatttatcacaattctcagcatcgatggaggtggcattagaggattaattcctgcaactattctcgaatatcttgaatctcaacttcaggaattggatggtaaggatgctagactcgcagattatttcgatataattacaggaacaagcacgggtggccttgttaccgctatgctaacagctccaaacaaagagaatcgtcctctatttgctgctaaggatataaagcctttttatctcgagcatggtcctaacatattcccacaaaataatatgatactgattggatcaatgataaagggatggaagtttttaacaggaccaaaatataacggaaagtatcttcgtcaagtcataaaggagaaattagggggagactaaattgcatgagactttgactaatgtttaatgttgttattccaacttttgatatcaaaaatatgcaacctacaattttctctacttttgaggcgaaaaaacattcaataatgaatgctaagctttctgatatatgcattggaacatctgctgctccgacatatcttccagcacataattttcaaacccaaaacgaagatggcaaatttcatgagttcaatcttattgatggtgctatcgctgctaacaatccgaccttaattgctataaatgaagcgaccaaacaaatattcgaacaaaccccgtatttcaaaaatttcaaggaaatgaagcccactaattatgggaaatttttggttctctctattgggactggatcagcaaaattggaacataaatatgatgctaaaattgcatcaaattggggtatttttggatggctaactggtggaggctcaaatccaattattgatgcatttgctgatgctagtgatgatatggttgattatcatatttctgttgttttccaatctgttcattctcaaaaacattatcttcgtattcaggatgatacattaagtggagcagactccactgttgacatatcaaccaaagagaacatgaacaaattggttgaaattggcacaaatttattgaagaaaccagtttcaagggtaaatctacaaacaggcctatttgaacaattaaacaaagatggtggcacaaatgaagaagctttgaaagagtttgcaaagttgctttctgaagaaaaaaaaatcagaaatttcaaatcatctcctaccgatgaatctcgcagtagtcttgttctcaaagaaatccaaaaagcaaagcaaaacaaaacccaatcggagagtatgtctggaatggaaagattgcagcggatgttcgccggagctggcggcgcgttgggccacccgccaccggactctccaactctggactcttctgagcaagtctacatctcttctcttgccctcctaaagatgcttaaacacgggagggctggagttcctatggaggtgatgggattgatgttaggggatttcgtcgatgagtatacagtgcgtgtagttgatgtgtttgcaatgcctcagagtggtactggtgtgagtgttgaagctgttgatcatgtttttcaaaccaatatgcttgacatgctcaagcaaactgggagacctgagatggttgttggttggtatcactcacatcctggatttggctgctggctttctggtgttgacatcaatacacagcagagttttgaagcactgaatcaacgagcagtggctgtggtggtggatcctattcagagtgttaaagggaaggtggtaattgatgcctttcgcttgatcaatccccaaactatgatgcttggccaagagccacgtcagacaacatcaaatctgggacatctgaacaaaccatctattcaagcattgatccatggtttgaacagacactactactcaatagccataaactacagaaagaatgaacttgaagagaagatgctactgaatcttcacaagaagaaatggacagatggacttgcactccagcgttttgatgctcattccaaaaccaatgagcagacagttcaggagatgttaaatcttgctggcaagtataataaagcagtgcagcaagaggatgagttgaccccagaaaagctagctattgcaaatgtaggaaggcaagatgcaaagaagcatcttgaagaacatgtctctgatttgatgtcttcaaacattgtccagacattgggaaccatgctcgacactgttatcttctgaagttcatttatcccatgtctgcaaaagttgtgtttttagtagtgaaataggaacaattctttttgctgtttttcttttaaatgagacctagtacttcgttttactctgtcatagtagctcttatactatataacgttacgttattttaagatgacttttcggaaataatagtctgtaccattttcctaattcagtgcctgtctatttcgacaccatttaagtgaaggagatatacgttactccgttggtatttg

SEQ ID NO: 1942 - DNA, 1369 bp, Amorphophallus konjac
cttggagtagacggaagggggagggcgaagcgcgatggagaggttgcagaggatcttctctgttcccggcgcagtggggccgccgccctctgactcgccgctcctcgactcctccgagcaggtctacatttcgtccctcgcgctgctcaagatgctcaagcacgggagggcgggggttcccatggaggtgatggggctgatgctgggggagttcgtggacgagtacacggtgcgggtggtggacgtgttcgcgatgccccagagcgggacaggagtcagcgtcgaggccgtcgatcatgtattccagaccaacatgctcgacatgctcaagcagaccggcagacctgaaatggttgtcggatggtatcactctcatccaggttttggttgttggctttccggtgttgacataaatacgcagcagagttttgaagctttgaatcagagggctgttgcagtagtggtggatccaatccaaagcgttaaaggaaaggtggttattgatgcctttcgcttgatcaatccccagactatgatgctaggtcaggagcctcggcagacaacatcaaatcttggacaccttcataagccatccattcaggcactgatccacgggttgaaccggcattactattccatagcaataaactacaggaagaatgaactcgaggagaagatgctgctaaatctacacaagaagaagtggacggatggtctgacaatgcagcgatttgatgcccattccaagaccaatgagcagactgttcaggacatgctgagtttggcgatgagatacaacaaagctgtccaggaggaggatgagctaccgccggagaaactggcgattgcaaacgttggaaggcaggatgccaagaaacatctggaggagcacgtgtcccacctgatgtcggcgaatataatccagacactaggagccatgctagacactgtcatcttctagtcttagagtgggaaaaagttggtcttgtgcccgttgctctgattttcctgtttgcctgctttcgttttaaattcttcaatatttttgcttttttgcgctcaaactccatacgagctgtttgtggatttcttttgatggaatccatcaaaagtggatcagatgaatcttcggttcaagaggccatgacctaaacatgtgatagtataattttagacagaactatagccttagatatctcgtggatcggatgacagatgtaataaagatcgatccgaactgatcaaatttagatgaagtttgatctgatggtttgccataagtttttttttttggggggggggatggtttgagtctatatctctatacaattggaaggtggtttataatatttttatttttttaagtttt

SEQ ID NO: 1943 - DNA, 1214 bp, Tropaeolum majus
gttcgccggtgcaggtggtgccttggggcacccacctccggattctcctactcttgattcatcggagcaggtttacatctcctctcttgctctactcaaaatgcttaagcacggcagggctggggttcctatggaagttatgggtttgatgcttggagagtttgttgacgagtacactgttcgtgttgttgatgtatttgcgatgcctcaaagtggtactggtgttagtgttgaagccgttgaccacgttttccagactaatatgcttgatatgctcaaacagaccggaagaccggagatggtggttggttggtaccactcgcatcctggatttggctgttggctttctggcgttgacataaatactcagcagagttttgaagccttgaatcaacgggcagtagctgttgtggtggatcctattcagagtgtcaaaggaaaggtggtaattgatgcattccgtttaattaacccacaaactatgatgcttggccaagaaccacgacagacaacatccaatcttgggcatctcaataagccgtcaattcaggcattaatccatggcctgaacagacactattactcgatagccattaattacagaaagaatgaacttgaggaaaagatgcttcttaatcttcataagaagaaatggaccgatggattgacacttcaacggtttgatactcactccaaaactaatgaacagactgttcaggaaatgcttactttggctatcaaatacaacaaggcagtacaagaggaagatgaattgacaccagaaaagcttgcgatcgccaatgttggaagacaagatgcaaagaagcacctcgaggaacatgtctcaaacttgatgtcttctaacataattcagacattgggaacgatgctcgatacggttgtcttctagacattattttattaccgatgaatcatcactttacgaccagaggaagcattcaaaagccattgttgcatgaataacttcatagtagccacaaaaagacctcgaactagaccagaaaccccactcttctaagtcgggttccaaaacccaaaaaccgacaggtttgatcagatttttgttggttcggattgagttttaattacggttgaattatccgaatcttatccaaattttaatgcaaggatttattttaataactaaaaaaaaaaaaagtaacgactagtagactagaccaaacggacgaacc

SEQ ID NO: 1944 - DNA, 1140 bp, Curcuma longa
gcaccacatgaagagtagacgaagaaatgcaagggatggaaagactgcatcgcatcttctcgggtgccggcgggatgggccacccgccgaccgattccccgcaactcgactccgccgagcaggtctacatctcctctctcgccctcctgaagatgctcaaacgcgggagggctggggtgcccatggaggtgatggggctcatgctcggggagttcgtggacgagtacaccgtcagggtcgtccacgtcttcacgatgccgcaaagcgggacgggcgtcaatgtggaggccgttgatcacgttttccagaccaacatgctcgacatgctgaagcatacaggaagacctgaaatggttgtcggatggtaccattctcaccctggctttggctgctggctttctggtgttgatataaacatccagcagagttgtgaagccctcaatccaagggcaatagctgttgtggtagacccaatacagagtgtgaaggggaaggtggttattgatgcttttcgcttgatcaatcctcagacaatgatgcttggccaggaaccacgccaaacaacatccaatgttggacatctcaacaagccatccatacaggcgcttatccatgggctgaatcggcattactattctatcgcaataaattataggaagaatgaacttgaggagaaaatgttgctgaaccttcataaaaagaatggacagatggtttgatacttaggccttttgacactcattccaaaaccaacgagcagacagtccaggaaatgttggatctggctatcaaatataacaaagcagttcaggaggaggacgagcttccaccggaaaaattggccattgcaaacgttggaaggcaagatgcaaagaaacatctggaagagcatgtgtctaacttgatgtcttcaaacataatccaaactgtaggaaccatgttggacacagttgtatttgagaacacgacttaggattccttacctagacatcctccactgaacaatcagatttaatctattcgtgactgcctgtggtttgctaaaagaaaagacggtaatgctagtcttccaattgaacaagtgtagggcttgaaagcaaaatcttaaactatttattttcttcagagattatcatgcca

SEQ ID NO: 1945 - DNA, 1259 bp, Fraxinus spp
gacccaaaaccccagagactcagaaagaattctagatgtccggcatggaaagactacaacgaatgttcgccggcgccggcggcgctcttggacacccgccgccggattctccgacccttgatacctccgaacaagtctacatctcgtctctcgctctactcaaaatgctcaaacacgggagggcgggagtgccgatggaagtgatggggctgatgctgggggaatttgtagatgagtacacggtgcgcgtggtggacgtttttgcgatgccgcaaagtggaacaggggttagtgtggaggccgtggatcatgttttccagaccaatatgcttgacatgctcaagcaaactggcagacctgagatggtggttggttggtatcattcacatcctggttttggatgttggctttctggtgttgacatcaatactcaacagagttttgaagctttgaatcaaagagcagttgcggtggtggtggatccgattcagagtgttaaagggaaggtggtgattgatgccttccgtttgattaaccctcaaaccatgatgcttggccaagaaccacgccagacaacatccaacctggggcacctccataagccgtctatccaagcattaattcatggtttgaataggcattactactccatagccataaattataggaagaatgaacttgaagagaagatgcttctaaatcttcacaaaaagaaatggacagatggattgaccctgcagcggtttgatgaccattcgaaaacaaatgagcacacagttcaggagatgctaaatctagctaccaaatacaataaagcagttcaggaggaggatgaattacccccggagaagttagctattgctaatgtgggaaggcaagacgccaagaagcacctcgaggagcacgtctcaaacttgatgtcttccaacattattcagacactgggaacgatgctagacactgttgtcttctagagtcgaaaaactcaatttcttgaggttggttaaaccaaatttgatatatgatttgttttctcttggattcgatcaacacttttcaggtactgggggaatgcaagtgtgcaactatcccgtacatgattctatttccaatttgtcatgatttcctcttgtatttattctggtcgggataactaggtatactcaccaataattcgtaatttgtacaatcttcgaatgaagtttattgaacctatattgaattgattgacattgatatctactaaaatatattatata

SEQ ID NO: 1946 - DNA, 1149 bp, Lactuca sativa
cggcgggggttgagttcgatagatcttggcttgttaccaaagaaattcaaatcccttcatcggaagctaaaacagaatgtcaggaatggaacggctacagaggatgttcgccggcgcaggaggcgcactaggtcacccaccaccggactctccgactctcgatacatcggagcaagtttacatctcctccctagccctcctcaagatgcttaaacacggaagagcgggagttcctatggaagtcatgggcttgatgcttggggaattcgtcgatgaatatacagttcgtgtggtggatgttttcgctatgcctcaaagtggtactggtgttagcgttgaagctgttgatcatgttttccagaccaacatgcttgatatgcttaaacaaactggcagaccagagatggtggttgggtggtatcattcgcatcctggatttggttgttggttatctggagttgacatcaatactcaacagagttttgaagcactgaatcaacgcgcagttgcagtagtggtggatccaattcaaagtgtgaaaggaaaagttgtaatcgatgctttccgtttaatcaacccccaaactatgatgcttggccaagagccacgccaaacaacatctaatcttggacatcttaataaaccatccatccaagcacttatccatggtttaaacaggcattactattcaattgccattaattacaggaaaaataaactcgaggagaagatgctcttgaaccttcataagaagaagtggaccgatggtttgactctcgaacgttttgatacccattccaaaaccaatgagcagactgtccaggagatgttgggtttggcggtgaaatataacaaagcggttgaggaagaggacaaattgtcaccggagaagctggcgattgcaaatgtgggaagacaggatgcaaagaagcatctagaagagcatgtttccaatttgatgtcatcaaatatcattcagacattggggacaatgcttgacactgttgtgttctagttctctagatgaatctgttatgggaaagtgtgttttggtatacttggaaatgaatggaatgacttgttggatgggttaagttgtttgttgtgttgatggattttaatgaactgaaatgaatatttctttattag

SEQ ID NO: 1947 - DNA, 1159 bp, Lippia dulcis
ctctactttacgctagcaaagaaaaacacagaccgacgaaaaatgtcaggaatggaaagactacaccggatgttcgccggcgccggcggagcccttggccacccgccgccggactccccaactctcgacacgtccgaacaagtctacatctcatctcttgccctgctcaaaatgctcaaacacggtagggcgggtgtgccaatggaagtgatggggcttatgcttggggagtttgtggacgagtacacggtgcgtgtggtggacgtctttgcgatgccgcagagtggaactggggtcagtgttgaggccgtcgatcacgttttccagactaacatgcttgacatgctcaagcaaactggcagacctgagatggtggtaggatggtaccactcacatcctggctttggatgctggctttctggcgttgacatcaatactcaacagagttttgaagctctgaatcagagagcagttgccgtggtggtggatcctattcagagtgttaaaggaaaggtggttatcgatgccttccgtctgattaaccctcaaaccatgatgcttggtcaggagccacggcaaacaacatccaacttagggcatcttaataaaccatctatccaggctttgattcatgggctgaacaggcattattactctatagccataaattaccgaaagaatgaacttgaggagaagatgcttctgaatcttcacaagaagaaatggactgatgggttgaccctccagcggttcgatgaccactccaaaacaaatgagcagacagtcgaggagatgctaaatctagccatcaagtacaataaagcagttcaggaagaggatgaaatgcccccggaaaagctagctatcgccaatgtgggaaaacaggacgccaagaagcatctggaggagcatgtctcaaacttgatgtcttcaaacattgttcagacattgggtacaatgctggatactgtcgttttctagattctgggaggtttgagtgcataggaaatagacaaatatcgttccatagagtaacactctgctgtacctttaactcactgacattcatttcagagtcgtggtacttaaatttgcatcaaattgttgtcatgacttgatggagattaaactgaagcgcctaaaattatcttacttcgtg

SEQ ID NO: 1948 - DNA, 1076 bp, Vinca minor
aaaacctaatgtcaggaatggagagattacaaaggatgtttgccggagccggcggatctttgagccatccaccaccggattctccgactctcgatacatcggagcaagtctatatttcttctttggccttgctcaagatgctcaaacacggtagagctggtgttccaatggaagttatggggctaatgcttggcgattttgtggatgaatatacggtacgtgttgtcgatgtgtttgctatgcctcagagtggtacgggtgttagtgttgaggctgtggatcacgtttttcagactaatatgcttgatatgctcaagcaaactggaaggccagaaatggttgtcggttggtaccattctcatccaggatttggctgttggctttctggtgtggacattaatactcaacagagttttgaagctctaaatcaaagagccgtagctgttgtggttgaccccattcagagtgttaaaggaaaggtggtaattgatgccttccgtttgatcaatccccaaactatgatgcttggtcaagagccacgtcagacaacatccaaccttgggcatctcaacaaaccctctatccaggctttgatccatggtctgaacaggcattattactcaatagccatcaactataggaagaacgaacttgaggagaaaatgttgttaaatcttcacaagaaaaaatggactgatggattggcaattcagcgatttgacgcccattctaaaaccaatgagcagacagttcaggaaatgctaaacttggccataaaatataacaaagcagttcaggaggaggatgaattgccaccagagaagttggcaatagcaaatgtgggaaggcaagatgccaagaagcatctagaagagcacgtctctaatctcatgtcatccaacattattcagaccctcggaacaatgattgatacagtcgtcttctaggctttataagtcttcaaattcagatctaaaacttgatgtttgatgttgattttcatttgagcgagacgtgagaaaccgtctgtcatcggacatctgtttcttattgactatctgtattcaaacaacatt

SEQ ID NO: 1949 - DNA, 1329 bp, Lactuca sativa
ggaatgaaaaactgaaaaagattaagggcctattctgaaaacccctttgcataataagtaccatcatccatcttgagaaaaccctgttgagttcgaatagatcttggcttgttaccaaagaaattcaaatcccttcatcggaagctaaaacagaatgtcaggaatggaacggctacagaggatgttcgccggcgcaggaggcgcactaggtcacccaccaccggactctccgactctcgatacatcggagcaagtttacatctcctccctagccctcctcaagatgcttaaacacggaagagcgggagttcctatggaagtcatgggcttgatgcttggggaattcgtcgatgaatatacagttcgtgtggtggatgttttcgctatgcctcaaagtggtactggtgttagcgttgaagctgttgatcatgttttccagaccaacatgcttgatatgcttaaacaaactggcagaccagagatggtggttgggtggtatcattcgcatcctggatttggttgttggttatctggagttgacatcaatactcaacagagttttgaagcactgaatcaacgcgcagttgcagtagtggtggatccaattcaaagtgtgaaaggaaaagttgtaatcgatgctttccgtttaatcaacccccaaactatgatgcttggccaagagccacgccaaacaacatctaatcttggacatcttaataaaccatccatccaagcacttatccatggtttaaacaggcattactattcaattgccattaattacaggaaaaataaactcgaggagaagatgctcttgaaccttcataagaagaagtggaccgatggtttgactctcgaacgttttgatacccattccaaaaccaatgagcagactgtccaggagatgttgggtttggcggtgaaatataacaaagcggttgaggaagaggacaaattgtcaccggagaagctggcgattgcaaatgtgggaagacaggatgcaaagaagcatctagaagagcatgtttccaatttgatgtcatcaaatatcattcagacattggggacaatgcttgacactgttgtgttctagttctctagatgaatctgttatgggaaagtgtgttttggtatacttggaaatgaatggaatgacttgttggatgggttaagttgtttgttgtgttgatggattttaatgaactgaaatgaatatttctttattagaatgtgttttcttctatattgtggtgtttttagtagttttatcttggacttgttgaaaagcttgcgatatacattattttattattattattttttgtgtct

SEQ ID NO: 1950 - DNA, 1044 bp, Primula obconica
ttcgccggcgccggaggagctctaggccacccgccgccggactcgccgacgcttgacacgtcagagcaagtttatatctcttcgctcgcgcttcttaagatgctcaaacacggtagagccggagttccaatggaagtgatggggcttatgttgggtgaatttgttgatgagtatacagttcgtgtggttgatgtgtttgctatgccacagagtggtactggagttagtgttgaagccgtggatcatgttttccagacgaatatgcttgatatgctcaagcaaacagggaggcctgaaatggtggttgggtggtatcattcccatcctggatttggctgttggctatctggtgtggacattaatactcaacagagttttgaagctctgaaccagcgtgctgttgcggtagtggtggatcccatacagagtgttaaggggaaggtggttattgacgcctttcgtttaattaatccacagactatgatgctcggtcaagagccaaggcaaacaacatccaaccttgggcatctaaacaagccatcgattcaggcgttgatccacggtctgaataggcactattactcaattgcaatcaactacaggaagaatgaacttgaggagaaaatgttactgaaccttcacaagaagaagtggacagatggattgacacttcaaaggtttgatacccattccaagactaatgaacacaccgtccaggagatgctcaatttggcaatcaaatacaacaaggctgtgcaagaggaggacgagttgccacccgagaaactagcaattgcaaatgttggaaggcaagatgctaagaaacacctcgaagagcacgtgtcaaacttgatgtcttcaaacatagttcagactcttggcacgatgctcgacacagttgtcttctaagtttctctcccttcggtttctctcttatcagtccagggacgaagctaagtagtgagaatagagtgtcatggcaccccccataaaaataaaaatttcttgttctgattattgattatatatttacagtataatttg

SEQ ID NO: 1951 - DNA, 1153 bp, Silene vulgaris
atcttcacttgttaagagagagaaagtagacgacgaagaataagaataatggacagattaactcgcatgttcgccggcgccggaggtggtctggcccacccacccgtagattcaccaactctcgacacttccgaacaaatctacatctccgctaccgccctcctcaagatgcttaaacacggaagagctggagttccgatggaagtgatggggttaatgttaggagagtttgttgatgagtatactgttagagttgttgatgttttcgctatgccgcaaagtggtactggtgttagtgttgaagctgttgatcatgtttttcagactaatatgttggatatgcttaagcaaactggaaggcctgagatggtcgtggggtggtaccactctcatcctggttttggttgctggctctctggagttgacattaatactcaacagagctttgaagctttaaaccaacgagctgttgccgtggtggtagatccaatacaaagtgtcaaagggaaggtagttattgatgccttccgtctgatcaatcctcaaaccatgatgcttggtcaggagcctcgtcagacaacatctaaccttgggcacctcaacaaaccatcaattcaggcgttgatccacgggttgaacagacattattactccatagccatcaactacaggaagaatgaactcgaggagaagatgttgctgaacctgaacaaaaagaaatggactgacgggctaacacttcagagattcgatgttcactcacgaaccaatgagcagactgttcaggaaatgcgaaacttggccataaagtataacaaagcggttcaggaagaggatgaattgtccccagaaaagctagcaattgcaaatgtgggaaggcaagatgctaagaagcatcttgaagaacatgtctccaacttgatgtcatccaacattgttcagaccctgggaaccatgctagacacagttgtcttttaatttgtgaccgtttccgccttgacagataattgcggttactgttttcttttcttattatttttttctatgattttcagtcaatgtttagagctcggatagatacattgttctgaagttgatcggaaatattcatgtttcctctctctggactgtcctgaatattagggttatatgc

SEQ ID NO: 1952 - DNA, 1170 bp, Catharanthus roseus
tccttttttgctctagagagagaaaaacctaatgtcaggaatggagagattacaccggatgtttgctggtgccggcggatcattgagccatcctccaccggactctccaactcttgattcgtctgagcaagtctatatttcttctctggcactgctcaagatgcttaagcacggtagagctggggtgcctatggaagttatgggactgatgctgggggattttgtggatgaatatacggtgcgtgtggtcgatgtgtttgctatgcctcagagtggtacgggagtcagtgtggaagctgtagatcacgtcttccaaacaaatatgcttgatatgctcaagcaaactggcaggccagaaatggttgttggttggtaccattctcatcccggatttggctgttggctttctggtgtggacattaatactcaacagagttttgaagctctaaatcaaagagctgtggctgttgtggttgaccccattcagagtgttaaaggaaaggtggtaattgatgccttccgtttgattaatccccaaactatgatgcttggtcaagaaccacgacagacaacatccaaccttggacatctcaataaaccctctatccaggcattgatccatggtttgaacagacattattactcaattgccatcaactatagaaagaatgaacttgaggagaaaatgttattaaatcttcacaagaaaaaatggacagatggattgactctccagcgatttgacacccattctaaaactaatgaacagacagttcaggaaatgctaaacttggccatgaaatataacaaagcagttcaagaagaggatgagttgccgccagagaagttggcaatagcaaatgttggaaggcaagatgcaaagaagcacctagaagagcatgtttctaacctcatgtcatcaaacattattcagacccttggaacaatgattgatacagttgtcttctaagatttagttcttcaaaatgcatatatcaaagacttttagtgttcgatgttgatttccattgaggatcacacaatttgtttcaccctttgacttatatattttgcattcaaacaagagattatgtactttcattttctttactagtattaatggattatcacaaaattatattaatcagaagtcagctatctgttgcttgc

SEQ ID NO: 1953 - DNA, 1202 bp, Cichorium intybus
aatttgaaatctcttttgcacatttatcaagcatccatcaggccggagaaaaaaaccctttcaagttttggagatcttggcttgttaccaagaaattcaactctcttcatcggaagctaacacataatgtcaggaatggaacggctacaaaggatgttcgccggcgcaggaggcgcgttaggtcatccaccgccggactccccgactctcgatacatcggaacaagtttacatctcctccctagccctcctcaagatgcttaaacacgggagagcgggagttcctatggaagttatgggattgatgctcggggaattcgtggatgaatacacggttcgtgtggtggacgtcttcgctatgccgcagagtggtactggtgttagtgtcgaagctgtcgaccatgttttccaaaccaacatgcttgatatgcttaaacaaactggcagaccagagatggtggttgggtggtaccattcacatcccggatttggttgttggttatctggagttgacatcaacacacaacagagttttgaagctctgaatcaaagagctgttgcagttgtggtggatccaattcaaagtgtgaaagggaaagttgtaatcgatgcattccgcctaattaacccccaaaccatgatgcttggccaagaaccacgccaaacaacatccaatcttggccatctgaataaaccatccatccaagcattgatccatggattgaacaggcattactattcaattgccattaattacaggaagaataaacttgaggagaagatgctattgaacctccataagaaaaaatggaccgatggattaacacttgaaagatttgatacacattcaaaaaccaatgagcaaactgttgaggagatgttagggttagcagtgaaatataacaaagcggttgaagaagaagacaaattgtctccagaaaagctggcgattgcaaatgtgggaagacaggatgccaagaaacatctagaagaacatgtctccaatctcatgtcatcgaatatcattcagacactcggtaccatgcttgacacagttgtcttctagaatgttgggaaattgatgtaatggtttgttggattgaatgaaatgtactaaattgttccataagagtttgttttctctattttgtagtggggatgtttttttttcaatgtcatgttggagttgattgaaatattgtt

SEQ ID NO: 1954 - DNA, 1170 bp, Physcomitrella patens
aatcttatttcgaggtcgaaggagggtgatcagttgccgtcaatttgcgaaatctctcttcatgttcaggagtttttgagtctttgaggacagcaagtgtgtgattctaacgcgatggattcaagactgaataggattttcgccgggagcggtggagggggtggcccgcacccagactcgcctctcgttgattcatcggagcaagtctacatttcttccctggcgttgcttaaaatgcttaaacatggtagagcgggagttcctatggaagtgatgggactgatgctcggggagtttgtggacgagtacactgttcgtgtcgtagatgtatttgctatgcctcagagtggaactggcgtgagtgttgaagcagttgaccccgtttttcaaacgaagatgctcgacatgctcaagcaaactggccggcctgagatggtcgttgggtggtatcattcacatccagggtttggctgctggttgtctggcgtggatatcaatacgcaacagagttttgaagctttgaatcaaagagctgtggcagtagtggtggatccaatccaaagtgtgaaaggaaaggttgtgattgatgcttttcgattgatcaacccccagacaatgatgttgggacaggagcctaggcagaccacttcaaatgttggtcatcttaacaagccttccattcaggctttgattcatggattgaaccgacactattattctattggcattaattatcggaagaatgaattggaagagaaaatgcttttgaaccttcacaagaagaagtggactgatggactcactctgcaacgatacgacgaacatggaaaaactaatgagtccacggtgaaggaaatgttagatctcgcaatcaagtacaataaggctgtgcaagaagaagaccagctcagtccagagaagttggctattgccaatgtggggcgtcaagatgcaaagaagcatttagaagagcatgtctctaatttgatgtcttccaatattgtgcagaccttgggaaccatgcttgacaccgttgtcttctagtggatgtgctttatatggtatctaggaactgtcctcatttttggtgaagtacatatccatagaagaactccaagctcaatgaaactgtccttgttaattgtaatttctttttccacgcttttcttc

SEQ ID NO: 1955 - DNA, 1147 bp, Utricularia gibba
ggaaattcatccggaatgtttcgccggagccggaggcgctctaggccacccgccgccggactcgccgacactagattcctccgaacaagtctacatttcttctctagctctactcaagatgctcaaacacggtagggctggcgtgcccatggaagtgatggggctgatgttgggggagtttgtggacgagtacacggttcgtgttgttgacgtgtttgccatgccccagagcggaactggggtcagcgttgaagctgttgatcatgttttccagacaaatatgcttgatatgttaaaacaaactggaaggccagagatggttgttggctggtatcactcgcatcctggttttggctgctggctttcaggtgttgacataaatactcagcagagttttgaagcattgaaccagcgagctgtggctgtcgttgttgatcccattcagagcgtgaaggggaaggtggtgattgatgcatttcgcttgattaatcctcaaacaatgatgcttggtcaggagccacggcaaactacatccaacctaggacatctaaataaaccctctatccaggcactgattcatggcttgaacagacattactattcgattgccatcaattacaggaagaatgaacttgaggaaaagatgcttttaaaccttcacaagaaaaaatggacagatgggcttacccttgagcggtttgatgcacactcgaagaccaatgagcagactgtccaggagatgctcaaactggctttcaaatataacaaagcagttcaagaggaggacgcgttgccaccagaaaagctcgccatcgctaatgttggaaagcaagatgctaagaagcacctcgaggagcatgtctcaaacttgatgtcttccaacattgcccaaactttgggtatgatgctggacacggttgttttctagtttaagcatatcaacttcccacctaaggagcaagcatatcatgacgtttgataagctttgtctttttttttttcctgattgttttacatgcccgttgcatcttcacgtgatttgttgggaacacagtgtctagtgactataattccaattgacatgatatggttatcttctgagttgtaccagcttccatgtcattattgaagcgattgaattgcaggt

SEQ ID NO: 1956 - DNA, 1178 bp, Ceratodon purpureus
gatgagatcacttccctgaaatcgatcacctcgaaacggaaccagaaagcttcaggagcaaaaacttcgctgcactcggccccgaacccactcgactcgactcatctctctcgttccactcctctcagcatcgccatggagtccaggttgcaccggatctttgcggggggtggtgcggggggcggaccgcacccggactcgccgctggtcgattcatcggagcaagtgtacatctcctcgctcgcgcttctcaaaatgctcaagcatgggagggctggcgttccgatggaggtgatgggactgatgctcggggagtttgtggatgagtacacggttcgcgttgtggatgtgtttgctatgccccagagtgggacgggggttagtgtggaggcggttgaccctgtgttccagacgaagatgctcgacatgttgaagcaaactggccggccagagatggtcgtgggttggtatcattcgcatccaggatttggttgctggttgtctggcgtggatatcaacactcaacagagttttgaagctctgaatcaaagggcggttgcagtggtggtggatccaatccaaagtgtgaaagggaaggttgtgatagatgctttccgattgatcaaccctcagacgatgatgttgggccaggagcctaggcagaccacttcaaacattggccatcttaacaagccttctattcaggctttaatacatgggttgaaccggcactactattcaattggaatcaattaccgaaagaatgaactagaggagaaaatgcttctgaaccttcacaagaagaagtggactgatggactcacacttcagcggtatgacgagcatgggaaaacaaatgaatctaccgtgaaggaaatgttggatctggcaattaagtataataaggctgtgcaagaggaagaccaacttagtccagagaagctggctattgccaatgtggggcgtcaagatgcgaagaagcacttagaagagcatgtctcgaatctgatgtcttccaatattgtgcagaccttgggaaccatgcttgacaccgtcgtcttttagtatgcttctgtacaggaacaggatatggtccttatttggccaagtaaatagagctagatttatgtggaaattgaggaagttgtttcattgttactgttaattccattctgaag

SEQ ID NO: 1957 - DNA, 1467 bp, Ceratodon purpureus
gtcgtcgtcgtcgtctagaagcgtcgtcgcgggaggaaggaagggagcggagaaggcagagcatcgggccttgcactgctcgcgggctcgatcgattcactgcgcatctgttttcgatcgggagaagctagttgctggtcatggagtccaggttgcacaggatcttcgcggggggcggtgcggggggcgggccgcacccggactcgccgctcgtggattcctcggagcaagtctacatctcctcgctggcgcttctcaaaatgctcaagcatgggagagctggcgttccgatggaggtgatggggctgatgctcggggagtttgtggatgagtacacggttcgcgttgtggatgtgtttgctatgcctcagagtgggacgggggttagtgtggaagcagtcgaccctgtcttccagacgaagatgcttgatatgttgaagcagactggccggccagagatggtcgtgggttggtatcattcgcatccaggttttggttgctggttgtctggcgtggatatcaatactcaacagagttttgaagctttgaaccaaagggcggttgccgtggtggtggatccaatccaaagtgtgaaagggaaggttgtgatagatgcgttccgattgattaaccctcagacgatgatgttgggtcaggagcccaggcagaccacttcaaacattggccatcttaataagccttctattcaggctttaatacatgggttgaaccggcactactactcaattggaatcaattaccggaagaatgaactagaagagaaaatgctactgaaccttcacaagaagaaatggacggatggactcacacttcagcggtatgacgagcacgggaaaacaaatgaagctacagtgaaggaaatgttggatttggcaattaagtacaataaggctgtgcaagaggaagaccagctcagtccagagaagttggcgattgccaatgtggggcgtcaagatgcgaagaaacacttagaagagcatgtctctaatttgatgtcttccaatattgtgcagaccttggggaccatgctcgacactgttgtcttctagtatgcttccatacagcagcaagatactgttcttattttggccaagtaaatagagctagattcttatgtgaaaattgaggaagttgttcctattattgcatatatctagtactgttaattacattctgcacttttgtttgcatgaaccaagaagtatgatttgaacatgtatagtacccactagaaaattacgtctctggtttcattagggtcgacacagtgcaggtgataggaacttcgaccgagcactacggggtgaaaaatgcttcaaattgagaactgcgttgctgagtcaacgaagtgtacttttatgtcattctaaatttgcacgatcaaatcgagcaaaaaatacatcaattgggcttctgcgacacattgctcgctgacttatgttgccg

SEQ ID NO: 1958 - DNA, 1350 bp, Gossypium hirsutum
ttttatctttagttctcgaattgaaacctttatcattttcttatacacaattttatgaatttaaatccaagtattacaaaaatatccgataagctgtgaatcagccaaggaaaaagaaacaaaagatttagaggtccttgtcctgctactaagtaaaggttcccaaaagtctgatttacaatgtctggcatggacagattacagaggatgttcgccggtgcaggaggcacgttgggtcacctgccaccggattccccgactctcgacttgtcggagcaagtttacatacctctctcgccctcctcaaaatgctcaagcacggaagagctggagttcccatggaagttatgggtttgatgttgggagagttcgtcgatgagtacattgtgcgtgttgttgacgtctttgcaatgccacagagctgtacatgtgttagtgtggaagcagtggatcatgtttttcaaacaaatatgcttgacatgctcaaacaaacaggaaggcttgagatggtggtgggttggtaccattcacatcctggatttggctgttggctttctggtgtagacataaacacacagcagagtttttgaagctttgaaccaaagggctgtagcagtggtggtggacccaattcagagtgttaagggaaagtggtgattgatgcattccgcttgatcaacccacaaaccatgatgcttggccaagaaccacgtcagacaacatctaatctcgggcatcttaataagccatctattcaagcattaatacatgggctaaacagacattactactccatagccattaactaccggaagaatgaactggaggaaaagatgctgttgaatcttcacaagaagaagtggacagatggactgacacttagacgtttcgatactcattccaaaactaatgagcagactattcaggaaatgctgaatttagctataaaatacaataaggcagtgcaggaggaaggtgaattacctcctgagaagctggcgatcgcaaatgtcggccggcaagatgccaagaagcacttagaggaacatgtctcgaacttgatgtcgtcaaacatagttcagacattgggaactatgctcgacacggtggtgttctaaaactcttttagcacctgtatactcttttttcatattcaggaactatcatagcttgttggtcaaaaaactgccattgtattgtcaaatttgaaagggactgtcatgttgtctcattaatctctctgttatcccctctttgatgtgtaagtgggattgtgaagatgtttaacttttgttacttgccttctggtagttttctgagattcttcatattgcaattattgctcaagtt

SEQ ID NO: 1959 - DNA, 1262 bp, Physcomitrella patens
cttcttcttcgaggtctttcgattgacgatctcggtggatgctcttgttgctgtcaccacagatcggaggtttctctcggtggatttttgtgggattcgcgttaattgcgtagattggtgggattttttgtttgggccacttcggatcacaagttttttgggttcgacgctatggattcaaggctgcacaggatttttgctgggggcggttctggaggtggaccgcatccagattcacccctcgttgattcgtcggagcaagtgtacatttcctctctggcgctgctcaaaatgctcaaacatggtagagctggagtgcctatggaggtgatggggctgatgcttggggagttcgtggacgagtacactgttcgtgttgtggatgtatttgctatgccacagagtggaacaggtgtaagtgtggaagcagttgaccctgtctttcaaacgaagatgcttgatatgctcaagcaaactggtcgaccagagatggtggtgggctggtaccattctcatccaggttttggttgctggttgtctggcgtggatatcaatactcagcagagttttgaagctttgaatcaaagggcggtagcagtagtagtggatccaatccaaagtgtgaaaggaaaggttgtgatcgatgcttttcgattgatcaaccctcaaacaatgatgttgggacaggagcccagacaaaccacatcgaacgttggacatcttaacaagccctccatccaggctttaatccatggattaaaccgacactactattcaatcggaattaattatcggaagaatgaactagaagagaaaatgcttttgaaccttcacaagaagaagtggactgatggacttactcttcagcgatatgacgagcatggaaaaactaatgaagccacagtgaaagaaatgttggatttagcaatcaagtacaataaagctgtgcaggaggaagaccagcttagtccagagaaattggctattgtcaatgtggggcgtcaagatgcgaagaagcacctagaagagcatgtctctaatttgatgtcgtctaatattgtacagaccttagggaccatgcttgacaccgttgtcttctagttggcgtgatttatacggtactaaagaactgttttcgttttgatgaactggatagaggtaggttatttgaaggttaatgaagctgttattatttcaatcttatactgtatctttgtacttgtcacatgaatcaaagaactatttgacaatcatgttctgtc

SEQ ID NO: 1960 - DNA, 1000 bp, Papaver somniferum
gggaggacatccacctccagattcaccactcttagattcatccgagcaagtttacatttcttctcttgcactcctcaagatgcttaaacacggaagagctggggtccctatggaagtcatgggattgatgcttggggagtttgtagacgaatatactgttcgtgttgttgatgttttcgccatgcctcagagtggtactggtgttagtgttgaagctgttgacccagtgttccagactaatatgctcgatatgcttaagcagacgggcagaccagagatggttgtaggatggtatcactcgcatcctggatttggctgttggctctctggtgttgatattaatacacagcagagttttgaagctttgaatcagagagctgttgccgtggttatagaccctatacaaagtgttaagggtaaggtagtcattgatgccttccgtttgatcaatcctcaaaccatgatgttgggacaagagccacgacagacaacatcaaaccttggatatctcaacaagccgtccattcaagctttgatccatgggttgaataggcattactattcaatagcaattaattacaggaaaaatgaacttgaggagaagatgttgctgaatcttcataagaagaagtggactgatgggttgactctgcagcagtttgattctcattcaaaaactaatgagcagactgtagaggaaatgcgaagcctggccatcaaatacaacaaagctgttcaagaggaggatgagttatccccagagaagcttgctattgccaatgttggtaggcaagatgctaaaaagcacctggaagagcatgtcaataacttgatgtcatcaaacattatccagaccctgggaaccatgcttgacaccgttgtgttttaggattatcaatctagaagtttctttccaaggttattgaaatttcagatttactcttttgttataaagtagtgtccgtggaagttaacatcgggaaatgtttaatgttggtgg

SEQ ID NO: 1961 - DNA, 1179 bp, Marchantia polymorpha
  misc_feature (481)..(481): n is a, c, g, or t
  misc_feature (1143)..(1143): n is a, c, g, or t
  misc_feature (1178)..(1178): n is a, c, g, or t
cagagcacggtcgtggacgaaggcaagtctcagtcggtcgagaagcagaggcagatcggtgcagcgatttcttctccttgttttgtgaaattgtgagctcgatcgtcatcagcctgatcggcttgtcggttatttcaatccggaaacatggaaaggttgcaaaggattttctcgggcgttggagcaggtggtggtggcatgggcggaccgcaccctgacgcccctctcgtcgattcttccgagcaagtttacatctcatcgttggcgttgttgaagatgcttaagcatggaagggctggagttcctatggaggttatgggtttaatgcttggcgagtttgttgacgagtatacggttcgagttgtagatgtgtttgccatgcctcagagtggacaggagtgagtgttgaggccgtggaccccgtttttcaaacgaatatgcttgacatgttgaagcaaactggcaggccagagatggtggngggttggtaccattctcatccaggattcggctgctggctttctggtgttgatatcaatacccaacagagttttgaagctctgaaccagagatcggttgcagtcgtggttgatcctattcaaagtgttaagggaaaggtcgtcatcgatgcttttcggttgatcaacccccaaacaatgatgttgggccaggaaccacgacagacgacttcgaatttgggtcacttaaacaagccatcgattcaggcattgattcatggtttgaatcgccattattactccattggtattaactatcgcaagaatgagctggaggagaaaatgctcttaaatctacacaaaaagaagtggacagacggcctgacgttgcaacgtttcgacaatcatgcgaagactaacgaggctactgtacaggaaatgttggagcttgctgtaaagtacaacaaagctgttcaagaggaagatcaattgtctccagagaagctagctatcgccaatgtaggacgacaagatgccaagaaacatctagaggaacatgtatcaaaccttatgtcctcgaacatagtgcagacccttggtaccatgcttgacacagtcgtattttaggatgttaaatatatgttgcagaattttgatctattattcgaaaaggtcgttttgtatnctgaattctgcttcatctgaacatgatgcatgacnc

SEQ ID NO: 1962 - DNA, 1117 bp, Artemisia annua
ctcgcgtgtcagtactccaacggggatactcacaaacaccgatcggaaaactcacacatccaaccaaacaaactccggtcaaaaaaagaaaaagttaatgtcagggatggaaagaattcaaagaatgctagctggtggtggtggcgcgttaggtcacgctcctccagattcacccactctcgacacatctgagcaagtttacatctcttcccttgctctcttgaagatgcttaagcacgggagagctggtgtgcctatggaagttatgggattgatgcttggtgaatttgttgatgagtatacggttcgtgttgtcgacgtctttgctatgccgcagagtgggactggtgtcagtgttgaagctgttgatcatgttttccagactaacatgcttgatatgcttaaacaaactggaagacctgaaatggtggttggatggtaccattcacatcctggatttggctgttggttatctggagttgacgtcaacacacaacagagttttgaagctttgaaccaacgagctgttgcagtggttattgatccaatccaaagtgttaaagggaaagttgtcatagacgcattccgcacaatcaaccctcaaaccatgatgcttggtcaagagccgcgccagactacttctaatcttggtcatctgaacaaaccatccattcaagcactgatccatggtttaaacaggcattattactcaatagccatcaattacagaaagaatgagcttgaggagaagatgctattgaaccttcacaagaagaagtggactgatggactgacccttgaacgatttgatactcattccaaaaccaatgaggtgactgtccaggaaatgctgggtctagctatcaaatataacaaagctgttcagacgaactgtccccagagaaactagcaattgctaatgttggaagggaagatgccaagaagcatctggaagaacatgtctctaacctaatgtcatccaacatcattcagacattgggtaccatgcttgacaccgttgtcttttaaacttgaaattgtatgtttcatgtattgtgtaccttgaaactatcttgcaagtgatttagaaagccacagttctttgtttatcagactt

SEQ ID NO: 1963 - DNA, 1294 bp, Triphysaria pusilla
caaaattctagataaaaagaaaggcaccgaactagcgaaagaaaaaagaaaagaacaagcaaaaaccaatggccggcatcgaaagactacagcgtatgttcgccggcgccggcggcagcctcagccacccgcctgtggactccccaaccctcgacacatccgaacaagtctacatctcgtctcttgcgctactcaaaatgctcaaacacggtagggctggggtgccgatggaagtgatgggtctcatgctgggggagtttgtggacgagtatacggtgcgtgtggtggatgtgtttgctatgccgcagagtgggactggtgtcagtgttgaggctgtggatcccgttttccagactaatatgcttgacatgcttaagcaaactgggagacctgagatggtggttggttggtaccactcacatcctggatttggttgctggctttctggtgttgacattaatactcagcagagttttgaagctttgaatcagagagcgatagcagtggtggtggatccaatccaaagtgttaaaggaaaggtggtaatagacgcctttcgtctgattaaccctcagtctatgatgctcggtcaagagccaagacaaacgacatcaaacctagggcatcttaacaaaccatctatccaggctttgattcatgggctgaacaggcattattactcgattgcaataaattacaggaaaaatgaacttgaggagaagatgctcctgaatcttcacaagaaaaaatggactgatgggttgactctccagcggtttgatgcccactccaaaaccaatgagaagacagtcgaggagatgctaaatctagctaccaaatataataaagcagttcaggaggaggatgagatgccgccagagaaactagctattgcgaacgtgggaaaacaagacgcaaagaagcatctcgaggatcacgtctcaaacttgatgtcatcaaacattgttcagacgctggggacgatgctggacaccgttatcttttaaatttcagaatcgaaagaacaattgtgaaatttttatgccttcaattgaactcactattgttttcgagttttattttgttgtaccttccttattattactcaaacaattgcaattcaatagaactaagcgttgtcacaaaaattacacttgcagttatgaattacgaattactacacaataggcggcatatccctgttgaagaaattagccattcttctcatcctttctttagccttgtcacttttcatgtcacgcagatgaaaaacatgttcttccccttccgtttc

SEQ ID NO: 1964 - DNA, 1113 bp, Centaurea maculosa
  misc_feature (425)..(425): n is a, c, g, or t
  misc_feature (873)..(873): n is a, c, g, or t
  misc_feature (877)..(877): n is a, c, g, or t
  misc_feature (881)..(881): n is a, c, g, or t
  misc_feature (897)..(897): n is a, c, g, or t
  misc_feature (912)..(912): n is a, c, g, or t
tggtccggattcccgggatctccgatcgagaaaagagagctaatcgccggtgaaagaatatgtcagggatggagcggctacagaggatgttcgccggcgccggcggcgcgttaggtcacccgccaccggattcaccgactcttgatacatcggagcaagtttacatctcttcacttgccctattaaagatgcttaaacacgggagagctggagttcctatggaggtcatgggtttgatgcttggggaattcgtggatgagtatacggttcgtgtggtggatgtgtttgctatgcctcagagtggtactggtgttagtgtggaagctgttgatcatgttttccaaactaatatgcttgatatgcttaaacaaaccggaagacctgaaatggtggttggatggtaccattcacatcctggatttggntgttggttatctggagttgacatcaacacacaacagagttttgaagctttgaatcaacgagcagttgcagtggtggtggatccaatccagagtgttaaggggaaggttgtgatagatgcattccgtctaattaacccccaaactatgatgcttggccaagagccacgtcaaacaacttccaatcttggccatctcaataaaccatccatccaagcactgatccatggtctgaacaggcattattactcgatagccattaattacaggaagaataaactcgaggagaagatgctactgaaccttcacaagaagaagtggaccgatggattgacacttgaacgctttgatacccattcaaaaaccaacgagcagactgtccaggaaatgctgagtttggctatcaaatataacaaagcggttcagagagacgagctactcagagaactancgantggnacgttgggagcaggangcaaagaagcatctngaagagcacgtgtcgaacttaatgtcgtccaacatcattcagacgttgggtaccatgctcgacaccgttgtcttctaaacttgagatgctaaatctatattttccatgtattatgtactctttgcaagtgattttagaaagcaactgttcaagtttgtttatgagactatgatgcttttattcttacatttttaccctctg

SEQ ID NO: 1965 - DNA, 1272 bp, Taxus baccata
atgggaccacccgctacagacggcccaatgcttgattcatcagagcaggtctacatttcatcgctcgccctcctcaaaatgctcaagcacggtagagctggagtgcctatggaggttatgggattgatgcttggtgattttgttgatgagtacacagttcgagttgtagatgtatttgctatgccccaaagtggcactggagtaagtgtcgaagcagttgaccatgtttttcagacaaatatgcttgacatgcttaaacagactggcagaccggagatggttgtaggatggtaccattcacatccaggttttggatgctggctgtcaggtgttgatatcaacacccaacagagttttgaggctcttaatcaacgagctgttgccgtggttgttgatcctattcaaagtgtgaaggggaaggttgtgattgatgcattccgcttaatcaatcctcagactatgatgcttggccaggagcctagacaaacaacttcgaatcttgggcatctgaacaaaccatccatccaagcattgatccatggtttgaatcgacattattattctattgctattaattatcggaaaaatgaactagaagaaaagatgctgctcaacttacataagaaaaaatgggctgatggcctgaaccttcaacgctttgattgtcatgctaagacaaatgaacagacagttcaggaaatgcttgatcttgcagtcaagtataataaagccgtacaagaagaggaccagctacctcctgaaaaacttgctattgcaaatgttgggagacaagatgctaaaaagcatctagaggagcatgtctcgaacctgatgtcttccaacatagttcaaactctaggaaccatgcttgatactgttgttttctaaggcctttgtgtttacaagtatattccaagtcccagaaacaagcaaacatcttcagctttgacatatctgcatttatcataagcagcagcagaaaatggaaggagtgggactacctccaagatggtttatttgttagaattttggagtgggactgtatattcaattctttggtgtaatgaaattattcatgcagcttatagttgaagtgattgacactctgaagtggacaatgctattattttaattatttggatattggaaatgttttgttaaatttagttctgtggtacggtgccagttcttctctactataattgtttatttgtctatatgatctgctaaacatattgatgtcgctaaaaatgtgggcaatgtatagcttta

SEQ ID NO: 1966 - DNA, 1101 bp, Cleome gynandra
ctccgactctcgatacgtcggaacaggtctacatctcttcgcttgccctcctcaagatgcttaagcatggaagagctggggttcctatggaagtcatggggctgatgcttggagagtttgtagatgagtacacagttcgagttgttgatgtatttgcgatgcctcagagtggtactggtgtaagcgttgaagctgttgatcacgttttccagactaacatgcttgacatgctcaaacagactggaagacctgagatggtggttggttggtatcattcgcaccctggattcggctgctggctttctggtgttgacataaatacacagcagagttttgaagctttgaatcaacgagctgtagcagtggtggtagatccaatccagagcgtgaaagggaaggttgtgattgatgcattccgcctgataaatcctcagaccatgatgcttggccaagaaccccgacaaacaacatcaaaccttggccacttgaataaaccatcaatccaggctctgattcatggactgaatagacattactactccatagccattaactataggaagaacgaactcgaggagaagatgctgcttaacctccacaagaagaagtggacagatggtctaacactaagacgttttgacactcactccaaaacaaatgaacagactgttcaggagatgttgaacttagctatcaaatacaacaaggcggtgcaagaagaagacgaattggcaccggagaaattggcgattgcaaacgtgggaagagaagatgcgaagaagcaccttgaagagcatgtgtccaacttgatgtcttccaacattgttcagaccttaggaaccatgcttgacactgtcgtcttctaggcctctctttatgcttttctactctttacaataactccatgaaaatttgtgtctcggcagatattactgttgtctttgtgttttctacatcatctcctataatatcttctcttacagctattattcttatatactaggaattatatgttgatgatttctctttatatttctaaataaatgttttagatttaataattaataaaaaggatcttgtaataagataattattcatagt

SEQ ID NO: 1967 - DNA, 1002 bp, Conyza canadensis
gccaccagattcaccgactctagatacatcggagcaagtttacatctcttcacttgctctattgaaaatgctcaaacatgggagagctggagtgccgatggaagttatgggattgatgctaggggaatttgtggacgagtatacggttcgcgttgtagatgtgtttgccatgcctcaaagtgggacgggggtcagtgttgaagctgttgaccctgtttttcagactaaaatgcttgatatgcttaagcaaactggaagacctgagatggtggtgggatggtaccattcacatcctggatttggttgttggttatcgggagttgacatcaatacacaacagagttttgaagccttgaatcagcgagctgttgctgtggtaatcgatccaatccagagtgttaaagggaaggtggtcatagatgcttttcgcctaatcaaccctcaaaccatgatgcttggacaagagccccgtcagacaacttccaatcttggacatctcaataaaccatctattcaagcattgatccatggtctcaaccgccactactactcgatagccattaattataggaagaatcaacttgaggagaagatgctattaaaccttcacaagaagaagtggactgatggattgacacttgaacgattcgatacacattctaagacgaatgaacagactgtccaggaaatgctggggctagctgtcaaatataacaaggccgttcaagaggaagaccaattatctccagagaaactagtaattgcaaatgtcggaaggcaggatgcaaaaaagcatctggaggagcatgtctccaacttaatgtcatccaacatcattcagacccttggtaccatgctcgacacagttgtcttctaacttcaacatatgtcaatgtattttcaccttaatgtctttctagcaagtgattctagagaacatgtctttgtttatcaaaactatgatgcctgtattgagattttgatctaaaatcttactgtaat

SEQ ID NO: 1968 - DNA, 858 bp, Distylium racemosum
cctatgctcgactcatccgagcaggtctacatttcttcgctcgccttgcttaaaatgctcaagcacggtagagctggagtgccaatggaggttatgggactgatgcttggtgagtttgttgatgagtacacggttcgagttgtagatgtatttgctatgcctcaaagtggtactggtgtcagtgtagaagcagtcgatcatgttttccagacaaacatgcttgacatgcttaagcagactggaagaccggagatggttgtaggatggtaccactcacatccaggttttgggtgttggctctcaggtgttgacatcaacacacagcagagtttcgaggctctcaatcaaagagcagttgctgtggtggtggatcctattcagagtgttaagggaaaggttgtcattgatgcattccgcttaattaatcctcagactatgatgcttggtcaggagcctcgacaaacaacttcaaatcttgggcatttgaataaaccatccatccaagctttgattcatggtttgaatcggcattattattccattgctattaactatcgcaaaaaatgagctggaagaaaagatgctactcaacttgcacaagaagaaatggactgatggtctgactctgcaacgctttgattgtcattctagaacaaatgaacagacagtgcaggaaatgcttgatcttgcaatcaagtataacaaagctgtacaagaagaggacgagttacctcctgaaaagcttgctattgcaaatgttgggagacaagatgctaaaaggcatctagaggaccatgtctcaaatctaatgtcttcaaacatagtccaaaccttagggacaatgcttgatacagttgt

SEQ ID NO: 1969 - DNA, 1229 bp, Secale cereale
ccaagcgcccccctcaccccggaaccaaatcgaacaaccgagagaagccatggagcgactgcagcggatcttcggcgccggcgggatgggccagccgccgtcggactcgccgctgctcgactcctccgagcaggtctacatctcctccctcgccctcctcaagatgctcaagcacgggagggccggcgtgccgatggaggtcatgggcctcatgctcggcgagttcgtcgacgactacacggtccgggtggtcgacgtcttcgccactgccgccaaagacgggacgggggtcgagcgtcgaggccgtcgaccacgtcttccagaccaacatgctcgacatgctcaagcagaccggccaggccagaaaataggtggtagggtgggtatcactctcatcctggttttggtttgctggctatcgggtgtcgatatcaatactcaacagagttttgaagctttggaaccccagggcagttgctgtcgtgatcgaccccatccagagtgtcaaggggaaggtggtcattgatgcatttcgtctcattaaccctcagaccatgatgcttaaaagggaaaacaaaaaggaaaagaaaccaaacggaacaaagaaacaaaacaaataccaaatagttagggacaacctagaaataaagccatctattcaggctcttattcatgggctcaatagacactactactccattgcaataaattaccgcaagaatgagctcgaggaaaagatgctgcttaaccttacacaaaaagaaataggaccgatggattaattactgaagaaatttgacgcgcactcagaaaccaatgagcagactgttcaggaaatgctgagcctggccatcaagtacaacaaggcagtgcaagaggaggatgagctgtcccctgagaaattagcgatagctaatgtgggacggcaagatgcgaagaagcatctagaagagcatgtctcaaatctgatgtcgtcgaacatagttcagaccctagggaccatgcttgacacggttgtcttttagtctactactgttgttccaaccgtatgtagactcacccagtctatcattgatgttgtgtatccaaagcctgccacaatgcagcaaggcacattcgggttctaacagtttgctcgacagactcaattttctgtagtactatcttctgcatgtttcattttgcagcaatttccatggggtcccttaaaattgcaagttctggttatg

SEQ ID NO: 1970 - DNA, 921 bp, Arnica chamissonis
gaaaaagggcagcgcaggtagcgaaaatgtcagggatggaacgactacagagaatgttcgccggcgccggtggagcgttaggtcacccgccaccagattctccgactctcgatacatcggaacaagtttacatctcttcccttgccctcttgaagatgcttaaacacgggagagctggagttcctatggaagttatggggttgatgcttggggaatttgtcgatgagtatactgttcgtgttgtagatgtgtttgctatgcctcagagtggtaccggtgttagtgttgaagccgtcgatcatgttttccagaccaatatgcttgatatgcttaaacaaactggaagacctgaaatggtggtcggatggtaccattcacatcctggatttggctgttggctatctggagttgacatcaacacacaacagagttttgaagctttgaatcaacgagccattgcagtggtggtggatccaatccagagtgttaaagggaaggttgtcatagatgccttccgcctaattaacccccaaaccatgatgcttggtcaagagccacgccagacaacttccaatcttggccatctcaataaaccatccatccaagcattgatccatggtttgaacaggcattattactcgattgccattaattacaggaagaataaactagaggagaagatgctacttaaccttcacaagaagaaatggactgatggattgacacttgagccatttgatacacattctaaaaccaatgagcagactgttcaggaaatgttgaatctagctatcaaatacaacaaagcggttcaggaagaggacgaattacctcccgagaaactagcgatcgcgaatgtcggaaggcaagatgccaagaaacatctggaagaacatgtctcaaacttaatgtcatccaaca

SEQ ID NO: 1971 - DNA, 1477 bp, Selaginella moellendorffii
gaaagaattagggttcttagtttttggatggagagaatggagcgtctacagcggatgttttcggggatgggaggaggaggcgctggcccgcatcccgactcgccgctggtcgatacgtcggagcaagtctacatctcatcgctcgcgcttctcaagatgctcaagcacggacgagctggtgtgccaatggaagttatgggtctcatgctaggtgattttgtggatgagtacactgtccgggtcatcgatgttttcgcgatgccgcagagtggcactggtgtcagcgtcgaggctgtagatccagttttccagaccaagatgatggacatgctcaaacaaacaggaagatcggaaatggttgtaggatggtatcattcacatcctggattcgggtgctggctttctggagttgatatcaatactcaacagagctttgaagcattgaatcaaagagctgtggcggttgtcgtggatccaatccagagtgtgaaagggaaagttgtgattgatgccttcaggcttatcaatccacagacgatgatgttgggacaggaaccacggcagactacttcaaaccttggacacttgaataagccttctattcaggcgcttatccacggcctaaaccgtcactattactcgatcgctatcaactaccgcaaaaccgagctcgaggagaaaatgctcttgaacctccacaagaagacctggacggacgggctagctctccagcacttcgactgccattcaaagacaaacgaggcaaccatcaatgaaatgctcgatcttgccgtgaaatacaacaaagcagtccaagaggaggacaaactatccccggagaagctggccattgcaaacgttggcaggcaggacgccaagaaacacttggaagatcgcgtgtccaacctcatgtcctccaacattgtccagactttaggcaccatgctcgacactgtggtgttctaaagcgaggaaacagatggaaccatgaagtctagagcttgagcttcgctttgccgggtttgaagcaacgacagatgggtggaatagatctggtgcagaggctgcagcttccaccgttcaggcagtccgcatccgagcaacactgtgatgcggcgctgcatcttttcggattcggggcgtcacagaagcaagttggaggaaagcttcgggtgcaacgtccacaaaactggcctgccttgctgcatcgcttggagccggggcagcactgggagtttggcctgcacaccatggcctggagattggcagcagagactagatcatcgcgttgctcatcaccagcaagagcggctgcaaggcaagagagagcaagcaagagcaaaacactacgaagtttatccatagttgccgtggaggagatagttggccattatattctcggtgcatcccacgatttccacgcatgacatattctttaaagttatttctcttagtaaatctattggattttgacctc

SEQ ID NO: 1972 - DNA, 935 bp, Lactuca sativa
aaagaaattcaaatcccttaatcggaagctaaaacagaatgtcaggaatggaacggctacagaggatgttcgccggcgcaggaggcgcactaggtcacccaccaccagactctccgactctcgatacatccgagcaagtttacatctcctccctagccctcctcaagatgcttaaacacgggagagcgggagttcctatggaagttatgggcttgatgcttggggaattcgtggatgaatatacagttcgtgtggtggatgtttttgctatgccgcaaagtggtactggtgttagtgttgaagctgttgatcatgttttccagaccaacatgcttgatatgcttaaacaaactggcagaccagaaatggtggttgggtggtatcattcacatcctggatttggttgttggttatctggagttgacatcaacactcaacagagttttgaagcactgaatcaaagagctgttgcagtggtggtggatccaatccaaagtgtgaaagggaaagttgtgatcgatgctttccgtttaattaaccctcaaactatgatgcttggacaagaacctcgccaaacaacatctaatcttggacatcttaataaaccatccatccaagcattgatccatggtttgaacaggcattactattcgattgccattaattacaggaaaaacaaacttgaggagaagatgcttctcaaccttcataagaagaagtggaccgatggtttgactcttgaacgatttgatacccactccaaaaccaatgaacagactgtccaggagatgttaggtttagcggtgaaatataacaaggcggttgaggaggaggataaattgtcaccggagaagctagcgattgcaaatgtgggaagacaggatgcaaagaaacatctagaagagcatgtttcccacttgatgtcatcaaatatc

SEQ ID NO: 1973 - DNA, 1225 bp, Pteridium aquilinum
gagagcgcggcgtatggagagactgcagcggatcttctcgggcgtggggggcggggcaggaggccggtggtccgcaccctcgactccccccttgtcgattcctcagagcaggtctacatctcctccctcgcgcttctcaaaatgctcaagcatggcagagcaggagtgcccatggaggtgatgggcttgatgctcggagattttgttgatgaatacacggtacgagttgtggatgtgtttgccatgccacaaagtggaacgggtgttagtgtggaggctgtcgatgctgtattccaggccaaaatgctggatatgctgaagcagaccggcaggcaagagatggttgtgggttggtatcactcacatcctggttttggttgctggctttctggagtggacataaacacgcagcagagttttgaagctttgaatcaaagagcagttgcagttgttgtggaccccattcaaagtgtgaaagggaaagtcgtaattgatgcttttcgactgattaatccacaaacaatgatgcttgggcaagaacctaggcaaacgacttccaaccttgggcatctcaacaaaccctcaattcaggcattgattcacggattaaatcggcactactactcgattgccatcaattatcgaaagaatgagctggaagaaaagatgctacttaatctacacaagagaaaatggactgatggactgacactcgagcggtttgataatcatgcaaagatgaatgagagtactgtacaagagatgctcgaccttgctatcaagtataacaaagctgttcaggaagaagaccagcttcctcctgaaaagttggccattgcaaatgtaggacgacaagatgcaaagaaacatctggaggagcatgtttcaaatcttatgtcttcaaacattgtccagactctagggacaatgctcgatacagtggtgttctaaatgcagctttgttgggactgtgatttggatgtttgccaatggactgttcgaacgaatttgtaaccacaaagagtgaatggcagtgaccaggggacactactgtttgaggcactcttcacagaattactttttcttcaagctttcttgtttctatgagagcacttttaagccattggacctggtcattggaatgcagtgaagttgaactggcaaattttttgtgctttttggtgcaaaaatatcagtcttaaattgttgttggctttaaaaagaa

SEQ ID NO: 1974 - DNA, 849 bp, Ambrosia trifida
gttcgccggagctggtggcgcgttaggtcacccgccaccagactctccgacgctcgatacgtcggaacaagtttacatctcgtcacttgctcttttaaagatgcttaaacatgggagagcgggagttccgatggaagttatgggattgatgcttggggagtttgtggatgagtatactgttcgtgtcgtagatgtgtttgctatgcctcagagtggtaccggtgttagtgttgaagctgtggatcatgttttccagactaatatgcttgatatgctcaaacaaactggaagacctgaaatggtggttggatggtaccattctcatcctggatttggctgttggctatctggagttgacatcaacacacaacagagttttgaagctctgaatcaacgagccattgcagttgtggtggatccaatccagagtgtcaaagggaaggtcgtcattgatgccttccgtttgattaacccccaaaccatgatgcttggtcaagagccgcgtcagacaacttccaatcttggccatctcaataaaccatccatccaagcgttgattcatggtttgaacaggcattattactcgatagccattaattacaggaagaataaactcgaggagaagatgcttcttaaccttcacaagaaaaaatggactgatggactcacgcttgaaccatttgatacccattctaaaaccaatgagcagactgtccaggaaatgctgagtctagctatcaaatataacaaagcagttcaagaagaggatgaattacctccggagaaactagcgatcgcaaacgttggaaggcaagatgcgaagaaacatctggaagaacatgtctcaaa

SEQ ID NO: 1975 - DNA, 1061 bp, Ambrosia trifida
gatcagttagtttgtgggagatcttgtcttgtaacccaagaaatcaaaacttgttgatcggagagcaatgtcagggatggaacgcctacagcgtatgttcgccggagccggaggcgccttaggccacccaccactcgactccccaactctcgacacctcagaacaagtctacatctcttctttagccctcctcaagatgctcaaacacgggagagcgggtgtgcctatggaagttatgggattgatgcttggggaatttgtggatgagtataccgttcgggtggtcgatgttttcgctatgccccagagtggtactggtgttagtgttgaagctgttgatcatgttttccagactaatatgcttgatatgcttaaacagactgggagaccagagatggtggttggctggtaccattcacatcctggatttggttgttggttatctggagttgacatcaacacacaacagagttttgaagctctgaatcaaagagctgttgcagtggtggtggatccaatccagagtgtgaaagggaaggttgtgatagatgctttccgcctgattaacccacaaaccatgatgcttggccaagaaccacgacaaacaacatccaatcttggccatcttaataaaccatccatccaagcgttaattcatgggttgaataggcactactattcaatagctattaattataggaagaatgaacttgaagagaagatgctattgaacctccataagaagaagtggactgatggattgaaacttgagcgatttgatactcattcaaaaaccaatgagcagactgtccaggagatgctgagtctagccatcaaatataacaaagctgttcaggaagaagacaaactgtctccagagaagctagcaattgcaaatgtgggaaggcaggatgacaaaagaaacatctcgaagaacatgtctccaatctcatgtcgtccaatatcattcagacattaggtacaatgctggacactgtttctttctagacctctgatcatttttattttcgtgtactcgtgatcttgttcaacacaagttt

SEQ ID NO: 1976 - DNA, 880 bp, Salvia sclarea
ccctttatcaatttgaattgaaatggcaggcatggagagactccaccggatgttcgccggcgccggcggcgccctcggccacccgccgccggactccccgacgctcgattcctccgagcaagtctacatttcgtctctcgcccttctcaaaatgctcaaacacggtagagctggtgtgccgatggaggtgatggggctgatgctgggggagtttgtggatgagtacacggtgcgtgtggtggatgttttcgcgatgccgcagagtggaaccggtgtcagtgtcgaagctgtcgatcacgttttccagactaatatgcttgatatgctgaagcagactggaagacctgagatggtggttggctggtatcactcacatcctggctttggatgttggctttctggtgttgacattaacactcagcagagtttcgaagctttgaatcagagggcagtagctgtggtggtagatccaattcagagtgtcaaaggaaaggtggtaattgatgccttccgtctcattaaccctcaaaccatgatgctcggtcaagaaccacggcaaactacttccaacgtggggcacctcaataaaccatctatccaggctttgattcatggattgaacaggcattattactccatagccataaattaccggaagaacgaacttgaggagaagatgctcctcaatctccacaaaaagaaatggacagatgggttgaccctccagcgattcgacacccactccaaaacaaatgagcagaccgtccaggagatgctaaaccttgcaatcaagtacaataaagcggtgcaagaggaagatgagctgccaccggagaaactagccattgctaacgtgggtaagcaagacgcaaagaagcat

SEQ ID NO: 1977 - DNA, 1063 bp, Panicum virgatum
gaaaaagaaaaaaaaagaaaaagctccgtccatctcgttctccagtccgtcaccgtccggcgtccgctcgcgtgcgagtgcgacccccaccgcggcgacagctccaccgccggctgcttccccgtcgccgccgagcgcaactccaccggtggcctcctccaggggtctgaaggaagcagccaatccacaaaaagagcctcacaagaaaagcaattgcaagcagctgagaagcttgctgctctctccatagcacatcagcatggatcgcctgcagaggatatttggcgcctctgggatggggcagccaccttcggactcgccgctgctcgactcctctgagcaggtctacatttcctcccttgcactcctcaagatgctcaaacacgggagggctggtgtgccaatggaggtgatgggccttatgctgggtgagtttgtggatgactacacggtcagggtggtggatgtgtttgccatgccacagagtggtactggggtcagtgttgaggctgttgatcatgtcttccagaccaacatgcttgacatgctcaagcagacagggagaccagaaatggttgtagggtggtaccactcccatcctggctttggttgctggctttctggagttgacatcaacacccaacagagttttgaagctttaaaccccagggcagttgctgttgtgatagaccccatccagagtgtcaaagggaaggtggtcattgatgcatttcgtctcattaacccccagaccatgatgcttggtcaggagccacgacagacaacatcaaatgttgggcacctaaataaaccatctattcaggctcttatccatgggctgaacaggcactactactccattgcaatcaactaccgaaagaatgagctcgaggagaaaatgttgctgaacttgcacaaaaagaaatggactgatggcctgattttgaagagatttgatactcattcgaaaactaatgagcagacagtgcagaaatgctgaacctagctgtgaagtacaacaaggccgtgcagaggaggatgagttgccaccagagaaattggc

SEQ ID NO: 1978 - DNA, 891 bp, Ambrosia trifida
atatcttgttaccaaagaaataaaaaagctttgatcggaaaaatgtcagggatggaacggctacagagaatgttcgccggagctggtggcgcgttaggtcacccaccgccggattctccgacgctcgatacgtcggaacaagtttacatctcgtcacttgctctgttaaagatgcttaaacatgggagagcgggagttccgatggaagttatgggattgatgcttggggagtttgtggatgagtatactgttcgtgtcgtagatgtgtttgctatgcctcagagtggtaccggtgttagtgttgaagctgtggatcatgttttccagactaatatgcttgatatgctcaaacaaactggaagacctgaaatggtggttggatggtaccattctcatcctggatttggctgttggctatctggagttgacatcaacacacaacagagttttgaagctctgaatcaacgagccattgcagttgtggtggatccaatccagagtgtcaaagggaaggttgtcattgatgccttccgtttgattaacccccaaaccatgatgcttggtcaagagccgcgtcagacaacttctaatcttggccatctcaataaaccatccatccaagcgttgattcatggtttgaacaggcattattactcgatagccatcaattacaggaagaataaactcgaggagaagatgcttcttaaccttcacaagaaaaatggactgatggactcacgcttgaaccatttgatacccattctaaaaccaatgagcagactgtccaggaaatgctgagtctagctatcaaatataacaaagcagtttcaggaagaggatgagttacctccggagaaactagcgatcgcaaatgttggaaggcaagatgcg

SEQ ID NO: 1979 - DNA, 870 bp, Ambrosia trifida
aaaaactttgatcggaaaaaatgtcagggatggaacgactacagagaatgttcgccggagctggtggcgcgttaggtcacccgccaccagactctccgacgctcgatacgtcggaacaagtttacatctcgtcactcgctcttttaaagatgcttaaacatgggagagcgggagttccgatggaagttatgggattgatgcttggggagtttgtggatgagtatactgttcgtgtcgtagatgtgtttgctatgcctcagagtggtaccggtgttagtgttgaagctgtggatcatgttttccagactaatatgcttgatatgctcaaacaaactggaagacctgaaatggtggttggatggtaccattctcatcctggatttggctgttggctatctggagttgacatcaacacacaacagagttttgaagctctgaatcaacgagccattgcagttgtggtggatccaatccagagtgtcaaagggaaggttgtcattgatgccttccgtctgattaacccccaaaccatgatgcttggtcaagagccacgtcagacaacatccaatcttggccatctcaataagccatccatccaagcgttgattcatggtttgaacaggcattattactcgatagccattaattacaggaagaataaactcgaggagaagatgcttcttaaccttcacaagaaaaatggactgatggactcacgcttgaaccatttgatacccattctaaaaccaatgagcagactgtccaggaaatgctgagtctagctatcaaatataacaaagcagttcaggaagaggatgagttacctccggagaaactagcgatcgcaaatgttaggaaggcaagatgacg

SEQ ID NO: 1980 - DNA, 1054 bp, Physcomitrella patens
gttggtgttcgtgttcgagatcgatcttcaatgttcgaccatcatctgggctcagctcaattcattagcgactcttgggtggctttggattttttttacagtttggtttcgtcaaggtctagaggaactcgttagtggaataggcgctatggattcaagattgcacaggatttttgctggaggcaattccagcggtggagcacactctgactcgccgcttgtcgattcttcggagcaagtttatatttcctccttggcactcctaaagatgcttaagcacgatatggtagagctggagtacccatggaggtgatggggctgatgcttgtggagtttgttgatgaatacacagtttgtgttgtgaatgtgttcgctatgcctcaaagtggaacaggagttagtgtggaagctgttgaccctggcttccaaaccaagatgctccatatgctcaagcaaactggccggccagaaatggttgtgggctggtatcattcacatccaggttttggttgctggttatctggtgtggatataaatactcaacagagttttgaagctttgaaccaaagagcggttgcggtagtggtggatccaattcaaagtgtgaaaggaaaggttgtgattgatgctttccgattgatcaatctccagacaatgatgttgggacaggagcctaggcagaccacatcgtacgttggtcatctcaacaaaccttcaattcaggcattaattcatggattgaaccgccattactactcaattggaatcaattaccagaagaatgaacttgaggagaaaatgcttctgaacctgcgtaagagaagtggactgatggactatgtgtcaacctcctgtttggaaatgttgaatttggcaatcaaatataacaaagctgtgcagggagaagaccagctcagccctgagaagttagccattgctaatgtggggcgtcaagatgcgaagaagcacttggaagagcatgtttctaatctaatgtcgtccaacattgtacagacattaggcaccatgcttgacacagttgccttctagtcag

SEQ ID NO: 1981 - DNA, 983 bp, Cenchrus ciliaris
  misc_feature (13)..(13): n is a, c, g, or t
cttcgttcccttnaccgtccgctctcgcgtgcgtccccaaccggcgacaactccaccgccgggagcctccccgtcgccgccgagcgcatctccaccggagcccgcctccagggttctgcagaaaatattcaatccccccaaaaaaaagagtcatacaagaactgagaagctttccagtctctccataacacatcagcatggagcgcctgcataggatcttcggcgccgctgggatgggacagccaccatcggactcgccgctgctcgactcgtccgagcaggtctacatttcctcccttgcactcctcaagatgctcaaacacgggagggctggtgtgccaatggaggtgatgggtcttatgctgggtgagtttgtggatgactacacagtcagggtggtggatgtgttcgccatgccacagagtggtactggggtcagtgttgaggctgttgatcatgtcttccagaccaacatgcttgacatgctcaagcagacgggaagaccggaaatggttgtagggtggtaccactcccatcctggttttggttgctggctttcaggcgttgacatcaacactcaacagagttttgaagctttaaaccccagggcagttgctgttgtgatagatcccatccaaagtgtcaaagggaaggtggtcattgatgcatttcgtctcattaacccccaaactatgatgcttggccaagagccacgacagacgacatctaatgttgggcacctcaataagccatctattcaggctcttatccatgggctgaacaggcactactactccattgcaatcaactaccgaaagaatgagcttgaggagaaaatgttgctgaacttgcacaaaaagaagtggactgatgggttgattttgaagaggtttgacactcattcgaaaaccaacgagcagactgtgcaggaaatgctgaacttagctgtgaagtacaacaaggcggtgcaagaggaggatgag

SEQ ID NO: 1982 - DNA, 898 bp, Platanus occidentalis
caagcacggaagggctggggtgccgatggaagtgatgggtttgatgctgggggagttcgtagacgagtacacggtccgtgttgttgatgtctttgcaatgccccagagcggtactggggtcagtgtggaggccgtcgatcatgtcttccagactaacatgctcgacatgctcaagcagactggaaggccagagatggtggtaggatggtatcattcacatcccggatttggctgttggctttcgggtgtggatattaatacccaacagagctttgaagctctgaatcaacgagctgttgcagttgtggttgatccaatccagagtgttaaggaaaagtggttattgatgccttccgattgattaacccacaaaccatgatgcttggccaagagccacggcagacaacctctaaccttggacatctcaacaagccgtccattcaagcattgatccatggattgaacagacattattactcgatagcaattaattatagaaaaaatgaacttgaggagaaaatgctattgaatctacacaagaagaagtggactgatgggttaatgctacagcgatttgatactcattccaagacaaatgaacaaactgttcaggagatgctgaatctagccatcaaatacaacaaagcagttcaggaggaggatgagttgcctcctgagaagctagcaattgcgaatgtagggaggcaagatgccaagaagcatctggaagaacatgtctctaacttgatgtcaacaaacatagttcagacattgggcaccatgctggacacggttgtattctaatatgaggaaaaggattgaccataacgaggttattgtactcccaattgacttctacaggtatcatgatcatccatctggattttttttttttttt

SEQ ID NO: 1983 - DNA, 872 bp, Thalictrum flavum
gatgcttaaacatggtagagctggtgttccaatggaagtgatgggattgatgttgggtgatttcgttgatgagtatactgttcgtgttgttgatgtttttgcaatgcctcaaagtggtactggtgttagtgttgaagctgttgatcctgtttttcagactaagatgcttgatatgctcaagcagactggaagaccagagatggtcgtaggttggtatcattcacatcctggatttggttgttggctttcaggtgtcgatattaacacacagcagagttttgaacaattgaatcagagagctgttgcagtggttgtggacccaattcagagtgttaaaggaaggtggtcattgatgccttccgtttgatcaacccacaaaccatgatgcttggccaagaaccaaggcaaacaacatccaatcttgggcatctcaacaagccatcgattcaagcattgattcatgggttgaacaggcattactactcaatagccatcaactacaggaagaatgaactcgaggagaagatgttgctaaaatctacataagaagaagtggaccgatgggctgacacttcagcgattcgatactcactccaagaccaatgagcagactgtgcaggaaatgttgaatctagctgtcaagtacaataaggctgttcaggaggaagatgagttgtctcctgagaagcttgcaattgctaatgtaggcaggcaagatgcgaaaaagcaccttgaggagcatgtttcaaacctgatgtctgccaacattgttcagactcttgggacaatgttggacactgttgtattttaaggctcattcgtcacaaacaagattcatatgatacaggcgtggcttttgaactgtagttata

SEQ ID NO: 1984 - DNA, 1205 bp, Cleome gynandra
tcgggggggaatttcacgaactagttttcctgtctggtaagaaatctcaaggaactttagatcgacgagagagaaatcgagcgagaagaggagtcaaaactagttcgtgtcaatggacagattgcagagaatgtttgcgggagctggggtgcgttgggtcatccgccgccggattctccaaccctcgatacgtcggagcaggtctacatctcttctctcgctcttctgaagatgcttaagcacggaagggctggtgtaccgatggaagttatgggattgatgcttggcgagtttgtggatgagtacacagttcgagttgttgatgtatttgcgatgcctcaaagtggtactggtgtcagcgttgaagctgttgaccatgtctttcagacaaacatgcttgatatgctgaagcaaactggaagaccggagatggttgttggttggtatcattcacatcctggatttggatgctggctttctggtgttgatataaacacccaacagagttttgaagccctgaatcaacgagcggttgcagttgtggtagatccaattcagagtgtcaagggaaaggtggttattgatgcattccgtctgattaatccgcagaccatgatgctcggccaagagcctcgacagacgacatcaaaccttggacatcttaacaaaccatcaattcaggcgttgatccatggtttgaacagacattattactcgatagcaatcaactacaggaaaaatgaattggaggagaagatgctacttaaccttcacaagaagaaatggactgatggattgacgcttcgtaggtttgatacccattccaataccaatgaacagactgtccaggagatgctgaatcttgccataaagtacaacaaggcggtgcaagaagaggacgagttacctcctgaaaaactagcgattgcaaatgtcggaaggcaagacgcgaagaagcaccttgaagaacatgtatcaaacctcatgtcctccaacatcgttcagactctcgggacaatgctcgataccgtggtcttctagaatgtttctcctgttgtacttcattgtcccccttatctttctcgttagataggtgctggagaactgactttgcttactgcagaaagttttacatttagctttgctttgtgatattgcaaatgcctttgtggattgctttgtgatattgcaaatgcctttgtgga

SEQ ID NO: 1985 - DNA, 1093 bp, Cucurbita pepo
ccaccttagattcttccgagcaggtctatatctcatcgctcgcgctcctcaagatgctcaagcacggaagagctggggttccgatggaggtgatgggtttgatgctgggagagtttgttgatgagtacacggttcgtgttgttgacgtctttgccatgccccaaagtggtactggtgttagtgtcgaagccgtcgatcatgtttttcagaccaacatgctcgatatgcttaaacagactggacggcctgagatggtcgtgggttggtatcattctcatccagggtttggatgttggctatctggtgttgatattaatacacaacagagttttgaggctctgaatcagagagctgtcgcggtggtcgtggatccaatccagagtgttaaggggaaggtggtgattgatgcttttcgtctaattaaccctcagactatgatgcttgggcaggaaccacgccaaacaacttccaacctcgggcatcttaataagccatctattcaagcgttaatccatgggttgaaccgacactattactcgattgcaataaactacaggaagaatgagcttgaggagaagatgttgctcaaccttcacaagaagaaatggactgatggtctgacacttcgccgattcgatacccattcgaaaaccaacgagcagaccattcaagaaatgctgagcttggctatcaagtacaacaaagcagtccaggaggaagatgagttgccccctgagaagctcgcaatagcaaatgtgggcagacaagatgctaagaaacaccttgaagaacatgtctccaacttgatgtcatcaaacatcatccaaacattaggaacaatgctagacacggtagtattttgaagctccacattgttatcctgcaactaaaaggtgctctatttaaacatcgccctatgagaagctacacgtccattgcgatctgatcgggatgtaagatctttcaatgcttattggttttgatctattgtaattcctatctcccttttttagttgatagagacagaaatggtaaactttagaacttgattgatgctgattttattgggtttatatgatgatatctgatttta

SEQ ID NO: 1986 - DNA, 982 bp, Momordica charantia
tcccatggaggttatgggtttgatgctgggagagtttgttgatgagtacacagttcgtgttgttgacgtctttgcgatgccccaaagtggcactggtgttagtgttgaagccgttgatcatgtctttcagaccaacatgctcgatatgcttaaacagactggacggccggagatggttgtgggttggtatcattctcatccaggtttgggtgttggctatctggtgttgatattaatacacaacagagttttgaagctctgaatcagagagctgtggctgtggtggtggatccaatccagagtgttaaggggaaggtggtgattgatgctttccgtctgattaacccacagaccatgatgcttggacaagaaccacgacaaacaacgtccaacctcgggcatcttaataaaccatccattcaagcattaatccatggattgaaccggcattattactcgattgcgataaactacaggaagaacgagcttgaggagaagatgttgctcaaccttcacaagaagaaatggactgatggtctgacacttcgtcgattcgacacccattcaaaaactaacgagcagactgtccaagaaatgctgaatctggctatcaagtacaacaaagcagtgcaggaggaagacgagctgacccccgagaagctcgcaattgcgaacgtgggcagacaagatgcaaagaaacacctcgaagaacatgtctccaacttgatgtcgtcgaacatcatccaaacattaggaacaatgctagacacggtagtgttttgaagctgcaatttcaatgtctcactgtcatttcctcccaactaaaaaggttctccatttaaacttaatccaattattagctacacgttcattattacccaatcgggatgtcaggttcttcaatgtctgttggtttctattgttgtaacattcttcagttgatagaaacaaggaaaatggtaatatatgcacctttatatta

SEQ ID NO: 1987 - DNA, 824 bp, Zingiber officinale
ggggcatcagggggagcagcagacaaagaaatgcaagggatggaaagactgcatcgcatcttctctggtgccggcgggatgggccacccgccgaccgattccccgcaactcgactccgccgagcaggtctacatctcctctctcgccctcctcaagatgctcaagcacgggagggctggagtgcccatggaggtgatggggcttatgcttggggagttcgtggacgagtacaccgtcagggtcgtcgacgtcttcgcgatgccgcagagcgggacgggcgtcagtgttgaggccgttgatcacgttttccagaccaatatgctcgacatgctgaagcagaccggaaggcccgaaatggttgtcggatggtaccattctcacccaggctttggttgctggctttctggtgttgatataaacacccagcagagttttgaagccctcaatccaagggcaatagctgttgttgtagacccaatacagagtgtgaaggggaaggtggttattgatgcttttcgcttgatcaatcctcagacaatgatgcttgggcaggaaccacgccaaacaacatccaatgttggacatcttaataagccatccatacaggcacttatccatgggctgaatcggcattactattctatcgcaataaattataggaagaatgagctcgaggagaaaatgttgctgaacctgcataaaaagaaatggacagatggtttgatactccggccatttgacactcattccaaaaccaacgagcagacagtccaggaaatgttggatctggctatcaaatataacaaagcagttcaggaggagga

SEQ ID NO: 1988 - DNA, 519 bp, Pseudoroegneria spicata
  misc_feature (218)..(218): n is a, c, g, or t
  misc_feature (317)..(317): n is a, c, g, or t
  misc_feature (375)..(375): n is a, c, g, or t
ctagctagcacagcctcccgtctctgcaactgtaagggtcctgacttctgagcttgctaacgaggccggacatggcgatcagggggataccttcgcagcgggagatgacggtggaggagttcaaggagtggctgaagcagttcgacgtggacggcgatggccggatcagcagggccgagctccgcgaggccatccgccgccgcggcggctggttcacnaccctcagggccggccgcgccgtccgccgcgccgacagggacaacagcggcttcgtcgacgacgccgaggtggagaacctcgtcgccttcgcgcagaangatctcggcatgaggatctctgcctggtagccacccacctaggctggctccgtgggtnttttatctgctatgctatgctcggcctactgaatgaaaactagtaaccactatagtacagtacctgcctagcgtcgtgtgatataggcttaacttgacatgccaacttctccagaataatatgtgtaaaatcaggagatttaat

SEQ ID NO: 1989 - DNA, 680 bp, Secale cereale
gtctagctgaaagggttctgacttctgagcttgcgaacgcggccggcatggcgatcagggggataccttcgcagcgggagatgacggtggaggagttcaaggagtggctgaagcagttcgacgtggacggcgacggccggatcagcagggacgagctccgcgaggccatccgccgccgcggcggctggttcaccaccctcagggccggccgcgccgtccgccgcgccgacagggacaacagcggcttcgtcgacgccgccgaggtggagaacctcgtcgccttcgcgcagaaggatctcggcatgaggatctctgcctggtagccagctgcctaggctggctccatgggttttcatctgccatatgctaagctcgatcttacctactgaatgaaaactacactatagtacagcacctgtctagcgtcgtgtgatataggttgaacttgacgcgccaacttctcctgaataatatgtgtagaatcaggagattcagttaaggttcgccactatgcagttgcttcgttatggagtgtttgtgtgcaagtactacgctgaaatttgatgttgtgccccttaggtcaccaaaccagtgggtgttgcgacccttttggaccgccgttgtggttcttcttctcgtgcccgtgctccggatgaaaacactattctgtttgtttaagg

SEQ ID NO: 1990 - DNA, 647 bp, Secale cereale
tcagttagtctaccatagcatctcgtctctgcaactgtaagggttctgagcttgcgaacgcggccggccatggcgatcagggggataccttcgcagcgggagatgacggtggaggagttcaaggagtggctgaagcagttcgacgtggacggcgacggccggatcagcagggacgagctccgcgaggccatccgccgccgcggcggctggttcaccaccctcagggccggccgcgccgtccgccgcgccgacagggacaacagcggcttcgtcgacgccgccgaggtggagaacctcgtcgccttcgcgcagaaggatctcggcatgaggatctctgcctggtagccagctgcaggctggctccatgggttttcaactgctacttatatgctaagctcgatcttacctactgaatgaaaactactacagtacgtactagtaaccactatagtacagcacctgcctagcgtcgtgtgatataggttgaacttgacatgccaacttctcctgaataatatgtgtaaagtcaggagatttagttaaggttcgccactatgcagttgcttcgttatggagtgtttgtgtgcaagtactacgctgaaatttgatgttgtgcgccttaggtcaccaagccagtgggtgttgcg

SEQ ID NO: 1991 - DNA, 765 bp, Triticum aestivum
tgctgcgcagatcggatcgactataaaaggaggcgcagccgcgagaggcccttacaccatccatcaccttagctagcatagcatcccgtctctgcgtcctgagcttgcgaacgcggccggacatggcgatcaggggggtaccttcgcagcgggagatgacggtggcggagttcaaggagtggctgaagcagttcgacgcggacggcgacggccggatcagcagggccgagctccgcgaggccatccgcagccgcggcggctggttcaccaccctcagggccggccgcgccgtccgccgcgccgacagggacaagagcggcttcgtcgacgacgccgaggtggagaacctcgtcgccttcgcgcagaaggatctcggcatgaggatctctgcctggtagccgcccgcctaggctggctccatgggtttttatctgctgtgctatgctcgacctactgaatgaaaactactcaagtaaccaccatagtacagtacctgcctagcgtcgtgtgatatggttgagcttgacatgccaacttctcctgaataatatgtgtaaaatcaggaggcttaattaaaggttcgccactatgcagttacttcattatggagtgtttgtgtatggaatttgatgttgtgcccccttaggcgaacttcacgatcccgttctgtccgaattctatccgtttgagtcagccaaaagggacgccgtccgacctcttctgtgtttgcgtgggtagtgcggccgagcggaccaaatgtatata

SEQ ID NO: 1992 - DNA, 614 bp, Triticum aestivum
accatccatcaccttagctagcatagcatcccgtctctgcagctgtaagggtctcgagcttgctaacgcggccggtcatggcgatcaggggggtaccttcgcagcgggagatgacggtggcggagttcaaggagtggctgaagcagttcgacgcggacggcgacggccggatcagcagggccgagctccgcgaggccatccgcagccgcggcggctggttcaccaccctcagggccggccgcgccgtccgccgcgccgacagggacaagagcggcttcgtcgacgacgccgaggtggagaacctcgtcgccttcgcgcagaaggatctcggcatgaggatctctgcctggtagccgcctgcctaggctggctccatgggtttttatctgctatgctatgctcggcctactgaatgaaaactactcaagtaaccaccatagtacagtacctgcctagcgtcgtgtgaaataggttgaacttgacatgcaaacttctcctgaataatatgtgtaaaatcaggagatttagttgaggttcgccactatgcagttacttcattatggagtgtttgtgtacgagtactattacgctggaatttgacgctgcgcccctta

SEQ ID NO: 1993 - DNA, 568 bp, Avena sativa
ccttagccagcacagccgcctgtgcaagactgtaactgcaaggatcacccatggcgatcattaggacagtcccatcggcgcgcgggatgtccgtggaggagttcaaggagtggctgaagcagttcgacgtggacggcgacggccggatcagcaagggcgagctccgcgaggccatccgccgccgcggggggtggttcgccaccctcagggccggccgcgccgtccgccgcgccgacagggacaacagcggctacgtcgacgacgccgagatcgagaacctcgtcgccttcgcgcagaaagacctcggcatgaagatctccagctggtagatagcctaggctatacctgcttggctagaccaatggggagttttatctgcttggcttaatattaattaccgaaaaccagtatagcactatatagttcttcgacatggcatggcaacttctcctgaataatatgtgtaaaaatcaggagaactaattatggtttgctactttactaagcgtcgttgtatggctatatgctgggttctgatcctcataaagatgaaacaaaattactagcg

SEQ ID NO: 1994 - DNA, 996 bp, Brachypodium distachyon
agacgagggcgacacgcacggctccatcgagaccagtataaaaggaggtgcagcctcgagctagagacctcacacctcagcccaagcaacacctgctctttctttcaagttcagagctttcagatccatggcgatcaggggagtgccgtcggcgagggagatgacggtggaggacttcaagttgtggctgaagcagttcgacgtggacggggacgggcggatcagcaggggggagctccgggaggcactccggcgccgcgggggatggttcaccaccatcaaggccgaccgcgccgtgcgccgcgccgacaaggacaacaacggcttcgtcgacaacgccgaggtcgagaacctcatcgccttcgcgcagaaagacctcggcatgaagatctccacatgatagagggtagctatgtatggctctttctagcttagctccggcggccatggaggagctttatccggcctgtgctcggtctaaactctaaatgaatgaaaaccagtagcactctagtaatttacgtactagctcggtcaaaaaaaaatgtctcaactttgagtaaatttgaatgcatctatacaccaagtcatgtctacatacatccaaattttgacaaactcgagacatcttttattggacggagaggaagtacctagctttgtacgctagccttcgacttggcatggcatggcatcttgtcctgaataataccgtttgtgtgagaattaaggttttgctactatgcaataaatctcaactatatatgcatgacttatatgtgtatacattgctatgcatgacatatatatcgggtttatttgatgctcgatcatgtataattgaagattaaactgagtcattggcgttaaacaattaccacccgctcaacatgtttctagtcagcctctctcggtcgatttcctgcgaataaaaaggatgacaagttcgaaaaccggcccggaccaccagttgaaacggaaaaaacaagaaccggg

SEQ ID NO: 1995 - DNA, 693 bp, Brachypodium distachyon
ctcacacctcagcccaagcaacacctgctctttctttcaagttcagagctttcagatccatggcgatcaggggagtgccgtcggcgagggagatgacggtggaggacttcaagttgtggctgaagcagttcgacgtggacggggacgggcggatcagcaggggggagctccgggaggcactccggcgccgcgggggatggttcaccaccatcaaggccgaccgcgccgtgcgccgcgccgacaaggacaacaacggcttcgtcgacaacgccgaggtcgagaacctcatcgccttcgcgcagaaagacctcggcatgaagatctccacatgatagagggtagctatgtatggctctttctagcttagctccggcggccatggaggagctttatccggcctgtgctcggtctaaactctaaatgaatgaaaaccagtagcactctagtaatttacgtactagctcggtcaaaaaaaaatgtctcaactttgagtaaatttgaatgcatctatacaccaagtcatgtctacatacatccaaattttgacaaactcgagacatcttttattggacggagaggaagtacctagctttgtacgctagccttcgacttggcatggcatggcatcttgtcctgaataataccgtttgtgtgagaattaaggttttgctactatgcaataaatctcaacta

SEQ ID NO: 1996 - DNA, 2569 bp, Triticum aestivum
tgccgccgtggcgctcctcctcgccgccgtcctctgcctcggcggcggcggtgcggcgtccgcgtcgccggacttcgactacccggcggcgttcaacttcggcgactccaactccgacacgggcggccgcatcgccgcgggcttcgagcccatgcccccgccctacggctccaccttcttcggcgccccctccggccgcttctccgacggccgcctcatcctcgacttcctcatggatgcgatggatatgccattcctcaatgcatacttggattctcttggtgcgcctaacttccgggcaggtgttaattttgctcaagctggctgttcgattactccagcaagtgcaacatctgtcagcccgttttcatttggtcttcagattaagcaattctttgccttcaaggaaaaagtcactagcctgctctccaaaggagataggtaccgtcggtatattcctcagttggattacttttcgaagggactctacatgtttgatataggtcaaaatgaccttgctggtcaattctactccagaacagaggaccaagtcattgcatccattccgactattttgttggaatttgaaactgggctcaagactctatacgatcagggtgccaggaagttctggattcacaacacaggtcctcttggctgcttacctcaaaacatagatctttttggcaaagacccaacacaactggatgaacttcattgtgtagcaaagcacaatcgtgctgcaaagattttcaacttacagctgcatgcactttgcacaaagttgagaggccagtttgctggagctaatatcacttacatcgacatctactccatcaaatatgccctgattggcaattactctcgatatggatttgaaagtcccaccgaagcatgctgtggatacggaggaccacccctgaattatgatggccgagtgccgtgtggacagacgaaatctgttaacggtaatctcgtaaccgcgaaaggatgcagtgacagcactgagtatgtcaactgggatggaatacattacacggaagctgcaaatttccacgttacatcgcagattctgaccgggaagtactcagatcctccgttcgtcgacaagacgccattccttataaaaccgaggttctaatgagcgggtatttattcccacaactgaattagtaaaccaatgtaatgttgtattgaccacaacagatgtattatttatcacatgtcaataatcacatatagctttctttttcatttagttaaaccatgttcttcctgttctctctgtatgacaaaattactcgaaatttcgttgtagcatgcaagtttttgcttcacattttgcaagcaattgaagttactaaagaatcttggcaagaaagagtagatttgcatccaaattaatctccagtaatcacagtatccagttgagctatcgtaagaagaattaataagtcctgtttgggtgagaatctttttccgaatgctgcgggaactgaagtgtgtgctctgtaaaattacctagttccaaacaggcggcaaacactgcacacgagcgcgggtgcgcttgcattgatctctctctgtttcacttctaaacctccaatccaacagaaaaccggggggactcgaaaaattactgtactgtacacgcacgccgctcgactcgatcacttcttggagatgtaggcgtagtactgcgccatgggcacgacgaaggcgatgacgagcaggccgccgacgacgagcgtgaactggccgcgcttctcctccgtctcctccttgctcttgaagttggactcccgcttgctctcctggaacgccggcccgcccgggtccggcagcccatcgatcgccgccaccagccgcttcgccgtcgagaagatggcctcgttgtacttctcgtccgtcgccagcactgggaggttctcggagacggtggcgtcgaggatggcgtcgccgacggcctgcacgaagtccgggccgcctgtgatggccccctccttctggctggtgacgagcaccacgatccccttgttgctgccctcctccaccgtcgggtaccacttctcgagcacttggtccgcgtactcaaacgcgtcagctttgctcgtgagcttgcggacggtgacgaagttgatccggatgttcttgcgggcctcgaggtcgcgggcgaggcgcttcacgtcggacttggtcacgcggctcagcacgccggcgtcgtccaccacgtacgtgtccgccggcggcccgtcgttgagcacgtcgaactccgacgccacggccggcgcgggcgcaggcgacagggtgagggccagggacagcgccgcggcggcgaggccgtggtgcaagaacgacgcccagctcccgaggccgcggtcgccgtctccacgccaggcgacgcccgcctgcgtctgcgtctgcttcttgagcgagcaggagacggcggacctgctgcacgggacggcggcgggggccgctggcttcctggagccccggagcgggccgagcaatgcggacggggagaggagggtctccatggccgcggacgcggagcgggaggtggggg

SEQ ID NO: 1997 - DNA, 1113 bp, Triticum aestivum
cccgcgtccgcggccatggagaccctcctctccccgtccgcattgctcggcccgctccggggctccaggaagccagcggcccccgccgccgtcccgtgcagcaggtccgccgtctcctgctcgctcaagaagcagacgcagacgcaggcgggcgtcgcctggcgtggagacggcgaccgcggcctcgggagctgggcgtcgttcttgcaccacggcctcgccgccgcggcgctgtccctggccctcaccctgtcgcctgcgcccgcgccggccgtggcgtcggagttcgacgtgctcaacgacgggccgccggcggacacgtacgtggtggacgacgccggcgtgctgagccgcgtgaccaagtccgacgtgaagcgcctcgcccgcgacctcgaggcccgcaagaacatccggatcaacttcgtcaccgtccgcaagctcacgagcaaagctgacgcgtttgagtacgcggaccaagtgctcgagaagtggtacccgacggtggaggagggcagcaacaaggggatcgtggtgctcgtcaccagccagaaggagggggccatcaccggcggcccggacttcgtgcaggccgtcggcgacgccatcctcgacgccaccgtctccgagaacctcccagtgctggcgacggacgagaagtacaacgaggccatcttctcgacggcgaagcggctggtggcggcgatcgacgggctgccggacccgggcgggccggcgttccaggagagcaagcgggagtccaacttcaagagcaaggaggagacggaggagaagcgcggccagttcacgctcgtcgtcggcggcctgctcgtcatcgccttcgtcgtgcccatggcgcagtactacgcctacatctccaagaagtgatcgagtcgagcggcgtgcgtgtacagtacagtaatttttcgagtccccccggttttctgttggattggaggtttagaagtgaaacagagagagatcaatgcaagcgcacccgcgctcgtgtgcagtgtttgccgcctgtttggaactaggtaattttacagagcacacacttcagttcccgcagcattcggaaaaagattctcacccaaacaggacttattaattctt

SEQ ID NO: 1998 - DNA, 1170 bp, Pseudoroegneria spicata
  misc_feature (605)..(605): n is a, c, g, or t
  misc_feature (666)..(666): n is a, c, g, or t
  misc_feature (837)..(837): n is a, c, g, or t
cgctccgcggccatggagaccctcctctccccctccgcattgctcggccctctccgggtctccaggaagctagggggccccgccgccgtcccgtgcaggtccgccgtctcctgctcgctcaagaagcaggcgcaggcgcaggcgggcgtcgcctggcgtggagacggcggcgtcgggagctgggcgtcgttcttgcaccacggcctcgccgcggcggcgctgtccctggccctcaccctgtcgcctgcgcccgcgccggccgtggcgtcggagttcgacgtgctcaacgacgggccgccggcagacacgtacgtggtggacgacgccggcgtgctgagccgcgtgaccaagtccgacgtgaagcgcctcgcccgcgacctcgaggcccgcaagaacatccggatcaacttcgtcaccgtccgcaagctcacgagcaaagctgacgcgttcgagtacgcggaccaagtgctggagaagtggtacccgacggtggaggagggcagcaacaaggggatcgtggtgctcgtcaccagccagaaggagggggccatcaccggcggcccggccttcgtgcaggccgtcggcgacgccatcctcgacgcaancgtctccgagaacctcccagtgctggcgacggacgagaagtacaacgaggccatcttctcnacggcgaagcggctggtggcggcgatcgacgggctgccggacccgggcgggccggcgttccaggagagcaagcgggagtccaacttcaagagcaaggaggagacggaggagaagcgcgggcagttcacgctcgtcgtcggcggcctgctcgtcatcgccttcgtcgtgccnatggcgcagtactacgcctacatctccaagaagtgacccagcggcgtgcagtgtacagtacagtaatttttcgaatccccccggttttctgctcgaatctttagaagtgaacagagagagattaatgcaagcgcacccgcgctcgtatgcagtgtttgcctgtttggaactaggaaattttacagaacacacagttcagttcctgcagcattcggaaaaaaaaaaatctcacccaaacaggacttattaatttttcttacgatagctcgactggatataaatgtctgagatcactggtgattaatttggatgcaaatcaactctttcttgcca

SEQ ID NO: 1999 - DNA, 1142 bp, Triticum aestivum
ccgcgtccgcggccatggagaccctcctctccccctccgcattgctcggcccgctccgggtctccaggaagccagcggcccccgccgccgtcccctgcagcaggcccgccgtctcctgctcgctcaagaagcaggcgcaggcgcaggcgggcgtcgcctggcgcggagacggcgacggcggcgtcgggagctgggcgtcgttcttgcaccacggcctcgccgccgcggcgctgtccctggccctcaccctgtcgcccgcgcccgcgccggccgcggcgtcggagttcgacgtgctcaacgacgggccgccggcagacacgtacgtggtggacgacgccggcgtgctcagccgcgtgaccaagtccgacgtgaagcgcctcgcccgcgacctcgaggcccgcaagaacatccggatcaacttcgtcaccgtccgcaagctcacgagcaaagccgacgcgttcgagtacgcggaccaagtgctggagaagtggtacccgacggtggaggacggcagcaacaaggggatcgtggtgctggtcaccagccagaaggagggcgccatcaccggcggcccggccttcgtgcaggccgtcggcgacgccatcctcgacgccaccgtctccgagaacctcccagtgctggcgacggacgagaagtacaacgaggccatcttctcgacggcgaagcggctggtggcggcgatcgacgggctgccggacccgggcgggccggcgttccaggagagcaagcgggagtccaacttcaagagcaaggaggagacggaagagaagcgcggccagttcacgctcgtcgtgggcggcctgctcgtcatcgccttcgtcgtgcccatggcgcagtactacgcctacatctccaagaagtgatccagcagcgtgcagtgtacagtacagtaatttttgatattcccccagttttctgctcgaattttagaagtgaacagagagagatcaatgcaagcgcacccgcgctcgtgtgcaatgtttgcctgtttggaactaggaaattttacagagcacacacttcagttcccgcaggattcggaaaaagaaaatctcacccaaacaggacgtattaattcttcttacgatagctcaactggataatgtgattactggtgatta

SEQ ID NO: 2000 - DNA, 1086 bp, Triticum aestivum
ccgcgcccgcggccatggagaccctcctctccccctccgcattgctcggcccgctccggggctccaggagcaggaagccagcggcccccgccgccgtctcctgctcgctcaagaagcaggcgcaggcgggcgtcgcctggcgtggcgacggcgacggcggcgtcgggagctgggcgtcgttcctgcaccacggcctcgccgccgcggcgctgtccctggccctcacgctgtcgccggcgcccgcgccggccgcagcgtcggagttcgacgtgctcaacgacgggccgccggccgacacgtacgtggtggacgacgccggcgtgctgagccgcgtgaccaagtccgacgtcaagcgcctcgcccgcgacctcgaggcccgcaagaacatccggatcaacttcgtcaccgtccgcaagctcacgagcaaagccgacgcgttcgagtacgcggaccaagtgctggagaagtggtacccgacggtggaggacggcagcaacaaggggatcgtggtgctggtcaccagccagaaggagggcgccatcaccggcggcccggccttcgtgcaggccgtcggcgacgccatcctcgacgccaccgtctccgagaacctcccagtgctggcgacggacgagaagtacaacgaggccatcttctcgacggcgaagcggctggtggcggcgatcgacgggctgccggacccgggcgggccggcgttccaggagagcaagcgggagtccaacttcaagagcaaggaggagacggaggagaagcgcgggcagttcacgctcgtcgtcggcggcctgctcgtcatcgccttcgtcgtgcccatggcgcagtactacgcctacatctccaagaagtgatccattccagcgccgtgcagtgtacagtacagcacagtaatttttcgaatccccccggttttctgttggattgtttagaagtgaacagagagagatcaatgcaagcgcacccgcgctcgtgtgcagtgtttgccgcctgtttggaactaggtaattttacagagcacacagttcagttcccgcagtactcggacaaaaattctcacccaaacaggacttatta

SEQ ID NO: 2001 - DNA, 1158 bp, Triticum aestivum
ggaagccagcggcccccgccgccgtcccgtgcagcaggtccgccgtctcctgctcgctcaagaagcagacgcagacgcaggcgggggtcgcctggcgtggagacggcgaccgcggcctcgggagctgggcgtcgttcttgcaccacggcctcgccgccgcggcgctgtccctggccctcacgctgtcgccggcgcccgcgccggccgcagcgtcggagttcgacgtgctcaacgacgggccgccggcggacacgtacgtggtggacgacgccggcgtgctgagccgcgtgaccaagtccgacgtgaagcgcctcgcccgcgacctcgaggcccgcaagaacatccggatcaacttcgtcaccgtccgcaagctcacgagcaaagctgacgcgtttgagtacgcggaccaagtgctcgagaagtggtacccgacggtggaggagggcagcaacaaggggatcgtggtgctcgtcaccagccagaaggagggggccatcaccggcggcccggacttcgtgcaggccgtcggcgacgccatcctcgacgccaccgtctccgagaacctcccagtgctggcgacggacgagaagtacaacgaggccatcttctcgacggcgaagcggctggtggcggcgatcgacgggctgccggacccgggcgggccggcgttccaggagagcaagcgggagtccaacttcaagagcaaggaggagacggaggagaagcgcgggcagttcacgctcgtcgtcggcggcctgctcgtcatcgccttcgtcgtgcccatggcgcagtactacgcctacatctccaagaagtgatccattccagcgccgcgcagtgtacagtacagcacagtaatttttcgaatccccccggttttctgctcgaatttttagaagtgaacagagagagatcaatgcaagcgcacccgcgctcgtgtgcagtgtttgccgcctgtttggaactaggtaattttacagagcaaacagttcagttcccgcagtactcggacaaaaattctcacccaaacaggacttattaattcttcttacgatagctcaactggatactgtgattactggagattaatttggatgcaaatctactctttcttgccaagattctttagtagcttcaattgcttgcaaaatgtgaagc

SEQ ID NO: 2002 - DNA, 1271 bp, Avena sativa
aactccggtgatctctgctctgcccctcacaaactcccatctcccccggccccgcggcaatggagaccctcctctccccctccgcattgctcagcccgctccgcggatccaagaagccagctccggccgcggtctcctgctcgctcaggaagcagacgccgccggcgcaggcgggcgtggcctggagcggagacggcgcgagcagtgtcgccggaagctgggcttcgttcttgcaccacggccttgccgccgcggcgctgtccctggccctcaccctggcgcctgcgcccgcaccggtggcagcgtcggagttcgacgtgctgaacgacgggccgccggccgacacgtacgtggtggacgacgccggcgtgctgagccgcgtgaccaagtccgacgtgaagcggctcgcccgcgacctcgaggcccgcaagaacatccggatcaacttcgtcaccgtccgcaagctcacgagcaaggctgacgcgttcgagtacgcggaccaagtgctggagaagtggtacccgacggtggaagccggcagcaacaaggggatcgtcgtgctcgtcaccagccagaaggagggcgccatcaccggcggcccggagttcgtgaaggcggtcggcgacgccatcctcgacgccactgtctccgagaacctgccagtgctggcgacggacgagaagtacaacgaggcgatctactcgacggcgaagcggctggtggcggcgatcgacgggctggaagacccgggcggaccggcgttccaggagagcaagcgggagtcaaactacaagagcaagcaggagacggaggagaagcgcggccagttcacgctcgtcgtcggcggcctgctcgtcatcgccttcgtcgtgcccatggcgcagtactatgcctacatctccaagaagtgagcggcgtgcagtgtacagtagtaaaattttcgattccccccggttttcagttggagtcttatttagaagtgaacagagaggtgatcaatacagcaggcgcacgctcgtgtgcaatgtttggaaactcaggaatttttactggaaacagttcagctcctgcaggggtttggaaaaaggaaatctcacccaaagtagacttggctaattcttcttcggtggctcaactggatcttgtgatcaatttggatgcaaatttcttgcctcggttccctggtaattttaaatgcttgcaaaaagcaaatctctccttcacaatttagatgctacagtgaaatctttggtctctccaaaatttagatg

SEQ ID NO: 2003 - DNA, 3059 bp, Brachypodium distachyon
gtccacgctggcacccgcgccttatccgaatccagaatcccagccacccaatcacaatatccaagttccacaaaaatccaaaccaaaacggaaacagccagctagcggaggaaggaaggaaactcctccggcgatctctccccccctcacaaactccatcctctcccgaaatgctaatggagaccctcctctccccctccgcattgctcagcccagcactccgcggctcctcctccaagacgacgaagctagtacctcccgccgcctcgtgcaagcctaccacgatctcctgcttgctcaggaagccgcaggcggtcgttgcttcttctcgaggggacggcgtcgttgggagcagctgggtttcgttgttgcagcatggcatggccgcggcagctctgtctctggcgctcacgctcgcgccggctccggccccggccgtggcgtcggagttcgacgtgctgaacgatggcccgccggccgacacgtacgtggtggacgacgcgggcgtgctgagccgcgtgaccaagtccgacgtgaagcggctcgcccgcgacctcgaggcccgcaagaacatccggatcaacttcgtcaccgtccgcaagctcacgagcaaggctgacgcgttcgagtacgcggaccaagtgctggagaagtggtacccgacggtggaggagggcggcaacaaggggatcgtcgtgctcgtcaccagccagaaggaaggcgccatcaccggcggccccgcattcgtgcaggcagtcggggacgccatcctcgacgccaccgtctccgagaacctgccagtgctggcgacggacgagaagtacaacgaggcgatctactcgacggcgaagcggctggtggcggccatcgacgggctgccggacccgggtgggccggcgttccaggagagcaagcgggagtccaacttcaagagcaaggaggagacggaggagaagcgcggacagttcacgctcgtcgtcgggggactgctcgtcatcgccttcgtcgtgcccatggcgcagtactacgcctacatctccaagaagtgatccagcagcgtgcgatgcacagtaaattaattactcgagagaagaaggaaattgttcggttcctccccacggttttccgttggaatttttagaagtgaacacagggtgagtgatcaaaacatgcaagcgcattcttctgtgcagtactgcagtgtgcggatgaagggactgtttgggacttgaatttcacaggaatcagttcagttcctgcaggattcagaagaaattctcacccattggtaacttaatctgcttgcggtagctcaaatggacatacatatctgtcgttaacttgatgtaaaacaaccgtttcttacctcagttcgtcaatactcgatgccattaagtgcttgcagagtgcgaaactttccttcaaaacttgcattctacaaatgaaatcttgttataaacttctcaacttctcttttcgacttagtccctgttttcattgaatgtaatttttgtgtgctccccggtatttactccaaactcaatctattaatcaaaaggcagatctccgccgataacttggaaaaaaaccgaaacctttggtagttttgcagagggaagggcgcacatcaggcatgacagtcttggacaattgaaaagaagccatataagattattaacaagtgataaatacatcatttgctatcaatacaaacttgcagtggtttgctaattcagtggggtaaataccagctcattagaatctcggttttaggaggaatggcatcttgtcaacgaatggaggatcggagtgtctcccggtcagaatctgtgatgtaatgtggaaatttgcagcttctgtgtaatgtattccgtcccagttgacatattcagtactgtcactgcacccttttgcagttacaagattgccatttacagactttgtctgtccacacggtactcgaccatcatagttcaggggtggccctccatatccacaacatgcttgtgttggattctcgaaccctgcaagattttgaagtgcaaattaaaaaaaatcacttgaattattgctaaaaaatattactgcgttaaatagttcaacaaatgtaaaaacccatagtacacggaagtcaaagagacaaagactaggcaggatgagcaaagagacaaaaactaaagcatctttgttttccctcctttagtgggctgatcattgctagcacttgttcaggaatgattgtaaaatttcatcataagccttctacttaagcttgattagaattcttgaaaacatctttcctggtaaatggacaccaaacgatatcttgtgcattagtttgtttttataactagagaatatgttgaagtgtagtttgcttaccatatcgagaataattggcgatcaggctgtacttgatggagtagatgtcaatgtaagtgatatcagctccagcaaattgacctcttaactttgtgcaaagtgcatgcagctgtaagttaaaaatctttgcagcacgattgtgctttgttacacaatgaacttcatccagttgtgatgggtctttgccaaaaagagctatgttttgaggtaagcaaccgagagggcctgtattgtggatccagaatttcctggcaccttgctcgtatagtgactgaaataaggagtacagactctaaggtcaaattatagatgataaaaagaatataggagttaggaacttccacaagacgtatataactagaagagtatagcaagatccaataatgcataatccggaacctatatgaactacatccagagtttttacctctattagcagtgtaattaccaaaatacactgaagcaaatatgactagcatatgcactgaagtatataactacaaacctttagcccagtttcaaattccagcaaaatagtcggaatggatgcaatgacttggtcctctgttttcgagtagaattgaccagcaaggtcattttgaccaatatcaaacatgtagagtccctttgaaaagtaatccaactgaggaatataccgcctgtacctatctcctgaa

SEQ ID NO: 2004 - DNA, 1409 bp, Brachypodium distachyon
tccacaaaaatccaaaccaaaacggaaacagccagctagcggaggaaggaaggaaactcctccggcgatctctccccccctcacaaactccatcctctcccgaaatgctaatggagaccctcctctccccctccgcattgctcagcccagcactccgcggctcctcctccaagacgacgaagctagtacctcccgccgcctcgtgcaagcctaccacgatctcctgcttgctcaggaagccgcaggcggtcgttgcttcttctcgaggggacggcgtcgttgggagcagctgggtttcgttgttgcagcatggcatggccgcggcagctctgtctctggcgctcacgctcgcgccggctccggccccggccgtggcgtcggagttcgacgtgctgaacgatggcccgccggccgacacgtacgtggtggacgacgcgggcgtgctgagccgcgtgaccaagtccgacgtgaagcggctcgcccgcgacctcgaggcccgcaagaacatccggatcaacttcgtcaccgtccgcaagctcacgagcaaggctgacgcgttcgagtacgcggaccaagtgctggagaagtggtacccgacggtggaggagggcggcaacaaggggatcgtcgtgctcgtcaccagccagaaggaaggcgccatcaccggcggccccgcattcgtgcaggcagtcggggacgccatcctcgacgccaccgtctccgagaacctgccagtgctggcgacggacgagaagtacaacgaggcgatctactcgacggcgaagcggctggtggcggccatcgacgggctgccggacccgggtgggccggcgttccaggagagcaagcgggagtccaacttcaagagcaaggaggagacggaggagaagcgcggacagttcacgctcgtcgtcgggggactgctcgtcatcgccttcgtcgtgcccatggcgcagtactacgcctacatctccaagaagtgatccagcagcgtgcgatgcacagtaaattaattactcgagagaagaaggaaattgttcggttcctccccacggttttccgttggaatttttagaagtgaacacagggtgagtgatcaaaacatgcaagcgcattcttctgtgcagtactgcagtgtgcggatgaagggactgtttgggacttgaatttcacaggaatcagttcagttcctgcaggattcagaagaaattctcacccattggtaacttaatctgcttgcggtagctcaaatggacatacatatctgtcgttaacttgatgtaaaacaaccgtttcttacctcagttcgtcaatactcgatgccattaagtgcttgcagagtgcgaaactttccttcaaaacttgcattctacaaatgaaatcttgttataaacttctcaacttctctt

SEQ ID NO: 2005 - DNA, 1013 bp, Cynodon dactylon
gccggggggaacagcagcaatggagaccctcctctccccctccacattgttcacccctctccgcggaggatccaagaaaccatctcccgccagcgcctcctcctccaggtccgtcgtctcctgcacgctcaggaagcagcagccagcagcccttgccgcttcttcccatggagatggcgccaggaactgggtgtcgttcttgcaccatggccttgcagccgccgcgctgtcgctggccatcagcctggctccggctcccgcgccggccgtggcgtcggagttcgacgtgctgaacgacggcccgcccgtggactcgtacgtggtggacgacgccggcgtcctgagccgcgtgaccaagtccgacgtgaagcggctggcccgtgacctcgaggcccgcaagaacatccggctcaacttcatcactgttcgcaagctcacgagcaaagctgacgcgttcgagtatgcggaccaagtgctggagaagtggtacccgacgatcgaggagggtagcaacaagggcatcgtcgtgctcgtcaccagccagaaggagggcgccatcaccggcggcccggaattcgtgaaggccgtcggcgaccagatcctcgacgccaccgtctccgagaacctcccagtgctagcgactgacgagaagtacaacgaggcgatcttcagcacggcgaagcggctggcggcagcgatcgacggtctgccggacaccggaggcccgtcgttcaaggagaacaagagggagtcaaacttcaagaccaaggaggagacggagtcgaagcgcggccagttcacgctcgtcgtcggtggcctacttgtcatcgcctttgtcgtgcccatggcgcagtactacgcatacatctccaagaaatgagtagcgagctgcagtgcatgtacagtattcataccgaagaggaaacatccaggcacccccaaggttctctaccggaatttttagaactcaactgagaatgattaatataggtgcacgcttgtgccggttaatc

SEQ ID NO: 2006 - DNA, 1240 bp, Leymus cinereus x Leymus triticoides
  misc_feature (6)..(7): n is a, c, g, or t
  misc_feature (87)..(87): n is a, c, g, or t
  misc_feature (89)..(89): n is a, c, g, or t
cacaanncctaactcccgctccgcggccatggagaccctcctctccccctccgcattgctcggcccgctccggggctccaggaagcnantagcccccgccgccgtcccgtgcaggtccgccatctcctgctcgctcaagaagcagacgcaggcgggcgtcgcctggcgtggagacggcgacagcggtgttgggagctgggcgtcgttcttgcaccacggccttgccgcggcggcgctgtctctggccctcaccttggcgccggcgcccgcgccggtgttggcgtcggagttcgacgtgctcaacgacgggccgccggcagacacgtacgtggtggacgacgccggcgtgctgagccgcgtgaccaagtccgacgtgaagcggctcgcccgcgacctcgaggcccgcaagaacatccgaatcaacttcgtcaccgtccgcaagctcacgagcaaagccgacgcgttcgagtacgcggacacagtgctggagaagtggtacccaacggtggaggagggcagcaacaaggggatcgtcgtgctcgtcaccagccagaaggagggcgccatcaccggcggcccggccttcgtgcaggccgtcggcgacgccatcctcgacgccaccgtctccgagaacctcccagtgctggcgacggacgagaagtacaacgaggcgatcttctcgacggcgaagcggctggtggcggcgatcgacgggctgccggaccccggcgggccggcgttccaggagagcaagcgggagtccaacttcaagagcaaggaggagacggaggagaagcgcggccagttcacgctcgtcgtcggcggcctgctcgtcatcgccttcgtcgtgcccatggcgcagtactacgcctacatctccaagaagggagatcaccgtggcggcttggctgctgtggctggcgctctccttctttcctcttcttctgttcgtggcggtggaacgggagggactgggagctgcctttctaggtcagccacatgggctgggtcacatgggctctagtgaggagatgggcaaggcccataccggttcaacactccccctcaagatgggtggtagatatctatcatccccatcttgtcacacgccaagttacagtcctttgttcccagtccctttgtcaagcaatctgcaaactgctgcccagaactgacatgagtaaggctgatgatcccagcatcaagtttctccttaatgaagaagcgatcaattttcaca

SEQ ID NO: 2007 - DNA, 1505 bp, Oryza sativa
atggctgtccacgctggcccctcgccttatccggctccagaatcccatccacccaatcacaatccaacccacgccattgcaaccaaatttccaatacacaaaacagcagaaactctagtgatcacaagctcagctcagctcagctccctccttctccccggagaagcagcggccggcacggcagcaatggagaccctcctctccccctccacattgctctcccctctccgcggctccaagaagaagccggcgagccccgccgcgtcggcgtcgtcgtcgtcgtcgtctcccgccaggtccgtcgtctcctgcgcgctcaggaggcagcagccgccgccgcaggcggtcgccgcttggcgcggagacggcggccgcggtggcggcgtcgggagctgggcgacgttcttgcagcacggcctggccgcggcggcgctgtcgctggcaatcagcatggcgccggcgcccgcgccggccgtggcgtcggagttcgacgtgctgaacggcgggccgccggaggacacgtacgtggtggacgacgccggcgtgctcagccgcgtgaccaagtccgacgtgaagcggctcgtccgcgacctcgagtcccgcaagaacatcaggatcaacttcatcaccgtgcgcaagctcacgagcaaagctgacgcgttcgagtacgcggaccaagtgctggagaagtggtacccgacggtggaggagggcaacaacaagggcatcgtcgtgctcgtcaccagccagaaggagggcgccatcaccggcggcccggccttcgtgcaggccgtcggcgacgagatcctcgactccaccgtctccgagaacctcccagtgctggcgacggacgagaagtacaacgaggcaatctacacgacggcgaagcggctggcggcggcgatcgacgggctgccggaccccggcgggccgacgttcaaggacaacaagagggagtccaacttcaagacgaaggaggagacggaggagaagcgcggccagttcacgctcgtcgtcggcggcctgctcgtcatcgccttcgtcgtgcccatggcgcagtactacgcctacatctccaagaagtgaacagcagcggctacctgttctttccaacaaaaaaagagagaaaaaatgagcagcatatggtgctgctctgtacagtaaatttgctcaggagatggctaaatctcccggttttctgtcggaattttagaggcgaaacagagaattatgatgaacacaggtgcaccaccgtgccggttaatttttattgtagtagcataactgaggcactgagcaattaggtgcaaatcagcacttccttaccccgattcctcttcttctataaccattttttttgttgttagtttttgctctgttttatccttccagcaatgctgcaacagttcttgcaaaatgtgcaaactctccagcaaaaatttcatgctacaacaatgcaactaaacctgtcttttagtttttttttattattttttttagagaag

SEQ ID NO: 2008 - DNA, 1834 bp, Setaria italica
cgcatttcatcctgacacgtggacatattcatgtcttctgagctctaacatcgagacaagcgccgtccatggtggcaccgcaccttatccggctccagaatcccagccacccaatcacaatccagaccaaacggacgctgggcgcagcagaaactccagcgatctgcgccctcacaaccgcgcgcgattcctctcctcttttcccgagctcccgcggcggcagcagcaatggagaccctcctctccccctccacattgttcacccctctccgcggcaccaggagcgtctcggccaggtccaccgtctcctgcgccgcgctcaagaagcagcagcaggcggcggctctcgccgcttccgcctcctcccatgggtactccggcagcggcggcggcaggagctgggtgtcgttcctgcaccacggcctggcggcggccgcgctgtctctggccatcagcctgggcccggcgcccgcgccggccgtggcatccgagttcgacgtgctgaacgacgggccccccgtggactcgtacgtggtggacgacgccggcgtgctgagccgcgtgaccaagtccgacgtcaagcggctggcccgcgacctcgaggagcgcaagaacatccgcctcaacttcatcaccgtccgcaagctcacgagcaaagcggacgcgttcgagtacgcggaccaggtgctggagaagtggtacccgacgattgaggagggcagcaacaagggcatcatcgtgctcgtcaccagccagaaggagggcgccatcaccggcggccccgccttcgtccaggccgtcggcgaccagatcctcgacgccaccgtctccgagaacctcccagtgctggcgacggacgagaagtacaacgaggcgatcttcagcacggcgaagcggctggcggcggcgatcgacgggctgccggacacgggcggcccgtcgttcaaggagaacaagagggagtccaacttcaagaccaaggaggagacggaggagaagcgcgggcaattcacgctcgtcgtcggaggcctgctcgtcatcgccttcgtcgtgcccatggcgcagtactacgcctacgtgtccaagaagtgagctgagtcctagcgtgctgtacagtaattttacaccgaagaggaaaagttcatttcccactctcagggtgagcagagctttcttctgttggaggaattcttagaggtgaacggagaatggttaatttttcctgcggtagcatatatacaaataataactgcatatatttttatgttttcactggtgggttcattaggtgaaaaagcgtagttcctctgcaaccaatcaagtaattacctctgtctagcactgcttgcaacgtgaaactctacaacccttactagacaagtagggcaatggaataaaatcactgaagccagccacaagaaacaatgataggcaactgaccaagccagatgtgacttttcccccttctgtgatcgagctatatatggttattaacaagtaataaatacatcgtatccgcaaccaatgctgttaaagtggttgatcagagagaaaacaattgtatgctacttagaatctaggttttatgacgaatggcatcttgtcgacgaacggaggatcagagtatttcccggtcagtatctgagatgcaatgtggaaatttgcagcttcagtgtaatgtatcccatcccaattgacgaattcagtactgtcactgcaccctttcgctgtaacaggtttaccattcaaagacactgtctgtccacatggtaccctaccatcatagttcaggggtggacctccatatccacagcatgtttgagtggcatgctcg

SEQ ID NO: 2009 - DNA, 1249 bp, Zea mays
gagttgtcaaacaagcgctgtgccgatgtccagctaggctggcacggcaccttatccggctccagaatcctagccacccaatcagaatccagagcaggcggtcgcagcagaagctccggtgatcagcgccctcacaatgcgagcgtgattcctcccctccatcccggctcgagctccccgcggcagcaatggagaccctcctctccccctccacattgttcacgctaccactccgtggctccagcaggagaccgtctctggctgctagcgtctcgtccaggcccaccgtgtcctgctccagcgcgctcaagaggccacaggccggcgccgtcgctgcctcctcccatggagacggcgtcggcaggaactggatgtcgttcctgcaccacggcctggcggcggccgcgctgtcgctggccatcggcctgaccccggcgcccgcgccggcggtggcgtcggagttcgacgtgctgaacgacggggcccccgtggactcctacgtggtggacgacgccggcgtgctgagccgcgtcaccaagtccgacgtcaagcggcttgcccgcgacctcgaggcccgcaagaacatccgcctcaacttcatcaccgtccgcaagctcacgagcaaggctgacgcgttcgagtacgcggaccaagtcctggagaagtggtaccccacgattgaggagggcaacaacaagggcatcgtggtgctcgtcacaagccagaaggagggcgccgtcaccggggggcccgccttcatccaggccgtcggcgaccagattctcgacgccaccgtgtctgagaacctcccagtcctcgcgaccgacgagaagtacaacgaggcgatcttgagcacggcgaagcggctggcggcggcgatcgacgggctgccggacactggtggcccgtcgttcaaggagaacaagcgggagtccaacttcaagaccaaggaggagacggaggagaagcgcgggcagttcacgctcgtcgtcggcggcctgctcgtcatcgccgtcgtcgtgcccatggcgcagtactacgcctacgtgtccaagaagtgagcgaaccatgaatatggcgtgctgtgtacagtaaatcagtaatgttataccgaagagggttttttttttaatctcccaggttgaagttcttcgatctgttggaattcttagaaatggacggaaaaaaatgattattatgcttttacattgggttcattaaaatcgacaaccattcattgccgaacaag

SEQ ID NO: 2010 - DNA, 1297 bp, Sorghum bicolor
gagttgtcacaaccagaacaagcgctgtccacgctgttacggcaccttatccggctccagaatcccagccacccaatcacaatccagaccagacgggcgcagacagaagctcgagtgagtgggcagtgatctgcgccctcacaatgcgagcgtgattcctcttcctcccccctccttcctcgagcgagctccccccgcggcagcaatggagaccctcctctccccctccacattgttcacgccatcactccgtggctctaggagaccgtctctgaccgctagcgtctcgtccaggtccaccgtcgtcgtctcctgcgcgctcaggaggccacaggccgccggcgccgccgtcgctgccaccacctcctcctccaatggagacggcggcatcgacgtcgtcggcaggagctggatgtcgttcctgcaccacggcctggcggcggccgcgctgtcgctcgccatcagcctggccccggcgcccgcgccggcggtggcgtcggagttcgacgtgctgaacgacgggccccccgtggactcgtacgtggtggacgacgccggcgtgctgagccgcgtcaccaagtccgacgtcaagcggctggcccgcgacctcgaggcccgcaagaacatccgcctcaacttcatcaccgtccgcaagctcacgagcaaagctgacgcgttcgagtacgcggaccaagtcctggagaagtggtaccccacgattgaggagggcaacaacaagggcatcgtcgtgctcgtcaccagccagaaggagggcgccgtcaccggaggccccgccttcatccaggccgtcggcgaccagattctcgacgccaccgtgtctgagaaccttccagtgctcgcgaccgacgagaagtacaacgaggcgatcttcagcacggcgaggcggctggcggcggcgatcgaagggctgccggacacgggtggcccgtcgttcaaggagaacaagcgtgagtccaacttcaagaccaaggaggagacggaggagaagcgcgggcagttcacgctcgtcgtcggcggcctgctcgtcatcgccttcgtcgtgcccatggcgcagtactacgcctacatttccaagaagtgagtcaaccatagcgtgctgtacagtaaatgttaaactgaagaggatttttaaactcccaggttgagcttcttctgttggaattcttagaagtgaacagaaaaaaatgattaatacaagtgcacacctgtgcgcgccggttaatttttcttgtggtagcatattagtatgcttttattatactgggttcattctgtg

SEQ ID NO: 2011 - DNA, 1557 bp, Sorghum bicolor
ttttttcttttttttccttaccacctccttctacttctccggatatgtgctcccaggccacgcgtatatttacacgcatgtgatgtggtttatcaagtgcgaaaagatgaagagatacgaggaactcttgtagatgatttttttccctccttttttttcaaaatacctggttggtgaaggaatatggggcacttgaagatcctcctagcagttagtacaacactttaaccacctacaatcagttagtgaacgcctgagtgcatcagcttgacacgtggacatcgccatgactcgtgagttgtcacaaccagaacaagcgctgtccacgctgttacggcaccttatccggctccagaatcccagccacccaatcacaatccagaccagacgggcgcagacagaagctcgagtgagtgggcagtgatctgcgccctcacaatgcgagcgtgattcctcttcctcccccctccttcctcgagcgagctccccccgcggcagcaatggagaccctcctctccccctccacattgttcacgccatcactccgtggctctaggagaccgtctctgaccgctagcgtctcgtccaggtccaccgtcgtcgtctcctgcgcgctcaggaggccacaggccgccggcgccgccgtcgctgccaccacctcctcctccaatggagacggcggcatcgacgtcgtcggcaggagctggatgtcgttcctgcaccacggcctggcggcggccgcgctgtcgctcgccatcagcctggccccggcgcccgcgccggcggtggcgtcggagttcgacgtgctgaacgacgggccccccgtggactcgtacgtggtggacgacgccggcgtgctgagccgcgtcaccaagtccgacgtcaagcggctggcccgcgacctcgaggcccgcaagaacatccgcctcaacttcatcaccgtccgcaagctcacgagcaaagctgacgcgttcgagtacgcggaccaagtcctggagaagtggtaccccacgattgaggagggcaacaacaagggcatcgtcgtgctcgtcaccagccagaaggagggcgccgtcaccggaggccccgccttcatccaggccgtcggcgaccagattctcgacgccaccgtgtctgagaaccttccagtgctcgcgaccgacgagaagtacaacgaggcgatcttcagcacggcgaggcggctggcggcggcgatcgaagggctgccggacacgggtggcccgtcgttcaaggagaacaagcgtgagtccaacttcaagaccaaggaggagacggaggagaagcgcgggcagttcacgctcgtcgtcggcggcctgctcgtcatcgccttcgtcgtgcccatggcgcagtactacgcctacatttccaagaagtgagtcaaccatagcgtgctgtacagtaaatgttaaactgaagaggatttttaaactcccaggttgagcttcttctgttggaattcttagaagtgaacagaaaaaaatgattaatacaagtgcacacctgtgcgcgccggttaatttttcttgtggtagcata

SEQ ID NO: 2012 - DNA, 760 bp, Secale cereale
ctcgaagaaggcagcgaatccgatagctacggcccagttaagcccaggtcgaagtctctcgtccagatcgggggtttatgtctccttccccgctgagaaaagaagcagctcgtggcagctccctgtaaaaaccctagctttacctccgccaccaagcgcctccacgatgaagctcgtcaggttcttgatgaagctgaacaacgagacggtgaccatcgagctcaagaatggcaccactgtccacggcaccatcatcggtgtcgacatcagcatgaatactcatctcaagactgtgaagctcacactgaaagggaagaatcctgttacccttgaccaccttagtgtgaggggaaacaacattcgttattacatccttcctgatagcttaaacctggagacgttgctggttgaggaaacaccaagggtgaagcctaagaagcctactgcagggaaacctatgggtcgtgggcgcggccgtggtcgtgggcgcggccgtggcagggggcgctgagctattataccttggaaattttacactgcatgcttgtgtgcagtgtaatctggcttcttacttgtacggagcaatattcttattagagcccagacgttgatattggtacggagcaatattcttattagagcccagacgttgatattggctgtacccagctgttcttgatgtggaattatgttgttgctgtttgacagatgttctaaagtgtgccatctttataatgcgattactgtgtcatgattccca

SEQ ID NO: 2013 - DNA, 661 bp, Triticum aestivum
cccgctgagaaaagaagcagctcgtggcagctccctgcaaaaaccctagctttacctccgccaccaagcgcctccacaatgaagctcgtcagattcttgatgaagctgaacaacgagacggtgaccatcgagctcaagaatggtaccaccgtccacggcaccatcattggcgtcgacatcagcatgaatactcatctgaagactgtcaagctcacattgaaagggaagaatcctgttacccttgaccaccttagtgtgaggggaaacaacattcgatattacatccttcctgacagcttaaacctggagacgttgctggttgaggaaacaccaagggtgaagcctaagaagcctactgcagggaaacctatgggtcgtgggcgcggccgtggtcgtgggcgcggtcgtggcagggggcgctgagctatgttataccttggaaattttgcactgcatgcttgtgtgcagtgtaatctggtttcttacttgtacggagcaatattcttattagagccaagaagacgttgatattggctgtaccagctgttcttgatgtggaattatgttgttggtgtttgactgatgttctaaagtgtgctagctttatattacgggtgttcaaaagtgtactatctttattttgcgattactgtgtcatgat

SEQ ID NO: 2014 - DNA, 1912 bp, Triticum aestivum
cacccagttcaatctgtgaaatgatttcgtcccgaggccaaaattgtcaaatttgccatcaaaatagctgtcgcgtgcgtcggttgcacaagcgcccgcaattcccctccccctcccttctcttaaaccaatcagacgctagaatccttggcaattcgccgctcctccgatccgttcgccgccgccgggatcgaccatgtcgtacgcctacctcttcaagtacatcatcatcggcgacacaggcgtgggcaagtcatgcctgctgctgcagttcaccgacaagaggtttcagcccgtgcacgacctcaccatcggcgtcgagttcggcgcccgcatgatcaccatcgacaacaagcccatcaagctccagatttgggacacggctggccaagaatcattcagatctataacaagatcatactacagaggtgctgctggtgctcttttggtttatgatatcaccaggagggaaacttttaaccatcttgcgagctggctagaagatgcaagacagcatgcaaatgccaatatgacagtgatgttaatcggaaacaaatgtgatctgtctcatagacgggctgtcagctacgaggagggtgaacagttcgccaaggagcatggtctagtctttatggaggcatctgcaaaaacagcacaaaatgttgaggaggcattcattaagacggctggaacaatatacaagaaaatccaagatggtgtttttgatgtatctaatgagtcctacggaatcaaagttggctatgctgtccccaatgcatctggaggtggtgctggctcgtcctctcaagcaggtggctgctgcagttaagcaagtttacgaccaagtcctatcatgtgagactgaaaacagctgcccaggttgttgtccttccttccgccattgacggtgtaatcagtgagcaaatgttcatcaatggtgcttgtctacactgcgcaatctttctgtaaagcaaacatctatagtttctgtccatttgtgtctgtaactaaatggtgtggatattcatttgttcgatgtaataatgctttgtagactacagacatggctgtgcagcaattgccctgatccatgtcacaatatttgccctgatccttccattgcgcagtatttgtccacgctatttgtgcttgttgttgatgatgcatttaatacttgtccaatagcaatagtcacaaccattgttcaactttgtcggatattactcatactttgtcggaacataccagataaatttcctagaaatgggaatcatgacacagtaatcgcaaaataaagatagtacacttttgaacacccgtaatataaagctagcacactttagaacatcagtcaaacaccaacaacataacataattccacatcaagaacagctggtacagccaatatcaacgtcttcttggctctaataagaatattgctccgtacaagtaagaaaccagattacactgcacacaagcatgcagtgcaaaatttccaaggtataacatagctcagcgccccctgccacgaccgcgcccacgaccacggccgcgcccacgacccataggtttccctgcagtaggcttcttaggcttcacccttggtgtttcctcaaccagcaacgtctccaggtttaagctgtcaggaaggatgtaatatcgaatgttgtttcccctcacactaaggtggtcaagggtaacaggattcttccctttcagtgtgagcttgacagtcttcagatgagtattcatgctgatgtcgacgccaatgatggtgccgtggacggtggtgccattcttgagctcgatggtcaccgtctcgttgttcagcttcatcaagaatctgacgagcttcatcgtggaggcgcttggtggcggaggtaaagctagggtttttgcagggagctgccac

SEQ ID NO: 2015 - DNA, 1529 bp, Triticum aestivum
gctttacctccgccaccaagcgcctctacgatgaagctcgtcagattcttgatgaagctgaacaacgagacggtgaccatcgagctcaagaatggcaccaccgtccacggcaccatcattggcgtcgacatcagcatgaatactcatctgaagactgtcaagcttacactgaaagggaagaatcctgtcacccttgaccaccttagtgtgaggggaaacaacattcgatattacatccttcctgacagcttaaacctggagacgttgctggttgaggaaacaccaagggtgaagcctaagaagcctactgcagggaaacctatgggtcgtgggcgcagtcgtggtcgtgggcgcggtcgtggcagggggcgctgagctatgttataccttggaaattttgcactgcatgcttgtgtgcagtgtaatctggtttcctacttgtacggagcaatattcttattagagccaagaagacgttgatattggctgtaccagctgttcttgatgtggaattatgttgttggtgtttgactgatgttgataaataggaagttagagttatggagacaaaccttggaatcgaaagggtttaggcttagtagaactaaaaccgagtacatgatgtgcggtttcagtactactaggtgtgaggaggaggaggttagccttgatggtcaggtggtacctcggaaggacacctttcggtatttggggtcaatgctgcaggaggatgggggtattgatgaagatgtgaaccatcgaatcaaagccggatggatgaagtggcgccaagcttctggcattctctgtgacaagagagtgccacaaaagctaaaaggcaagttctacaggacggcggttcgacccgcaatgttgtatggcgctgagtgttggccgactaaaaggcgacatgttcaacagttaggtgtggcggagatgcgtatgttgagatggatgtgtggccacacgaggaaggatcgagtccggaatgatgatatacgagatagagttggggtagcaccaattgaggagaagcttgtccaacatcgtttgagatggtttgggcatattcagcgcaggcctccagaagctccagtgtatagcggacggctaaagcgtgcggagaatgtcaagagagggcggggtcgaccgattttgacatgggaggagtccgttaagagagacctgaaggattggagtatcgacaaagagctagctatggacaggggtgcgtggaagcttgctatccatgtgccagagccatgagttggttgcgagatcttatggatttcacctctagcctaccccaacttgtttgggactaaaggctttgttgttgttgttgttgtagtatcttttgttttacagtgtaattctcaaaggatttttgcactcattagtcagttgtggactttttacattgtaattatcaaaagagttacagtgtaattcttaaagtatttttacactgtaattatcttttcgtttacagtgtaattctcgttgtggactttttacagtgtaattat

SEQ ID NO: 2016 - DNA, 840 bp, Brachypodium distachyon
cggcccagttaagcccagctcgcagtcggatcgtccagatcggggtttttatttcttcttccccgctccgagaagaaaagcagctctaggcagctccctgcaaaaaccctaggtttacctccgccaccaaacgcctccacgatgaagctcgtcaggtttttgatgaagctgaacaacgagacggtgaccatcgagctcaagaatggcaccaccgtccacggcaccatcaccggtgttgacatcagcatgaatactcatctgaagactgtgaagctcacattgaaagggaagaatcctgttacccttgatcaccttagtgttaggggaaacaacattcgctattatatccttcctgacagcttaaacctggagactttgttgattgaggaaacaccaagggtgaagcctaagaagcctactgcagggaaacctatggggcgtgggcgcggccgtggtcgtgggcgcggtcgtggcaggggacgctgagctttcttatcttcgttggaaattttgcactgcatgcttctgtgcaatgtaatcttctctcttgccagttgtacggagtaatattcttatgagccaagatgttgatgccagctgttcttgctgtgcgttttatgttggtgttcgacctgatgttcaagagaatgctagctcgcattgtcagtttactgtgtaatgatgctcttctcactcttgcaaatgtcgtcaattacatctctgtttcacaatgcaatgtttgattggtaccgtgcatgataaaaagaagtgcaaggttttagtaattttggaaatcaagcaatgctttaccccattacgtttttcagcgagcatgcattg

SEQ ID NO: 2017 - DNA, 732 bp, Brachypodium distachyon
cggcccagttaagcccagctcgcagtcggatcgtccagatcggggtttttatttcttcttccccgctccgagaagaaaagcagctctaggcagctccctgcaaaaaccctaggtttacctccgccaccaaacgcctccacgatgaagctcgtcaggtttttgatgaagctgaacaacgagacggtgaccatcgagctcaagaatggcaccaccgtccacggcaccatcaccggtgttgacatcagcatgaatactcatctgaagactgtgaagctcacattgaaagggaagaatcctgttacccttgatcaccttagtgttaggggaaacaacattcgctattatatccttcctgacagcttaaacctggagactttgttgattgaggaaacaccaagggtgaagcctaagaagcctactgcagggaaacctatggggcgtgggcgcggccgtggtcgtgggcgcggtcgtggcaggggacgctgagctttcttatcttcgttggaaattttgcactgcatgcttctgtgcaatgtaatcttctctcttgccagttgtacggagtaatattcttatgagccaagatgttgatgccagctgttcttgctgtgcgttttatgttggtgttcgacctgatgttcaagagaatgctagctcgcattgtcagtttactgtgtaatgatgctcttctcactcttgcaaatgtcgtcaattacatctctgtttcacaat

SEQ ID NO: 2018 - DNA, 527 bp, Festuca arundinacea
ggcagaggcagatccggggttttatgtctccttctcctctctgagaagcagctcgtggcagctccctgcaaaaaccctagcttttcctccgccaccagaggcctccacgatgaagctcgtcaggttcttgatgaagctgaacaacgagacggtgaccatcgagctcaagaacggaaccaccgtccacggcaccatcaccggtgttgacatcagcatgaatactcatctgaagactgtgaagctcacactgaaagggaagaatcctgttaccattgatcaccttagcgtgaggggaaacaacattcgctattacatccttcctgacagcttaaacctggagactttgctggttgaggaaacaccaagggtgaagcctaagaagcctactgcagggaaacctatggggcgtgggcgcggccgtggtcgtgggcgcggtcgtggcagggggcgctgagctttgctgtaccttggaaattttgcactgcatgcttctgtgcaatgtaatcttctttcttgttggtcgtacg

SEQ ID NO: 2019 - DNA, 598 bp, Avena sativa
ggtggcagctccctgcaaaaaccctagctttacctccgccaccgaaggcctccaagatgaagctcgtcaggttcttgatgaagctgaacaacgagacggtgaccattgagctcaagaacggtacaaccgtccacggcaccatcaccggtgttgacatcagcatgaatactcatctgaagactgtgaagctcacactgaaagggaagaatcctgtcaccattgatcatctcagtgtcaggggaaacaacattcgctattacatccttcctgacagcttaaacctggagactttgctggttgaggaaacaccaagggtgaagcctaagaagcctactgcagggaaacctatggggcgtgggcgcggccgtggtcgtgggcgcggtcgtggcagggggcgctgagctttgttgtaccttccttggaaactttgcactgcgtgcttatgtgcaatgtaatcttctttcttgttgatcgtacggagtaatattcttatcggagctaagatgttgctactagctgtctgttgatgtcgaattatgttggtgtttgacctgatgttcaaaagcatgtcagcttacattgtgatggtcaaaagtgg

SEQ ID NO: 2020 - DNA, 587 bp, Avena sativa
ggaagcagctcgtggcagctccctgcaaaaaccctagctttacctccgccaccaaaggcctccacgatgaagctcgtcaggttcttgatgaagctgaacaacgagacggtgaccattgagctcaagaacggtaccaccgtccacggcaccatcaccggtgttgacatcagcatgaatactcatctgaagactgtgaagctcacactgaaagggaagaatcctgtcaccattgatcatctcagtgtcagaggaaacaacattcgctattacatccttcctgacagcttaaacctggagactttgctggttgaggaaacaccaagggtgaagcctaagaagcctactgcagggaaacctatggggcgtgggcgcggccgtggtcgtgggcgcggtcgtggcagggggcgctgagctttgttgtaccttccttggaaactttgcactgcgtgcttatgtgcaatgtaatcttctttcttgttgattgtacggagtaatattcttatgggagctaagatgttggtactagctggctgttcttgatgttgaattatgctggtgtttgacctgatgttcaaaagcatgttagc

SEQ ID NO: 2021 - DNA, 751 bp, Panicum virgatum
cgggggaggcagcagctcccccgcaaaaaccctagctttacctccgccccgtcgtcccccaccaagcgcctccaagatgaagcttgtcaggttcctgatgaagctgaacaacgagacggtgaccatcgagctcaagaacggcaccgtcgtccacggaaccatcatcggcgttgatatcagcatgaatactcatctgaagactgtgaagctcacactgaaagggaaaaatcctgttacccttgatcacctcagtgtgagaggaaacaacatccgctattatatccttcctgacagcttaaacttggagactttgctggttgaggaaacaccaagggtcaaacctaagaagccaacttcagggaagcctttgggacgtgggcgtggccgtggtcgtgggcgcggtcggggtcggggacgttgagcttgctgcccatttggaaattgcattgtggacttctttgcaatgtaatctgctttcatatcagtatgtacggagtatcacttttgttaaggcaatggtgttggtgccgtctgttcttgctgtggattgagttgatggttagatgttacatgccatacgctcttcccctgaactcctgtgcgtgatgactaaattcatgtgaagtcaaccatgcaacctttctgatcactgtcactggtgtaatagggtcaaagtaaggtagacagcttcgattcttttcaacaacggtaccgttgactttagaacaacggccatggttacctttctaat

SEQ ID NO: 2022 - DNA, 774 bp, Vaccinium corymbosum
aatctttgccctagcgtccctcctcgtcgtcgtcgtctttctcctgtcaacaatgaagctcgttaggttcttgatgaagttgaacaacgagaccgtgtcgattgagctcaagaacgggaccgttgttcatggcaccatcacaggtgtggatattagtatgaacacacatttgaagacagtaaagctgacactgaaggggaaaaatccagtgactctggatcatctgagtgtgaggggtaacaatatccgctactatatccttcctgacagcctgaatcttgagactttgttggtagaagagacgcctagggtcaagcccaagaagccgactgcagggaagcctttgggacgtggccgaggccgtggtcgtggtcgcggacgtggcagaggtcgttaattgtgatgccctcgttgcaatttttgagacgtgttttctgtgaacacccatgtcatgggaggtagttgtttctgatgatggttgtgaaagagtttcctaaaatttcttggaacagctggatctttggtgccgttctcctaaaatctgtaatcgtggtttagcttagatttcccaatgagatattaatgtacaagtcttgaattgctcaatttcaattctcctggcatttgcagaattggagttctcgttgtagtatgttagattatcctatagaatcactatcctagtattttgttatgattttccagaaattgtggccaaacttcatttcctttgttagacttgcaacattatagagatcgctcggaggtccattg

SEQ ID NO: 2023 - DNA, 661 bp, Vaccinium corymbosum
gttcttcaccggcgactttggcgttctgctttgtgcaacaaaaccctaggcataaatcgtcatccttcttcttcctcgctccccaacaatgaagctcgtcaggtttttgatgaagttgaacaacgagaccgtgtcgattgagctcaagaacggaaccgttgttcacggtaccatcacaggtgtggatatcagtatgaacacgcatttgaaaacagtaaaacttacactaaaggggaagaatccagttaccctggatcacctgagtgtgaggggaaacaatattcgatactatatcctccctgacagcttgaatctcgagaccttgttggtggaagagacgcctagggtgaagcccaagaagccgacagcagggaagcctttggggcgtggcagaggccgtggtcgcggacgcggtcgtggccgaggccgttagtcacggggttgtcattgcaatttttgggactattgtaaacacctgtgttgtttgagccggtaatttctaatgtcctagactttctcgaaacagaagctccattatgactttaaatttacccactcaagtctcaatagagttttctattgtttcctattagttctatgttttgaaggttcagaaatcctgtacaagtatcttatctatgggttgtgaagcattggtttt

SEQ ID NO: 2024 - DNA, 817 bp, Gossypium raimondii
agccctaaaatcccaagtccacagcaaacctggcaggttcttcttctcctctctccggcttccttccacagtgccattggctctctctcccctacctctatcttcaacatgaagctcgtcaggtttttaatgaagttgaacaatgaaacggtgtccattgagcttaagaatggaaccgttgttcacggtaccatcacaggtgtggatatcagtatgaacacccatctgaaaaccgtgaaactcactttgaaagggaaaaatccggtcactttagatcaccttagcgtgcggggtaacaatattcgttactatatcctgcctgacagcttaaatcttgagacgctgctagttgaagagacacctagggtgaaacctaagaagccaacagctgggaagcctttgggacgtggtcggggtcgtggccgtgggcgtggacgtggtcgaggccgttaaatatgcactgtatttttgggactgctggatatggagacagctttgttgtagggtgaattcctttggtgatgttacgaatactatagggaaattgtattgggatttttgtattttgtgagatttttggcctggtttggatagcttaatcatgaaaacctgagattccttgaaccttttctttttaaattattattttcaaaatctgcccttataggatctgatcaagtcagaaactattgaattcggattaatagtaaaaagaataatttgattagattcctataatggaggatctctcgcctaaaataaattcctttcattttttcaaatcttaagacataacaagtccacgttttgggttgaa

SEQ ID NO: 2025 - DNA, 536 bp, Helianthus annuus
acatcttctccggcatattgttaatcctccggcaatgaagctcgtccggtttttgatgaagctgaacaacgagacggtttcgatcgaactaaaaaacggcactgttgttcacggaacaatcacaggagtggatatcagtatgaatacacatctaaagacggttaaacttaccctaaaggggaaaaatccagtgaccttggatcacttaagtgtgaggggcaataacatcagatactacatcttacctgacagcttaaatctcgagactttgctggttgaagaaacaccccgggtcaaaccaaagaagccaactgcagggaaaccagttggacgtggaaggggccgaggacgtggacgtggtcgtggtcgaggccgttaattttccaagacttatatttggttttgtaaacatttgtattgttgttggtctgaacatggatactatgataatctttcgaggtaatttttcttactgttaaacttggcgctttaaccctatgctccttttaatccaatgctataactagcttttttaa

SEQ ID NO: 2026 - DNA, 465 bp, Helianthus annuus
gcaatgaagctcgtccggtttttgatgaagctgaacaacgagacggtttcgatcgaactcaaaaacggcactgttgttcacggaacaatcacaggagtggatattagtatgaatacacatttaaagacggttaaacttaccctaaaggggaaaaatccagtgaccttggatcacctaagtgtcaggggcaacaacatcagatactacatcttacctgacagcttaaatctcgagactttgcttgttgaagaaacaccccgggtcaaaccaaagaagccaactgcagggaaaccggttggacgtggaaggggccgaggacgcggacgtggacgtggtcgaggtcgttaattttccaagacttatatttggttttgtaaacatttgtattgttgttggtctgaacatggatgctatgataatctttcgaggtaatttttcttactgttaaacttgtcgctttaaccc

SEQ ID NO: 2027 - DNA, 648 bp, Artemisia annua
attctaaaaaaaaagctagtgaggtcacaaataagcaaaaacccctcaccggaaccctaaattgtaacaaccatgaagctcgtacggtttttgatgaaactgaacaatgaaacagtttcgattgagttgaagaacggtaccgttgtccatggaacaattacaggtgttgatatttctatgaacacacatttgaagacggttaaacttacactcaaaggcaagaatccagtgaccttagatcacttaagtgtcaggggcaacaacatccgatactatatcttgcctgacagtttgaatcttgagacactgctggttgaagaaacgcctagggtcaaaccaaaaaaaccaactgcaggaaaaccggtgggtcgtggaaggggccgtgggcgcggacgtggtcgtggccgaggccgttaagtatgtaacattgctgttatatctggtattgtaagcagctgtattgtttgagactttttgaactagtattctgagtatggctatgatcattttgctagtagttattttgcatgatgtttaacttgtcattttcactatatgcaccgtttagctcaatggtataaagatattattaacaatttttaggttgtaatatactgttttctagatgccagttttaatgatctattt

SEQ ID NO: 2028 - DNA, 700 bp, Artemisia annua
tacttcaacggggattggaagaaaaaaaagacttaataaaactcaaggttttagatctcccgcttttccccaaaaataatttttggtaaccctagcttccgattcttagcatcaacaatgaagctcgtcaggtttttgatgaagttgaacaacgaaacagtctcgattgagctcaagaatggtacagttgtacatggaaccatcacaggtgttgacatcagcatgaacacacacttgaagacggtgaagttgactctgaaagggaaaaatcctgtaacccttgaccatttgagcgtgagaggcaataatattcgttactatatacttcccgacagcttgaatctggagacattgctagtggaggagacaccaagagtcaagcccaagaagccaactgcagggaagcccgtgggacgtggacggggccgagggcgaggccgtggacgtggacgtggtcgttagtcatgttactatcttctcgctttatgttagcgtgctatgtggatggtataccatgtgtgtgagactgtttaatgcaatagagagacccgaaaatgtgttaaatcttggtgatcaagtttggacttggaattgaacttgtaaccttgcatgaatgcatggacgcttgagttttagatggtatctgtattttgagacacaatcagagtatttttatcagtgcagtataaatctttaaaaa

SEQ ID NO: 2029 - DNA, 606 bp, Gossypium hirsutum
aagtccacagcaaacctggcaggttcttcttctcctctctccggcttccttccacagtgccattggctctctctcccctacctctatcttcaacatgaagctcgtcaggtttttaatgaagttgaacaatgaaacggtgtccattgagcttaagaatggaaccgttgttcacggtaccatcacaggtgtggatatcagtatgaacacccatctgaaaaccgtgaaactcactttgaaagggaaaaatccggtcactttagatcaccttagcgtgcggggtaacaatattcgttactatatcctgcctgacagcttaaatcttgagacgctgctagttgaagagacacctagggtgaaacctaagaagccaacagctgggaagcctttgggacgtggtcggggtcgtggccgtgggcgtggacgtggtcggggccgttaaatatgcactgtatttttgggactgctggatatggagacagctttgttgtagggtgaattcctttggtgatgttacgaatactatagggaagttgtattgggatttttctattttatgagatttttggcctggtttggatagcttaatcatgaaaacctgagattcct

SEQ ID NO: 2030 - DNA, 622 bp, Cynodon dactylon
tcgaggcagcagctccccgcaaaccctagcttttacccgcttcctcctcctccactcaacgcctccaagatgaagctcgtcaggttcttgatgaagctgaacaacgagacggtgactatcgagctcaagaacggcaccgtcgtccacggcaccatcaccggcgttgacatcagcatgaatacccatctgaagactgtgaagctcacattgaaagggaaaaatcctgttacccttgatcaccttagtgtgagaggcaacaacattcggtattatatccttcctgacagcttaaacctggagaccttgctggtcgaggataccccaagggtcaagcctaagaaaccaactgcagggaagcctttgggacgcgggcggggccgtggtcgtgggcgcggtcggggtcgcgggcgctgagcttgttccctgcgtttggaaagttttacactgctcacttgtgtgccgtgtggaatctgcttttgtatcagctgcatggagtattgttttcgtcagggcaaagacatttggcctcagcatttcttaagtggatttgtgttgtgtgttgccgttagacaatgtaattactatgccatatgcccttttcgccagaacacgactaaatttc

SEQ ID NO: 2031 - DNA, 793 bp, Vitis vinifera
ctttcttccacgaaccctataaaccctgctactctttgccgtgagatcagccgcaccatcccgctcgaatccagtgttatttgtaggacatgaatccgtgccctaaacttgatcgcttcgttgtgtagtgttgtgtcttcctcgccgtttttgctggcttccgtcttcattcgccaaaaatgaagctcgttaggtttctgatgaagttgaacaacgaaactgtgtctatcgagctcaagaatggaaccgtggttcatggcaccataacaggtgttgatattagtatgaacacacatttgaagacagtgaaacttacgttgaaggggaaaaatccagtgactctagatcacttgagtgttagaggcaacaacattcggtattatatccttcccgacagcttgaatcttgagacccttttggtggaagagacacctagggtcaagcccaagaagccaaccgcagggagacccatgggacgtgggcggggccgtggtcgcgggcgtggacgtgggcggggccgctaactgcattcgtaaattttgtgccatctggttatgtaaacaccagtgttgtagggagagtttaatggtaaacttagaagaggagtgggatagctatttacctttccatatcactatttaccttaatatggattaggcttgtttagctaaaagactaaaacgattgcttcatcatttgagtcgtatatttccagggtaatgcctaagatgctaccaagaatttattatatcttcgcttgcttcatcgtttatctgaacaagctatacccaca

SEQ ID NO: 2032 - DNA, 699 bp, Actinidia deliciosa
tcttcttcttggcgtgcttgtttgagtaaagccctagcgttgctctccttcctcacttccaacaatgaagctcgtcaggtttttgatgaagttgaacaacgagaccgtgtcgattgagctcaagaacggcactgttgttcacggcaccatcacaggtgtggatattagcatgaacacccatttgaagacagtaaaacttacactgaaggggaagaatccagtgaccttggatcacctaagtgtgagaggtaacaatattcgctactatatcctccctgacagcttgaaccttgagactttgttggtggaagagacacctagggtcaaaccaaagaagccaactgcagggaagcctttgggacgtggccgaggccgtggtcgtgggcgcggacgtggccgaggccgttagttaccatggcgtcattgcaatttttggggcattttgttctgtgacacctatgttgtgggaattggtaatttctaacaatggttatgaactgtttgttagacttccttgaaatagaggattcagtaagattattcaaatttaagcaccctactttcgtcatatgttttagaaactctcaatctactgcatttatcttgtttatggattgctaaacattggctttggccaaccttccatatgatctttaccacatattaggaaagattgcatcttggtatgtacttatccat

SEQ ID NO: 2033 - DNA, 742 bp, Glycyrrhiza uralensis
gagtgcttgtgccgcggtcagcgagtttcctctgtgaccctgcctttcatcttctcttctccgccaccatgaagctcgttaggtttctcatgaagttgaacaacgaaaccgtctcaatcgagctcaagaatggtactattgttcatggcaccattacaggtgttgatatcagtatgaatacacatttgaaaacagttaaactaaccctgaaagggaaaaacccagttactttggatcatctcagcgtgagaggcaacaacattcgttactatatccttcctgacagcttgaatcttgagactttactggttgaagagactcctagggtcaagcctaagaagccaactgctgggaagcctttggggagagggagagggcgcggacgtgggcgcgggcgcggacgtggccgttaagctgtgggaaacaatttttgtggatttggttgtacctttattgtagggaaattttctgggcggtttaaaagacatcaaaggattgtttgttattgttatttagttgtgttgactctgtcaatgatgctattttcttacgccagtgctttaaagatctagtttataattccttacggataatgccagttgctttggaaagaaaggcatggatcccagaaactgtcaacatggaaataggtcaattattcaacattgctactagatcttacgagtaaaaggtaaatagtgggagatatgtgatcataaaccttctgcgtttgccaagaaaa

SEQ ID NO: 2034 - DNA, 861 bp, Zea mays
gggccgacgagctcgaggacagtggccaaggccgccggtgcgacacgttgccgtcaggcgtcagcgaaagcgaatcctccacctccccatcggacttgagggatatcaaatagactttttcctttcgaagacccatcgtaggcccagctacagcccatttagcccatctcgcgactacagtgtacagccgcaaatcgggagaaggggtttttatgtctcctcgcccgctccgaatcagctcgaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctggagactttgctggttgaggaaacaccaagggtcaagcctaagaagcctacttctgggaagcccttgggccgtgggcgtggccgtggtcgtgggcgcggtcggggtcggggacgttgagcatgctagctgcttttggaaattgcattgcgtgcatctgcagtgtaatctacattcctatcaattgtacgaagtatgcctttgattatgcaaccatgtatcaattgtttttttttgccgtggatttatgttgatgaggttaccatgtgatcatatgttctttccctagaacttttaagaacaattaaatactatctttaagacttctctagacaca

SEQ ID NO: 2035 - DNA, 566 bp, Parthenium argentatum
ccctcttccccttcacgttctccagcgtatcgttaattctcagtcgtttctgcattatctccggcaatgaagctcgtccggtttttgatgaagctgaacaacgaaacagtttcgatcgaactaaaaaacggcactgttgttcacggcacaatcacaggagtggatattagtatgaatacacatttaaagacggtcaaacttaccctaaaggggaaaaatccagtgaccttggatcacctaagtgtcaggggcaacaatatcagatactacatcttacctgacagcttaaatctcgagactttgctggttgaagaaacaccccgggtcaaaccaaagaaaccaactgcagggaaaccggttgggcgtggaagaggcaggggacgcggacgtggccgtggtcgaggccgttagtttcgaagacttataatggttttgtaaacatttgtattgttgttggtctgaacatggatactgtgatcatcttgggagttattttacttgctgttaaacttgccattttcacagtatgcccttttttaatccaatgctataaccagctgttgtct

SEQ ID NO: 2036 - DNA, 805 bp, Arachis hypogaea
gagtcgttcatatacagcgattgtcgttttggagcccaaaaccacactcgcctcctttcagctttcgtcttccttcggtctctgccactgccaccatcatcaccatgaagctcgttaggtttctcatgaagttgaacaacgaaaccgtttcaatcgagctcaagaacggtactattgtccacggcactatcacaggtgttgatatcagtatgaatacacatttgaaaaccgttaaactaaccctgaaagggaaaaacccagtgactctggatcatcttagtgtgagaggcaacaacattcgttattacatccttccagacagcttgaatctcgagactttactagttgaagagactccaagagtcaagcccaagaagccaactgctgggaagccgttggggagaggaaggggaagaggacgtgggcgtggacgtggtcgtggccgttaagtttcatgtcgcaagttttgtggcattggttgtatacccttttgtaggaaaatttttcagggctatttcaaagacatccaaggagtgttattattcattagtcatgactctgtcaatgttgctattttcttatcagttatttctagtgtataattccttcctttagggtaatgctgattcctctcaactgaaacattcctatatatgtagctttgggataaggtgaagaagttaaaggaatcaatggggattgcccttgcctcgtagtcgtggtggttgtgttaatttaagaccttatatactttggacctcaaaccttacattcttttaagggattaccatgtggattaatctta

SEQ ID NO: 2037 - DNA, 855 bp, Sorghum bicolor
cgcgactacagtctacagccgcagactgggagaaggggttttatgcctcctccccccgctccgaatcagctcgaggcagcagctcccccgcaaaaaccctagctttacctccgccccgagtctcccaccaagcggctccaagatgaagctcgtcaggttcttgatgaagctgaacaacgaaacggtgaccatcgagctcaagaatggcaccgtcgtacacggaaccattaccggcgttgacatcagcatgaatactcatctgaagactgtaaagctgacgctaaaagggaaaaatcctgttacccttgatcaccttagtgtgaggggaaacaacatccgctattatattcttcctgacagcctaaatctggagactttgctggttgaggaaacaccaagggtcaagcctaagaagcctacttctgggaagcccttgggacgtgggcgtggccgtggtcgtgggcgcggtcggggtcggggacgctgagcatgctcgcagcttttggaaattgcactgcgtgcatctgcagtgtaatctacattcctatcatttgtatggagtatgcctttgattatggcacccatattagtgtcagttgtttttgctgtggattcatgttgatgagtttacaatgtgatcatatgttcttttccaactcctatggatgacgactaaatactatctctagtaagcatatgccctactttttatctaccataccacacaatgatgatgaagagtaaagattgcactattcgctaatcgcatacgttctatgcattacattcccaatgtatttgacattttggtgaggaaatcattctcaagtcagccatacttggcaatttatgaag

SEQ ID NO: 2038 - DNA, 870 bp, Sorghum bicolor
cgcgactacagtctacagccgcagactgggagaaggggttttatgcctcctccccccgctccgaatcagctcgaggcagcagctcccccgcaaaaaccctagctttacctccgccccgagtctcccaccaagcggctccaagatgaagctcgtcaggttcttgatgaagctgaacaacgaaacggtgaccatcgagctcaagaatggcaccgtcgtacacggaaccattaccggcgttgacatcagcatgaatactcatctgaagactgtaaagctgacgctaaaagggaaaaatcctgttacccttgatcaccttagtgtgaggggaaacaacatccgctattatattcttcctgacagcctaaatctggagactttgctggttgaggaaacaccaagggtcaagcctaagaagcctacttctgggaagcccttgggacgtgggcgtggccgtggtcgtgggcgcggtcggggtcggggacgctgagcatgctcgcagcttttggaaattgcactgcgtgcatctgcagtgtaatctacattcctatcatttgtatggagtatgcctttgattatggcacccatattagtgtcagttgtttttgctgtggattcatgttgatgagtttacaatgtgatcatatgttcttttccaactcctatggatgacgactaaatactatctctagtaagcatatgccctactttttatctaccataccacacaatgatgatgaagagtaaagattgcactattcgctaatcgcatacgttctatgcattacattcccaatgtatttgacattttggtgaggaaatcattctcaagtcagccatacttggcaatttatgaagtgcaattgtcgtgat

SEQ ID NO: 2039 - DNA, 715 bp, Saccharum officinarum
cggacgcgtgggtgcctcctcaccccgctccgaatcagctcgaggcagcagctcccccgcaaaaaccctagctttacctccgccccgagtctcccaccaagcggctccaagatgaagctcgtcaggttcttgatgaagctgaacaacgaaacggtgaccatcgagctcaagaacggcaccgtcgtacacggaaccattaccggcgttgacatcagcatgaatactcatctgaagactgtaaagctgacactaaaagggaaaaatcctgttacccttgatcaccttagtgtgaggggaaacaacatccgctattatatccttcctgacagcctaaatctggagactttgctggttgaggaaacaccaagggtcaagcctaagaagcctacttctgggaagcccttgggacgtgggcgtggccgtggtcgtgggcgcggtcggggtcggggacgctgagcatgctagctgcttttggaaattgcactgtgtgcatctgcagtgtaatctacattcctatcagttgtacggagtttggaaattgcactgcgtgcatccgcagtgtaatctacattcctatcagttgtacggagtatgcctttgattacggcaaccatattagtgtcagttgtttttgctgtggattcatgttgatgaggttacaatgtgatcatatgttctttccctagaactcctatggatgaccactaaatactat

SEQ ID NO: 2040 - DNA, 564 bp, Helianthus annuus
cccgaagccctaaaacaccaaaaaccctcttcttctacatcttctccggcgtattgttaatcctccggcaatgaagctcgtccggtttttgatgaagctgaacaacgagacggtttcgatcgaactcaaaaacggcactgttgttcacggaacaatcacaggagtggatatcagtatgaatacacatctaaagacggttaaacttaccctaaaggggaaaaatccagtgaccttggatcacttaagtgtgaggggcaataacatcagatactacatcttacctgacagcttaaatctcgagactttgctggttgaagaaacaccccgggtcaaaccaaagaagccaactgcagggaaaccagttggacgtggaaggggtcgaggacgtggacgtggtcgtggtcgaggccgttaattttccaagacttgtatttggttttgtaaacatttgtattgttgttggtctgaacatggatcctatgataatctttcgaggtaatttttcttactgttaaacttggcgctttaaccctatgctccttttaatccaatgctataactagc

SEQ ID NO: 2041 - DNA, 714 bp, Panicum virgatum
ggaggcagcagctccccccgcaaaaaccctagcttttacctccgccccgtcgtcccccaccaagcgcctccaagatgaagcttgtcaggttcctgatgaagctgaacaacgagacggtgaccatcgagctcaagaatggcaccgtcgtccacggaaccatcaccggtgttgatatcagcatgaatactcatctgaagactgtgaagctcacactgaaagggaaaaatcctgttacccttgatcacctcagtgtgagaggaaacaacatccgctattatatccttcctgacagcttaaacctggagactttgctggttgaggaaacaccaagggtcaaacctaagaagccaacttcagggaagcctttgggacgtgggcgtggccgtggtcgtgggcgcggtcggggtcggggacgttgagcttgctgcccatttggaaattgcattgcagacatctttgcaatgtaatctgctttcgtatctgtttgtacggagtatcacttttgttaaggcagtggcgttggtgctgtctgttcttgctgtggattgagttgatgttagatgttacatgtaactactgtgccatatgctattcccctgaattcctgtgcgtgatgactaaattcatgtgaagtctaacatgcaaccttttctgatcactgccactggagtaataggtaaaagtaagctagacggcttcgattctttccaaaaa

SEQ ID NO: 2042 - DNA, 487 bp, Ambrosia trifida
agtaccaaagccctaaaacaccaaaaaccctactttcccttcaccttctcaggcatctcgttaatcctcagtcgtctctccattatctcacacaatgaagctcgtcaggttcttaatgaagctgaacaacgagacggttcgattgaactccaaaacggcactgttgttcatggaacaatcacaggagtggatattagtatgaatacacatttgaagacggttaaacttaccctaaaggggaaaaatccagtgaccttggatcacctaagtgtcaggggcaacaacatcagatactacatcctacctgacagcttaaatcttgagactttgctagttgaagaaacaccccgagtcaaaccaaagaaaccaactgcagggaagccggttggacgtggaaggggtcggggacgcggacgtggtcgtggtcgaggccgttaattttcttagacttatatttggctttgtaaacatttgtattgttgttggt

SEQ ID NO: 2043 - DNA, 521 bp, Cirsium arvense
gccctaaaactgcaaaaccctcctctctccccttcacgttttccggcaaattgtaaatcgtcggtaatcttcttcattctctccggcaatgaagctcgtccggtttttgatgaagctgaacaacgagacagtttcgatcgagctcaagaatggaactgttgttcacgggacaatcacaggtgtggatattagcatgaacactcatttgaagacggttaaacttacccttaaaggaaagaatccagtgaccttagatcacttaagtgtcaggggcaacaatatccgatactatatccttcccgacagcttaaatctcgagactttgcttgttgaagaaacacctagggcaaaccaaagaaaccaactgcagggagaccgatgggacgtggaaggggacgtgggcgtggacgtggtcgtggccgaggccgttaattctttgtcgattgttgtgatatctgcttttgtaaacacttgtattgttgggagacttgtgataattttctgaatatgggtgggatgtt

SEQ ID NO: 2044 - DNA, 773 bp, Musa acuminata
cgctcgtctccacgagtgcccaacctttcggttttggaaccctaacggggagctgttgtcgtctgcctcctcttctgcctccgttgcctcgccaccttcccgatccaggatgaagctcgttaggttcttgatgaagctcaacaacgagaccgtctcgatcgagctcaagaacggtaccgttgtccacggaaccatcataggtgtggatattagcatgaatactcacttgaaaactgtgaaactcacagtgaaagggaaaaatccagtcactcttgatcacctaagcgtgagaggcaacaatatccgctactacatcctgcctgacagtctgaacctcgagacactattggtcgaggagacacctcgggtcaagcccaaaaagccaactgcagggagatccatgggacgtggtcgtggccgtggccgtggacggggacgaggtcggggccgttaacagcatcactctcttcataattttttgcatcatcatctgtccgtgtacaaatagcctgctctttatcgagaagtatcatttggaagcttctcttcacaaaatggcaagcaggactatctgttttagctctaaacagcagttaagtttttatccagtaggaccaaactttagaatcaagtgaaaagaaagaagaaaacaagaactgtgtgctgtaagattgttctgtatttgtgggctgcactagaattgttgtattcctgcttgtttggttcatatacgttgttggttatcagagacaaatctgagttcttgcagctgt

SEQ ID NO: 2045 - DNA, 1071 bp, Gossypium raimondii
ttttttgcgatatacttacccacaagtcacaaaattaaaaccagtcggcggaagagttttgggtcgatacttaataaaggttttccccaaatgtagacaaaggcctgagccctaaatcctctctctcgcatcgcagagtaaaaccagacagcaaaaatcaaagtcacaaacgggcaaacagctccatctctctcccgcttcctttcacagttcaacaactgctgcctctctttctcacatttttgcttcaatcattaccgctcctcatcatgaagctcgtcaggtttttgatgaagttgaacaatgaaacggtgtcgattgagctcaagaatggaaccgttgttcacggcaccatcacaggtgtggatatcagtatgaacacccatctcaaaactgtgaaacttacactgaagggaaaaaatccagtgactatggatcacctcagtgttaggggtaacaatattcgctactatatcctgcctgacagcttaaatcttgagacattgctggttgaagagacacctagggtgaaaccaaagaagccaacagctgggaagccattgggacgtggtcggggtcgtgggcgtggacgcgggcgaggtcgaggccgttaaatatgctgccatgcctccaaattttcgtaacagctggatgtgtagacaactttgttgtggggagaatttatgggtgaagttactaatattaaaaggaattgtattgatattttacttttctatatgattattagccttggttgtacggcttaatcatggatcctgagattcccgactagcagatattttaatacctctatcgattatgttgtaaaatgaaggaatgcggttcattgccttcgatcagaactctttttttccccttctttttgtacaattaaatgtttggattaattataacaagaaattaaattaataattgaaatatatttagcacgtaatgaggtttctaaaaaatttgcctcactttttacctatgcataatcggcactttgttttttgttaccgtttctcgaagttgtttcatcctcgttattttaatggttttttttctaga

SEQ ID NO: 2046 - DNA, 993 bp, Gossypium raimondii
aaactcaaaaagtcaaaaggccttgtaggagtgtaccgagtcataaattcatcgctcggtgcacatctggtctggtagcattagcaaacaggtcccttactctcctgctaactcactgagttccataggctctcgcctttgcttcaacctctaactctcctcagcatgaagctagtgaggtttttgatgaagttgaacaatgaaacggtgtcgattgagctcaagaatggaaccgttgttcacggcaccatcacaggtgtggatatcagtatgaacacccatctgaaaacggtgaaacttacattgaaggggaaaaatccagtgagtttagatcaccttagtgtgaggggcaacaatattcgctactatattctacctgacagcttaaatctcgagacattgctggttgaagagacacctagggtgaaacccaagaagccaacagctgggaaacctttaggacgtggtcggggtcgtggacgtggaaggggacgcggtcgaggtcgttaactcggctgccttgcatcaaattttttgtgacaatcagatgcgtagacagatttgctgtagggagaattttgtgggtgattatacgaatattaaaggaaccctattggcatattaccatcatgtgtggttattagcctggatttggatagcttaatcatgaatcccgagattaccagcctcagatgatatgatctagtgctaataggtgagcaggtaatctatttctattccggtttgttgcttttagaacgagaaaaggtaaaaataggaagcaacaatcttggattgtcactcatacagaccatgcttagtgttgatgttgaaccttttcctgaagttgattttttactagctactagggttatcaaatagccttatgatggattatatgagcacattagttaagcttgttttcttccttttttttttttttccgagtacaacccgaaaacaaactccatctttgagtttcagtctccaaaa

SEQ ID NO: 2047 - DNA, 780 bp, Medicago truncatula
ataaaacggtgtcgtactcggagagcctaaaaacaaaacacttgtgcaagagcgactagcgtcactgacccgcccctcccttcccttcgtggttgttgaagtcgagagccggtgctcatcttccgccccatcgccgccatgaagctcgtcaggtttctgatgaaattgaacaacgaaaccgtatcgatcgagctcaagaacggtacaattgttcatggcaccattacaggtgttgatatcagcatgaacacacatttgaaaacagttaaactaacactgaaggggaaaaacccagtgactctggatcatctcagtgtgaggggtaacaacattcgttattatatccttcctgacagcttgaatcttgagactttgctggttgaagaggcacctagggtcaagcctaagaagccaactgctgggaagcctttggggcgtgggcgtggtcgagggcgtggacgtggtcgtggccgcggtcgttgaattgcatattcagaatttttgtgccatatggttatgtcttaggaggaatttatgagtggtcttgtggacatctaaagagtgttcttgctgattagttatgttggctttgcttacattgccattatttttgaacaagtgctttcaagttcttttgtataattccttcctcagttctttaactgagtaatactttgttgacttctaaaggatacctaacaccactcaagtttcaactgaagtctgcatgtatgtttttatcatcttatctaagggaaatggatcttataatcaattagg

SEQ ID NO: 2048 - DNA, 654 bp, Acacia harpophylla
gggggggagaacaccagaaccccccacagacccgtcgcatatcttcgctcgccctactccgtggctgccaaacccgactaccactgccaccacgccgccgtccgtcgttttcttcctcgattccgccgtcgagaagagtgagggcagcttccacattctctggtatctgctgtgctgaagttaagcccttcctaatccttccttgcccaccatgaagcttgtcaggtctctaatgaagttaaacaatgaaactgtttcaatcgagctgaagaatggtactgttgttcatggcaccattacaggtgtggatatcagcatgaatacacatttgaaaacagttaagcttactctgaaagggaaaaatccagtgactttggatcatctcagtgtgaggggtaacaacatccgttattatatccttcctgacagcttaaatcttgagactttgctggttgaagaaacacctagggtgaagccaaagaagcccactgcaggaaagccattgggtcgaggccgaggccggggtcgtggccgtggccgtggccgtggccgttaagtatgaacatttcccagtttttgtgtcatgtagttgttaacgaatgttaagggagaagttatgggcagttaaggaacatcgtaggagcgtttcctttc

SEQ ID NO: 2049 - DNA, 615 bp, Amorphophallus konjac
cttggccttcgagggaactggggcaagggctcctcttccggcttgcgctctcgcgcgctctcgctctctgcgtcccgcaccgtctcaagatgaagctcgtaaggtttttgatgaagctgaacaacgagaccgtctcgatcgagctcaagaacggcacggtcgttcacggcaccatcacaggtgtggacattagtatgaatacacacctgaagacggtgaagcttacactgaaggggaaaaatccagtgactcttgatcatctgagtgtgagaggcaacaacatccgttattacattctacctgacagcttgaaccttgagactttgctggtcgaggaaacacctagagtcaaacccaagaagccaactgcagggagacctacagggcgtggcaggggccgtggacgtgggcgtggtcgtggccgaggccgttagtaggtctaatcctcttaatttttgcaccatttgctttctgcaagtgaacttgagagaaagctcaatgaaacattttgttgtaacagaaaaacttggatcatgttcgggtggagtagctgactgttgttgccaacttgtgtacttccatgttgttttaccctgaatgagaatagtgtactta

SEQ ID NO: 2050 - DNA, 572 bp, Fagus grandifolia
aaaagacctcgtagtttagccagtagtactagtagcagcccgagccctaaactcaaaagtctctctgtgtccagtgcatcacacagagccctagaccttcgttctccttctccacaatgaagctcgttaggtttttgatgaagctgaacaacgagaccgtctcgatcgaactcaaaaacggcaccgttgttcacggaaccatcacaggtgtggatatcagtatgaatacacatttgaagacagtgaaacttacattgaagggaaagaatccagtgacgctggatcatctcagtgtgaggggtaacaatattcgatattacatccttcctgacagcttgaatcttgagactttgctggttgaggagacacctagggtcaaacccaagaagccaactgctgggaggcctttgggacggggacgtggccgtggacgtggccgcggacgtggtcgtggacgttaagtcatattgcgctggtttcaatttttgtggcacttggttatgtaaacaccaatgttgtagggagaatttattggtgatcttagggacatgaaaggagtgttattactattg

SEQ ID NO: 2051 - DNA, 1954 bp, Ricinus communis
tagggtcattcttttttacccgatccggaattattagtatgtccgaaattatcaatattttactaaatgctgtgtgatacgatacgatggagtaattattttcgtttatattaaaaattaaattgttatataaattaacccgaggcttgagtacggtgtcgtttcaataagcttgagtgaggttttagaagaggccctccctcccgagtgagccctaaaacgttggtctctagtctcttctccccgctttcatcgttgattggctttattgtattgtgtttttctgaagccctagatttcgcactctcgctccacaatgaagctagtcaggttcttgatgaagttgaacaacgagactgtttcaattgaactcaagaatggaactattgttcacggaacaattacaggtgttgatattagtatgaatactcatctaaagaccgtgaaactaacactgaaggggaaaaacccagtaactttggatcatctcagtgtgaggggtaacaatattcgctattatatccttcctgacagcttgaatcttgagacattgctggtcgaagagacacctagggtcaagcctaagaagccaactgctgggaggcctttgggacgcggccggggacgtggacgtggtcgtggacgtggtagagggcgctagatatgttgcacaagttctaatttttgtgtcatctggttatgtaaacacctatgttgtatggagagtttattggtaaagttaggaaattgaaagattatattattgctatttttgtcaagtcttttgccttagaggctaactagcaaactatgagcttttctctttgtttgaattccttctaatagcagaaagttggggatttatgagtttgtgatatataatagcttagtagcaagcatcttttgtcctcaagtatgctgcatttcacggacacatccaatattgtatcaaagttgcccctcctactcgtgtgttgcagcaagtagttgtaagttccattttcaatgctcgggaagcctaatttgtagttgtctgcaactgatgtctcttaccatgagtgcatccaaatgtatacttcatccgctgaaattcaaaatagcaagcatcaaaaccattagaggagtgcaactgcaaatgaatggatggcaagcaatgttctccaccaaacagctataaattacttgttcacaaacaacccgcaaaaatggaaagatattgagatgtgcggtgctgtatgatcgaatctgatataaaagagatatatttgctgtagtcaatattgtccgtcgattgatgagacaaagaagtaactcagcactggtgggtttttacggggcccctggcatacataaattcacgtgcagccgaagtgaggttgtgagagtgcaaaataatcttgtattaaaagcacaaaaagaagaagagacagtgaatcgaaagcggggtcggagagagaagtaaaaagatgggaacgaagcctgtgaaacaagccatggtggttgttggggctcttgcttttgggtggctggcgattgagatggctttcaagccttttctcgacaaagctcgtgccgccatggacaagtctgatcctgaacgcgatcctgacgactctcctcccaaagatttgccttctgatgctcttgcttccgacgacaaaccagcaacaatctgatgagatgatgattgttaggtcatgacaacccgctaggtcaaataattttcatttttatttttttgagtcgagtagtttaatttaatatgtgttattaaaatttgtctactgaaggggtacttaaatggtgaagtttaagctattattaacaattttatggtggtgtttatgggtagtttatttctatgaatttttgttacgcgattcccatctttagcagaattgtggttgtggctgtttgtcaattattattaaaatagaattttccacaatttgat

SEQ ID NO: 2052 - DNA, 758 bp, Cicer arietinum
caagagtctaaaaccccttgtgcacagtgcgactagcggctttctctctgtcccgctcctcagtgaagttcaaaggtggtgctcattttccgccgccatgaagctcgttaggtttctgatgaaattgaacaacgaaaccgtatcaatcgagctcaagaacggtacaattgttcatggcaccattacaggtgttgatatcagtatgaacacacacttgaaaacagtcaaactaacactgaagggtaaaaacccagtgactctcgatcatctcagcgtgaggggtaacaacattcgttattatatccttcctgacagcttgaatcttgagactttgctggttgaagaggcacctagggtcaagcctaagaagccaactgctgggaagcctttggggcgtgggcgtggccgaggtcgtggacgcggtcgtggccgcggtcgttgaattgcatattcagaatttttgtgccatatggttatgttgtaggaagaatttctgagcggtcttgtggagacatcaaaggagtgttcttgctgattagttatgttggctttgcctatattttccatttttttgaacaagtactttcaagttcttctgtataattccgtcctgagttctataactgatcgatattactttttaactcctaaaagatacctaacgccactcaagtctcaactaaagtctgcatatatgagcttctcatatcttgtcgaattctgagatttggtcccctttaaggttttggttcctctcc

SEQ ID NO: 2053 - DNA, 779 bp, Cicer arietinum
gaacttcatacgtttttaatttatcttttttagcggtgggtttcttgcacagtatacacactactaaacgctgtcgtcgttcggagccgaaatacaccaacttctgcttctgccgcgatttccgatttttccactctcactctcctcttctttgccaccatgaagctcgttaggtttctcatgaagttgaacaatgaaaccgtttcaatcgagctcaagaatggtactattgttcatggcaccattacaggtgttgatatcagtatgaatacacatctgaaaacagttaaactaactttaaaggggaaaaatccagttactctggatcatctcagtgttagaggcaacaacattcgttattatatccttcctgacagcttgaatcttgaaactttactggttgaagaggctcctagggtcaagcctaagaagccaactgccgggaagccattggggcgaggacgagggagaggacgtggacgcggtcgtggtcgtggccgttaaattatgtatcacatattttatggatttggttgtacctttgttgtagggaatttttctggactgtttgaaagacatcagcagagtgttattgtgaattagttgtgtggagtgttaatgatgctattttcttacataagtgatttatagatgtagtttataattcctgctggataatgccgaataccaattaactaaagaagccgcctacaggtgtagttgttggataaggtaatgacgttaattaggaagtcgcaaatacattggtattgtttgtc

SEQ ID NO: 2054 - DNA, 638 bp, Cichorium intybus
gttaatcctcagtctcttctgcgttctcttcgaaaatgaagctcgtccggtttttgatgaagctgaacaacgagacagtttcgatcgagctaaagaatggaaccgttgttcacgggacgattacaggtgtggatattagcatgaatacacacttgaagacggttaaacttaccctaaaggggaaaaatccagtgagcttagatcacctgagtgtgcggggtaacaacatccggtactacatcttgcctgacagcttaaatctcgagactcttctggttgaagaaacaccccgagtcaaaccaaagaaaccaactgcagggagaccaatgggacgtggaaggggccgtgggcgtggtcgtggtcgtgggcgaggccgttaattcctctaaattgttgtgatatctggttttgtaaacagctgtattgttggagagtttctgtgaacaatgttatgaaatatggatgtgatcattttggcgagttgttttttccttcatgtttgccttgtcatcttcattggaaactatggcccggccccccaaaaccaacttcattttatcgtttaggccaataggattgtctttaggcttttggttttcagttcaagtgtgttttgggatagtatagtttgttgacgt

SEQ ID NO: 2055 - DNA, 943 bp, Gossypium hirsutum
cccaaatgtagacaaaggcctgagccctaaatcctctctctcgcatcgcagagtaaaaccagacagcaaaaatcaaagtcacaaacgggcaaacagctccatctctctcccgcttcctttcacagttcaacaactgctgcctctctttctcacatttttgcttcaatcattaccgctcctcatcatgaagctcgtcaggtttttgatgaagttgaacaatgaaacggtgtcgattgagctcaagaatggaaccgttgttcacggcaccatcacaggtgtggatatcagtatgaacacccatctcaaaactgtgaaacttacattgaagggaaaaaatccagtgactatggatcacctcagtgttaggggtaacaatattcgctactatatcctgcctgacagcttaaatcttgagacattgctggttgaagagacacctagggtgaaaccaaagaagccaacagctgggaagccattgggacgtggtcggggtcgtgggcgtggacgcgggcgaggtcgaggccgttaactcggctgccttgcatcaaattttttgtgacaatcagatgcgtagacagatttgctgtagggagaattttgtgggtgattatacgaatattaaaggaaccctattggcatattaccatcatgtgtggttattagcctggatttggatagcttaatcatgaatccctagattaccagcctcagatgatatgatctagtgctaataggtgagcaggtaatctatttctattccggtttgttgcttttagaacgagaaaaggtaaaaataggaagcaacaatcttggattgtcactcatacagaccatgcttagtgttgatgttgaaccttttcctgaagttgattttttactagctactagggttatcaaatagccttatgatggattatatgagcacattagttaagcttgtttt

SEQ ID NO: 2056 - DNA, 930 bp, Gossypium hirsutum
aaaaagtcaaaaggccttgtaggagtgtaccgagtcataaattcatcgctcggtgcacatctggtctggtagcattagcaaacaggtcccttactctcctgctaactcactgagttccataggctgtcgcctttgcttcaacctctaactctcctcagcatgaagctagtgaggtttttgatgaagttgaacaatgaaacggtgtcgattgagctcaagaatggaaccgttgttcacggcaccatcacaggtgtggatatcagtatgaacacccatctgaaaacggtgaaacttacattgaaggggaaaaatccagtgagtttagatcaccttagtgtgaggggcaacaatattcgctactatattctacctgacagcttaaatctcgagacattgctggttgaagagacacctagggtgaaacccaagaagccaacagctgggaaacctttaggacgtggtcggggtcgtggacgtggaaggggacgcggtcgaggtcgttaactcggctgccttgcatcaaattttttgtgacaatcagatgtgtagacagatttgctgtagggagaattttgtgggtgattatacgaatattaaaggaaccctattggcatattaccatcatttatggttattagcctggatttggatagcttaatcacgaatcccgagattaccagcctcagatgatatgatctagtgctaataggtgagcaggtaatctatttctattccgatttgttgcttttagaacgagaaaaggtaaaaataggaagcaacaatcttggattgtcacttatacagaccatgtttagtgttgatgttgaaccttttactgaagttgattgttgtgtttttttactagttactagggttatcaaatagccttatgatggattatatgagcatattagttaagcttgttttctt

SEQ ID NO: 2057 - DNA, 638 bp, Cynodon dactylon
ctcctctggttcggtcggcgcctcacctccgcctccgcgccgctccgttcagctcctccctgcagcagccgccaagatgaagctcgtcaggtttttgatgaagctgaacaacgagacggtcaccatcgagctgaagaatggcacggtggtccacggcaccatcaccggtgttgacatcagcatgaatactcatctgaagacagtgaagcttacattgaaagggaagaatcctgttacccttgaccatctcagtgtgcgggggaacaacattcgctactacattcttcctgacagcttaaacctggaaactttgcttgtagaggacacccctagggtcaagcctaagaagccaacttcaggaaagcctgtggggcgtgggcgcggccgtgggcgtggacgtggtcggggccggggacgctaagctttgtagtttcctgcttggggttatcctgcatgacatgtttcccgtacgatgtaacctgctttccttgtaagctactcctaagaatgtttcattgttgcccttctgccggatgtgaaccaaatatctcaatctcagtagttgttgtggatcgtcctttctatttgacccatttcgcatgtctatcctagcttgattcgtaatgtctttcccctct

SEQ ID NO: 2058 - DNA, 557 bp, Euphorbia peplus
tgaaagtgttgtgcaggctccttcgaattcgattggcctttcttctgttccttcaaaccctagatttcatcttcttgcttcacgatgaagctcgtcaggttcttgatgaaattgaataacgagactgtctcaattgagcttaagaatgggactattgttcttggcaccattacaggtgtggatatcagtatgaatactcatctaaagactgtcaaactgacgctgaaggggaaaaatccggtaactttggatcatctcagtgtgaggggtaacaatatccgttactatattcttcccgacagcttgaatcttgagactttgcttgtcgaagagacgcctagggtcaaaccgaagaaacccactgctgggaagcctttgggacgaggtcggggacgtggacgcggccggggtcgtggtagaggccgctaaattgtgattgtactcagttttatgattttctggcatatggttgtgtgtaaaaaacacctggtgttgtatggataaatttttcagtaaatttaggtatgtggagagaatgttcttgctatttcaaactc

SEQ ID NO: 2059 - DNA, 583 bp, Euphorbia peplus
cggacataaaggtcgcgtctcctctcccgcttcctttgattggcttttcttcaaaccctagatttcaccttcctacttcacaatgaagctcgtcaggttcttgatgaagttgaacaacgagactgtttcaattgagctcaagaatggaaccattgttcatggaaccattacaggtgttgatattagcatgaatactcatctaaagactgtcaaactaacactgaaggggaaaaatccagtaactttggatcatctcagtgtgaggggtaacaatatccgctattatattctccctgacagcttgaatcttgagacattgcttgttgaagagacacctagggtcaaacctaagaagcccactgctgggaggcctttgggacgaggtcggggccgcggacgtggccgtggtcgtggtagaggccgctaattttgctggactcatttataatttttgtggcatctggttatgtaaaaacagctgtgttgtaaggagaatttgtcagtatattagggacaagaagagaatgttatattgctatttcggactctggttgctttagagctagctcgctgattctgaaat

SEQ ID NO: 2060 - DNA, 533 bp, Euphorbia peplus
tttgctctacttgtccattgtaattttttcgaattccattgacgtttcttccgttcttgaaaccctagattccatcttcctccttcacgatgaagctcgtcaggttcttgatgaagttgaacaacgagacagtctcaatcgagcttaagaacgggactatagttctcgggactattaccggtgtggatatcagtatgaatactcatctaaagactgtcaaactaacgctgaaggggaaaaatccggtaactatggatcatctcagtgtgaggggtaacaatatccgttattatattcttcccgacagcttgaatcttgagacgttgcttgtcgaagagacgcctagggtgaaaccgaagaaacccactgctggaaagcctatgggacgaggtcggggacgtggacgtggccgtggtcgcggtagaggccgctaattgtgcttgtactcgtttataattttgtgtcctctggtgttgtaaggataaattttcagtaaatttaggcatgtgaagagaatgttgttgctatttcaa

SEQ ID NO: 2061 - DNA, 807 bp, Carpinus betulus
gacaaagaccaaacccatttctctctgacgccaaatctgttcttcgaatcatttattctctgtttggtacccgagaaactccaagaaaatccaaagcaaggggaagatgctaagtccgcagagaagctgaggaagaagacactccaagcagagagaaagtagagattgccttcccggaaacctttagcttgacacagattcttctagccccagccttcttcttccttgcccacaatgaagctcgtcaggtttttgatgaagctgaacaacgagaccgtgtcgatcgagctcaaaaatggcaccgttgttcacggaactatcacaggtgtggatatcagtatgaatacacacttgaagacagtgaaacttacattgaagggaaaaaatccagtgactctggatcatctcagcgtgaggggtaacaatattcgatattacatccttcctgacagcttgaatctcgagactttgctggttgaagaggcacctcgggtcaagcccaagaagccaactgctgggaagcctttgggacggggacggggacgtggacgtgggcgcggacgtggtcgtggccgttaagtcatattgcacctgtttcaatttttgcagcacctggttatgtaaaaacctaagttgtagggagaattttatcggtgatcttaggggcatgaaaagactgggattgctattgaatcttgtattttgagtttgtcttatgtcttggttattttcttaaaattgtaccttttgtgtgtcgtgcggggtatcgtattgtaatctcgtaatctatcttacaagttagtagga

SEQ ID NO: 2062 - DNA, 685 bp, Jatropha curcas
acggccgggggtgcagagttcaaaggtcccgtcctcatctcccgctccattgattagccgtcatcgtgcttcttgaaaccctagatttcgccttcctacatctagtccaaaatgaagcttgtcaggtttttgatgaagttgaacaacgagactgtatcaattgagcttaagaacggaaccgttgttcacggcactattacaggtgtggatattagtatgaatactcatctgaagactgttaaactaacacttaaggggaaaaatccagtaactttggatcatctaagtgtgaggggtaacaatattcgctattatatccttcccgacagcttgaatcttgagactttgctggttgaagagacacctagggtcaaacctaagaagccaactgctgggaggcctgtgggacgtggtcggggccgtggacgtggtcgtggacgtggtagaggccgctagatctgctgcacgtatttcaatttttgtggcatctggttatgtaaaacgcctatgttgtaaggagaatttgttggtaaagataggaacgcaaagaatgctattggtatttttacaatccttttcgccttatagaggctaacttgctgattttgtgagttctctcacttctcaatggttgaatttcgtcgagcgctagcaggaagttgggaattgacgagttcatgatttg

SEQ ID NO: 2063 - DNA, 606 bp, Actinidia deliciosa
  misc_feature (36)..(36): n is a, c, g, or t
  misc_feature (74)..(75): n is a, c, g, or t
  misc_feature (87)..(88): n is a, c, g, or t
  misc_feature (394)..(394): n is a, c, g, or t
  misc_feature (510)..(510): n is a, c, g, or t
ctcccgcttctctacagatcgaaaagcttttcgaanccctaatatagcagcaaagcagtgaactctctctctcnnctgctgcttctnnaaatcgacgatgaagctcgttaggttcttgatgaagttgaacaacgaaaccgtctcgatcgagctcaagaacggcactgttgtgcacggaaccatcacaggtgtggatatcagtatgaacacacatttgaagacggtgaaattgacactgaaggggaaaaatccagcaactcttgatcacctaagcgtaaggggaaacaacatccgctattacattctccctgacagcttgaatctcgaaactttgctggtggaggagacaccgagagtcaagcctaaaaagccaactgcagggaagcctttgggncgtggtcggggccgcgggcgcggacgtgggcgcggacgtgggcgttaatcatgttgcactggttttattctctccagactcaactatgtagaacgacttccttgttactgttaacnatagctttgtttcttatatttgcttttaatagaagctgttacttcccttggattctttggcttggcatctaggagtatgtgatttgtgtctaagtt

SEQ ID NO: 2064 - DNA, 658 bp, Glycyrrhiza uralensis
aaaaaacacttgtgctcactcactgcttcagagcgactggcgtctctgttccgctcctcctcctcctcctccgtggttgaagaaaagttggtggtgctcattttccgccgccatgaagctcgtcaggtttctgatgaagttgaacaacgaaactgtagcaatcgagctcaagaatggtaccattgttcatggcaccattacaggtgttgatatcagtatgaacacacatttgaaaacggttaaactaacagtgaaggggaaaaaccctgtgactctggatcatctaagcgtgagaggtaacaacattcgttattatatccttcctgacagcttgaatcttgagactttgctggtcgaagagacacctagggtcaagcctaagaagccaactgctgggaagcctttggggcgtgggcgtggtcgggggcgtggtcgtggccgtggccgtggccgttaaattgcatatttacaaattttgtgccatgtggctatattgtaggaagaatttctgagtggttttgtggacatcaaaggacggttcttggtgattagttatgttgattttatcttcgctgctattttcgtaaacatgtactttcatgttctgtataattccttcctgagttatagaatcgattaggacagggtttgctatgcc

SEQ ID NO: 2065 - DNA, 586 bp, Liriodendron tulipifera
gttggcaagccctagtttcagtgtcttctctacctctctcaatctcgccaagatgaagctcgtcaggtttttgatgaaattgaataacgagacggtatcgatcgagcttaagaatggcaccgttgttcatggcaccatcactggtgtggatatcagcatgaacacgcatcttaagacagtgaagctgaccctgaaaggtaaaaatcctgtgacccttgatcacctgagcgtgaggggaaacaatattcgatactacatcctccctgatagcttgaacctggagactttgctggttgaggagacgcctagggtcaagcccaagaagccaactgcagggagacctttgggacgtggtcggggccgtgggcgcgggcgtggtcgtggccgagggcgctagatctgttgctttcttcccttttctaatttttgcagcgtctgtttgtgtacaaatagcttgcatccatggagacagtttagtgggggatgcttgttttgaggatagaaaaagcgggactgctgtttgtcttcatattatagcctgaaagatctatggatatggcctagtgttgtttctttttacgtcttg

SEQ ID NO: 2066 - DNA, 722 bp, Pennisetum glaucum
ggatgttataatccgaaagcgtgcggccgtcctcgagctgctcccccgctccgaatcagctcgaggcagcagctccccccgcgaaaaccctagctttacctccgccccgtcgtcccccaccaagcgcctccaagatgaagctcgtcaggttcttgatgaagctgaacaacgagacggtgactatcgagctcaagaacggcactgtcgtccatggcaccatcacaggtgttgacatcagcatgaatactcatctgaagactgtgaagctcacactgaaagggaaaaatcctgttacccttgatcacctcagtgtgaggggaaacaacatccgctattatatccttcctgacagcttaaacctggaaacgttgctggtggaggaaacccctagagtcaagcctaagaagccagctacagggaaacctttgggacgtggtcgcggccgtggtcgtgggcgcggtaggggtcggggacgttgaagagcttgctgcccatttggaaattgcattgcactcatctttgcaatgtaatctgcttcctatatgtttgtaaggagttctgctttcattaaggcaatggcgttggtgtcagctgttctgtggattcatagttagatgttacaatgttgtgttttggcttaattatgtccgccaagccgttctgtgccatatgataccttgaactcctgttgagttgacttaatccgcgcaacatttactgtt

SEQ ID NO: 2067 - DNA, 618 bp, Nuphar advena
  misc_feature (375)..(375): n is a, c, g, or t
  misc_feature (464)..(464): n is a, c, g, or t
  misc_feature (472)..(472): n is a, c, g, or t
  misc_feature (481)..(481): n is a, c, g, or t
  misc_feature (515)..(515): n is a, c, g, or t
  misc_feature (527)..(527): n is a, c, g, or t
  misc_feature (535)..(535): n is a, c, g, or t
  misc_feature (538)..(538): n is a, c, g, or t
  misc_feature (544)..(544): n is a, c, g, or t
  misc_feature (549)..(549): n is a, c, g, or t
  misc_feature (596)..(596): n is a, c, g, or t
cttccttaagccctaaaacgttctcctccttcagccatgaagctcgtcaggttcttgatgaagttgaacaacgagacggtctccatcgagctcaagaacggaaccgtcgtccatggaaccatcacaggggtggatattagtatgaacacgcatctgaagacagtgaaactaaccctaaaaggcaaaaacccggtgactctcgatcacctcagtgtgcgtggcaacaatatccgatactatatccttcctgacagcttgaacctggagactttattggttgaggagacgccaagagtgaagcccaagaaaccgactgcagggaggcctgtgggacgtggtcggggccgtggtcgtggccgtggtcgtgggcgtggncgctagttatcagctgtgtgattttaccaatttttgtgctttcagatttttattgctcctgcttctgtacaaagagtacctgctttggntggattancttggtttnaaccaaggcagtctgtttgtgatgagcatgaaanatctggttatangtagacanagngatctngtttnctatgttagagactatatcttcaagctggaatcaagttgaaacaacnacattgaacgcctagttggttc

SEQ ID NO: 2068 - DNA, 747 bp, Elaeis guineensis
cgcgtctactcccgctcgttcactgtccgaagccctagcctcgctttccccttcttcactctctcacacacacagactctccaagatgaagcttgtcaggtttctgatgaagctcaacaacgagaccgtctcgatcgagctcaagaacggcaccgtcgtccatggtacgattacaggtgtggatatcagcatgaacacacatttgaagactgtgaagcttactttgaaagggaaaaatccagttactcttgatcaccttagtgtcagaggtaacaacattcgatactatatcctccctgatagcttaaaccttgagactctcctggttgaggagacacctagggtcaagcccaagaagccgactgctgggagaccgttgggacgtggtcgtgggcgtggacgtggtcggggccgtggccgaggccgttagtcatcctcttaatattttgtggtgtttgtttatgtattaaagcctgctcccctggagaatttttcaagggcgtttgttttaccagttagaaacaggactgctaggttaccacagatagctctaatgaaaatgtgttttagttgttgggactctaatgattattgaaattggatgatgaaatcagaactgtgatgcaatcatttcgctgacatggtgcttcgggttgttgagctttagttgttggtgctatggctattaaactgcaaaaaatatgttgaactcttaaattgatataaagcaatctgcagttacgtatt

SEQ ID NO: 2069 - DNA, 1081 bp, Elaeis guineensis
gtagcttgtctttaagcagggtttaagctcccgcagggaactcggctttcgcttggagccctagctgctgctttcctcttcctctctttcccggtttatttccaagatgaagcttgtcaggtttctgatgaagctgaacaacgagaccgtttcgatcgagctcaagaacggtaccatcgttcatggcactatcacaggagtggatataagtatgaatacgcatctgaagacagtgaagcttacgttgaaagggaaaaatccagttacccttgatcacctaagcgtgagaggtaacaacattcgttattatatcctccctgacagcttaaacctggagactttactggttgaggaaacacctagggtcaagcccaaaaagccgactgcagggagacctttgggacgtggtcgtggccgtgggcgtggacgaggtcgtggccgtggccgttaactcttgtcactctcgtgaatttttgcagcatctgcttttgcaccagtagcctgcttgcatggagaatagttgattaatttccaagcatcaggccagcaggactgtttgtttgtgggaaattatcattacaaggctcgtgttctgggttcttatctttttcaccattacgttgttctgagtagaaaagattcttttgggaaacaatggcattatatattgtgactcatttttatgtggtctgatgtgagttgaggctgccccatatggttcaatgttgatttgtcacctttgttgattactgtgttgtttccgatttgttatatagacgttgtattgttgctttggttaactatcaaccatatggcgtgatgtactgtgacgcgtggagtttgaatggatgaaagtgagctgtaagagtatgtgggatttgcgttcgtgtccgcgtggctagcagctacatggaatgtatgcaatttcggttccaaaaggtctctgagattgcaggattagtttcatgatttgtaatccaggcttcaaaagtttaaacacaccgcagttgtgcttgtgctctccagtcacatagacttgtctcagaaggtacaaatttatgaagattacaatttgagcttc

SEQ ID NO: 2070 - DNA, 879 bp, Elaeis guineensis
agggtcaagctacagtgctcgtctttagggcagggttttagctcccgcttcccagcagagaacccggcttgcgcttggatccctagctgctctcctcttcctctctcccccatctatctcccagatgaagctcgtcaggtttttgatgaagctgaacaacgagaccgtctcgatcgagctcaagaacggtaccatcgttcatggcaccatcacaggagtggatattagtatgaatacacatctgaagacagtgaagcttacattgaaaggaaaaaatccagttacccttgatcacctaagcgtcagaggtaacaacattcgttactatatcctccctgacagcttaaacctggagactctactggttgaggaaacacctagggtcaagcctaaaaagccaactgccgggagacctttgggacgtggtcgtggccgtgggcgtggacgaggtcgtggccgtgggcgctagcactgtcacccgtttattaatttttgcagcatctgcttctgtacaagtagcctgcatacaaggagaatatttgattactttccaagcattaggcaagcaggattgtttgtttaccaaaaattatctttgcaagatttcatgtcgtcggcatatctttcgctatcaccttgttttaagtagaaaaggttttcatgtggtcaaaaaaatggtagtatacattgggacacatttaagtaaggtcttaccgctgctatccttttctctgtatgttgtgctatgtgaatacggaatcagtgggcgaataagagtagatattttatcttcggatgcttacggatgtacttactctagattgatctggtaattccggtttatcaaaataaagtagaaaataaaggatgaacttctag

SEQ ID NO: 2071 - DNA, 718 bp, Orobanche aegyptiaca
cgcttggccaatgttctaaaaccctcccttttcacagagaggtctcgcttcgtctttcttgttgttgctttcacacaaccctagcttcgtcatcttctcgctgcaactatgaagctagtcaggtttttgatgaaattgaacaatgaaaccgtgtctattgagctgaagaacggcaccatagttcacggcacgattacaggtgttgatatcagcatgaacacacatctgaagactgtaaagcttactttgaagggtaaaaacccagtgaccatggatcacctgagtgtgaggggtaacaatatccgctattacattcttcctgacagcttaaatctcgagactttactggtggaggagacacccagggtcaagcccaagaaaccaactgctgggaaacctttgggccgtggtcggggccgtgggcgtgggcgtggacgtggtagaggccgttagacgtgttccggaaatcatcgtaattttttgtagcttttgttataaaacattttgtaccgatggacaaagtcatatgcttgcaatgtaacatttgtctggagtaaaaggatgtctcgaactttctgtgtccattgttagtcgttcttaattgagttcggaattggatttgtgatcgacttttatctttagcgtttttaatgtgtttggattcggaaacaatcgattttagcccggcccgattacggtttgctgaaagaagcagcct

SEQ ID NO: 2072 - DNA, 612 bp, Orobanche aegyptiaca
ttcgtacaaaaccctagttttccgtcggtttccttcgcaacaatgaagctcgtcaggtttttgatgaaattaaacaacgaaactgtgtcgattgagctcaagaacggcaccattgtacacggcacaataacaggtgttgatatcagcatgaatacacatctgaagactgtaaagctaactttaaagggaaagaatccagtgactatggatcatcttagtgtaaggggtaataacattcggtattacatccttcccgacagcttaaatctcgagacgttgttggtggaagagacacctagggtcaagcccaaaaagccaactgcagggaaacctcttgggcgcggtaggggcaggggccgtggtcgtggacgtggtcgaggccgctaatactctctctctcgttttctctgtcgttttctctctgtagcattttgttatgtaaacatccgagtgttcctaaaactcttgaaaacatttacaggtacagatgattgaaattttatcgacgctcgatccgtattgtctttcttataatttttttgtctgactaatttttcctccaaagacttcttcctcgtgactattggtatgctttaagtttataagaaagaa

SEQ ID NO: 2073 - DNA, 1355 bp, Arachis hypogaea
atcaacgcagagtacggggtatcctaaatccaaacccaaatcgaaaagaagccgcttctgaagatttcaatttttcgcagtttgccctaatctctctggtcgcctcccaaaagctgattagctgaaaggaaaacgccgcgccactgcctgcaaccaccgttctccggccgccgcccctcaccactccctatctcaccttcatcatgaagctcgtcaggtttttaatgaagttaaacaatgaaactgtgtcaattgagctcaagaatggtaccattgttcatggcaccattacaggtgttgatattagtatgaacacacatttgaaaacagttaaaatgactctgaaagggaaaaatccggtgactctggatcatctcagtgtgaggggtaacaacatccgttactatattcttcccgacagcttgaatctcgagactttgcttgttgaggagacacctagggtcaaacccaagaagccaactgccgggaagcctttggggagaggacggggacgcgggcgtggacgtggtcgtggtcgcggccgttgagttgtggttcataatttttgtgacatgtggtttgaagctatgtttgggaggatttctgaggtggtgttagacctttaggaacatctgagaagcagaattgttagtctgttccaactgttttcttgcagaagctgatttctctgatgtatccttaattatgattagcttataactaccgacttaagtttgacccaacattttagcaatattgatgtactgtccatgacttagtgatgatacaaaacatagtaaataggcccaagagaaagcctaatgctcttgaactatttgtgagatatttcctgattattcagattcttatgtttaatacatgcacggcatatatttaagaatgtgtgctttataaatcaatgtagtagtgaattgttcagtgtgctgcatatatgattcacaaaacaatgttgtgttttaaaaacaccctaatcatatcatgcattcaacatactaattactacctcattgaggcaacttcctggactgaaaaatggcaaacttagaaacattagaatatgaatattgcactccattctctttgaggaagtcctcaagcaattccttgtgcttttcagggtcagcactctcacattccaactcatagtttgtaccaaagtcatagttggtctcatccagctccagcttcaaccctctccactcatgcacagccctcaagttcctaaaccctcccaagcacacaaccccacttgcaccaaaaccatattcatctctcaccctcctcagtaccttcaaattgtcgactgataaaagcctccatggctcggcaatgca

SEQ ID NO: 2074 - DNA, 780 bp, Platanus occidentalis
gtctcttgtctgagaagagaagtctcgagcttagccctagacacttgacctttcatttttaattgtactttctatatctctttaaagcagggtgcggactcccgcctcttcactggctttgcttccagccctagtttccctctgtcgccaagatgaagctcgttaggtttttgatgaagttgaacaacgagactgtgtcgattgagctcaagaacggaactgttgttcatggcaccatcacaggagtggatattagtatgaatacacatttgaagactgtaaaactgacgctcaagggtaaaaatccggtaactcttgatcacctcagtgtgaggggtaacaacatccgctattatatccttccggacagcttgaaccttgagactctgttggtggaggagacacctagggtcaagcccaagaagccaactgctgggagacctttgggacgtggtcggggccggggccgtggtcgcggacgtggacgaggccgctagttatgttactcagactattaagttttgcagaatttgcctgtgtacaaatgatccacatgcatgcggaaatttaagtagggatggtcgtttgaagcaatagaaaaagcggttttgctgtttacatttctagtcaactagtttttctcgtaatgttaaatgaaagttgctccttaatcgggtttccgcccccaatgacatcactttaacatgttacttgatttgtcccgatcctcaaatgttattatgaatttttaattggttgttaaatacatccagataatct

SEQ ID NO: 2075 - DNA, 5189 bp, Oryza sativa
aacggcccaagttagccaacaagaccagctttggcgtcttggccagatcaaattagggttttgctcctcccgctccgagaaagcgagcagctcgagctccgccgattcccacccgtggctcgtcgccgcctccgcctccgctcctccctcccgccgccaagatgaagctcgtcaggtttctgatgaagctgaacaacgagacggtcaccatcgagctcaagaacggcaccgtcgtccacggaaccatcaccggtgtggatataagcatgaacacccacttgaagactgttaagctcacattgaaagggaaaaatcctgtaacccttgaccacctcagtgtgagaggaaacaacattcgctattacatcctccctgatagcttaaatctggaaactttactagtagaggataccccgagagtcaaggctaagaagccaactgcagggaaacctttggggcgtgggcgcggacgcggtcgtggccgtggtcggggccgggggcgctgagctttgttattccctgttttgtgaagctcttgcagtgcaaaagtatttcaattctattagaacagagatgccaatctcagtagttcttgctgtggaatcatcctggcatttgacctaatgttcatgtctatcaggttacatcattcataatgaacatgggcgatgccttttctcagaccttcgagattttaagtggtatgttgttagtttggttattttaatataattcttctgccttaatactgagtaagtgcttgaaatgtcttgatctattaagcatgtctggtatgaactttcaaccttggcctttggtgctgttttcttatctcaaaagacaaaaggaatactactagtagtttgttttcttcataaatcataatcattcttcccccatttggtaggttgttcatgtgatttgctgggctgtcagcagtagctaaattcctaagttaaaaccgtgtaaatgatactccctccgtttcacaatgtaagtcattctagcatttcccacattcatataggtgttaatgaatctaaatatatatagatgtctagattcattaacatttatatgaatatgagaaatgctagaatgacttacattgtgaaacggagggagtacgtaagattgaagttgctggtggtactcttcaactcatgctcggttcgcagtctctggaccccctcgaatccctttccttttttcccccttttgtgcctttgattctgcgggcgccgtgcttctttgcctatccaacagcagttgcaacgagcactggtgatttacctgattggccggccgattgctttgctttcccatcgaagcaagtacgctgtcgcgatcgcattcacttctgcaacctggtcagccaattcatcccgtgctcactgctcggcaaacggcattatcatgtcctaatgatctgatcgtcccatttagaaatggcaaggcgacacatgtagctctcccagaattaactcctttcacccacgatgcactgcaaatactactacttgataaccatcatcctggtctttatgggcagagccatgtccatgtgtccgtgattagtccatacagtcgtctggctatctgcaaccgaagattccgggcatggcaaaaaggtagtaaaaggcccatcactccaaagagtacaaacagtcaccaagcttcgctatagtagctagcttgtccctgaagcgacactgcggataccatgccatccaggagaggcacaaggacgacacttgtgcatgcagcggcttctctccgataaaaagggcgtgcagcttgggctgtccggcgagagaggggtgcagcagtgcagtggagaggcatgtgcaagctcaagttcaacagggagagggtggggtgctacctgctggtgatcctggtggtggccctcctcatcggcgtcctcttcggcctcggcgtcttccgccacggctacgagcgcttcaaggacctcggccgcaaccacacctgctacgactgcaacaccggctgacgctttctcgatcagctgctcaggtttccaagtagctattgctctggtgcggagtagcgtctaaattaataaattcgtggttttttgggggtagtagtcgttgttgttttggttttgtccttggtagtcgttgttgtttggttttgtccttggtttcattcttgccaaaagcaatagaactgctgtttctctcgtgttgtacacttgtactgcctcatttgttcagttgtttctgttgtggttgtactgcgtcgatcattcagtcagtactcataggagaaacagttaaattcacagaccaatattaaagtaattttgagcatgatatgatatgatatgatcagaattatgatgctcttgcccatattacactgctacaaggttactatttagtaacctttttgattatatatatgcatctccatgttccatgccttggttaagatatatgtccactgagatgaaaagaagggtcaccagcatacctgagtattaaacaacaaaaaaatgtatatattcctcacaaaaaagtagttggataaactcaattacacttgcactccctccagttccgccgtaaccaaaagcttctactttcgcacataaagcatacaaacgggccttttagaaccgaataagctcgtaaatgacttcaatgatagacggtggcctgataataaacaaaagcaaatgattgaaacaacaggatcaaagtaccaaatattcaaaccatgcattgctattgtaattacacatgcagacaataagaattcctagatgccaagtggcatgaagctgtaaaaaaaaatctagagactactgtttatgcacagcagacataaatgaaccgagtcttttggcatgttaacactggagcaactacgtttcagtcagcatcaagaagatgattccaagggtaagtggcagtgtgacacacgatagacacccgagtatatcgttccattagctactgcagcagccacccccttgagaagacgaggaaccagcacctccggattggcccgggaccgtgtaaccaagtttgattccattagcctgcaaatttttaaaaggacacaaaactcatgctcaggtcaatatgtcaatacagtagccaaaagcaatcacaagtgctctcttgaggagaagaatgtagcagtgctcttgcactcatttgattcctataccaatatagaaatctaaaacacctccttttcttctttttttttctttgggaggataggcattttgtaatacatctccttttttgccattaaaagaggcaaaatgaccatttttggtccctcgatcattttcggtttaattacagactcagtttcaagttcagttattccattcaattacaggaaacattgacctgaaaatgtatacacagtttttttttgtgtgtgcttctagggccatgttaaagtttttgcagtgcataagttaattacagactctgtttctactacttattcagttattcctctcaggaaagttttgcagggcatatgttaattaagaatacacttatgttgtataaataatgatctagttcacatcagacatgctcagaagaacaatatgatttgtgtttgtaaatttacctcaatacattacatacattcctaaaaaactttacctcattagataaatcaaagacaccatcttgaattttcttgtatattgctccagcagtcttgacaaaagcctgtgtaacagttgggataagaaaaacatctggagaaagctcttacttgcacatatgcaccgataagaaaaaatcatttacctcctcaacattctgcgcggtttttgcagacgcctccataaatatcagaccgtgctcttttgcaaactgctcgccttcctcatagctcacagcacgcctatgagatagatcagatttatttccaacaagcattattgtcatgttagcattcgcatgttgccttgcatcttccagccagctcgcaagatgattgaatgtctccctcctgaagtcagtataacgtaaacatatgtgatcactcaggttagcaaagtttaaagggaaatcatgcacttaaatcaaaccaaagcccctttttttttcctttttgagaaataaaccaagcaactttgacagattgggtaaaaaccttgtaatgtcataaaccaaaagagcaccggcagcccctctgtagtacgatctagttatcgatctgaatgactcctggcctgcctgaaatgttgtcagagccacaaaagcataagatgaatgtttaacttgacaattgaacatgccatcttataggtatcaaggaaaactcaaaataacagatagacaatgtaacttcaagcctcacgttttggctctctcatccagagctaatctgtacagaaagtgatgtgattaaaaactgaatttcaggttatcggtagtacataccaacggcgaagcccgcataaagccataaactagaatggcattttcaatctcaaaccaaaagccacaagtaatccaagtttacctaaccaatccaagcactctccgcctcaattgaacagcttggtaacagatggctacgctagaaacatcatccaatcgatctacacgagtagcagcagcagagagagttcgaggcggggggtataaccaaccgtgtcccaaatctggagcttgacgggcctgctgtcgacggtgatcatccgggcgccgaactcgacgccgatggtgaggtcgtggacgggctggaaccgcttgtccgtgaactgcagcagcaggcacgacttgcccacccctgctcgcgcgcccccgccgccaccatcgatcatcagacacaacaacaacacagtcatatagagggaaacgagatttctcgtcgttggaggaggggggccggacctgtgtcgccgatgatgatgtatttgaagaggtaggcgtacgacatcttcgccgcctcggcccgcaccggcggcggcggcgcggggggtggtttaccgcggcggattcgcggggcggggagagggtgggatttccttcgtcgggagggaggcgaggcgaggagaggagaggagggttacgtggacgatttgtttggctaattttgggggcggtttgtgtttatcgtcgtcacggtcacggtcgcggtcgcgtgcggattacatcgtgcactcgagctgttttttc

SEQ ID NO: 2076 - DNA, 2647 bp, Oryza sativa
caattacagaacagcccatgaaaaagcccatattgcaatccggcccagtaaaagcccatctcgcggcctctctcccagatcggggaggttttatggcggcttcccctctttcttcctctctccgaggagagaagccgctcgaggaggcagctcccccccaaaaaccctagctcaggcttcggcaccgcctctccccccctcgccttcctccccccaccaggcgcctccaagatgaagctcgtcaggttcttgatgaagctgaacaacgagacggtaacgatcgagctcaagaacggcaccaccgtccatggcaccatcactggtgttgatatcagcatgaacacgcacctgaaaactgtgaaactcacattgaaagggaaaaatcctgttacctttgatcacctcagtgtgaggggaaacaacattcgctattacattcttcctgacagcttaaacctggagacattgctggttgaggatacaccgagggtcaaggctaagaagccaactgcagggaagcctttggggcgtgggcgcggccgtggtcgtgggcgcggtcgtggcaggggacgctgagcttcactccagttccctatcttggaaacttttgcatccgtgcaaatgtaatctctgctctcgtgttagcttgtacggagtagtgttctgattatggcaaagacgttgatgtaagcactcggcacctctttatcgatgtggattttttcccggttggtatttgaccagatgttcttgttcaagaatatgctacgttacattgtaattactgtgccatgatgctctagcttctcagtgagtggtcgaatccttccccaacttcttactaatatgcgaaatttgcattccatctcacagcatcacgtctctactcttcagttggtagaaagcattgccctatctccggatgattagtcgccacaaaatgcttatactgatgtttggatgttcaatggagcgaagctgatgcatacacaggataaagccggcttaagttatactgaagcagattaaactaattatgttccacaatcgaaaataccatggacactagcgactagttacaatagttacaaaccagtttgtttctatggattatttgattgaaggaatgaatgtaacacaccatttcatttagttacacatgcaaaagtacagaaatcgtgaatgtttaactttacatgactgcaatgtagacaaactaccatggatgaacattttgtgcactaacactgaacgtcggtagctggaaggagtaaaaaacacagtaccaataccagctattttttccacaaggcaacatcgaaatattgagggccatgttacacatgatctgacttttcaatttaggctggatacatgactagttggatactgctgctgcctttagccgcagcagccaccaccttgagaggatgagccagctccaccacctgaagcatttggtaccgcatagccaactttgatcccataagactgcagcagttttggaagataagttagtagctgtgaaatataatatatcatacttccttaaaatgcgagaatattgataaagtggttgctgaactggaaaagaaaaatcatgtgataagaggggagccagctggcacattgacactccaaccaacctctctatcagaatagtttcatgtatatgttattacttgtcaatagtctagaatacaacaccacagctttctattcattaatcaatactaactggagaacttaacaataaaacttgtaatcaaatagaagaggtgtgtcgaattcacagatagtatcatcctatacatgtagttcagaaaaaaatgtcaacttgttcttttgggggttcaaaacatagcatgaccgatgtatggtgccattgcaacttacgaacaagattgaattcaattacattccactaattatctttgattagcacaaactgaactgagagtttaaaagggaaaaggggcaagcaataaaaagctcacctcattagatacatcaaagacaccatcttggattttcttgtaaattgttccagcagtcttgatgaatgcctacatcacaagaagacacacgataagttttcaagagaaatgaaccctgcaaccaaactcaaatgtaccagggacaaacaatcacctcctcaacattttgtgcagtttttgcagatgcctccataaatactaggccatgctccttggcaaattgttcaccttcctcatagctgacagcacgtctatgagacagatcacatttgttaccaataagcattactgtcatgttggcatttgcatgctgtcttgcatcttctagccagctagcaagatgattaaaagtctctctcctgaagtttaagttagccaactgtgagcaatatccatattaagaaagttaagatcataagcaatatattgcatttaacatgcacctggtgatatcatacaccaaaagggcaccagcagcacccctgtagtatgatctagttatagatctgaacgattcttgaccagcctgcattattgcgagagaatagtatgagatgggtgtgtgtcatgacaacaaactcaagaaagtcatttagctgtacaggcagacccaaaacataaatgcttcaccgtatggcattttaattaag

SEQ ID NO: 2077 - DNA, 589 bp, Euphorbia esula
tgaaagtgttgtgcaggctccttcgaattcgattggcctttcttctgttccttcaaaccctagatttcatcttcttgcttcacgatgaagctcgtcaggttcttgatgaaattgaataacgagactgtctcaattgagcttaagaatgggactattgttcttggcaccattacaggtgtggatatcagtatgaatactcatctaaagactgtcaaactgacgctgaaggggaaaaatccggtaactttggatcatctcagtgtgaggggtaacaatatccgttactatattcttcccgacagcttgaatcttgagactttgcttgtcgaagagacgcctagggtcaaaccgaagaaacccactgctgggaagcctttgggacgaggtcggggacgtggacgcggccggggtcgtggtagaggccgctaaattgtgattgtactcagttttatgattttctggcatatggttgtgtgtaaaaaacacctggtgttgtatggataaatttttcagtaaatttaggtatgtggagagaatgttcttgctatttcaaactctacctgattttgaacccttctatatttgtgtg

SEQ ID NO: 2078 - DNA, 849 bp, Trigonella foenum-graecum
aaaatcataaatacataagggcaacactaaaacggcgtcgtactcagagaggctaaaaacacttgtgcggagacacagagcgactagcgtcactgacccgcccatccctccctccgtggttgttgaagtcgacagccggtgctcattttcctcctccactgccgctatgaagctcgtcaggtttctgatgaaattgaacaacgaaaccgtatcgatcgagctcaagaacggtactattgttcatggcaccattacaggtgttgatatcagtatgaacacacatttgaaaacagttaaactaacactgaaggggaaaaacccagtgactctggatcatctcagtgtgaggggtaacaacattcgttattatatccttcctgacagcttgaatcttgagactttgctggttgaagaggcacctagggtcaagcctaagaaaccaactgctgggaagcctttggggcgggggcgtggtcgagggcgtggacgtggtcgtggccgcggtcgttgaattgcatattcagaatttttgtgccatatggttatgttttaggaggaatttatgggtggtcttgtggacatcaaaagattgttcttgctgattagttatgttggctttgcttacattgccattatttttgaacaagtacttacaagttcttctgtacaattccttcctgagttctttaactgagtaagactttgttgacttctaaaagatacctaacacctcttaagtctcaactaaagtttgcatatatggtggctctcttgtctttttcaataactgatatatggttctcatgagggtttggttcctccccagttttcaatagctaagaaagattt

SEQ ID NO: 2079 - DNA, 647 bp, Amborella trichopoda
taaaggaagctttgccgctcggctttacacccgcggtccatgtttctgcttctcctctagccctagaacagaagcagttcccccctctctctctctaaaaaatgaagctcgttaggtttttgatgaagctgaacaatgagacggtctccattgagctcaagaatgggacagttgttcatggcactatcactggagtggatatcagtatgaacacacatcttaagacggtgaagttgacactgaaaggcaagaatccggtgacccttgatcaccttagtgtgaggggcaacaacatacgatactatatcctccctgatagtctaaacctcgagactcttttggttgaggagacacctcgagtcaaacccaagaagcctactgcagggagacctcttgggcgtggccgaggacgtgggcgtgggcgtggacgcggccgtggccgttgatttcttggttaccaaagtctacagtttttctcgtgcaattgagtactatgttgatgtatattgtagacattttgaagagaatctttatttgaggcctagcatgtttcttcttcacttatcttgaagcatacacgtttatggatacatatattggctgtggcattttggtggtttaagagcgttccgcctttttggtgtcta

SEQ ID NO: 2080 - DNA, 747 bp, Medicago truncatula
gcgaggagtacagtactctaaacactagtgtcgttcggagccgaaaaaaacctcaccgtgcttccgccgcgatttgcgattttccaccgcgactctcttcttctccactaccatgaagctcgttagatttctcatgaagttgaacaacgaaaccgtctcaatcgagttgaagaatggcactattgttcatggcaccattacaggtgttgacatcagtatgaatacacatttgaaaacagttaagctaactctaaaggggaaaaatccagttactttggatcatctcagtgtgagaggcaacaacattcgttattatatccttcctgacagcttgaatcttgaaactttacttgttgaagaagctcctagggtcaagcctaagaagccaactgctggaggaaagcctttggggcgaggacgggggcgaggacgtggacgtggacgcggtcgtggccgttaaattgtgtatcacaagttcatgtatttgactttgttgtagggcaattttctgacagtttgaaagacaccgacagtgtgttattgttaattagttttgtggagtattaatgatgttatattcttacctaagtgctttatagatccagtttatagtccctgccgggtaatgtcaaatgccaatcaactgaaagaagctgtgttagtacgtattagataattgagtttataggaattgctgatcactcaccggtgttgtctgcagtggtaatggtaattgttatttgaacg

SEQ ID NO: 2081 - DNA, 842 bp, Setaria italica
gatcagccttcaaactagggtttactcgtcccgaagccaacagcaaaggcttcctccacgcttgagctccgccgcctcctcctccctccgccgactccctccgccaggaccgcgaagatgaagctcgtcaggttcttgatgaagctgaacaacgagacggtcaccatcgagctcaagaacggcacggtggtccacggcaccatcaccggtgttgacataagtatgaatactcatctgaagacagtgaagcttacactgaaagggaagaatcctgtaacccttgaccacctcagtgtgcgaggaaacaacattcgctattacattcttcctgacagcttaaacctggaaacgttgctggtggaagaaacccctagagtcaagcctaagaagccaactacagggaagcctttgggacgtggtcgcggccgtggtcgtgggcgtggtcggggccgggggccgcgctgagctctatagttcccttgctgtcggctctcttgcatgacaaatttccctacaatgtaacctctttcccctgcacgctatgtgaaagaatgttgcattgttacccttctgatgaacttggacctaatatctcaaatctcagtagttcttgttgtggaatcgccctgtctatttgatccatggttcatgtctatcttaggtctacattgtagttaattggtaatgtgcttcacctggcatacatataagatgccgcagaccattggatacctaggttgtatgcttgtgttttcgctacatcggaattattgctctggagttatgctttgcagtcgcctgcctctacttgatctttagctctgcataaaactaaattccgg

SEQ ID NO: 2082 - DNA, 1052 bp, Zea mays
acctcctcccacccgtccgccagatcagcattcaaactagggtttactcctgccgctccgagaaagcaaacaagcgtcagctccgccggcttcctccgcgctttctccccgccgccgccgccgccgctccttccctacgccaggcacgccaagatgaagctcgtcaggttccttatgaagctgaacaatgagacggtcaccatcgagctcaagaacggcacggttgtacacggcaccatcaccggtgttgacataagcatgaacactcatctgaagacagtgaagcttacactgaaagggaagaaccctgtaacacttgaccacctcagcgtgcgaggaaacaacatccgctactacatccttcccgacagcttaaacctggaaaccttgctggtagaggaaacccctagggtgaagcctaagaagccaactacaggaaagcctttggggcgtggtcgcggccgaggtcgtggacgtggtcggggccgggggccacgctgagctttatcgttcccctgctgtcggctcccttgcaagacaagtttcctctacaatgtaaaacatctttcctctgcacgctgtgtgaaagaatgttgcatcgttacccttctgatgaaggtggacgaaatatctcaatgtcagtagttcttgctgtgaaatcacgctgtctacctggcccccctactcatgcctatcttaggtttacactctagttaatttgtaatgttttttttctcccccgtggaatacatgtaagctgccgcagagctttggatgtctagggttgtatacttgtgtttgccacatgggggggactggggattattgatctggagctatgcctgtggctggctctgttagatcttgacctctgcttgaaactaaattaccattgtgctgctcgggggatcgcagatactggttttgctaaagcagttggcatctacaggtctctctcagacgatgcccttggcctgtatcgacttttctgctgtattggtaaaggattgctagctattggttctttttgtctcagtatgttccgatttggc

SEQ ID NO: 2083 - DNA, 704 bp, Carica papaya
gcacgatgctacagcagtgcctcgatttttaacactggctgattttctcccgctcttcgcatttcctcccaagccctagctttctctgtaacttcttcccaaaatgaagctggtcaggttcttgatgaaattgaacaacgagacggtctcgattgagctaaaaaatgggacggttgttcacgggaccatcacaggtgtggatatcagtatgaacacacatctgaaaactgtgaagctaacgctaaaggggaagaatccagtgactctggatcaccttagtgtgaggggtaacaatattaggtattacatcctccctgatagcttgaaccttgagactttgctggtggaagagacaccaagggtcaaacccaagaagccaactgctgcagggaggccattggggcgtggcaggggtcgtggacgtgggcgtggccgtggtcgaggtcgttagccatgttgcatcggtttcaaatttttgtaacagctggttatgtaaacatctttgctgtagggagagtttgattattgttagtaagagaaatagtactgatgttcacctttttatgtatttgatgagagagacagaatcatgaatttgaagatactttgttaatgggatagagaatgagtgtcttgagtggcaagttgatatatttacttgtaaactgagactgtattaatgatggtgttgccccatatcagac

SEQ ID NO: 2084 - DNA, 937 bp, Saccharum officinarum
cagccttcaaactagggtttactcctcctgctccgagaaagccaacaagcgtctcagctccgccggctgcctccgcgctttctccccgccgccgccgctccttccctacgccaggcccgccaagatgaagctcgtcaggttccttatgaagctgaacaatgagacggtcaccatcgagctcaagaacggcacggttgtacacggcaccatcaccggtgttgacataagcatgaacactcatctgaagacagtgaagcttacactgaaagggaagaaccctgtaacacttgaccacctcagcgtgcgaggaaacaacattcgctattacattcttcctgacagcttaaacttggaaactttgctggtagaggaaacccctagggtcaagccgaagaagccaactacaggaaagcccttggggcgtggtcgcggccgtggtcgtggacgtggtcggggccgggggccacgctgagctttactgttcccctgctgtcggctctcttgcctgacgagtttcccgtacaatgtaacctctttcccctgcacgctatgtgaaagaatgttgcattgttacccttccgatgaacgtggatgaaatatctcaatctcagtagttcttgttgtggtgatcaccctgtctacttggcctatcattcatgtctgtcttaggtttacactgtagttaattcgtaatgtctttcccctggcatacatataagatgccgcagaactttggatatctaagggtggatgcttgtgttttcacatggggattattgatctggaactatgcctttgcagtgggtcttgctttattttgatctttagcaaatgcttgaaagctaaatttcgcatcaaaagaacagaccccgatctctccgtggatcggctaatcgacgattgaaagtctgatgttgatcaattgtctgcattgcat

SEQ ID NO: 2085 - DNA, 698 bp, Panicum virgatum
gaaagccaacagcgtagctccgccggcttcctccacgcttgagctccgccgccgccgcctccctccgttcctccgctaggaccggcaagatgaagctcgtcaggttcttgatgaagctgaacaacgagacggtcaccatcgagctcaagaatggcacggtggtccatggcaccatcacaggtgttgacataagcatgaatactcatctgaagacagtgaagcttacactgaaaggaaagaatcctgtgacccttgaccacctcagtgtgcgaggaaacaacattcgctattatattcttcctgacagcttaaacctggaaactttgctggtggaggaaacccctagagtcaagcctaagaagccaactacaggaaagcctttgggacgtggtcgcggccgtggtcgtggacgtggtcggggccggggtccgcgctgagctccattgtacccttgctgtcagctgtctcgcatggcaagtttcccatacaatgtaaccctcttgcccccgcacgagatgtgaaagaatgttgcattgttacccttctgatgaacgcggacctaatatctcaatctcagtagttcttgttgtggaatccctctgtctatttgaccaatcgttcatgcttatcttaggtcttgtagttaatttgcaatgctttgacctgtcatacatattaagatgcgcagacatttgaat

SEQ ID NO: 2086 - DNA, 751 bp, Panicum virgatum
ggctccgcgaaagccaacagcgtagctccgccggcttcctccacgcttgagctccgccgccgccgcctccctccgtctccgtccctccgccaggaccggcgagatgaagctcgtcaggttcttgatgaagctgaacaacgagacggtcaccatcgagctcaagaatggcacggtggtccatggcaccatcacaggtgttgacataagcatgaatactcatctgaagacagtgaagcttacattgaaagggaagaatcctgtgacccttgaccacctcagtgtgcgagggaacaacattcgctattatattcttcctgacagcttaaacctggaaactttgctggtggaggaaacccctagagtcaagcctaagaagccaactacaggaaagcctctgggacgtggtcgaggccgtggtcgtggacgtggtcggggccggggtccgcgctgagctccattgtacccttgctggcagctgtctggcatggcaagtttcccatacaatgtgaaagaatgttgcattgttacccttccgatgaacgcggacctaatatctcaatctcagtagttcttgttgtggaatccctgtctatttgaccaatcgttcatgtctatcttaggtcttgtagttaatttgcaaagctttgacctggcatacatataaggtgccgcggacatcttaatatctaggctgtatgcttgtgttttcacaacatgggaattattgctccggagctatgccttgatcttc

SEQ ID NO: 2087 - DNA, 835 bp, Trigonella foenum-graecum
aatgagtacactactaaacaaacactagtgtcgttcggagcccaaaaaaaacctcattgtgctgccgcgattggcgattttccaccgcgactctccttttcaccgccaccatgaagctcgttagatttctcatgaagctgaacaacgaaaccgtctcaatcgaattgaagaatggtactattgttcatggcaccattacaggtgttgatatcagtatgaatacccatttgaaaacagttaagctaactctaaaggggaaaaatccagttactttggatcatctcagtgtgagaggcaacaacattcgttattatatccttcctgacagcttgaatcttgaaactttacttgttgaagaagctcctagggtcaagcctaagaagccaactgctggaggaaagcctttggggcgaggacgggggcgaggtcgtggacgcggacgcggtcgtggccgttaaattgtgtatcacaagttttatggatttgactttattgtagtgtaattgtctgagcagttgaaagacatcaacagtgtgttattgtcaattagttgtgtggagtgttaatgatgttattttcttacataagtgctttatagatctagtttatagtccctgctgggtaatgtcaaatgccaatcaactgaaagaagctgtctaagtaggtaagtaagtttataggaatcgctgatcactgattggccttgtctgcagtggtaatggtaattgtgttctttgaacaaatggttattttctgcaatctgcaattgacgacactgcttttgttacatatattttgtttgaaataaaagcatgataaattagctgaacgttga

SEQ ID NO: 2088 - DNA, 511 bp, Pteridium aquilinum
ttccgactggctctctcgcctttgcttgcttctagcctacctccgcttcccccttctcaacaatgaagcttgtcaggtttttgatgaagttgaacaacgagacggtgtcgattgagctcaagaacggaaccgtgttcacggcaccatcacaggtgtggatatcagtatgaacacgcatctgaaaacagtgaaacttacattgaagggaaaaaaaatccagtgagcttggatcaccttagtgtgaggggtaacaatattcgctactatatcctacctgatagcttaaatcttgagacattgctggttgaagagacacctagggtgaaacccaagaagccaacagctgggaggcctttgggacgcggtcggggtcgtgggcgtggacgtggacgtggtcgaggccgttaaatatgttgccctcctttcaaatttttgggacagctggatgcgtagacacctttgttgtagggagaattggccgttgatgctaatggatattaaagttgtattg

SEQ ID NO: 2089 - DNA, 858 bp, Musa acuminata
gcttccacgagcttggccattcgcttcttttggagccctaactcgctgttctcttccgctctgtggcatcgccatctcctcgatccaggatgaagctcgtcaggttcctgatgaagcttaacaacgagaccgtctcgatcgagctcaagaacggcaccgtcgtccatggaaccatcacaggtgtggatattagcatgaacacacacttgaagaccgtgaaacttaccgtgaaagggaaaaatccagttacccttgatcacctaagcgtgagaggtaacaatatacggtattacatcttgccggacagcttgaaccttgagacattattggtcgaggaaacacctcgggtaaagcccaaaaagcctactgcagggagaccagtgggacgtggtcgtggacgcggccgtggtcgtggacgaggtcggggccgttgacaatgtcatgctcatggtaatttttgcatcatctgtttatgtacaaatagcctgctcttactcttgagtagtttcgtttgaaagcttgtcttctcaaaacagcaagcaggactatctgtttttagcttaaatagcataagtgttatcatctgcgatgaagctttagaagcaactaaaagaaatactggcttatgttatcatttcttgttgttgtctgagtgttgtctagtggggggcctgcattagaattacttctattcctgcttctttagttcatcgaggttgttgataaactgagatttctctttttgcttcaatttttcttcactcaaattttgtccatcttctaaaattctagaagtcattctagacaaaagtgtttgtaatttagacaaaatcacatgcctaaaacgaaaacggagag

SEQ ID NO: 2090 - DNA, 968 bp, Phaseolus coccineus
attcaaaatcacaaaattatcccttaagccattacaaaagaaccgcttcttcacctttctctctctctccccttcaatttttgccctaaaaccctggctgccgttgtggtggccgccgccgaagaaggagaatagagaagcaaacggagtcatacaattcgattcaccatgaagctcgttaggtttttaatgaagttgaacaatgaaaccgtgtccattgaactcaagaatggcactattgttcatggaaccattacaggtgttgatatcagtatgaacactcatttgaaaacagttaaactgactctgaaagggaaaaatccagtgactctggatcatctcagtgtgaggggtaacaacattcgatactatatccttcctgacagcttaaatctcgagaccttgcttgtggaagagacacctaagatcaaaccaaagaagccaactgctgggaaacctttgggccgtggacgagggaggggccgcggacgtgggcgtgggcgtggtcgttgagttctgccctccatttctgtggcatgcagttataaactttgtcgcaagattttctgggtgttttcaggaacttctgaggagcgtaattgtcaatttattcctgttattttcttgcaagagctatcatgttctagtgtacaatcaccttcatgctgaaactgatgtaacctgaattacctattgccttatagttgttagtgaggaacccttcattcagcagtatgacaaattgttcatgacttaatggctatacttaacacagtaaataggcccacgagttgcctaatgaggtttgaactaaatgatggttttcctgatgacagattcttatgtttatttacatgtatggatggtatttgtgaaatgtttgttgttgtttgcttccattgtcttactgtcacatccgttgcaagttaatcatgtaaatttatttagtaaaccaggtatatatagtt

SEQ ID NO: 2091 - DNA, 763 bp, Gossypium raimondii
cgacccctaaatcacccccgactccgatacctggtagaagcagcacacaggtccatctccgtctcctctctttcccgcttccttcgacttgctttctcgccttttgcttcaaaccctacttctcttctctcttctcaaaatgaagctcgtcaggtttttgatgaagttgaacaatgaaacggtgtcgattgagctcaagaacggaaccgtcgttcacggcaccatcacaggcgtggatatcagcatgaacacccatctgaaaacagtgaaacttacattgaaggggaaaaatccagtgagtttggatcacctcagtgtgaggggtaataatattcgctattatatcctgcctgacagcttaaatcttgagacattgctggttgaagagacaccaagggtgaagcccaagaagccaacagctggcaggcctttgggacgtggtcggggtcgtgggcgtggacgtggacgtggtcgaggccgttgaatatgttgctctgtttccaaatttttgtgacagctggatgtgtaggcagctttgttgtagtgagaatttgtgggcgatgctacgaattttaaaggaattgtattggtgttttactgttctgtgtgattattagcctgggttgaatagcttaatcatgaatccagaggttcaccgctctttcgttttcatttctcctcttaccccatttttctcgtatcattttacaaattcaaataaacaaataaataaaaaggtgcaactgcttttaacttttcaaaa

SEQ ID NO: 2092 - DNA, 838 bp, Lactuca sativa
gggccgggagtaggccctaaatacaaactacacaagtgtaatatacaaggattacacagtcgttctctcgtgccaaagccctaaaacagcaaaaaaccctctttcccttcgcgttctccggcaaattgttaatcatcagtctcttctgcattcactccggcaatgaagctcgtccggtttttgatgaagttgaacaatgagacggtttcgatcgagctcaagaacggaactgttgttcacggaacaatcacaggtgtggatattagcatgaatacacatttgaagacagttaaacttaccctaaaagggaagaatccagtgagcttagatcacctgagtgtgaggggcaacaacatccgctactacatccttcccgacagcttaaatctcgagactcttctggtcgaagaaactcccagagtcaaaccaaagaaaccaactgcagggagaccggtgggacgtggaaggggccgtggacgcggacgtggtcgtgggcgaggccgttaatgttaatgttgttgattgttgtagtgatatctggttttgtaaacagctgctgtattcttggagagtttctttgacaactgacattgttatggatgtgatcattttgcgggtttgtttttccctttatgcccccaaaaccaactcgctttttatggtcaattacaagtatctttcaaggataagtccccattcctcattagttttgttaattagatttggattcttgatattaagagtataactagcgtgttcaagtgtttatgctttatgcgtgcatgatattgttacccaaagctttgacgtttaggtacatctattagactactctttt

SEQ ID NO: 2093 - DNA, 873 bp, Secale cereale
tccgagaaagcaaacagctcgagctcctccgattccgcccccctccgttcctccgcatcttcccggccgccgccaagatgaagctcgtcaggttcttgatgaagctgaacaacgagacggtcaccatcgagctcaagaacggcactaccgtccacggcaccatcaccggtgttgacataagcatgaatactcatctgaagaccgtaaagctcacaatgaaagggaagaatcctgtaacccttgatcacatcagcgtgagaggaaacaacattcggtactacatcctccctgatagcttaaacctggaaacgttgctggttgaggatacccccagggtcaagtctaagaagccaactacagggaagcctatgggtcggggtcgtggacgcggccgtgggcgtggtcggggccgggggcgctgagccttattgttccctgctttggaagctcgtgcagtgcaagtccctacagcgtaacctgcttcctctgcgagctatgttgaagaatgtttctgttctgttagaagatgtcaatctaagtacgtgttgatgtggaatcatctcgcctgtttgacctatgttcttatatattgttcgtaatgcattttctcgggaatttcacttgcaggcctccagacttttgaaatgctaagtggcatcctgtgctgttacttgttaccctggaattcttgcccttgtgcttttgcgtagcagtaagttgtgtttgagtagaagctgaccctttttcttctgtagcaatgctttgaaattaaactggcatgggggcactgctattgcatatagaacaaaaaaaaaaaaagaaaaaaaaaaaagtaaaactactagcgtgtatacactgctcttgagactagac

SEQ ID NO: 2094 - DNA, 708 bp, Amsonia hubrichtii
cagaggcttcgcttttgcttcaactgagctactgaaccctagcatccgtcttcttcttccttcagcaacaatgaagctcgtcaggtttttgatgaagttgaacaatgagacggtgtcgattgagctaaaaaacggcacagttgttcacggtaccgttacaggtgtggatatcagcatgaatacgcatttgaagactgtcaaacttactctaaagggaaagaatccagtgacattggatcacctgagcgtaaggggtaataatattcgctattacatccttccagatagcttaaatctcgagactttgttggtggaagagacaccaagggtgaagcctaagaagccaacaacaggtaagcccttggggcgggggcgaggacgtggtcgtggccgtggccgtggccgaggccgttagatttgttccactgatttcagtttttgtggcatctagttgtgtaaacatctgtaatgagagtgttaacttagtcgatgatccctaaatattatactccgagagcttctgcgaatcatatttcccatccagggggaatcatattggaattgtatgttctatttaatagtgtctatggctagtagctattgtgcccattcttctgatagtgaagatcacatggatcagtttgttcattcactgctacttatgctttctatattatcattccgctgctttatggtggcgttgattac

SEQ ID NO: 2095 - DNA, 685 bp, Aristolochia fimbriata
accctaggcacaaaggccaaaaccccgagtctttaaacggagccttctctcccgcctcttcgactggctttttactgcgagccctagctctcatcttccttgcactttcagtcaagatgaagctcgtcaggtttttgatgaagttgaacaatgagaccgtgtcgattgagctcaagaacggcaccattgttcacggcaccattacaggagttgatatcagcatgaacactcatttgaagacagtgaaactgactctgaaaggcaaaaatccggtgacgttggaccaccttagtgtgaggggtaacaatatccggtattacatcttacctgacagcttgaatcttgagacgcttctagtagaggaaactcctagagttaagccaaagaaacctactgcagggagagctttgggccgtggtcgaggtcgtgggcgtggacgaggacgtggtcggggccgctaggtgtttccctttcaaatttttgcaaaatctgtcttgtacaaatggcttgcacccattaacgaaagggatattgctttctactattctataggacctgaaagattttatgggtgtggcttagatgtatgttgaaatgcgcagctcatggttgtgtagaagatatatcttgacgttgcacttacatatttgtgacagttaatgtgttccagtaccgcacttactaa

SEQ ID NO: 2096 - DNA, 623 bp, Musa acuminata
ggcttcttttggagccctaactcgctgttctcttccgctctgtgacatcgccatctcctcgatccaggatgaagctcgtcaggttcttgatgaagcttaacaacgagaccgtctcgatcgagctcaagaacggcaccgtcgtccatggaaccatcacaggtgtggatattagcatgaacacacacttgaagaccgtgaaacttacagtgaaagggaaaaatccagttacccttgatcacctaagcgtgagaggtaacaatatacggtattacatcttgccagacagcttgaaccttgagacattattggtcgaggaaacacctcgggtaaagcccaaaaagcctactgcagggagaccagtgggacgtggtcgtggacgcggccgtggtcgtggacgaggtcggggccgttaacaatgtcatgctcatggtaatttttgcatcatctgtttctgtacaaatagcctgctcttactcttgagtagtttcgtttgaaagcttgtcttctcaaaacagcaagcaggactatctgtttttagcttaaatagcataagtgttatcatctgcgatgaagctttagaagcaactaaagaatactggcttatgttatcatttcttgttgtt

SEQ ID NO: 2097 - DNA, 724 bp, Musa acuminata
agctgttgtcgtctgcctcctcttctgcctccgttgcctcgccaccttcccgatccaggatgaagctcgttaggttcttgatgaagctcaacaacgagaccgtctcgatcgagctcaagaacggtaccgttgtccacggaaccatcataggtgtggatattagcatgaatactcacttgaaaactgtgaaactcacagtgaaagggaaaaatccagtcactcttgatcacctaagcgtgagaggcaacaatatccgctactacatcctgcctgacagtctgaacctcgagacactattggtcgaggagacacctcgggtcaagcccaaaaagccaactgcagggagatccttgggacgtggtcgtggccgtggccgtggacggggacgaggtcggggccgttaacagcatcactctcttcataattttttgcatcatcatgtgtccgtgtacaaatagcctgctctttattgagaagtatcatttggaagcttctcttcacaaaatggcaagcaggactatctgttttagctctaaatagcagttaagttttatccactaggaccaaactttagaatcaaagtgaaaagaaagaagaaaacaagaactatgtgctgtaagattgttctgtatttgtgggttgcactagaattgttgtattcctgcttgtttggttcatatacgttgttggttatcagagacaaacctgagttcttgcagctgtc

SEQ ID NO: 2098 - DNA, 785 bp, Hordeum vulgare
cggcacgaggccgcttcgagaaagcaaacagctcgagctcctccggttccgtccgcctccgttcctccgcaccttcccggccgccgccaagatgaagctcgtcaggttcttgatgaagctgaacaacgagacggtcaccatcgagctcaagaacggcactaccgtccacggcaccatcaccggtgttgacatcagcatgaatactcatctgaagaccgtaaagctcacaatgaaagggaagaatcctgtaacccttgatcacatcagtgtgagaggaaacaacatccggtattacatcctccctgatagcttaaacctggaaacgttgctggttgaggatacccccagggtcaagtctaagaagccaactacagggaagcctatgggtcggggtcgtggacgcggccgtgggcgtggtcggggccgggggcgctgagctttattgttccctactttggaagctcgtgcagtgcaagtccctacagcgtaactgcctcctttctctgcgagctatgtcgaagaatgtttctgttctgttggaagatgtcaatctaagtacgtgttgatgcggaatcatctcgactgtttgacctatgttcttatatattgttcgtaatgcattttctcgggaattttacttgcaggcctccagacctttgaaatgctaagtggcatcctgtgctgttacttgttaccctggattcttgcccatgtgcttttgcgtagcagtaagttgtgtttgagtagaagctgaccctttttcttctgtggcaatgcttgaaatt

SEQ ID NO: 2099 - DNA, 3307 bp, Hordeum vulgare
ttgtacaccccattacaacgcacgggcaattttcctattgtttgtcagaagcgcagtggcctcacggcttctaccgagcccaaagacgtaaagcccggcccaagtaaaccgactcaccaacagccaggtcagccttcaaactagggttttgccctcccgcttcgagaaagcaaacagctcgagctcctccggttccgtccgcctccgttcctccgcaccttcccggccgccgccaagatgaagctcgtcaggttcttgatgaagctgaacaacgagacggtcaccatcgagctcaagaacggcactaccgtccacggcaccatcaccggtgttgacatcagcatgaatactcatctgaagaccgtaaagctcacaatgaaagggaagaatcctgtaacccttgatcacatcagtgtgagaggaaacaacatccggtattacatcctccctgatagcttaaacctggaaacgttgctggttgaggatacccccagggtcaagtctaagaagccaactacagggaagcctatgggtcggggtcgtggacgcggccgtgggcgtggtcggggccgggggcgctgagctttattgttccctactttggaagctcgtgcagtgcaagtccctacagcgtaactgcctcctttctctgcgagctatgtcgaagaatgtttctgttctgttggaagatgtcaatctaagtacgtgttgatgcggaatcatctcgactgtttgacctatgttcttatatattgttcgtaatgcattttctcgggaattttacttgcaggcctccagacctttgaaatgctaagtggcatcctgtgctgttacttgttaccctggaattcttgcccatgtgcttttgcgtagcagtaagttgtgtttgagtagaagctgaccctttttcttctgtggcaatgcttgaaattaaactgggatgggggcactggtattgcagattacatattcatctgaatcatgcgcctgtctacattattctcctgtatgttgcgatgttaggctttatcactctttctgtgcttggattttattaagctgttgaacagcctcgtgtggaatctgagccgcatgattttggttgtgtcattttccatggtttagtggtttggcttacggtaagttttgagcaaatggaatcattttgtttagttgtaatgtccatacagtccacggtcggaggatttcgctacaaattgaacgtcaaattctgagcatggcaaatcgaatgtcttttatggcaatttgtggtgtcgcgaggaacatggcaagaatttgccatgcttcataaaggcaattgcaatcctcatgacaacataatttgctaacttgggctttccatttgccatgttaaaaaataatatccgatgtttgatttgcagcgagatccgaaatccaaatttcacctggtaggctccgtttgatgctgcggtggctttcttatagacatttacatatctctcctggaatctctcatctggtggttataatgctttaccggaatgtaacagcaaagccttgctatagtatagtagttagtaaaagctcgtgcgtgtaaccggccaacaccgttgatgcagtgccatgtcggatcatgcaacgagcgttgtggttgaatcgtttgaagcgacaggttaggccggcccacggtgtcgtcatgcttgggacaaatgttggccggagcattttccgacggctgcctcccttcaccgtcgtacatttcaggatcaggccgaattaaactgtgatgttgataattttcccttgagttctccataagcttgatcaaagtgtaagaacagttctccgaaaataacccctcacatcagtgcgcatcccaatcgaattgattccgtcctgtcaaccccgtcttccgtccgtccgtccgttcatgccctcccggtcttctcccagtggcattgtcacaatggactggaggacacccccaacccaatcaaccaagccgcacgcattatcctcttccatcctcttatctctctatctaaaaggcaaaagacaaatattccgcagcaaaagatggggccgaagcacggaaaagcagggccggaccggctgttgctctctgcaaattgatgcctcccacatgcccctcgatgaacgctcatccttttccagtccaggatgacacatcacggcatcaataaaccccgtcttgttagacatgtgtcgtgggctcggccacacaggatcgagattccgggcatggcggaaaggcaacccagagagatttcccgtcacccgaccgaccgttccgcacagtgtcttagcttccctagcaagcgatgccctgcacggccgcacaccaccgttgaagcgagaaagagcggcgctcgttggagtggttagatagctgtccagccccagcagttttgctctctctctctttcggatccaagtgtgcaaattttctccgataaaaaggcgtgcccgtgctgctccagcctgcctgcatgttccaaaaccctcacgccgcagcacggtggatagatagagggagagagaggtttagatagaggaagaaagagaggagggggaggaggaaggatgtgcttcaagttcaacagcaaggagagggtggggtgctgcctgctggtggtgctgtgcgtcgtgctcctcgtcggcgtcctcttcgggatgggcgtcttccgccacggctacgacaagttcacggaactcggccgcaaccgcacctgctacgactgccacacgccctaagcccggccggccggtcggtcaccgggtcacggcggctgtccttgtgcactcggcgtgtgcgatggcctgctcatgtgtatgtgtttatgtatgtatgtacgtgtagtgaactgtgcagaatttggttgctctcgtacacaagagagggtacagaccgtttttgtgttgctgctgctgttgccatcttcttcctttgcctctctgtttcttgcgttgcttcggtcgttttgtaggaacgagctggaattgtttgtggcctatttccacaccttataaaccatataagaggagaaatatatatgagaagaaactactccctccgtttcatgataagtaagttgaactaaaccatgacacttattctgaaacagagggagtaggttgcaattcaacacgaactgcagtcaacaaacaagcaaaactagggttgaaggaactcagaaatgcttcttgctcatacaagagatctctgagagaaaaaaagtaatagacaaaaaggatgaagggaaaacccgaaaacaagtcaattacaaatcattgcaagagaacc

SEQ ID NO: 2100 - DNA, 762 bp, Phaseolus coccineus
gcttcttcacctctctctctctctctccccttcaatttttgccctaaaaccctggctgccgttgtggtggccgccgccgaagaaggagaatagagaagcaaacggattcatacaattcgattcaccatgaagctcgttaggtttttaatgaagttgaacaatgaaaccgtgtccattgaactcaagaatggcactattgttcatggaaccattacaggtgttgatatcagtatgaacactcatttgaaaacagttaaactgactctgaaagggaaaaatccagtgactctggatcatctcagtgtgaggggtaacaacattcgatactatatccttcctgacagcttaaatctcgagaccttgcttgtggaagagacacctaagatcaaaccaaagaagccaactgctgggaaacctttgggccgtggacgagggaggggccgtggacgtgggcgtgggcgtggtcgttgagttctgccctccatttctgtggcatgcagttataaactttgtcgcaagattttctgggtgttttcaggaacttccgaggagcgtaattgtcaatttattcctgttattttcttgcaagagctatcatgttctagtgtacaatcaccttcatgctgaaactgatgtaacctgaattacctattgccttatagttgtagtgaggaacccttcattcagcagtatgacaaattgttcatgactcaatggttatacttacacagtaatagcccagagtgctatgagttgactacg

SEQ ID NO: 2101 - DNA, 830 bp, Theobroma cacao
cgtcgttttcgtaaactcataaacttaaaaagggcctttttagcagcggcccgatccctaaaacccctccacagcaaccctggcactggcaacaaacgggtacctctccacccgcttccttccgactggctctctcgcctttgcttgcttctagccctacctcgcttcccccttctcaacatgaagctcgtcaggtttttgatgaagttgaacaacgagacggtgtcgattgagctcaagaacggaaccgttgttcacggcaccatcacaggtgtggatatcagtatgaacacgcatctgaaaacagtgaaacttacattgaagggaaaaaatccagtgagcttggatcaccttagtgtgaggggtaacaatattcgctactatatcctacctgatagcttaaatcttgagacattgctggttgaagagacacctagggtgaaacccaagaagccaacagctgggaggcctttgggacgcggtcggggtcgtgggcgtggacgtggacgtggtcgaggccgttaaatatgttgccctcctttcaaatttttgggacagctggatgcgtagacacctttgttgtagggagaattggccgttgatgctaatggatattaaagttgtattggtattttacttttctgtgtgattattatcctttgtttgggtggcttaatcgtgaattctgggattacaaccatcggataacttgatctaaagctgatagctgagcatatgatctattcctttgtccacttgttgcttttgaaaaagagaaatagtaaaaataggaacgcggacatggattgtcataaacctagtcttgaagt

SEQ ID NO: 2102 - DNA, 955 bp, Citrus sinensis
gtgcagcacaacgttcccgcttcctagtagcagagaatcttcttctctccgcttttgcttcaaagccctagctttcgtcttgctcaccaaaatgaagctcgtcaggttcttgatgaagttgaacaatgagaccgtgtcgattgaactgaagaacggaaccattgttcacggaaccatcacaggtgtggatatcagtatgaacacacatttgaaaacagtgaaacttacgctgaaggggaaaaatccagtgaacttggatcacctaagtgtgaggggtaacaatatccgttattatatccttcctgacagcttgaatcttgaaacattgctggttgaagagacacctagggtcaagccaaagaagccgactgctgggaggccggtgggacgtggtcggggccgtggacgcggtcgcgggcgtggccgtggtcgttagatatgttgcactggttataatttttggagcacctggtcatgtaaacatctttgttgtaggagtgtgtggggacatggaaaggagtgatgttatcttttaatattgttccaccagggtgacttgatctagaattcgaagcttcactcctttgtttttgctttcttataatggtacccaaaaaaaaaaaaacaagacaaaaaaaaaaaacaaaaaacaagacttcaaaactcttcaaaccacccctaaccttaaaacaagggggggggcccttaaaaagaaccaagcttactcacccgggggttgcacaccccttaagttcttctaaaggggccccccaattttatttccggggcgcgtgtttataacccgccgggatgggggaaaacccgggggttatcccactttaatcccccttggcaacaactccccccttttcccctgcgggggaaaaaacaaaaaaaaggcccccccctattccccctccccccaagggtggggccccctcagtaatggggagag

SEQ ID NO: 2103 - DNA, 996 bp, Citrus clementina
acagagtgcagcacaacgttcccgcttcctagtagcagagaatcttcttctctccgcttttgcttcaaagccctagctttcgtcttgctcaccaaaatgaagctcgtcaggttcttgatgaagttgaacaatgagaccgtgtcgattgaactgaagaacggaaccattgttcacggaaccatcacaggtgtggatatcagtatgaacacacatttgaaaacagtgaaacttacgctgaaggggaaaaatccagtgaacttggatcacctaagtgtgaggggtaacaatatccgttattatatccttcctgacagcttgaatcttgaaacattgctggttgaagagacacctagggtcaagccaaagaagccgactgctgggaggccggtgggacgtggtcggggccgtggacgtggtcgcgggcgtggccgtggtcgttagatatgttgcactggttataatttttggagcacctggtcatgtaaacatctttgttgtaggagtgtgtggggacatggaaaggagtgatgttatcttttaatattgttccaccagggtgacttgatctagaattcgaagcatcactcctttgtttttgctttcttataatggtacccaaaaaaaaaaaaaaaaaagactctgattaattagcgtgtgatctaatacttattgaggaaatcttaacaggcaaatagctttcggtgtggcacttgccaaggattgttatcccttaccggagcacttaaataccatagcacaaattgggcacggcttatttagttaactcataaatgtctagaaagttattgtagtttttgttaaatgttttgttctaagtgcgtgggctacgcattttactgtgatctgcatgactggaaaaattgaactgagctgactgtatttattatgtctgcacgtagtctttaattttgtgagatttttcttatcaattaagtaataccctgtatatcttgaagaagcaaatcaaatgttcag

SEQ ID NO: 2104 - DNA, 657 bp, Gossypium hirsutum
gactccgatacctggtagaagcagcacacaggtccatctctgtctcctctctttcccgcttccttcgacttgctttctcgccttttgcttcaaaccctacttctcttctctcttctcaaaatgaagctcgtcaggtttttgatgaagttgaacaatgaaacggtgtcgattgagctcaagaacggaaccgtcgttcacggcaccatcacaggcgtggatatcagcatgaacacccatctgaaaacagtgaaacttacattgaaggggaaaaatccagtgagtttggatcacctcagtgtgaggggtaataatattcgctattatatcctgcctgacagcttaaatcttgagacattgctggttgaagagacaccaagggtgaagcccaagaagccaacagctggcaggcctttgggacgtggtcggggtcgtgggcgtggacgtggacgtggtcgaggccgttgaacatgttgctctgtttccaaatttttgtgacagctggatgtgtaggcagctttgttgtagtgagaatttgtgggcgatgctacgaattttaaaggaattgtattggtgttttactgttctgtgtgattattagcctgggttgaatagcttaatcatgaatccagaggttcaccgctctttcgttttcaaaaa

SEQ ID NO: 2105 - DNA, 760 bp, Vigna unguiculata
gaaaaaacacatagcgcagctacccgcgactcttgtgtttcaaaaccctcactcactcatcgtcttctcttccatcatgaagctcgtcaggtttctaatgaagctgaacaacgaaaccgtttcgattgagcttaagaatggcactgttgttcacggcaccatcacaggtgttgatatcagtatgaatacacatttaaaaacagttaaactaactctgaaagggaaaaacccagttactttggatcatctgagtgtgagaggcaacaacattcgttattatatccttcctgatagcttgaatcttgagacattactggttgaagaggctcctaggatcaagcctaagaagccaactgctgggaagcctttgggacgtggtcggggacgagggcgtggacgtggccgtggtcgtggccgttaaattgcaaattacagaatttgtggcctttggttgtacctttattgtaggaaaattttctaatgagttttaaagacgttgtagaagtgctgttgacctgttaagttagtcatgcagactttgttcacgttgccattttcttgcatcaatgctttgaagttcccttgtataattctccctgttggatcattgtcatatttcaactgagaatttattgcctacatgtgtagttttatggggcaaggtgaaccaataggaattcccgttgatagcccttgttcgtagaggtgattttatgtcaatggaagactttatacgtagtatattaaaaaagaaaaaaaa

SEQ ID NO: 2106 - DNA, 774 bp, Vigna unguiculata
  misc_feature (125)..(125): n is a, c, g, or t
agactctaaatctgaaaaaacacatagcgcagctacccgcgactcttgtgtttcaaaaccctcactcactcatcgtcttctcttccatcatgaagctcgtcaggtttctaatgaagctgaacaangaaaccgtttcgattgagcttaagaatggcactgttgttcacggcaccatcacaggtgttgatatcagtatgaatacacatttaaaaacagttaaactaactctgaaagggaaaaacccagttactttggatcatctgagtgtgagaggcaacaacattcgttattatatccttcctgatagcttgaatcttgagacattactggttgaagaggctcctaggatcaagcctaagaagccaactgctgggaagcctttgggacgtggtcggggacgagggcgtggacgtggccgtggtcgtggccgttaaattgcaaattacagaatttgtggcctttggttgtacctttattgtaggaaaattttctaatgagttttaaagacgttgtagaagtgctgttgacctgttaagttagtcaatgcagactttgttcacgttgccattttcttgcatcaatgctttgaagttcccttgtataattctccctgttggatcattgtcatatttcaactgagaatttactgcctacatgtgtagttttatggggcaaggtgaaccaataggaattcccgttgatagcccttgttcgtagaggtgattttatgtcaatggaagactttatacgtagtatattaaaaaagaaaaaaaa

SEQ ID NO: 2107 - DNA, 906 bp, Vigna unguiculata
gccctaaaaccctggctgccgtcgtggtggccgccgctggagaagtagaatagcgaagcaaacagagtattactctccgattcgtcatgaagctcgttaggtttttaatgaagttgaacaatgaaaccgtatccattgaactcaagaatggcactattgttcatggaaccattacaggtgttgatatcagtatgaacactcatttgaaaacagttaagctaacactgaaagggaaaaatccagtgactctggatcatctcagtgtgaggggtaacaacataagatactatattcttcctgacagcttgaatctcgaaaccttgcttgtggaagagacacccaagatcaaacccaagaagccaactgctgggaaacctttgggccgaggacggggaaggggccgtggacgtgggcgtggtcgtggccgttgagttctgtcctccatttctgtggcatgcagttatatactttgtggcaagattttctgggtgttttcagcaacttctgcggagcgtaattgttaagctattcctgctattttcttgcaatgttctagtgtacaatcatcttcatgccgaaactgatgtaacctgaattacctattgccttatagttgttagtaaggaatcctccattcagcagtatgacaaattgctcatgacttattggttatacataacacagtaaataggccaacgagttgcctaatgaggtttgaactaaatgatggatttccccatgacagattcttaatgtctatttacatgtatgaatggtatttgtgaaatgtcttagtgttgcttgcctccatcgccatactgttacatccgttgaagttaatcatgtaaatctatataataaaccaggaatatactagttgctattttgcgcaaaaaaaaaaaaaaa

SEQ ID NO: 2108 - DNA, 892 bp, Vigna unguiculata
  misc_feature (806)..(806): n is a, c, g, or t
gccctaaaaccctggctgccgtcgtggtggccgccgctggagaagtagaatagcgaagcaaacagagtattactctccgattcgtcatgaagctcgttaggtttttaatgaagttgaacaatgaaaccgtatccattgaactcaagaatggcactattgttcatggaaccattacaggtgttgatatcagtatgaacactcatttgaaaacagttaagctaacactgaaagggaaaaatccagtgactctggatcatctcagtgtgaggggtaacaacataagatactatattcttcctgacagcttgaatctcgaaaccttgcttgtggaagagacacccaagatcaaacccaagaagccaactgctgggaaacctttgggccgaggacggggaaggggccgtggacgtgggcgtggtcgtggccgttgagttctgtcctccatttctgtggcatgcagttatatactttgtggcaagattttctgggtgttttcagcaacttctgcggagcgtaattgttaagctattcctgctattttcttgcaatgttctagtgtacaatcatcttcatgccgaaactgatgtaacctgaattacctattgccttatagttgttagtaaggaatcctccattcagcagtatgacaaattgctcatgacttattggttatacataacacagtaaataggccaacgagttgcctaatgaggtttgaactaaatgatggatttccccatgacagattcttaatgtctatttacatgtatgaatggtatttgtgaaatgtcttagtgttgcttgcntccatcgccatactgttacatccgttgaagttaatcatgtaaatctatataataaaccaggaatatactagttgctattttgcgca

SEQ ID NO: 2109 - DNA, 557 bp, Taraxacum officinale
gttattctcagtttctcactcctgaagctcttcggaaatctctccagcaatgaagctcgtccggtttttgatgaagctgaacaacgagacagtttcaatcgagctgaagaacggaacggttgttcacggaacaatcacaggtgtggatattagcatgaacacacacttgaagacggttaaacttaccctcaaggggaagaatccagtgagcttagatcacctgagtgtgcggggtaacaacatccgatactacatcttacccgacagcttaaatctcgagactcttttggttgaagaaacacctagggtcaaaccaaagaaaccaactgcaggtagacctgtggggcgtggaaggggacgtgggcgcggtcgtggtcgtgggcgaggccgttaattttttctctctattatgacatctggttttgtaaacaactgtattcatggagagtttttgtatgtgatcattatgcgagtttgttcttcccctttatgttcccaaagttaacttgcggttgtagtcaagtatcttttctagggcaaaaaaaaaaaaaaaaaaa

SEQ ID NO: 2110 - DNA, 1327 bp, Eucalyptus grandis
gcgagggggggaagcagcgagccctagagcggtcggatcgaaccgtgtaagaagacgacatcatcagccttccttgcccgctcaaacagagtccgctttctctctctgcttcgcctcgtcttcgctcttggccagtgagccctagcgtccgtcttcttcgcagcgatgaagctcgtcaggtttttgatgaagctgaacaacgagaccgtctccatcgagctcaagaacgggactgtggttcacggcaccatcacaggtgttgatattagtatgaacacacatctcaagactgtgaaactcacattgaaagggaaaaacccagtgactctggatcacctgagtgtgagggggaataatattcgttactacattcttccagacagtataaatcttgagactttattggtggaagagacgcctcgggtcaaaccgaagaaaccaactgctgggagggctatgggacgaggacggggccgtggacgtggtcgtggacgtggacgtgggcgttaagtttgctgtccacagtttcataatttttgtatctctgaggttgtgtagaaactgagggtgttgcaggagagaggtgttggttctctggacttggaaaagcttggcgacactgtactctagtcagagttttatggtagaattcttaaaactgcatctgaagttacttgcaattttcagtctggtattgtggatcaaattgacgaacgtttaattcttcactagcggactagcatttgtcatggtattctagcgaggcctattgggggcattcatttccagaatgatggcctctggtgaagaagtttgccatgaatgtgaaagattggctgttattctgggggaaagctacaaatgcctgccgcttgctcatatcatagtgctatcggaaacagctgttttatgcgccttttcaaaaattctgtcctgatctcaacgcttcttgcgcagcactacatcggccatttatgagtttttgttgttgttcttgtccgatcacttatgttacgaatccgagcgatcatcaagcaagaatattccgcatagaattgatgctcgaagtaacaggacaaattacaatcgaaaatatctagatgagactgcttcgttgcttgtaagccggtcatttggtatcaactgccaggttcgttcgtctcatggttgagggaaatctagaaagcgatcgaagtcgcattctgtcgtcatttacttggtgtaattgctttgatacggtggtaagtaaaagaaagaaagaaccgatacgatcttattcgtgcatacgataattcagtaaataaattatatcagcagtgaacttaat

SEQ ID NO: 2111 - DNA, 734 bp, Euonymus alatus
gtctttgttgggcctaaaaccttcgaaagtgggcaagaagtgaacggcgccgtgctaatgagccctaattatcaccgcaagtaaacctgctgcatcgccttttccctagtggagagatctctcccctcccgctcctcacagtggccgtttgcttgtaaccctagttctttgtattctctccacaatgaagcttgtcaggtttttgatgaaattaaacaacgagactgtatcaatcgaactgaagaatggaactgttgttcatggcacgattacaggtgttgatatcagcatgaacactcatctgaagtctgtgaagcttacactgaaggggaagaatcctgtaactttggaccatcttagtgttagaggaaataatattcgctattacatcctacctgacagtttgaatctcgagactttacttgttgaagagacgcctagagtcaaacctaaaaaaccaactgctgggagagctatgggacgtggtcggggtcgtggacgcggacgaggacgtggccgtggtcgttagatattttttactaaatttccattatgtaaacagcttgtatgagagttgcttggtcgcttaggattgtattcaactttatttctggcgaacagcatctaccctgaggggacttgattaaggattctgaattctcacctggtattaattgcttgaatgccactgaaatggataaagaaaaagaaagtcaggtgcaggtgaatgtgct

SEQ ID NO: 2112 - DNA, 458 bp, Flaveria ramosissima
ccgcttcccctcaaaatttgacaattttttggaaccctagcttctgctcttgcgatttgcgacaatgaagctcgtcaggtttttgatgaagttgaacaacgaaacagtctcgattgagctcaaaaacgggacagttgtacatggaaccatcacaggtgttgatattagcatgaacacacacttgaagacggtgaagttgaccctgaaagggaaaaatcctgtaacccttgaccatatgagcgtgagaggcaataatattcgttactatatacttcccgacagcttgaatttagaaactttgctagttgaagagacacctagagtcaagcctaaaaagccaactgcagggcggcctgtgggacgtggtcgtggacgagggcgtggccgtggacgtgggcgtggccgttagtcatgttattatcttttgttatatgtcggtgtcgagctatgtaggtgta

SEQ ID NO: 2113 - DNA, 955 bp, Humulus lupulus
tcctccattccattctccgtccgtctgagactccaacccatacgttcttgacccgcttcagcctgacctacttcgtttatctctcctatcgtattttagggttttctttcttcgttttcctgttttccaaagttctagcccttgctttaaggatgaagctcgtcaggttcttgatgaagttgaacaatgagactgtgtctatcgaactcaaaaacggcaccgttgttcatggcaccatcacaggtgtagatatcagtatgaatacacatttgaagacagtgaaacttactttgaagggaaagaatccagttacccttgatcatcttagcgtgaggggcaacaatattagatattatatccttcctgacagcttgaatcttgagactcttctggtagaagagacaccaagggtcaagcccaagaagccaactgctgggagggctgtgggacggggacgtggtcgtggccgtggaaggggtcgtggacgtggccgttagatgcattacactgatttcaattctcaaggcacatggttatgtaaaaacacctatgttgtaatgaagaacttattggagatcttttaaggtatcaaaggagtgacagtgttggttacttcatttagttgtctatcctcggtgattttgacatttaatatttcttgcaagtagtgtttagttttggatgttgattcaacgagaattagtactcccaatattttgggtgaccagatggttcatgattcatcagcatgcctattaccaaaatcatccattgatggaatttattagtgatttatcccatacagccatatcaaagttctcgcaatgaccatcccaagactactcaggctctgggtgttgacttaatatttttttgaatgagatatatacttgagatgaatttctgttgtttgtgagatgtagatcgtggttacttgttggatcatagtttttat

SEQ ID NO: 2114 - DNA, 577 bp, Lactuca sativa
cgggggaattggacattttttggaccctagcttctcctcctgcgattcgcgacaatgaagctcgtcaggtttttgatgaagttgaacaacgaaactgtctcgatcgagctcaagaatggaacagttgtacatggaaccataacaggtgttgatatcagcatgaacacacacttgaagacggtgaagttgacactgaaagggaaaaatccagtaagccttgaccatttgagtgttagaggcaataacattcgttactatatacttcccgacagcttgaatctggagacattgctagtggaagagacacctagagtcaagcccaagaagcccactgcagggcggcctgtgggacgtggaagagggcggggccgcgggcgtggacgtggtcgtgggcgttaatcatgtttttctatctatgttatatcttagtcttgagctatgtggaagattttgtattttcatcaacacctcgaatcttacatgatatctatattatctagtagtacccttgcaagatctttacttttattgatgatgtatatttatttaactatcacaccatgaaatgcacttggta

SEQ ID NO: 2115 - DNA, 780 bp, Lactuca sativa
cggcggggatcgttctctcgtgccaagccctaaaacagcaaaaaccctctttcccttcgcgttctccggcaaactgttaatcatcggtctcttctgcattcactccggcaatgaagctcgtacggtttttgatgaagttgaacaatgagacagtttcgatcgagctcaagaacggaactgttgttcacggcacaatcacaggtgtggatattagcatgaatacacatttgaagacagtgaaacttactctaaaagggaagaatccagtgagcttagatcacctgagtgtgaggggcaacaatatccgatactacatccttcccgacagcttaaatctcgagactcttctggttgaagaaactcccagagtcaaaccaaagaaaccaactgcagggagaccggtgggacgtggaaggggccgtggacgcgggcgtggtcgtgggcgaggccgttaatgttaatgttgttgatttagtcggatgttgtagtgatatctggttttgtaaacagctgctgtattcttggagggtttctttgacaactgacattgttatggatgtgatcattttgctgagttttttttttttttggtatgcccccaaaaccaactcgctgctatggtcaagtacaagtatctttctaggataaaacccccttccattagtttgttaattagatttggattcatgatattaagagtataactagcgtgtttactttttaagtgttctatgctttatgcatacatgaataacatgataatgtcacccaagctttgac

SEQ ID NO: 2116 - DNA, 801 bp, Tropaeolum majus
cggccgggggtcgattcaggtttctacatttctcatctcctcctcaccgcgttccaaagatgaagctcgtcaggtttttgatgaaattgaacaatgaaaccgtttcgattgagctcaagaacggaactgtcgtccatggaaccatcacaggagtggatatcagcatgaacacccacttaaagacggtgaaactaacactgaagggaaaaaatccagtgactcttgatcatctcagtgtaaggggtaacaacatccgttattatatcctccctgacagcttgaacctggaaactttactagtagaggagacaccaagggttaagcccaagaaagcaactgctgggagacctgttggacgaggtagggggcgtggtcgtggtcgcggccgtggaagaggtcgctaattgcagttatattgtattcatatttgaagttatctgcgtgtgtgcgttctcactgcactggatatgaattgtaatgcaacaaccatggtgaagtaggcacaattatcaaccattttctgctttccgagttgctattttgtcagattgtgtagcctcgtgttttaaagttgtcagtagaaatgtttttggctaatgaaatgagctgacaatgatatatgttggtagtagttaacaggacttataatgaatttcggtttaattaatgacttccttagataagcataacaaggtagacattttaatcttcacaagcaaaacatccatgtaattctagagagggctaattaagctccctcgcaacaatccttccatgcacactattgaccgacctaatacg

SEQ ID NO: 2117 - DNA, 534 bp, Nicotiana benthamiana
  misc_feature (529)..(529): n is a, c, g, or t
gcacgaggatttcttcagcaacaaaatgaagctcgtcagatttttgatgaagttgaacaacgagacagtatcaattgagctcaaaaacggcaccgttgttcatggaaccattacaggtgtggatgttagcatgaacacacacctgaaggctgtcaaacttacattaaagggaaagaatccagtgacgttagatcacctgagtgtgaggggtaacaacatacgttattacatcctccctgacagcttaaatcttgagactttgctggtggaagaaacacctagggtgaagccgaagaagccaacagctggaaagcctttgggacgtggccgcgggcgtggacgtggtcgtggacgtggtcgaggccgctaaatgcattccagctcttctaatttttgcagtgtgtctatgttaacgtatatgtatggatggagagatttggtcttagttttccagcggaaaagagatcaatctcatgcaacaatatattctggatctttaaaatcagagcatgttattttgttgcaaaanaaaaa

SEQ ID NO: 2118 - DNA, 703 bp, Nuphar advena
agctccagaccttctgtcttttcctcctccaagcgcccaaagaaaacactcctttcaacgatgaagctcgttaggtttttgatgaaactgaacaacgagacggtcaccatcgagctcaagaacgggaccgtcgtccatggaactatcaccggggtggatattagtatgaatacacatctgaagacggtgaaattaaccctaaaaggtaaaaatccggtggctcttgatcacctcagtgtgcggggtaacaatgttcgatattatatcctccctgacagcttgaacctggagactttattggttgaggagacgccaagagtgaagcccaagaaacctactgcagggagacctgttggacgtggtcgtggccgtgggcgtggacgtggtcgtggccgtgggcgttaactctgagctatatgctgtggcaccaatttttgtgctttcaggttcttactcctgccgtttctctacaaagtggatgcctactttggttcgatcagcttgtttttcagactgggacagagtggaatgcctgttatttgtcctgagcatgaacagatctccagttatatgtagagacagaatctggttttccgtgttagaaacttcttttttcagactagaatcaaagttgatgtattgacattcactgtgctgttagtcccttttgcttgaagctggattgcattctcattgctatgct

SEQ ID NO: 2119 - DNA, 651 bp, Avena sativa
gctcgagctcctccgattccgtccgcctccgctcctcctccgggccgccgccaagatgaagctcgtcagatttttgatgaagctgaacaacgagacggtcaccatcgagctgaagaatggcaccaccgtccacggcaccatcaccggtgttgacataagcatgaatactcatctgaagactgtaaagcttacactgaaagggaagaatcatgtgacccttgatcatatcagtgtgagaggaaacaacattcggtattacatcctccctgatagcttaaacctggaaacgttgctggttgaggatacccccagggtcaaggctaagaagccaactacagggaagcctatgggccgtggtcgtggacgcggccgtgggcgtggtcgtggccgggggcgctaagctttatgttctctgctttggaagctcacgcagtgcaagttccacctgctgccttctctgcgagctatgtcgaggaatgtttctgttctgttagaagacatcaaccgaagtaggttttaatgtggaatcatctcgactgtttgacccaagttcttgttcgtaattaacgcgtaatgccttttgtcggggattttacttgcaggacaccagacttctgaaatcctaagtggcatgcttgtgttgttacttgt

SEQ ID NO: 2120 - DNA, 994 bp, Citrus sinensis
acagagtgcagcacaacgttcccgcttcctagtagcagagaatcttcttctctccgcttttgcttcaaagccctagctttcgtcttgctcaccaaaatgaagctcgtcaggttcttgatgaagttgaacaatgagaccgtgtcgattgaactgaagaacggaaccattgttcacggaaccatcacaggtgtggatatcagtatgaacacacatttgaaaacagtgaaacttacgctgaaggggaaaaatccagtgaacttggatcacctaagtgtgaggggtaacaatatccgttattatatccttcctgacagcttgaatcttgaaacattgctggttgaagagacacctagggtcaagccaaagaagccgactgctgggaggccggtgggacgtggtcggggccgtggacgtggtcgcgggcgtggccgtggtcgttagatatgttgcactggttataatttttggagcacctggtcatgtaaacatctttgttgtaggagtgtgtggggacatggaaaggagtgatgttatcttttaatattgttccaccagggtgacttgatctagaattcgaagcatcactcctttgtttttgctttcttataatggtacccaaaaaaaaaaaaaaaaaactctgattaattagcgtgtgatctaatacttattgaggaaatcttaacaggcaaatagctttcggtgtggcacttgccaaggattgttatcccttaccggagcacttaaatactatagcacaaattgggcacggcttatttagttaactcataaatgtctagaaagttgttgtagtttttgttaaatgttttgttctaagtgcgtgggctacgcattttactgtgatctgcatgactggaaaaattgaactgagctgactgtatttattatgtctgcacgtagtctttaattttgtgagatttttcttatcaattaagtaataccctgtatatcttgaagaagcaaatcaaatgttcag

SEQ ID NO: 2121 - DNA, 711 bp, Carica papaya
tgattttctcctaaaaccctcccctttgcaaaccaacgaatatgaagctcgtaaggtttttgatgaaattgaacaatgaaactgtgtctatcgagctcaagaacggaacagtagttcatggcacgatcacaggggtggatatcagcatgaatacacacttgaagactgtgaagctgacactaaagggaaaaaatccagttactcttgaccatctaagtgtaaggggtaccaacatccgctattatattctccctgacagcttgaacctggaaacattacttgtagaggagacaccaagggtcaagcccaagaagccaactgctgggaggcctgtgggacgaggtcgcggacggggtcgcggacggggacgtggccgaggtcgataactactgtcatctcgtatatttgtaccatttttcacagcatcagctagcgtacaggtgcattacactgggggaactttggaggggtcacatggtctgaaagctaggagtagaagttgatctcctttgtctatgatgagttgcttgtttattagaatgtagggaggtattgttgcttgaaatcttttaaagaaaatgcttattaactaaacaggaagatgatatattagaagatgctgcgctgaaattggaagttcagaataagtagggcttccttcaacttgctatgttatttgggaattgtagacaggcataggattctattaac

SEQ ID NO: 2122 - DNA, 596 bp, Lippia dulcis
ctttcagcttccttgttgcctggacacaaaaccctagttctcctcgggacgatgaagctcgtcaggtttttgatgaaattaaacaatgagacggtgtcgattgagctcaaaaacggcaccgttgtgaacggtaccatcataggtgttgatataagcatgaatacgcatctcaagactgtcaagcttaccctgaagggaaagaatccagtgaccatggatcacctgagtgtaaggggtaataacattcgttattacatccttccagacagtttaaatctcgagacattgttggtggaagagacacctcgagtcaagcccaagaagccaactgcagggcgacctattgggcgtggtaggggtcgtggtagggggcgcggacgtggtagaggccgttaggtataattcattcatcccgatttttgtagcattttgttgtgtcaacatctgtatttgagaattgttggaattttatcgaattttctttgttccaagtcaattctcattgcttgttgagttgtttcttgcttttgatggcctctgaaccgttttgtgatgtttatgatgttccatgagtaacatcattttcagatattatc

SEQ ID NO: 2123 - DNA, 2465 bp, Pinus taeda
attttaatattaagttatttagagtgtaagaggctcaacccagaagtttgaatcggacgctgcattttgttacagaacatctgctaccgctgcattttctcaacgctctgcaagcatgaagctcgtcagatttttgatgaagctgaataatgagacagtctccatcgagctcaagaacggaactgtagtccatggaaccattacaggagttgacataagcatgaacacacacttgaagacagtgaaactaacattaaaggggaaaaatccagtaacacttgaccacctaagtgtgaggggcaataacattcgatactatattttgcctgacagcttaaatttagaaaccctgctggtggaggatacaccgagaatcaaaccaaagaagccaacagctggaaaacctattggacgtggacgtggacgaggtcgtggccgtggtcgtgggcgtgggaggtagttgcaagatgcagtattttcaacaagggatgtgtacttggttgtacaaaatattgtttagcagtgccagtgcattgtttttttacatattcttggggccaccaaacatggatccttccatcaatatcttcacgaatggtggtgttttttatggctcttaatatgttatgggaggtaatatccatggttaatgataatattatattctggtgtttgccaacatcaatgtactcagtaacatttttggcatgtgagagaactattctagcaaaacaaaacacggtaaaattttatggtttgattgcccttctagttttatatctgaggcccaaaaatacttcactctcctctgttttgaggtaaggaatgctcatgtgcacttgaatgagtcattagttatctgaacagaagcattattcttcggaaagaattataggatgcttctgtggcagtaaattttttgttttttaaaatcagaagcttaaaatgtcggtttctgatatctatattataaaaatttgcaatgcattatttagatgaatagtgaattgtccataaatctagataaaggcggctgccctgcaattgcattgtcaaggacaacataaatagaggattcattcattgtttctgccaagccttatttcctctgatactgaaggtgttatatgcatttcaattaataccatggcaatgatatggacattgttggtttctactctgttgatgcttctgcagcctcagattggtcatggatggagaactccagctttgacaccaccagatggtaacagcctgaaactgaaaacaaaggcctacaatggaaagtatgtctatacgtgccagaacctccagtgggttcccgttaaagccactgcaactcttgtcaacatttcggataacacgcagagttttgggaggtactctctggtgtatcgtccaggcaatccagacttcttaggcatgtggtatcttgataacggcggtaacgaaatggctgaatccgggaaatcaatcagcgttgtggcgggtcaaggaatcgcttccgaaccatcagattattcaggcattcctcaggtattggcacaagcatcttaccatcagaactcctacgcagttgcagctcagatctcttatattcaacgcctatttaccaagggagggcttcctcccagcaacaaaaagtgcactggtaaggctaccaaggacgtagtggttcccttccaagccgaattctggttctacacacaagatttcctacctcccacggtgccatcttcagttgcggttccctccaacagccggatggtcatggggttcttctgcaagggagttgcagtgtacacctacaatggcactgcctggcgcagaactgatatccacgggaagctcttcaatgttcctggtgggaactacttaggaacctattatgtgaaacgaacaccagatggaaatggtgggaacttctgcctggagaccataaatccttatgcctggtcagtcactgcaaagatcgaaggtcattccactcaagtcgacccagattctttaccctggtctctattcaatgttactagcagtagcggaaacacaacgctgttgggaccttacaattattttcagatgatcggttgcagaggagggcttccaccgaaagcagaggattccgcaccaaaaggggcaacttacacatcggtcttcaccaatcaattctggatctactctccagcttaacaactctctctcctctgtaatactgcaacaaatgtccatgttcatccatattattatgttaagatcttccttctttctctgttgcgaccagaataagaggtcttttagaccggatattcattgaaataataacaaaatttcgctgaaagggcactattctgtagatggctttcgatgttgagcttttttgggaatggattcaagaatgtccagaagggtatgcatcatgttccatagctccacagaagtgttgtgtactactaagatctaga

SEQ ID NO: 2124 - DNA, 709 bp, Plantago ovata
cggccgggggcctcaacttcattcagctcactgctactctaaaacccttggctcccccttttctctctgctcgtacaaacaaaccctagctcttcgtcgtcctctcgcggcaaacatgaagctcgtcaggtttttgatgaagctgaacaacgagactgtctcgattgagctcaagaacggaactgtcgttcacggaactattacaggtgttgatatcagcatgaacacacatttgaaaacagtaaagcttaccttgaagggcaagaatccagtcaccatggatcacctgagtgtaaggggaaacaacatcagatattacattcttcctgacagcttaaatcttgagactttgcttttggaagagacacccagggtcaagcccaagaagccaaccactggaaaacctatggggcgtggcaggggccgtggtcgtgggcgtggacgtggtcgaggccgttgagattgggtttcaattatatgcaattttttgtagtattttgtcatgtaaacatctgtattaatggataagctgttcctagctgacagttcattttcgcccctatgttaagatcatactgtgttgtggcctagtagtctcagactcttgaacattcgtctgcagttctttcaacgttgttaggatggttgactgaaatctaagtagggattgctgattaagtgtgctaatgcttcaagtattaatggagta

SEQ ID NO: 2125 - DNA, 581 bp, Platanus occidentalis
tgcttcgagcgctagtttccctctctcgccaagatgaagctcgttaggtttttgatgaagttgaacaatgagactgtgtcgatcgagctcaagaacggaacggttattcatggcaccatcacaggtgtggatattagtatgaatacgcatttgaagacagtaaaactgtcattgaagggaaaaaatccagtaactcttgatcacctcagtgtgaggggtaacaacatccgctattatatccttccagacagcttgaaccttgagactttactggtggaggagacacctagggtcaagccaaagaagccaactgctgggagaccaatgggacgtggtaggggccgtggacgtgggcgtggacgtggccgaggtcgctagttatgttgcacttctaccaatttttgcagcatctgcctctgtacaaatgatctctgctttcatggggaaatttagtggaggtgttcatttgaagcctgaaacatggattgctgttgacatttcttttttattagtttcacatgtagtattagcttgttacttaaatgttttgaatggaaattgtttcttaaatcatctggttt

SEQ ID NO: 2126 - DNA, 617 bp, Solanum tuberosum
ccggcgctccttgccctaaaccctacgctgctgtgttttcaatttcttcagcacaatgaagctcgtcagatttttgatgaagctgaacaacgagactgtctcaattgagctcaaaaacggaaccgttgttcatggaaccattacaggtgtggatgttagcatgaacacacatctgaaggctgtcaaaattacgctaaaaggaaagaatccagtgacgttggatcacctgagtgtgaggggtaacaacatccgttattacatcctccctgacagcttaaatcttgagacgctactggtggaagaaacacctagggtgaagccaaagaagccaacagctggaaagcctatgggacgtggtcgtgggcgcggtcgtgggcgtggacgtggtcgaggccgctaaatgcattccagctgctctaatattttgcagtcttgcctatgtaaacatgtgtacggattgagagatttgctcttagtttttcccagtagaaaaaagatggatctgatgcaacaatttattttggatcttgaagtgaggagcatgttatctcgttagcggccgctgaagaaaatactccattcatttagaagaatttctacccaatctgataattcct

SEQ ID NO: 2127 - DNA, 624 bp, Prunus persica
cacagacaagatcccccactctcccgcttcgtttttggttacgcttcaaaaccctaagccctagctgtcgtctctctatcaacaatgaagctcgtcaggttcttgatgaagttgaacaacgagacagtgtcgatcgagctcaagaacggcaccgttgtcaacggcaccattacaggtgtggatatcagtatgaatacgcatttgaagacagtgaaacttacgctgaaggggaagaacccagtgactctggatcatctcagcgtgaggggaaacaacattcgatactatatcctcccagatagtttgaatcttgagactctgctagttgaagagacacctagggtcaagcccaagaagccaactgcagggagacccgtgggccgtggacgtgggcgcggtcgtggtcggggacgtgggcgtggccgttaaagatgtcgcactggttataatttttgtggcacatggttatgtaaacacctttgttgtaggaagaacttatcggtgatcttggagacattaaatgagtttcggtattgcacttttattcgttgtctatccccagtgaaactcccaaaatgttattaagaagttggtaatcgatatgcttttgacatctcatataca

SEQ ID NO: 2128 - DNA, 1198 bp, Pseudotsuga menziesii
tttgaatcgttccctgcattgtattgccgaacatctgccacaactccattgctcaaagctctgcaagcatgaagctagttagatttttgatgaaactgaataatgagacagtctccatcgagctcaagaatggaaccgtagtccatggaaccattacaggagttgacataagcatgaatacacacttgaagacggtgaaactcacattgaaggggaaaaatccagtaacacttgaccatctaagtgtgaggggcaataacattcgatattatattctgcccgacagcttaaacttagaaacactgctggtggaggatacaccaagaatcaaaccaaagaagccaacagctggaaaacctattggacgtggacgtggacgagggcgtggccgtggccgtggtcgtgggcgttagtggcatgttgcaggattttcaatcagtgtacttggttgtacaaaatattgttgagcagtgccattgcattatatttttacatatttcattggggcttccgaacatggatccttccatcaatatcttcatgagtggtagtgttttctatgtttatttatatgttttgggaggtagtatccttgattaatgataatattgtgttgtggtgtttgctaaagtcaaactatgcaccgagtaacaatgatggtacgtgagagaactattctagtgaatcaggacatggtaacttttatggctttgtagcacacattttattttcttagccccagagagtacttcttgatcttgtatgttccgggccctgtagggtatcatcatgtgcatttgaatgtgtcagaagtcatctgaacagaaacattaatcttgcgaaggaattttaggattgcctctgtgggagagctttctgttttttcaagattagaagcttaaaatgtttcagtttctgatacctgtatttcaagttctgtgacacattatttagatgatttatgcagaatttcttttataaaatgttgtgaaagtatcatgttttagtttctgtcaagtttagagaaagtcctcccctctaggaactttgaatttagacagtgtagagctttttattgaggtttcaaagtttctagatcagactatcggacctttggctggcttgaaatttcaaattgaaaggtacatatcttgaggtcgttgtaacaatttgtaattgctaaatatgggtaatgcct

SEQ ID NO: 2129 - DNA, 671 bp, Rhizophora mangle
ggcggtccgatccatacacgcaccgaacagcgcgacgccgttttaaaaaagtaaagcagatgtcgccattaggcttactccggggacaggccgagccctaggagcagcagagagatcgtttcttccacagaagtccgccatctttcctatactttgaaggctgcaatgaagctcgtgaggtttttgatgaagttgaataatgagaccgtctcgattgagctcaagaacggaactgttgttcacggcaccattacgggtgtggatatcagtatgaatactcatcttaagactgtgaaactaacagtaaaaggtaaaaatccagtgactttggatcatctcagtgtgaggggtaacaacatccgctattatatccttcctgacagcttgaatcttgagacattgctggttgaagaaacacccagggtcaaacccaagaagccaactgcggggaggcctgtgggtcgaggtcggggccgaggacgtggaaggggtcgtggtagaggtcgttagtcatgttgcaatggttctaatttttctggcacctatttattttaacaccagtgttgtagggataatttatttaaatttggaacatgaagacaatctgattatatctatttttatttctttgtcttgtcccaactccctatggagaccaggcttcaaattct

SEQ ID NO: 2130 - DNA, 663 bp, Solanum phureja
cggcgctccttgccctaaaccctactctgctgtgttttcaatttcttcagcacaatgaagctcgtcagatttttgatgaagctgaacaacgagactgtctcaattgagctcaaaaacggaaccgttgttcatggaaccattacaggtgtggatgttagcatgaacacacatctgaaggctgtcaaaattacgctaaaaggaaagaatccagtgacgttggatcacctgagtgtgaggggtaacaacatccgttattacatcctccctgacagcttaaatcttgagacgctactggtggaagaaacacctagggtgaagccaaagaagccaacagctggaaagcctatgggacgtggtcgtgggcgcggtcgtgggcgtggacgtggtcgaggccgctaaatgcatcccagctgctctaattttttacagtcttgcctatgtaaacatgtgtacggattgagagatttgctcttagtttttcccagtagaaaaaagatggatctgatgcaacaatttattttggatcttgaagtgaggagcatgttatctcgttgcatcatattgtctgctaacattactttcttatcgctttcgattttgttctgcctcgtcaagttactcaactaaattggtcacttttgcatctactcagaatagagtgac

SEQ ID NO: 2131 - DNA, 932 bp, Nicotiana tabacum
  misc_feature (20)..(20): n is a, c, g, or t
  misc_feature (41)..(41): n is a, c, g, or t
  misc_feature (554)..(554): n is a, c, g, or t
  misc_feature (740)..(740): n is a, c, g, or t
  misc_feature (763)..(763): n is a, c, g, or t
gtggtggtcgtgttcgatcntgcttcgacttaagccctagngtgttcttcaatttcttcagcaacaaaatgaagctcgtcagatttttgatgaagttgaacaacgagaccgtatcaattgagctcaaaaacggcaccgttgttcatggaaccattacaggtgtggatgttagcatgaacacacacctgaaggctgtcaaacttacactaaagggaaagaatccagtgacgttggatcacctgagtgtgaggggtaacaacatacgttattacatcctccctgacagcttaaatcttgaaactttgctggtggaagaaacacctagggtgaagccgaagaagccaacagctggaaagcctttgggacgtggtcgcgggcgtggtcgtggacgtggacgtggtcgaggccgctaaatgcattttagctcttctaattttttgcagtatgtctatgttaacgtatatgtatggatggagagatttgctcttagttttccagcggaaaagagatcaatctcatgcaacaatttattctggatctttaaaatcagagcntgttattttgttgcatcatatggaccactaacattactacccaatctcgttcacttctgctccgcctaaacaaggcagaacaattatggttacttttgcatccggccaggtgcattcctccctttttattttccttactataaactttaagcttttttcactgcattaacctttacccaacctccntagtgctaacacttgaaggaagnaaaaaaggactgttgggacatcggcctgatctgttgagtacagttgttactgaagtaggagaaaggccaaaacatttctatcagtagcatttgtctaattgagttagtgatatagttatctgtagtgtttgcagaccggcacacattttccttcataatagcggccgca

SEQ ID NO: 2132 - DNA, 731 bp, Solanum lycopersicum
gaggtcgtgttcgatctgcgcttcgacttaagccctagcgtctcttcaatttcttcagcaacaatgaagctcgttagatttttgatgaagctgaacaacgagactgtctcaattgagctcaaaaacggcaccgttgttcatggaaccattacaggtgtggatgttagcatgaacacacatctgaaggctgtcaaaattacgctaaaagggaagaatccagtgacgctggatcacctgagtgtgaggggtaacaacatccgttattacatcctccctgacagcttaaatcttgagacactgctggtggaagaaacacctagggtgaagccaaagaagccaacagctggaaagcctatgggacgtggtcgtgggcgcggtcgtgggcgtggacgtggtcgaggccgctaaatgcattccagctgctcttaatttttgcagtgttgcctatgtaaacatgtgtacggatggagagatttgctcttagtttttcccagtagaaaaaagatggatctcatgcacaatttattttggatctttgaagtcaggagcatgttatctcgttgcatcatattgtctgctaacgttacttttgtatcgtgtacaattatgttcttccttgtcaagttactcaactaaattggtcacttcagcatctatactctgagtaaagtgacatagaattatatttggaccaaattgggaattgagataaataaatattaagtttgatg

SEQ ID NO: 2133 - DNA, 727 bp, Solanum lycopersicum
gttcccagacgaggcatataataagacatcacttgtgtattttgaacaacccctggcgctccttgccctaaactaaagccctagattagtgtgttttcaatttcttcagcaagcaacaatgaagctcgtcagatttttgatgaagctgaacaacgagactgtctcaattgagctcaaaaacggcaccgttgttcatggaaccattacaggtgtggatgttagcatgaacacacatctgaaggctgtcaaaattacgctaaaaggaaagaatccagtgacattggatcacctgagtgtgaggggtaacaacatccgttattacatcctccctgacagcttaaatcttgagacgttactggtggaagaaacacctagggtgaagccaaagaagccaacagctggaaagcctatgggacgtggtcgtgggcgcggtcgtgggcgtggacgtggtcgaggccgctaaatgcattccagctggtctatttttttgcagtcttgcctatgtaaacatgtgtacggattgatagatttgctgttagtttttatcctgtagaaaaaagatggatctcatgcaacaatttattttggatctttgaagtcaggagcatgttatctcgttgcatcatattgtctgctaacattaatttcgtttcccgttcaatttagtcaccttatgcatgttttgagagttgagtcacatttagtgtcgattgagaatttagctcct

SEQ ID NO: 2134 - DNA, 586 bp, Tripterygium wilfordii
cttcgtattgtggagttcttcgtattgtctccacaatgaagcttgtcaggtttttgatgaagttaaacaacgagactgtgtcaattgaactcaagaatggcactgttgttcatggcacgattacaggtgttgatatcagcatgaacactcatctgaagtccgtgaagcttacactgaaggggaagaatcctgtaactttggatcatcttagtgttaggggaaataatattcgctattacatcctacctgacagtttgaatctcgagactttacttgttgaagagacacctagagtcaaaccaaaaaagccaactgctgggagggctatgggacgtggtcggggtaggggacgcggtcgaggacgtggtcgtggccgttagatgttgttgaactaagtttcaatttgtgtgacatggttgtgtaaacagctcgtatgagagttgcttggtcacgtaggattgtattcaacgtacttctggtgaacaaacacttaccttgagggggacttgattaaggattctgaattctcacctggtattttgttgcttgaatgccactgaaagaaaaggtgaggtgcaggtgaatg

SEQ ID NO: 2135 - DNA, 976 bp, Triticum aestivum
ggcacgagggttttgccctcccgctccgagaaagcaaacagctcgagctcctccgattctgtccgcctccgttcctccgcatcttcccggccgccgccaagatgaagctcgtcaggttcttgatgaagctgaacaacgagacggtcaccatcgagctcaagaacggcactaccgtccacggcaccatcaccggtgttgacataagcatgaatactcatctgaagaccgtaaagctcacaatgaaagggaagaatcctgtaacccttgatcacatcagcgtgagaggaaacaacattcggtactacatcctccctgatagcttaaacctggaaacgttgctggttgaggatacccccagggtcaagtctaagaagccaactacagggaagcctatgggtcggggtcgtggacgcggccgtgggcgtggtcggggccgggggcgctgagctttattgttccctgctttggaagctcgtgcagtgcaagtccctacagcgtaacctgcttcctctgcgagctatgtcgaagaatgtttctgttctgttagaagatgtcaatctaagtacgtgttgatgcggaatcatctcgcctgtttgacctatgttcttatatattgttcgtaatgcattttctcgggaatttcacttgcaggcctccagacttttgaaatgctaagtggcatcctgtgccgttacttgttaccctggaattcttgcccttgtgcttttgcgtagcagtaagttgtgtttgagtagaagctgaccctttttcttctgtggcaatgcttgagattaaactgggctgggggcactggcatttcagattacgcattgatatattcatctgaatcatgcacctgtccacaattctcgcatgtatgctgcgatgttaggcttgatcactttctgtgatttgattttctgcccggtgtggtttagtttcctataagtttggaacaaattgaatcatcattttt

SEQ ID NO: 2136 - DNA, 1338 bp, Triticum aestivum
agaagcgcagtggcctcacgacttccaccgagcccaaagacgtaaagcccggcccaagtgaaccgactcaccagcaaccagccaggtcagccttcaaactagggttttgccctcccgctccgagaaagcaaacagctcgagctcctccgattccgcccgcctccgttcctccgcatcttcccggccgccgccaagatgaagctcgtcaggttcttgatgaagctgaacaacgagacggtcaccatcgagctcaagaacggcactaccgtccacggcaccatcaccggtgttgacataagcatgaatactcatctgaagaccgtaaagctcacaatgaaagggaagaatcctgtaacccttgatcacatcagcgtgagaggaaacaacattcggtactacatcctccctgatagcttaaacctggaaacgttgctggttgaggatacccccagggtcaagtctaagaagccaactacagggaagcctatgggtcggggtcgtggacgcggccgtgggcgtggtcggggccgggggcgctgagctttattgttccctgctttggaagctcgtgcagtgcaagtccctacagcgtaacctgcttcctctgcgagctatgtcgaagaatgtttctgttctgttagaagatgtcaatctaagtacgtgttgatgcggaatcatctcgcctgtttgacctatgttcttatatattgttcgtaatgcattttctcgggaatttcacttgcaggcctccagacttttgaaatgctaagtggcatcctgtgctgttacttgttaccctggaattcttgcccttgtgcttttgcgtagcagtaagttgtgtttgagtagaagctgaccctttttcttctgtggcaatgcttgagattaaactgggctgggggcactggtatttcagattacgcattgacatattcatctgaatcatgcacctgtccacaattctcgcatgtatgctgcgatgttaggcttgatcactttctgtgatttgattttctgcccggtgtggtttagtttcctataagtttggaacaaattgaatcatcatttttacttgcaatgtctacacaaaatacagttagatgatgggtgatgttggttccacttctctctttcatcataacgtttgatgctgtggtggcctttttttttttagaacatttatatatcctggaatctctccatcttgtttgttgagacaatgttttactggaatttaactccaaaggcttactatagtcagtaaaagtttctggaatatgtttgcaaaaaaataaaaatagttggtaatagtttcaacctgcccgggcggccgctcga

SEQ ID NO: 2137 - DNA, 745 bp, Lotus japonicus
ggacctcgaccttgtactataaacgccactgtcatttggagttggccctgagcagcgagcgataagcgagtttcctctgcgacagtgtttctcgtcttctcctcttctccgccaccatgaagctcgtcaggtttctcatgaagttgaacaacgaaactgtttccatcgagcttaagaacgggactattgtccatggcaccattacaggtgttgatatcagtatgaatacacatttgaaaacagttaaactaaccctgaaagggaaaaatccagttactttggatcatctcagtgtaaggggcaacaacattcgttattatatccttcctgacagcttgaatcttgagactttactggttgaagagacccctagggtcaaacctaagaagccaactgctggggggaagcctttgggacgaggacgggggcgtggacgtggacgcggccgaggtcgtggtggccgttaatttgcttgttacaatttttggaatttggctttaccttactccctttaatgtagggaagttctatgggaggattttaaagacattgaaggagtgttattgttaagtagtcatgttgactttactaatgtcgctattttcttacaccagtgctttgaagttgtagtgtatatttccttccagataatgcctactatctctgatcagaaagaaactgcctacatgtgtggcttgtgggataagctaaagagacttagaattaatgatcattgcccttggcc

SEQ ID NO: 2138 - DNA, 2262 bp, Zea mays
actcccaagttcaccttcctctgcctgtagatcttctagagtcccgtatacggtttcgtctttcgtgtcccacttccatggcggcggcggcgcagctgcacggatcggctgcggccacggtggcatatcgcgggactcgagcctactcagttccatcctcatgccggtggccgcagtctggttccccgaagctttcgatttctacaagtggagtcagtatgaagccatttggctttgctgctaaactttcaacaaaatgtgcaaatgagaatgctcgagttgaagaattagatttgaggtcagaccagatgaaggaattacaggtggaggagcaggttattccccagaagaggagtgctaaaatccatgacttctgccttgggatcccttttggtggtcttttattctctatggggcttctaggatacatcttctccagaagcaccataagtcttgtcttgggcattgcaccagggctagccactctgctacttggcactctcagtctgaagttctggaggagcggcagatccagcttcctgcttatcttggctcaggcagcaatttctgctttcctggcatggaaatactctcatgcttacttcttgacaaatagactccttccttggggcttctacgcgtcactgagcactgcaatgggttgtttctacgcctatgtgctacttgcgggaggaaatcccccgcctaagaagttggcagccattccaccgcagtaggaagagccgaagagggattcggtttaggatcagctaggttttcattaaagttcagtacaactgggccgacaaaggcccaactaagccgctcgaaccgcttcggcgcctcccacccctcggacagaccagccttcaaactagggtttactcctcccgctccgagaaagcaaacaagcgtcagctccgccggcggcctcgcgctctctcccccgccgcaccttctctacgccaggactgccaagatgaagctcgtcagattccttatgaagctaaacaatgagacggtcaccatcgagctcaagaacggcacggttgtccacggcaccatcaccggtgttgacataagcatgaacactcatctgaagacagtgaagcttacactgaaagggaagaaccctgtaacgctggaccacctcagcgtgcgaggaaacaacatccgctattacattcttcctgacagcttaaacttggagactttgctggtagaggaaacccctagggttaagcctaagaagccgactacaggaaagcctttggggcgtgggcgcggccgtggtcgtggacgtggtcggggacgggggccgccacgctgacaggtttcccctgctgtgggctctcttgcctgacaagttccctgtacgatgtaacctctttcccccgcacgctgtgtgaaagaaccgttgcattgttacccttctgatgaacgtggactgaaatatctcaatctcaagtggttcttgtgaaatcaaccatgtctatttggtctaccattcgtgtgtgtcttagggtttacactgtagttaactcgtgatgtctttcccctggcatacataaatggtgccgcagaacttcggatgttctaggttgtatgcttgtttcacatggggattgttgatctggagatatgccttgcagtcgtgtctgcctctatttgatcttttagctctgcttgaagctgaattcccgtcgaccggagatactgattttgctgaagatctacagcttgctctcatacgacgccctgttggcatgcattgtgttttctgatgtgctgacaaacatgctcggtaaaggatgttttgtttgccggagatactgatcatctggagctgccgattctttttgtctcaggatgttttgtttgcaacgtttatagagttggtcaaaatagacaagatcagcttacgaacagagatgaagatattagtggcgtgatattgatgtgattgtacatagtaaacagtcacctgtagctccctgtgctgtgtatactctgggcccatcttccaccttgatttctcccactttggtcggcgtcacctagcgatatagatggccaaacgggccggcacggcccgacccgacacggcccgacaggcccggctagcgaagcgtgccgtgcccagatgggccggcgtgccgcggcccaggcacggcccgtgagcctgttagtcgtgccgggccggcccggtggcactatggcctatctgagtatattgtagaatttagcaaaaaatgtgtagtt

SEQ ID NO: 2139 - DNA, 747 bp, Phalaenopsis aphrodite
ggaagcactaggtttggagctcgggcgaattgttcttgggaagggttttggcttcggttcgcagaaccagatcggaaccctagcgccgcctatcacacgcgaggatgaagctcgtcaggtttttaatgaagctcaacaatgagaccgtctcgattgaactcaagaacggtactgtggttcatggaacgataacgggtgtggatatcagtatgaatactcatctgaagactgtgaagcttacactcagaggtaaaaatcctgttactcttgatcacctgagtgtgcgtggcaacaatattcggtacgtattcttcccgacagcttgaatctggagacgttattggtggaggagacgcctcgggttaagccgaagaagcctactgctgggaggccaatgggtcgaggtcggggtcggggtcgtggccgcggtggtcgtggccgcggccgttaactccattaacagcattagacacttgaaccaccttttttttttcttttctctctccctaaagaggcttaggaagtaatgggaacttgatccgaatttataaccaaggagaaaccaggcttctgcgtacatctcttgaatacataatgttgtcctttagtcagactgttacggtaacgctcagttggaaatgttaaaacatgatagaactgtgcttggttagtaggatgcaactttgcactcgtgtttgatcatggtatgttggagaaattcgagatttagacagcttcattgtgttt

SEQ ID NO: 2140 - DNA, 1042 bp, Brachypodium distachyon
atcagccaccgtcctcggccagatcagccttcaaactagggttttgcccctcccgctccgagaaagcaaacagctccagctcctacgattccggccgcctcctctcctgcttctcctcctcgacgccgccgccaagatgaagctcgtcaggttcctgatgaagttgaacaacgaaacagtcaccatcgagctcaagaacggcaccaccgtccacggcaccatcaccggtgttgacataagcatgaatactcatctaaagacggtaaagcttacattgaaagggaagaatcatgtgacccttgatcatatcagtgtgagagggaataacattcgttattacatcctccctgatagcttaaacctggaaactttgctaatcgaggatacccccagagtcaagtctaagaagccaactacaggaaagcctatgggtcggggtcgtggacgcggccgtgggcgtggaaggggccggggacgttgagctttacctttcgcagctttggaagctcgtgcagcgcaaacctctacactataacctactgctttccctgcgagctgtgttgaagaatgttgccgttctgttaaaaatcaatctagtaggtctcggtgtggaatcgtctcaactgtttgaccaatgttcatgtctatgttagtatcttttgttcctaatcaatgcgtaatgtcttgcccaggaattctacttgcgggactccacaaaccctttgaaattctaagtggcatggttctgttgttacagtacttgttaccctgtggaattcttactcaagggttatgactagcagtaagttgtgttgaattcaagctgacccattttgttttgcagcaatgctttaaattaaattgggtagcgaccatctatttgcagatcacattttgataggatgctagattttatcttttttgtgtttggattatcttgatgctgctgagcacgtctgttctagaatctgattccatggtttggaattctttttcccgataaccaaagctttattgatatcaaagacgaggctttccataa

SEQ ID NO: 2141 - DNA, 1340 bp, Cannabis sativa
agggtggttttgttatattattttgccctagaatatggtgttctcttctaaaatcagtgaactagtgaagcccaaatgcataactcgggtttgcatttcaaaacccctatctatataaaccctttctctttccccgctcctcgtttctcctccatttccatctccgccgtctgagactccgctcatcgttctcgccgctagtcctggtttcgcttctccctactattgtgttttagggttttatttcttcattttcctgctttccgaagttctatccctagctttaaagatgaagctcgtcagattcttgatgaagttgaacaacgagactgtgtctattgaactcaaaaacggcaccgttgttcatggcaccatcacaggagtggatatcagtatgaatacacatttgaagactgtgaaacttactttgaagggaaagaatccagttacccttgatcatcttagcgtgaggggcaacaatattagatattatattcttcctgacagcttgaatcttgagactcttctggtagaagagacacccagggtcaagcccaagaagccaactgctgggagggctgtgggacggggacgtggtcgtggccgtggaaggggtcgtgcacgtggccgttagatacattacactaatttcaattctcaaggcacatggttatgtaaaaacacctatgttgtaatgaagaacttattgcagatcttttaaggtaccaaaggagtgacaatgttggttactccatttagttgtctatcgtgggtgattttgacactaacatttcttgcttgtagtgttaaattttggatgttgattcaacgagaattagtactcccaatattttggctggcagggttcattgatcaacctgccccattaccaaaatcaaccattgatggaatttttagtgatttatcccatacagccatatcaaaagttctcgcaatgaccattccaagactactccagctttggtaattggcttaatatttgtttgaatgaaatgtagatcgtgtctgcttgttagatcatagttttatttttcatttttcaacttccttttctgtgaaacaaagccaagcctaactttttgaagttgacaagtatgaagctgcatttataatagctagttacttgccaatagcagtagatatgttacactatctttttataactcacagtgaatttgctttttaacattaatgtttggtagaggggagagaaggagggagggggaggggtggagagagggattggaaaatcctcttgtttggcaagaggaagagaagaagtgagaggagagatggaaggagaaggtctccctttaaac

SEQ ID NO: 2142 - DNA, 660 bp, Allium cepa
agggttttgtttccattctctgtcgctgtgaatttttccttttactatgaagcttgttaggtttctgatgaagctgaacaacgagacggtttccatcgagctcaagaatggcactgttattcacggaactattacaggtgttgatattagcatgaacacacacttgaagacagtaaagctgactttgaaagggaaaaacccagtaacactcgatcacctaagtgttagagggaacaatattagatactatattctacccgacagcttgaatctcgagactttgcttgttgaagaaacacctagggttaagcctaaaaaggcaaccgctgggaaaaccgttggtcgtgggagaggcagaggacggggtcgtggtcgtgggagaggccgttaatttgttgtctgtgttctgtgcactttgtttatgtaacgatgaaccttgcttaaagggagtgttattaactaagaatggctatgtattgggcagtaatctagtcctgtattttgatggttttacaaggcttagtttgctgatttgcatgcatggaatgttctatattgcctttggccattgattgtgtttgcagaatgttttattgtggtttattctgattgcgctaaatgtccgctattgctttagttaatttgctgttgaatctctac

SEQ ID NO: 2143 - DNA, 687 bp, Persea americana
ggagacttttggttttgttgcaaaccctagttttcatcatctcctctctctgctttctgctctcaatcaagatgaagctcgtcaggtttttgatgaagctgaacaatgagaccgtttcgatcgagctcaagaacggcaccgttgttcatggcaccatcacaggggtggatataagtatgaacacacatctgaagacagtgaaactgaccctgaaaggtaaaaaccctgtaactcttgatcacctgagcgtgaggggtaacaacatccgatactatatcctccccgatagtttgaaccttgagactttattggtcgaggaagcaccgagggtcaaacccaagaagccaactgcagggcggtcgttgggacgcggacgtgggcgtggtcgtggtcgtgggcgtggaagaggccgctagttgtattgcatattgcagtttttgcggcacctacttgtgtacaaataggcctgcacccgaagagagtttagttgagctccttgttgtttagagcaatgaagaagcaggactgttgtttatcttagcttgaaagatccatgaatgaagtttagctttccttttacatgtctaagggaaatatttgcttgatttggacatctacatggagacctttttcctaatgctaaaacctagatttgacgctgaaaaaaaaaaaaaaaaggaccgcctc

SEQ ID NO: 2144 - DNA, 641 bp, Phaseolus coccineus
  misc_feature (368)..(368): n is a, c, g, or t
  misc_feature (378)..(378): n is a, c, g, or t
  misc_feature (430)..(430): n is a, c, g, or t
  misc_feature (525)..(525): n is a, c, g, or t
  misc_feature (630)..(630): n is a, c, g, or t
  misc_feature (636)..(636): n is a, c, g, or t
  misc_feature (638)..(638): n is a, c, g, or t
ggcgactcttgtgtttcaaaaccctcactcagtcactcactcaccgtcttctctcccaccatgaaactcgtcaggtttctcatgaagctgaacaacgaaaccgtttcgattgagcttaagaatggcactgttgttcacggcaccattacaggtgttgatatcagtatgaatactcatttaaaaacagttaaactaactctgaaagggaaaaacccagttactttggatcatttgagcgtgagaggcaacaacattcgttattatatccttcctgacagcttgaatcttgagacattactggttgaagaggctccaaggatcaagcctaagaagccaaccgctgggaagcctttggggcgaggtcgggnacgagggcgnggacggggccgtggtcgtggccgttaaattgcaaatcacagaatttgtggcntttggttgtacctttattgtagggaaattttctgatgagttttaaagacgttgtagaagtgctgttgacctgttgttatgttagtcatgcagacnttgttcacgttgccattatcttgcaagttcccttgtataattctccctgttggataattgtcatatttcaactgagaatctgcttatatatgtgtagttttatgnggcccncnaaa

SEQ ID NO: 2145 - DNA, 1019 bp, Brachypodium distachyon
agccaccgtcctcggccagatcagccttcaaactagggttttgcccctcccgctccgagaaagcaaacagctccagctcctacgattccggccgcctcctctcctgcttctcctcctcgacgccgccgccaagatgaagctcgtcaggttcctgatgaagttgaacaacgaaacagtcaccatcgagctcaagaacggcaccaccgtccacggcaccatcaccggtgttgacataagcatgaatactcatctaaagacggtaaagcttacattgaaagggaagaatcatgtgacccttgatcatatcagtgtgagagggaataacattcgttattacatcctccctgatagcttaaacctggaaactttgctaatcgaggatacccccagagtcaagtctaagaagccaactacaggaaagcctatgggtcggggtcgtggacgcggccgtgggcgtggaaggggccggggacgttgagctttacctttcgcagctttggaagctcgtgcagcgcaaacctctacactataacctactgctttccctgcgagctgtgttgaagaatgttgccgttctgttaaaaatcaatctagtaggtctcggtgtggaatcgtctcaactgtttgaccaatgttcatgtctatgttagtatcttttgttcctaatcaatgcgtaatgtcttgcccaggaattctacttgcgggactccacaaaccctttgaaattctaagtggcatggttctgttgttacagtacttgttaccctgtggaattcttactcaagggttatgactagcagtaagttgtgttgaattcaagctgacccattttgttttgcagcaatgctttaaattaaattgggtagcgaccatctatttgcagatcacattttgataggatgctagattttatcttttttgtgtttggattatcttgatgctgctgagcacgtctgttctagaatctgattccatggtttggaattctttttcccgataaccaaagctttattgatatc

SEQ ID NO: 2146 - DNA, 729 bp, Manihot esculenta
gacctcgtgcagacttcacttcaaaggtcccgtcccctccctcccgctttctttgattagcctttactgtgcttcttcaaaccctagatttcacattcctcgtccaaaatgaagcttgtcaggtttttgatgaagttgaacaacgagaccgtgtcaattgagctcaagaatggaaccgttgttcacggcaccattacaggtgtggatatcagtatgaatactcatctgaagactgtgaaactaacactgaaggggaaaaatccagtaaacttagatcatctcagtgtgaggggtaacaatattcgatattatatccttcctgacagcttgaatcttgaaactttgttggttgaagatacacctcgggtcaaacctaagaaaccaactgctgggaggcctttgggacgtggtcggggccgtggacgcggtcgtggacgtggtcggggccgttagtagggttgcaattattctaatttttgggcatctagttatgtaaacacctatgttgtaaggataatttgttggtagagaaagaaacatgaagagagtgttatttctattttgttgctctgtttgccttagaggctaatttgcggatttgaggcttttctccttggttgaatttctatctagtgttagcagcaagttggaaaatgatgagttcatgacatattattgctcgttgtcttttgttctcaattatgttgcaatgattataattaatagagc

SEQ ID NO: 2147 - DNA, 675 bp, Castanea mollissima
gtcgcgagccctaaaactcaaaaatcgttctctccgtctctgtgtccattgcattgcagcacacacccacacgcagagccctagttcttcgtccacaatgaagctcgttaggtttttgatgaagctgaacaacgagaccgtttcgatcgagctcaaaaacggcactgtcgttcacggtaccatcacaggtgttgatatcagtatgaatacacatttgaagacggtgaaacttacattgaagggaaaaaatccagtgacgctggatcatctcagtgtgaggggtaacaatattcgatattacatccttcctgacagcttgaatctcgagactttactggttgaagagacgcctagggttaagcccaagaagcctactgccgggaggcctttgggacgtggacgtggccgtggacgtggacgcgggcgtggacgtggtggtcgttaagccatgctgcattggtttcaaatttttgtggcacttggttatgtaaacaccaatgttgtagggacatgaaaagagtgttatcgctatttcatcttgtattctgagttctatcctttgaaatttcttaaaatatctatcaaagaagtcggtattgataacctcgtgaaactttataaatagaccccattatcgtagaatttcacggtgcatatgttattactcaagccgaa

SEQ ID NO: 2148 - DNA, 642 bp, Gossypium hirsutum
gggggactccgatacctggtagaagcagcacacaggtccatctccgtctcctctctttcccgcttccttcgacttgctttctcgccttttgcttcaaaccctacttctcttcttcattctcaaaatgaagctcgtcaggtttttgatgaagttgaacaatgaaacggtgtcgattgagctcaagaacggaaccgtcgttcacggaaccatcacaggcgtggatatcagcatgaacacccatctgaaaacagtgaaacttacattgaaggggaaaaatccagtgagtttggatcacctcagtgtgaggggtaacaatattcgctattatatcctgcctgacagcttaaatcttgagacattgctggttgaagagacaccaagagtgaagcccaagaaggcaacagctggcaggcctttgggacgtggtcggggtcgtgggcgtggacgtggacgtggtcgaggccgttgaatatgttgctttgtttccaaatttttgtgacagctggctgtgtaggcagctttgttatagtgagaatttgtgggcgatgctacgaattttaaaggaattgtattggtgttttactgttccgtgtgattattagcctgggttgaatagcttaatcaagaatcctgaggttcacc

SEQ ID NO: 2149 - DNA, 706 bp, Cucumis sativus
agaaagaaaagaaagaaatagggacgaaaccgcggcaatctcccaatttcctctcccccgcttcgttgtttgaaaccctacattcttcctttcctctccaatcatgaagcttgttaggtttttgatgaagctcaacaatgagactgtctctatcgagctcaaaaatggaactgttgtccatggaaccatcacaggtgtggatatcagcatgaatacgcatttgaaggctgtgaagctaactctaaagggaaaaaatccagttaccatggatcatttaagtgtgagaggtaacaacatcagatattatatcctacctgacagcttgaatcttgaaactttacttgttgaagagacacccagggtcaagcccaagaaaccaactgcagggaggcctttggggcggggacgagggcgcggccgtggacgtggtcgtggacgtggacgctagatttgatgcagttgtttcaatttttgagacctgtagtgtaaacacttgcattgtagggaaagattatgaattttgggacacgaaaaagtggtattgcaattcactgttcaatctcgtatgtagtttattacaatgctattcggttgcttttcatatgatagatgtagccttgctatgttttctggtgcttgggatctgttaatgatttactctaatattgtcacaatgataaaacgagtatgtctctagattggaatc

SEQ ID NO: 2150 - DNA, 729 bp, Solanum melongena
cggccattacggccggggagatatgcaattcttaagagtgaaaaagtgagggcggcccaagttgtgtttcttgaataaccctggcgtacctagtcggctagccctaaaccggaggtggtgttcgatctactctgtgcttcgacttgagcgtcttcaatttttcagcaacaatgaagctcgtcaggtttttgatgaaactgaacaacgagagtgtctcaattgagctcaaaaacggcacagttgttcatggaaccattacaggcgtggatgttagcatgaacacacatctgaaggctgtcaaaattacgctaaaagggaagaatccggtgacattggatcacctgagtgtgaggggtaacaacatccgttattacatcctccctgacagcttaaacctcgagacgctgctggtggaagaaacacctagggtgaagccgaagaagccaacagctggaaagcctatgggacgtggtcgtgggcgcgggcgtggtcgtggacgtggtcgaggccgctaaatgcattccagctgctctaatttcttgcctttgtaaacatatgtacgaattgagagatttgctgttagtttttccagtgggaaaaagatgcgacaatttattttggatctttgaagtcggagcacgttatctcgttggtctgctatctttactttcctatgtcgttcaattttcttctgcctaggcaagtcgctggactacattggtcactttt

SEQ ID NO: 2151 - DNA, 632 bp, Solanum melongena
acgagcatttggcccaagtgaataaccctggtcggctagccctaaactggaggtggtgttggatcttcgagttgagcgtcttctgcaacaatgaagctcgtcaggtttttgatgaaactgaacaacgagactgtctcaattgagctcaaaaacggcaccgttgttcatggaaccattacaggcgtggatgttagcatgaacacacatctgaaggctgtcaaaattacgctaaaagggaagaatccggcgacattggatcacctgagtgtgaggggtaacaacatccgttattacatcctccctgacagcttaaacctcgagacgctgctggtggaagaaacacctagggtgaagccaaagaagccaactgctggaaagcctatgggacgtggtcgtgggcgcggtcgtggtcgtggacgtggtcgaggccgctaaatggctctaatttcttgcctttgtaaacatatgtacgaattgagagatttaccgttagtttttccagtgggaaaaagatgcgacaatttattttggtcacttttacattgggtctgtttgttgcagtattacttttaagcttcttgctgcattaaccttaatcaaatttgcaatgttcaaggacaaaagtatttggt

SEQ ID NO: 2152 - DNA, 457 bp, Fraxinus spp
ggttcctcgtacgcggtccgggggtccgctttccgttagtctacgtttctaacttccaatttttggaaccctagccggtggtagctactccccacttccagcaaccatgaagctcgtcagatttttgatgaaattgaacaacgagaccgtctcaattgaactcaagaacggcactgttgttcatggcactattacaggagtggatgttagcatgaatacgcatttgaagacagtgaaactgacactgaaagggaagaatccagttactcttgatcatctaagtgttaggggtaacaccatacgctattacatccttcccgacagcttgaatctggaaactttacttgttgaagagactcctagagtgaagcccaagaagcctactgcagggaggcctttgggccgtggaaggggcagaggacgtggtcgtggtcgtggaagaggccgttaaattatt

SEQ ID NO: 2153 - DNA, 807 bp, Zingiber officinale
gcggaggtaggcggcgtcgagggtcatggcgatgtggacggtgggggcggaggcgcagccggggccgttgcggaaggcaggggcctcgcggaagcgggggagctccgagggggtcgccaatgccatccaggaggcggcgaggagaacgaacaccggcgcgaagatggtggagggaggcattggagtcgtcgtcggcggcgaggcgaaggaggaagagggcggaatttttggaaccctagctcgcgactgccctccgcctcgcctcttctgcgatcgatcgaagatgaaactcgtcaggtttttgatgaagctcaccaacgagaccgtctcgatcgagctcaagaatggcaccgttgtccatggcacgatcatcggtgtggatatcagcatgaacacccacttgaagactgtgaaacttacagtgaagggaaaaaatccagttacactcgatcacctcagtgtgagaggcaacaacattaggtattacatcctacctgacagcctgaaccttgagactttactggtcgaggaaacgcctcgggtcaaaccgaaaaaacccaccgctgggagggctctgggccgtggtcgtggccgagggcgtggtcgcggacgaggccgtggccgttagcagcatcctccacttcatcagaattgtttccgcaactgcttatgcgcaaggtacatcatcggcaacactatttatgcttaaacacagcagacaagactttgttttagctctaaacgactgacgttttgatttgccaaagttctgttcgactggaaatcatcacgaattgtggttttagt

SEQ ID NO: 2154 - DNA, 660 bp, Vitis vinifera
aaaaatcccttaggccgagcggagaaccgtcttccttgctcacaggcctttgctttgctttgagccctagcttttgaatccttttctccgccaacatgaagctcgtcaggtttttgatgaagctcaacaacgagactgtgtcaattgagctcaagaacggtaccgttgttcatggcaccatcacaggtgtggatattagtatgaacacacatttgaagactgtgaaactgactctgaaggggaaaaatccagtgactatggatcacctgagtgtgaggggcaacaatattcgctattatatacttcccgacagcataaatctggagacattgctggtggaagagacgcctagggtcaagcccaagaagccaactgctggacggactatggggcgtggtcggggccgtgggcgcggacgtggacgtggtcgaggccgctagttaccttgtagttcaaatttcttgtcacttctggttatggaaaatcctttcttgtagagaattcattttaggagcgaaaggagcagattgctagtgatatttgtactttacaattaacttgaagtctttgctctgttacttggaggctttaaatgggaaaaagtcatctttttgggttccttggaatttaaaaggatcaatgtgaatttttatgatgagc

SEQ ID NO: 2155 - DNA, 982 bp, Cucumis melo
aataaagtttccccccctcctcgtccgtccttaattctcagtgttgggccctttcttcattttcttcaatctattagaaacaaagaaagaaagaaaagaaagaaatagggacaaccgcagcaatctcccaatttcctctcccccgcttctgttgtttgaaaccctacattcttcctttcctctccaatcatgaagcttgttaggtttttgatgaagctcaacaatgagactgtctcaatcgagctcaaaaatggaactgttgtccatggaactatcacaggtgtcgatatcagcatgaatacgcatttgaaggctgtgaagcttactctaaagggaaaaaatccagttaccatggatcatttaagtgtgagaggtaacaacatcagatattatatcctacctgacagcttgaatcttgaaactttacttgttgaagagacacccagggtcaagcccaagaaaccaactgcaggaaggcctttgggacgtggacgagggcgcgggcgtgggcgtggtcgtggacgtggacgctagatttgatgcagtttcaatttttgagacctgtagtgtaaacacttgcattgtagggaaagattatgaattttgggacacgaaaaagtggtattgcaattcactgttcaatctcgtatgtagtttattacaatgctattcggttgtttttcatatgatagatgtagccttgctatgtttcctggtgcttgggatctgttaatggtttgctctaatatcatcacaatgataaaacgagtatgtctctatctcgttttttacttttaatcccaatagatttggtagtcatgcagtacttgagttggttagaatcaaccccagcttgatttaaaattgatgcgagactcttggtggcgatttcttcttgcttgaaaaataatggagactcctttagagatccacttgccttcttttcacttctcccacaaacaattcaccttgggaagtttag

SEQ ID NO: 2156 - DNA, 677 bp, Nicotiana benthamiana
  misc_feature (31)..(31): n is a, c, g, or t
  misc_feature (475)..(475): n is a, c, g, or t
gcacgagggcaatttgctctctgcttctgtnaaaccctaagcgtctttacatcttcgtcgacgacaatgaagctagtgagattcctaatgaagttgaataatgagacggtctccattgagctcaagaacggcaccgttgttcatggaactattacaggtgtggatgtaagcatgaacacacacttgaaagctgtcaaaattacgctaaaaggaaagaatccagtgacattggatcacctgagtgtgaggggtaacaacatccgctattatatcctccctgacagcttgaatcttgagacgctgctggtggaagaaacacctagggtcaagcctaagaaaccaactgctggaaaacctttgggacgtggtcgcggacgtggccgtggacgtggtcgtggtcgaggccgctaaatgcattctagctcttctaattttttgtgatgttgtctatgtaaacatgtgtgtacggatgaanatatttactgttagtctcgtgcaacaagttgtctctgagcgcttaacatgagacttagaggtgttattctaatgcaactgtggtggttacttgtagctctttctactacattcagtcttgatcctcctggtcgagtcactcaacgatcttagcttcgcatcctttttttcaactaaaaagattttaaaaaaaaccgcagggg

SEQ ID NO: 2157 - DNA, 826 bp, Quercus alba
gctctccctgtctgtgtgtccattgcagcacacacgaacacccatacagagccctatttcttcgtccacaatgaagctcgttaggtttttgatgaagctgaacaacgagaccgtctcgatcgagctcaagaacggcactgtcgttcacggcaccatcacaggtgttgatatcagtatgaatacacatttgaagacggtgaaacttacattgaagggaaaaaatccagtgacgctggatcatctcagtgtgaggggtaacaatattcgatattacatccttcctgacagcttgaatcttgagactttactggttgaagagacgcctagggttaagcccaagaagcctactgccgggaggcctttgggacgtggacgtggccgtggacgtggacgcgggcgtggacgtggtggtcgttaagccaggctgcattggtttcaatttttgtggcacttggttatgtaaacaccaatgttgtagggagaatttattggagcttttagggacatgaaaagagtgttttcgctatttcatcttgtattctgagttctatcctttgaaatttcttaaaatatctatcaaagaagtcggtgttgataacctcatgaaactttataaatagaccccattatcgtagaatttcacggtgcatatgttattactcaagcctttgactttttgtgcccctaccatccccaaaatttttttctaccattcgtacttggcttcgtttaaaccacagggtcccactaacttggttacattttgtcctgaaattgatcctgcttgtttggtcaattatgtttatgtatcctttttccctagttg

SEQ ID NO: 2158 - DNA, 613 bp, Petunia hybrida
tttttttttgaataaccgtggcgcttctttgccctaagccgaagttgggttcgacttaagccctaatatttgttcttcaatttcttcagcaacaatgaagctcgtcagatttttgatgaagttgaacaacgagactgtatcaattgagctcaaaaacggtactgttgttcatggaaccattacaggggtggatgttagcatgaacacacacctgaaggctgtcaaacttacactaaagggaaagaatccagtaacgttggatcacccgagtgtgagaggtaacaacatccgctattacatcctccctgacagcttaaatctcgagacactgctggtggaagaaacaccaagggtgaagccaaagaagccaactgctggaaagcctttgggacgtggtcgcgggcgtggccgtggacgtggtcgaggccgaggccgctaaatgcattccagctgttctaattttttgcagtattgtctatgtaaacgtatgtgtatggatggagattggagagatttgctctaaattttcttgtggaaaaaagatcggtgtcatgcaagaatatattctggatccataaaactaagcgtgtaatttcgttgtatcgtatgggct

SEQ ID NO: 2159 - DNA, 617 bp, Petunia hybrida
ggggaattggaagagaaatttgctctgctaaaccctagcgtttaattttttccctcagcaactatgaagctcgtcagacttttgatgaagctgaacaacgagaccgtctcgattgagctcaagaacggcaccgttgttcatggaactatcacaggtgtcgatgtcagcatgaacacacacctgaaagctgtcaaactcacattaaaaggtaagaatccagtgacattggatcacttgagcgtgaggggcaacaacatccggtattatatcctccctgacagcttgaatcttgagactctgctggtggaagaaacacctagggtgaagcctaagaagccaactgccggaaaacctttggggcgtggtcgtgggcgtgggcgtggacgtggacgtggtcgaggccgctaaatgtgttctagttgtaatttcttgtgattttgactatgtaatcatgtgtgtatggatggagataattactcttagttttccagccaggtatattgatctcatgcaacaagttgtcccggatcattaacatgagtattaagagttattctgtgttgcaactggggtgtttacttatagctctttcatactgcattcagttctgatctgcc

SEQ ID NO: 2160 - DNA, 870 bp, Phalaenopsis aphrodite
ttggtcggaagcactaggtttggagctcgggcgagttgttctcgggaagggttttggcttgggttcgcagaaccagatcggaaccctagcgccgcctctcactcgcgaggatgaagctcgtcaggtttttaatgaagctcaacaatgagaccgtttcgattgaactcaagaacgggactgtggttcatggaacgataacgggtgtggatatcagtatgaatactcatctgaagactgtgaagcttacactcagaggtaaaaatcctgttactcttgatcacctgagtgtgcgtggcaacaacattcgatacgttatacttcccgacagcttgaatctggagacgttattggtggaggagacgcctcgggttaagccgaagaagcctactgctgggaggccaatgggtcgaggtcggggtcgtggccgtggccgtggtggtcgtggccgcggccgttaactccattaacagcattagacacttgaaccacctttttttttcctctccctaaagaggcttagcaagtaatgggaacttgatcccagtttattaccgaagagaaatcaggcttctgcgtacatctcttgaatacataatgttgtcctctagtcagactgttacggtaacactcagttggaaatgtattattaaaacacatagaactccccttggttggtaggatgcaactttgcactcttatttgatcatggtatgttggagagattcgagttttagacagcttcattgtgttttagttcgtatttgttgcttcaattcttttgcttttcaagaaatagggatcgcagtgattggtgttgtgcgtttctgtttgtctatttattttaaattcttcttcacagaacgaaaatcc

SEQ ID NO: 2161 - DNA, 942 bp, Cajanus cajan
catagtaacatgaagacaattaatttgtagttgattggaaattcaaaatctgaaaattatccccttaagaccttaaggcttcttcttctcctcatttctcagtctcaccctaatttttgccctaaaaccctgtctgccgtcgcggtggccgcccaagaaagaaagtagagtagttaaccgagtgctcacccccaattcaccatgaagcttgtcaggtttttaatgaagttgaacaacgaaaccgtctcgattgaactcaagaatggcactattgtccatggcaccattacaggtgttgatatcagtatgaacacacatttgaaagcagttaaactaactctgaaagggaaaaatccagtgactctggatcatctcagtgtgaggggtaacaacatccggtactatattcttcctgacagcctgaatcttgagaccttgcttgttgaagaaacacctaggattaaacccaagaaaccaactgatgggaaacctttgggccgtggacgaggacggggccgcgggcgtggtcgtggtcgtggccgttgagttgcatttttcttcatttttgtggcatgtggttgtaagctatgtaacaagaatttctaggtggtttcaggaacttctgagcagcataactattaatttattcctgctattttcttgcaagagctttcatgtttttgtgtacaaccaccttcatgcataaaccgatgtaacatgaattatttattgtcttatagttgttaatgtggaaccgactgttgagcagtatgacaaacgcggctccttattggttattattagttatacataacagtaaataggcccaatagtttcctagtgagtttgaactagatgatggatttcctgatgacacagattcttatgtttatttacatgtatgaatgacaatttcttaaacgtcttatttttgtttgcctc

SEQ ID NO: 2162 - DNA, 600 bp, Pseudoroegneria spicata
gattcttgatgaagctgaacaacgagacggtgaccatcgagctcaagaatggcaccaccgttcacggcaccatcatcggtgtcgacatcagcatgaatactcatctgaagactgtgaagctcacactgaaaggaaagaatcctgttacccttgaccaccttagtgtgaggggaaacagcattcgttattacatgcttcctgacagcttaaacctggagacgttgctggttgaggaaacaccaagggtgaagcctaagaagcctactgcagggaaacctatgggtcgtgggcgcggccgtggtcgtgggcgcggtcgtggcagggggcgctgagctatgttataccttggaaattttgcactgcatgcttgtgtgcagtgtaatcttgtttcttacttgtacggagcaatattcttattagagccaagacgttgatattggctgtacccagctgttcttgatgtggaattatgttgttggtgtttgactgatgttctaaagtgtgctagctttatattgcgattactgtgtcatgattcccatttctatgaactttatttggatgctcgacaattttattcattttctctatttttaacga

SEQ ID NO: 2163 - DNA, 631 bp, Secale cereale
aagctcgtcaggttcttgatgaagctgaacaacgagacggtcaccatcgagctcaagaacggcactaccgtccacggcaccatcaccggtgttgacataagcatgaatactcatctgaagaccgtaaagctcacaatgaaagggaagaatcctgtaacccttgatcacatcagcgtgagaggaaacaacattcggtactacatcctccctgatagcttaaacctggaaacgttgctggttgaggatacccccagggtcaagtctaagaagccaactacagggaagcctatgggtcggggtcgtggacgcggccgtgggcgtggtcggggccgggggcgctgagccttattgttccctgctttggaagctcgtgcagtgcaagtccctacagcgtaacctgcttcctctgcgagctatgttgaagaatgtttctgttctgttagaagatgtcaatctaagcctccagacttttgaaatgctaagtggcatcctgtgctgttacttgttaccctggaattcttgcccttgtgcttttgcgtagcagtaagttgtgtttgagtagaagctgaccctttttcttctgtagcaatgctttgaaattaaactggcatgggggcactgctattgcata

SEQ ID NO: 2164 - DNA, 607 bp, Sarracenia psittacina
gcgtaggtcctcttcttcacagccgacgatgaagctggtcagatttttgatgaagttgaacaacgagaccgtgtcgattgagctcaagaacggaaccgttgttcacggaaccatcacaggtgtggatattagtatgaacactcatttgaagactgtaaaacttacactgaagggaaagaatccagtgaccctggatcacctgagtgttaggggtaacactattcgccactatatccttccggacagcttgaatcttgagactttgttggtagaagagacgccaagggtcaaacccaagaagccaacagcagggcggcctttgggacgtggcagaggacggggccgaggccgtggacgtggccgaggccgttaattacaatggtgtcattgtaatttttgggacattttgttatgcaaaacacctttgttgtgggagtttgtaatttcagattcatgtttatgagctgttttctagactctccttggaatataattccatgaaaaatttcaatttttcttttaattggattactagaatggccttttatttcgccttatgctttcaatttttcttttaaagactagcaaatttaatgcagctatccaa

SEQ ID NO: 2165 - DNA, 2065 bp, Sorghum bicolor
cccaagttcaccttcctgtacctggaaatcttccagagaatcccgttccacggttcccttcgtctttggtgttccatggcggcggcggcgcagctgcacggatcggctgcggccacggcggcatgtcgccggactcgagcctactcagttcgatcctcgtgccggtggccgcagagccttctagctggttccccgaagctttcaatttctacaagtggagtttgtacgaagccatttggctttgctgctaaattttcaaccaaatgtgccaatgagaatgctcgagttgaagagttagatttacaatcagacaaaatgaaggaattacatgtggaggagcatgttattcctcagaagaggagtgctaaaatccatgacttttgccttgggattccttttggtggtcttttattctctatggggcttctaggatacatcttctccagaagcaccataagtcttgtcttgggtattgcaccagggcttgccactctgctacttggtattctcagtctaaagttttggaggagcggcagatccagcttcctgcttatcttggcccaagcagcaatttctgctttcctggcatggaagtactctcatgcttacttcttgacaaatagactccttccttggggcttctacgcttcactgagcactgcaatgggttgtttctatgcctatgtgctacttgccggaggaaatcccccacctaagaagttggcagccattccaccacagtagagagagggattcagtttaggatcagctaggttttcataaagctcaatacaagtgacccaacaaaggcccaactaagccgctcgaaccgcctcccacccgtcggccagatcagccttcaaactagggtttactcctcccgctccgagaaagcaaacaagcgtccgctccgccggctgcctccgcgctttcgccccgccgccgctccttccctacgccttgcccgccaagatgaagctcgtcaggttccttatgaagctgaacaatgagacggtcaccatcgagctcaagaacggcacggttgtacacggcaccatcaccggtgttgatataagcatgaacactcatctgaagacagtgaagcttacactgaaagggaagaaccctgtaacacttgaccacctcagcgtgcgaggaaacaacattcgctattacattcttcctgacagcctgaacttggaaactttgctggtagaggaaacccctaaggtcaagcctaagaagccaactacaggaaagcctttggggcgtggtcgcggccgtggtcgtggacgtggtcggggccgggggccacgctgagctttactgttccctgctgtcggttctcttgcctgatgagtttcccgtacgatgtaacctctttcccctgcacgctttgtgaaagaatgttgcattgttacccttccgatgaacgcggatgaaatatctcatctcagtagttcttgttgtggagctcaccctgtctatttggcgtatcattcatgtcttaggcttacattgtagttaattcgtaatgtctttcccctgacatacatatgagatgccgcagaactttggatatctaaggttgtatgcttgtgttttcacatggggattattgatccggagctatgatttgcagttgtgtctgcctctgatctttagatctgcttgtgaagctaaattcccgttgggctgttggggattgcagatactgattttgctgatgcacttgcatctacaattttctctcatatgacgtgcttgaccagtattaggttttctgctgtataataacgaaatgtgcttggtaaaggaaaagacaaccatgatttctagatattgattcttgtctcaggaattcaggatttgactcttgtctcaggaagtcaggatattttgttttgttaacaaaaaaatgggccattcgtttttctttctaacgtttgcatggttcagagttggtcaaaatagacaagaatagttttggaacagagggatgaaaatattattggcttgacattgaaatgattagacataataaagagtcaccccgtgttttccc

SEQ ID NO: 2166 - DNA, 798 bp, Glycine max
ggtttgtttcaccgaggataggacagtgaggactgagaactactacaatactcaaacgctgttgaagcgaccgacgagtcttgtgtgtgacctcaaaaccctgccgtcagtcaccgtcttctctgccgccatgaagcttgtcaggtttctcatgaagctgaacaacgaaaccgtttcaatcgagctcaagaacggaacagttgttcatggcaccattacaggtgttgatatcagtatgaatacacatttgaaaacagttaaactaactctgaaagggaaaaacccagttactttggatcatctcagtgtgagaggcaacaacattcgatattatatccttcctgacagcttgaatcttgagactttactggttgaagaggctcctaagatcaagcctaagaagccaactgctgggaagcctttgggaagagggcgggggcgaggacgtggacgcggccgtggtcgtgggcgttaagttgcacatcacaaaatttgtggcatttgcttgtacctttattgtagggaatttttcggagagaagttttaaagacgttgcaggagtgctgttgttagttagtcatgcagactttgttcatgttgccattttcttgcatcaataatttgaagttctcgtgtataattccttcctgttggataattgccatatctctcaagtctccactgaaagaaactgcctatgtatgtgtagtttcacaaggtgttaattgaagagtatttttacatatattggatattaaacttgactccatttaagagggagaaagtaagccataaaag

SEQ ID NO: 2167 - DNA, 804 bp, Glycine max
gtgaggactgagcattgctacaatacttataaacgctgttgcagcgaccgacgagtcttgtgtgtgacctcaaaaccctgccgtcagtcaccgtcttctctgccgccatgaagctcgtcaggtttctgatgaagctgaacaacgaaaccgtatcaatcgagctcaagaacggcacagttgttcacggcaccattacaggtgttgatatcagtatgaatacacatttgaaaacagttaaactaactctgaaagggaaaaacccagttactttggatcatctcagtgtgagaggcaacaacattcgatattatatccttcctgacagcttgaatcttgagactttactggttgaagaggctcctaagatcaagcctaagaagccaactgctgggaagcctttggggagagggcggggacgaggacgtgggcgtggccgtggtcgtggtcgttaagatgcacatcacaaaatttgtggcatttgcttgtaccattattgtagggaatttttctgagaagttttgaagacgttgtaggagtgctgttgttagttaatcatgcagactttgttcatgttgccattttcttgcatcaatgctttgaagttctcgtgtataattccttcctgttggataattgtcatatctctaaagtctcttctgaaagaaactgcctatgtatgtgtagtgtcatatgatgaagttataggaattactgatgatagccgttgttcgtagtggttgtgttaattgaagacttttacatatattggatattaaacttgactccatttaagagggaaaaagt

SEQ ID NO: 2168 - DNA, 1209 bp, Picea glauca
ggggaccggttggactcgcccttcgtttatatgaaattctatttaatcacaagcttgttttcaatattcatttttatatgaagttatttacagtgtaagcaagcacaacccacaagtttgaatcgtacccggcgttttgttacagaacttctgctacagctacatttctcaaaactctgcaatcatgaagctcgtcagatttttgatgaagctgaataatgagacagtctccatcgagctcaagaatggaaccgtagtccatgggaccattacaggagtcgacataagcatgaacacacacttgaagaccgtgaaactaaccttaaaggggaaaattccagtaacacttgaccacctaagtgtgaggggcaataacattcgatactatattctaccggacagcttaaacttagaaaccctgctggtggaggacacaccgagaatcaaaccaaagaagccaacagctggaaaaccaattggacgtggacgtggacgaggtcgtggtcgtggtcgtggccgaggccggtagtggcatgatgcagaattttcaacaagggctgtgtacttggttgtacaaaatatcgtttagtagtgccagtgcattgttttttaacatgtttcattggggccagcaaacatggatccttgcatcaatatcttcatgaatggtggtgttttctatggttcttaatgtgttttgggaggtaaatctttggttaaagataatattgtgttctggtgtttgccaaaatcaaacaatgtactgagtaacaatgacagtatgtgagagaactattccagtgaaacaacacacggcaaatttttatggctttgtagcccttgcatttttctttctgagcaccaaaaatacttcactcttgtatgttctggggtctgtagggtatgttcacgtgcaattgaatgagtcgccagtcatctgaacagaaaacagaaacaccgttcttgcgaaagaactgtaggattgtttctgtggcagcaagctttttgcttttttaagattagaagcttaaaatgtcggtttctgatatctatattttaaaaatctggaacacattatttagatgaattatgcagaatttcttttatgagatgttgtgtaagtttcatgttttagtctctgttgattttagagaaagttctcttctatgggaaatttgaatttggactgtatagctttcagagtttctg

SEQ ID NO: 2169 - DNA, 631 bp, Picea glauca
cagtcattgatatataccgctaaatgactgttatttttaattttcatatttgaattaatgaagcaagattttttaaccaccagttggactcgcccttcgtttatatgaaattctatttaatcccaagcttgttttcaaatattcatttttatatgaagttatttacagtgtaagcaagcacaacccacaagtttgaatcgtacccggcgttttgttacagaacttcagctacagctacatttctcaaaactctgcaatcatgaagctcgtcagatttttgatgaagctgaataatgagacagtctccatcgagctcaagaatggaaccgtagtccatgggaccattacaggagtcgacataagcatgaacacacacttgaagaccgtgaaactaaccttaaaggggaaaattccagtaacacttgaccacctaagtgtgaggggcaataacattcgatactatattctaccggacagcttaaacttagaaaccctgctggtggaggacacaccgagaatcaaaccaaagaagccaacagctggaaaaccaattggacgtggacgtggacgaggtcgtggtcgtggtcgtggccgaggccggtagtggcatgatgcaggatttcacaaggct

SEQ ID NO: 2170 - DNA, 768 bp, Triphysaria pusilla
gttcaaaaccctcccgcttcacacgaggccgtctctctcttttcgttacaaaaccctaattctccgtcaaaacccctcgcgacaatgaagctcgtcaggtttttgatgaaattgaacaacgaatctgtatcgattgagctcaaaaacggcactgttgtacacggaaccattatcggtgttgacatcagcatgaatacacatctgaaaactgtgaagcttactttaaagggcaaaaacccagtgacgatggaccaccttagtgtaaggggtaataacatccgatattacatccttcccgacagcttaaatctcgagacattgctagttgaagagacacctagagtcaagcccaagaagccaactgcagggagagctgttgggcgcggtaggggccggggccgtggacgtggtcgtggtaggggtcgctaaatatatctttaatcgccttcccgtttttttctggtagcattttgttatgtaaacatctgtatttgaagaatgcgtgttcgtgatactatttgaaatgtttacgggtacagattattgcaattttattgatgcttaattcacatagtttatttcttgcttataattagggttttctctgattatctatgtctcgaaataaaaggaactggtgttaaatttcatttttacaaatccatcttaaggaggaggtgatgctttattgataaggaatcacaagttttaaggatgtatttgtaatatatttatgtataatttgtaattaataatatttggattttc

SEQ ID NO: 2171 - DNA, 599 bp, Triphysaria pusilla
tctccaaaaccctctttcacaaaactcactcgcttcgtcatttcatttcctctcctcagaaccctagctccgtcacctttccactgcaactatgaagctcgtcaggtttttgatgaaattgaacaatgagactgtgtcgattgagctcaagaatggcaccgtagttcaaggcaccattataggtgttgacatcagcatgaatacgcatctgaaaaccgtaaagcttacattgaagggcaaaaacccagtaacgatggaccacctgagtgtgaggggtaacaatatccgctattacattctacctgacagcttaaatctcgagacattgctggttgaggaaacacctagagtgaagcccaagaagcctactgctgggagagctgtggggcgcggtcgagggcgtgggcgtggacgtggacgtggccgaggccgttaaacgtggtcctggatcatggtattttttttgtagcattctgtcatgtaaacatttgtactgaaggagagattatatgctgctgctagttattctaccctatccgagacttgcaagttcgatatgtaacgtttgtcgagattcaaaaatatttggaacttctagt

SEQ ID NO: 2172 - DNA, 680 bp, Tripterygium wilfordii
tctcgtctcgagaagagacagatctctctcatctcccgcttcttaccgtggccgtttgctcgaaccctagttctttgtattctcttcacgatgaaacttgtcaggtttttgatgaaattgaacaacgagaccgtgtcaatcgaactcaagaatggaactgttgttcatggcacgattacaggtgttgatatcagcatgaacactcatctgaagtctgtgaagcttacactgaaggggaagaatcctgtaactttggatcatcttagtgttaggggcaataacattcgctattacatccttcctgacagcttgaatcttgagactttactggttgaagagacacctagagtcaaaccaaaaaagccaactgctgggagagctgtgggacgtggtcggggtcgtggacgcggacgaggacgtggtcggggccgttagatatgttgcactaagtttcgatttgtgtgacatttgtgtaaacagcaatttatatgagagttgctgggtcacttagacacatgaaaggattgtattcagcgtacttctggtgatcatttgccttgagaggagacttgatagcggattctgaattctcaactgggattaattgcttgaaattgaacagagcatatagactcgaccgcactggctaagctaagcgtgtgagtgagatttagcctaaa

SEQ ID NO: 2173 - DNA, 776 bp, Citrullus lanatus
aaagcaaaacccatcgggacaaaaccgcggcaatctcccaatttcctctccctcgcttcgttgtttgaaaccctacattcttcatttcctctgcaatcatgaagcttgttaggtttttgatgaagctcaacaatgagactgtctcaatcgagctcaaaaatggaactgttgtccacggcactatcacaggtgtggatatcagcatgaatacacatttgaaggctgtgaaacttactctaaaggggaaaaatccagttaccatggatcatttaagtgtgaggggtaacaacatcagatattatattctacccgacagcttgaatcttgagactttacttgttgaagagacacccagggtcaagcccaagaaaccaactgcagggagacctttgggacgtggacgaggacgtggccgtgggcgtggtcgtgggcgtggacgctagatttgtggcagttgtttcaatttttgtttttgagccatgtagtttaaacacttgcattgtggggaaagattatgaattttgggacacaaaaaagtggtattgcatttcactgtccaatctcgtatgtagtttattacaatgctatccagttgtttttcctatgattgatatagccttgctatgttttcttctagtgcttggatctgttaatgatttactctaatatcatcacaatgataaaaccctagcatgtctctagattggaatctcgttttttactttcaaacctggtagattttgtagtcatgcagtacttgagttggttacaatcaa

SEQ ID NO: 2174 - DNA, 665 bp, Cucurbita pepo
tttacttatcaggcgtaccacatacttgaaattgtacaaatttcccctcccgcctcctttgtctgtctgtgcttgaaaccctacattttgcaattcctccgccatcatgaagcttgtcaggtttttgatgaagctcaacaatgagacagtttcaatcgagctgaaaaatggaaccgttgtccatggcaccatcacaggtgtggatatcagcatgaatacacatttgaaggctgtaaagcttactctaaaggggaaaaatccagttaccatggatcatttaagtgtgaggggaaacaacatcagatattatattctacctgacagcttgaatcttgagactttacttgttgaagagacacccagggtcaagcccaagaaccaactgcagggaagcctttggggcgtggacgaggacgaggccgtggtcgtggtcgtggtcgtggacgctagatttgttgcagtttcaaattttgatctccgtagtgtaaacacttgtatcttagggaaagtttgtgaatttaatgacgtgaagatgtggtatagcaattcactgtccgatctcacatgtttattacaatgctattcagttgtttttctgtgatcgatgtagctttgctatgtggctgggatctgcccctgttaatgatttactctaatatcatcaa

SEQ ID NO: 2175 - DNA, 665 bp, Euonymus alatus
gtgctaatgagccctaattatcaccgcaagtaaacctgcatcgccttttccctagtgtagagatctctcccctcccgcttctcacaggggccgtttgcttgtaaccctagttctttgtattctctccacaatgaagcttgtcaggtttttgatgaaattaaacaacgagactgtatcaatcgaactgaagaatggaactgttgttcatggcacgattacaggtgttgatatcagcatgaacactcatctgaagtctgtgaagcttacactgaatgggaagaatcctgtaactttggaccatcttagtgttagaggaaataatattcgctattacatcctacctgacagtttgaatctcgagactttacttgttgaagagacgcctagagtcaaaccaaaaaaaccaaactgctgggagagctatgggacgtggtcggggtcggggacgcggacgaggacgtggccgtggtcgttagatatttttttactaaatttccattatgtaaacagcttgtatgagagttgcttggtcgcttaggattgtattcaactgtacttctggcgaacagcatctaccttgaggggacttgattaaggattctgaattctcacctggtattaattgcttgaatgccactgaaatggaacaaaaaaaaaaaaggccg

SEQ ID NO: 2176 - DNA, 523 bp, Flaveria ramosissima
tgggacccgcttcccctcaaaatttgacaattttttggaaccctagcttctgttcttgcgatttgcgacaatgaagctcgttaggtttttgatgaagttgaacaacgaaacagtctcgattgagctcaaaaacgggacggttgtacatggaaccatcacaggtgttgatattagcatgaacacacacttgaagacggtgaagttgaccctgaaagggaaaatcctgtaacccttgaccatatgagcgtgagaggcaataatattcgttactatatacttcccgacagcttgaatttggaaactttgctagtcgaagagacacctagagtcaagcctaagaagccaactgctgggcggcctgtgggacgtggtcgtggacgaggccgtggccgtggacgtgggcgtggccgttaatcatgttattatcttttgttatatttggtgtcgagctatgtaggtgtaaccatgtatttgtagagactgtatcatcgtgagattagaaatagtgacgtaattgatgtac

SEQ ID NO: 2177 - DNA, 542 bp, Pinus pinaster
tatgaagttatttagagtgtaagaggctcaacccagaagtttgaatcggacgctgcattttgttacagaacatctgctatcgctgcattttctcaacgctctccaagcatgaagctcgtcagatttttgatgaagctgaataatgagacagtctccatcgagctcaagaacggaactgtagtccatggaaccattacaggagttgacataagcatgaacacacacttgaagacagtgaaactaacattaaaggggaaaatccagtaacacttgaccacctaagtgtgaggggcaataacattcgatactatattttgcctgacagcttaaatttagaaaccctgctggtggaggatacaccgagaatcaaaccaaagaagccaacagctggaaaacctattggacgtggacgtggacgaggtcgcggccgcggtcgtgggcgtgggaggtagttgcaagatgcagtatttcaacaagggatgtgtacttggttgtacaaaatattgtttagcagtgccagtgcattgtttttttactatatt

SEQ ID NO: 2178 - DNA, 1095 bp, Cajanus cajan
atgcaagataaagtggattgagaaaacctagttttcttcatatttttgcaatcatagaggcgcgcaggcagtaatccgaaacggtgtcgtgcgagcagagcgaaaaacaagaaggttgccgaaagtattgaagttccgctcccgctccttcttcttggcttatattgtctgcatccatcatgaagctcgttaggtttttgatgaagttgaccaacgaaactgtgtcaatcgagctcaagaatggtaccattgttcatggcactattacaggtgttgatatcagtatgaatacacatttgaaaacagttaaattgactctgaaagggaaaaacccagtgactctggatcatcttagtgtgagaggcagcaacattcgatattatattcttcctgacagcttgaatcttgagactttgctggttgaagagactcctaggatcaagcctaagaaaccaactgctggaaaacctatgggaagagggcgtggtcgaggacgtggacgtggtcgggggcgtggtcgtgaacattaacgtgaacactagtttcacattaataaattttgtgccatcgggttgtattgtaaggagaatttctgagcggttgtggatatcaaaggagtgttcatgttgatttttccatgttgccattctataacatactagtaggtgcttacatgttttgtaaaattcctttatagtattctacaattgagtaaggcagggtttgcgatcacactttgttgggtggtcccaaaagatgccttatgcctcttggctgaaaaactgcagatagttgtagctttcggtacaagatgaagttaatggaattactgatgcaatgttgtggacttgtggtttggtaggtcggggttctgtttgttgatttaacactctttattacccaagatagttggactgactcttgtgctttagcaccccggtttctttgagatttgaactcatccttgttgaagcttttgctacaaggtgaaaaagttaattggaattgcttaagcaatagtggtatggaaggtggtgtttctgtatgtcaattctagactcttatccattagtttataagttgatcttaatagtt

SEQ ID NO: 2179 - DNA, 863 bp, Cajanus cajan
cgcaggcagtaatccgaaacggtgtcgtgcgagcagagcgaaaaacaagaaggttgccgaaagtattgaagttccgctcccgctccttcttcttggcttatattgtctgcatccatcatgaagctcgttaggtttttgatgaagttgaccaacgaaactgtgtcaatcgagctcaagaatggtaccattgttcatggcactattacaggtgttgatatcagtatgaatacacatttgaaaacagttaaattgactctgaaagggaaaaacccagtgactctggatcatcttagtgtgagaggcagcaacattcgatattatattcttcctgacagcttgaatcttgagactttgctggttgaagagactcctaggatcaagcctaagaaaccaactgctggaaaacctatgggaagagggcgtggtcgaggacgtggacgtggtcgggggcgtggtcgtgaacattaacgtgaacactagtttcacattaataaattttgtgccatcgggttgtattgtaaggagaatttctgagcggttgtggatatcaaaggagtgttcatgttgatttttccatgttgccattctataacatactagtaggtgcttacatgttttgtaaaattcctttatagtattctacaattgagtaaggcagggtttgcgatcacactttgttgggtggtcccaaaagatgccttatgcctcttggctgaaaaactgcagatagttgtagctttcggtacaagatgaagttaatggaattactgatgcaatgttgtggacttgtggtttggtaggtcggggttctgtttgttgatttaacactctttattacccaagatagttggactgactcttgt

SEQ ID NO: 2180 - DNA, 1005 bp, Gossypium raimondii
aggggggggggggggaggaaagggttttgcatttgaaaatttgaatcgccatcaaactcagttctggagcttttactctcatttcactgctcaaaattttcaaacatgaagctcgtgaggtttttaatgaagttaaataacgagactgtctccatcgagctcaagaacggaactgtcgtccatggcaccatcacaggggttgatgttagcatgaatacacatttgaagatggtgaaactaacgctcaagggaaaaaaccccgttactcttgaccatctgagtgtccggggtaacaacattcgttattatattctccctgacagcttgaatctggaaactttgcttgtggaggagacaccaagagttaaacctaagaagccagctgcaggacggcctttgggacgtggtcggggtagggggcgtggacgtggtcgtggcagaggtcgctaattggctttctgcaatttgcctgcattgggtaccttactattttagtgtgctcgagcagaatttaagggagcgaagtttgaagtatacagtaagaatctgtctatttatatctgcccctagttgcctgctctagtttaattgttatatatagttgagcctgagattgtatgcaagtgaataaaaacggctgtcctctttctgtatggtctaaattagtaagcatttgaaggtgcggttaaagggaagatgatgtgcatgtggggatgacttggactaatggttcatcaagccaaggctagctatgtttttgcaacaaacaaacctctcaaatttgagtgagtgtttatatatatagtgatatactagtattgtacaaagctgcaaattcttttcttctgttttgcccggggggggggggggtgtcagttatgttacaaaaaaaagagaaaaaaacagatgacttcttttgtctcaaaaaaatggtttttacagtgataaacgtatgtgaagaatgtaaagagtgttaaagaaaatagaaagaagaaattgacatgg

SEQ ID NO: 2181 - DNA, 511 bp, Amborella trichopoda
tcgttaggtttttgatgaagctgaacaatgagacggtctccattgagctcaagaatgggacagttgttcatggcactatcactggagtggatatcagtatgaacacacatcttaagacggtgaagttgacactgaaaggcaagaatccggtgacccttgatcaccttagtgtgaggggcaacaacatacgatactatatcctccctgatagtttaaacctcgagactcttttggttgaggagacacctcgagtcaaacccaagaagcctactgcagggagaccttttgggcgtggccgaggacgtgggcgtgggcgtggacgcggccgtggccgttgattttttggttaccaaagtctacagtttttttcgtgcaattgagtactatgttgatgtatattgtagacattttgaagagaatctttatttgaggcctagcatgtttttttttcacttatcttgaagcatacacgtttatggatacatatattggctgtggcattttggtggtt

SEQ ID NO: 2182 - DNA, 865 bp, Persea americana
attctgcactgggctggtttgttccaaaccctaattttttttccattcctcgttgcttgtccatcttcccaaagagcaaagatgaagcttgtcaggtttttgatgaagctgaacaacgagaccgtctcgatcgagctcaagaatggaactgttgtccatggaaccatcacaggagtggatataagtatgaacacgcatctgaagacgggaaagctgaccctgaaaggtaaaaaccctgtaactctcgatcacctgagtgtcaggggtaacaacatccgttactatatcctccctgatagcttgaaccttgagacactactggtcgaggaagccccccggatcaaacccaagaaaccaactgctgggagacctctgggacggggacgtgggcgtggtcgcggacgtggccgtggtagaggccgttagttgtgtcgcacagtacaatttttgcagctcctacttgtgtacaaattacctgcacccgtagagagtttcatccaagtactgttaaagcgagactgatgttaactacctttagcctaaaggatacatgaatgtagtgtagctttgtttttatgtctcggatggaatgtttgcttgaccctagtatgttgatgtgtggcgatcatgagatgatgggtttggcattgatctcttgttttacggcaagatgttagattaaaaccaaggttatttattacttttagggtgttggtaacagcctattttgcacttcaaagatttctgtgcttgcattattatcaatgaattgaaatttgatctgtacgtttttgtttattatgaactagtgtgagctcaacagagtaatgggtgggctgattgaaatgtatgttgcattaaacag

SEQ ID NO: 2183 - DNA, 641 bp, Catharanthus roseus
ccggaccctgccctaaaacccttgcgccagaggcctcgcttttgcttcgtccggcagctactaagccctagcgtccgtcttcttccacccgcaagaatgaagctcgtcaggtttttgatgaagttgaataatgagacagtctcgattgagctcaaaaatggcacagttgttcatggcaccattactggtgtggatatcagcatgaacacacatttgaagaccgtgaaacttactgtaaagggaaagaatccagtgacactggatcacctgagtgtaaggggtaataatattcgctattacatccttcctgatagtttaaatcttgagactttgttagtggaagagacgccaagggtgaagcctaagaagccaacaacaggaggaaggcctttgggtcgagggcgtggccgtggtcgtggacgtggccgtggtagaggccgctagatttggtcactggtttcaatttttgggatatctagctgtataaacatctgtaatgagagagcattaacttagtcgatgatctactggatatattatatctttgagagcttctgttactcatattgcgcgtcaatggctggtagcctttttgtgcacattcttctgaagattacatacatggatatctggttgctatt

SEQ ID NO: 2184 - DNA, 793 bp, Gossypium hirsutum
gggggggaggaaagggttttgcatttgaaaatttgaatcgccatcaaactcagttctggagctttactctcatttcactgctcaaaattttcaaacatgaagctcgtgaggtttttaatgaagttaaataacgagactgtctccatcgagctcaagaacggaactgtcgtccatggcaccatcacaggggttgatgttagcatgaatacacatttgaagatggtgaaactaacgctcaagggaaaaaaccccgttactcttgaccatctgagtgtccggggtaacaacattcgttattatattctccctgacagcttgaatctggaaactttgcttgtggaggagacaccaagagttaaacctaagaagccagctgcaggacggcctttgggacgtggtcggggtagggggcgtggacgtggtcgtggcagaggtcgctaattggctttctgcaatttgcctgcattgggtaccttactattttagtgtgctcgagcagaatttaagggagcgaagtttgaagtatacagtaagaatctgtctatttatatctgcccctagttgcctgctgtagtttaattgttatatatagttgagcctgagattgtatgcaagtgaataaaaacggctgtcctctttctgtatggtctaaattagtaagcatttgaaggtgcggttaaagggaagatgatgtgcatgtggggatgacttggactaatggttcatcaagcctaggctagctatgtttttgcaacaaacaaacctctcaaatttgagtgagtgtttatatata

SEQ ID NO: 2185 - DNA, 857 bp, Euonymus alatus
catctcaagcctcgagtcacaagactcacaactcacaagtaggtacagatatctctcctcttccgcttcttacagtggccgttagctcggaaacctagttctttgtattctcttcacaatgaagcttgtcaggtttttgatgaaattaaacaatgagactgtgtcaatcgaactcaagaatggaactgttgttcatggcacgattacaggtgttgatatcagcatgaacactcatctgaagtccgtgaagcttacactgaaggggaagaatcctttaactttggatcatcttagtgttagggggaataatattcgctactatatcctacctgacagtttgaatcttgagactttactggttgaagagacacctagagtcaaaccaaaaaagccaactgctgggagagctgtgggacgtggtcggggtcgtggacgtggccgtggccgtggtcgtggtcgttagatatgttgcactaagtatcgatttgtgcggcgtggttgtgtaaacagctcgtatgagagttgcctggtcacttaggattgtagccaacgtatttctggtgaacaacgtttaccttgaggggactggatcaaggtaaggtgaggtgccgatgaatgtgctaatgacagattgatgaaaattatatatttgttctacccaaatttttctttttcttgtttgattttagcagctcgtatcagactattttctataattcttctctttagctcgaattagtcattcaacaattgaggaagatgcacagccaatctccatgttcaagggtgatcttggactgagagtctgagacatcgacattatattgggccacatattgaatggccgaattcagaaa

SEQ ID NO: 2186 - DNA, 471 bp, Hevea brasiliensis
atcctctcccgctttctttggtcagccttcattgtgcttcttcaaaccctagattttgccttcctctccaacaatgaagcttgtcaggttgataatgaagttgaacaacgagaccgtgtcaattgagcttatgaatggaactgttgttcacggcaccattacaggcgtggatattagcatgaatactcacttgaagactgtgaaactaacattgaaggggaaaaatccagtaactttagatcatctcagtgtgaggggtaacaatatccgatattatattcttcctgacagcttgaatcttgagactttgttggttgaagagacaccaagggtcaaacctaagaagccaactgctgggaggcctttggggcgtggtcggggccgtggacgcggtcgtggacgtggtcgaggccgctagttgggttgcactcattctaatttttgtggcgtctagttatgtaaacacctatg

SEQ ID NO: 2187 - DNA, 594 bp, Ipomoea nil
aaaaacccccgtcttccagactgaagaggcttttgcgctctatcgcttcgacatagccctagcttctctgttcttactctctcaacgatgaagcttgtcagatttttgatgaaattgaacaatgagacggtctcgattgagctcaagaacggaaccgttgttcacggaaccattacaggtgttgatgtcagcatgaacacacacttgaagacagtaaagcttactccaaaaggcaaaaatcctgtgactatggatcacctgagtgtaaggggcaacaacattcgctattacatcctccccgatagcttaaatctcgagactttgctagtggaagaaactcctagagtgaagcctaagaagccaactgctggaagggcaatgggccggggtcggggccgtggacgcgggcgtggccgtgggcgaggccggtaaaggcctttaagtcattccccattttgtgacaacatctgtttatgtagacgcatgtattcatgatggagagtctatctcgttatgtagtttaatagcatggaatggatgccaatctgttactactttgagtggattatgagattttctttagcaaaaaaaaaa

SEQ ID NO: 2188 - DNA, 632 bp, Capsicum annuum
gtctcttcatcttcaatttttgtgctttgatctaagacctagcttgttttcaatttcttcagcacaatgaagctcgtcagatttttaatgaagctgaacaacgagacggtctcaattgagctcaaaaatggcaccgttgttcatggaactattacaggtgtggatgtgagcatgaacacacacctgaaggctgtcaaaattacgctaaaggggaagaatccagtgacgttggatcacctgagcgtgaggggtaacaacatccgttattacatcctcccagacagcttaaatcttgagacgctgctggtggaagatacacccagggtgaagccaaagaagccaacagctggaaagcctttgggacgtggtcgtgggcgcggccgtggacgtggacgtggtcgaggccgctaaatgcattcctgctgctcttatttttttttttgcagtggtgtctatgtaaacatatatgtatggatggagagacttgctcttagttttctagcagaaaagagattgatctaatgcaacaatttattccggatccttaaagtctgagcacgttatttcgtttcgcacgatatatggtgtactaacatttctttcgtatctcattcaactttattctgcctatt

SEQ ID NO: 2189 - DNA, 698 bp, Capsicum annuum
cgccattgtaacaggagcttatgttttcgaatagtaacactggcgctccctgccctaaaccctagcgtctcttcatcttcaatttttgtgctttgatctaagacctagcttgttttcaatttcttcagcacaatgaagctcgtcagatttttaatgaagctgaacaacgagacggtctcaattgagctcaaaaatggcaccgttgttcatggaactattacaggtgtggatgtgagcatgaacacacacctgaaggctgtcaaaattacgctaaaggggaagaatccagtgacgttggatcacctgagcgtgaggggtaacaacatccgttattacatcctcccagacagcttaaatcttgagacgctgctggtggaagatacacccagggtgaagccaaagaagccaacagctggaaagcctttgggacgtggtcgtgggcgcggccgtggacgtggacgtggtcgaggccgctaaatgcattcctgctgctcttatttttttttttgcagtggtgtctatgtaaacatatatgtatggatggagagacttgctcttagttttctagcagaaaagagattgatctaatgcaacaatttattccggatccttaaagtctgagcacgttatttcgtttcgcacgatatatggtgtactaacatttctttcgtatctcattcaactttattctgcctatt

SEQ ID NO: 2190 - DNA, 695 bp, Populus trichocarpa
agcagtagagcaattcatcactcccgcttccaacactggccttcgatttttcatcttcaaaccctagctaggtaagctcagttctgcacgttcgagaccacaatgaagctcgtcaggtttttgatgaagctgaacaatgagaccgtctcaattgaactcaagaacggaactgttgttcatggaaccatcacaggtgttgatatcagtatgaatactcatctgaaaacagtgaaactaacagtgaaagggaaaaacccagtaactttggatcatctcagcgtgaggggcaacaacattcgttattacatccttcctgacagcttgaatcttgagactttgctggttgaggagacacctagggtcaaacctaagaagccaacagctgggagggctttgggtggtcgaggcaggggccgtggacgtggtcgtgggcgcggacgtggccgctaatcgtgttgtgcttgctttaatttttacagcgtctggttatgtaaacacctatgttgtagcaagtatttgtcggtaaagttagggacattaagagaatgttactgcttttatttaactgtttttgccttgtggaggctaattgcaggatatgagtttgtctatcggtaaccttttccaaatttaaccagaagatcaaagtgatgagcttatgctatattactcttctgtaacctgctgtcttgttc

SEQ ID NO: 2191 - DNA, 707 bp, Primula obconica
aaagaatcaagtggcccatagctacttgtttcctccggcgacggaaaagagaattattgtaatgacctaaactagtataaaaccctttctttctctggcaatttagatactaaagtagtaataaaacccaaccaggaaggagtgagtgtactaccaacaatgaagctcgtcaggtttttgatgaagctaaacaatgagacagtctctattgagctcaagaacggtaccgttgttcacggtactatcacaggtgtggatattagcatgaatacgcacttgaagacggttaagctcaccctcaagggaaaaaatccagtgagctttgatcacctaagtgtgaggggaactaatattcgctactacatccttcctgacagtttgaacctcgagacattgttggttgaagagacgcctagggtcaagccgaagaagccagctgcagggaagcctttgggtcgtggacgaggccgtggtcgtggccgtggacgtggccgtggacgttaatcgcaaattgtggcatttggtttaaacctctattaccaaagttagtaatgctattatgggcagtgatttaatgtgattttgagtaaagttgaaacaatctttgtttaatgttctttatataacactaatcgagacgacgaattttatgtgtattgtaaggttgtgttaagggaacttcgtcaataattggacatgtaattctt

SEQ ID NO: 2192 - DNA, 620 bp, Primula obconica
accctttctttctctggcaattaagatagtactacagtagtaataaaacccaaccaggaaggagtgagtaccaaaatgaagctcgtcaggtttttgatgaagctaaacaatgagacagtctctattgagctcaagaacggtaccgttgttcacggtactatcacaggtgtggatattagcatgaatacgcacttgaagacggttaagctcaccctcaagggaaaaaatccagtgagctttgatcacctaagtgtgaggggtactaatattcgctactacatccttcctgacagtttgaacctcgagacattgttggttgaagaggcgcctagagtcaagccgaagaagccaactgcagggaagcctttgggtcgtggacgaggccgtggtcgtggccgtggacgtggccgtggacgttaatcgcaaattttgtggcatttggtttaaacctctatcaccaaagttagtaatgctattatgggcagtgatttaatgagattttgagtgaagttggaacaatctttgtttgatgttctttatataacactaatcgagacaacgaattttatgtgtattgtaaggttgtgttaagggaaccccgtcaatagttggacatgtaa

SEQ ID NO: 2193 - DNA, 983 bp, Glycine max
gtctcactctcacttttgattttttgccctaaaaccctcgctgccgtcgtggtggccgcccaagaaaagagaatagagagcgcaaacgagtcttcatcttcgactcaccatgaagctcgtcaggtttttaatgaagttgaacaatgaaaccgtgtcaattgagctcaagaatggcactattgttcatggcaccattacaggtgttgatatcagtatgaacacacatttgaaaacagttaaactaactctgaaagggaaaaatccagtgactctggatcatctcagtgtgaggggtaacaacatccgttactacattcttcctgacagcttgaatctcgagaccctgcttgtggaagagacacctaagatcaaacccaagaagccaactgctgggaaacctttgggacgtggacgaggaaggggccgtgggcgtgggcgtggacgtggtggtcgttgagttgcacctttcttcatttttgtggcatgtggttataagctatgcagcaagaatttctgggtggttttaggaacttctgaggagcatattatttattcctgctattttcttgcaagagctgaaactgatgtaacctgaattacctatctgctattgccttatagttgttaatggggaatccattgagcagtatgacaaatggcccacgacttattggttatacataacacagtaaataggcccaagagttgcctaatgagtttgaactagatgatgggtttcctgatgacacagattgctatgtttatttacatgtatgaacggtatttcttaaacggcttttttttgtttgcttctattgtgtcactaactgactgtcatatacacattttaagttaatgtaattttttttagtataccagggatatactagttagatgcacttgctactagcaccttttgttacaatacacattttgttatgctaacttgagaaggaaggatatttactttaacatttagttaa

SEQ ID NO: 2194 - DNA, 452 bp, Tamarix hispida
gggggttcggcaatagagagaagcagcgggtttaacttctccgaactcaagcggctctctttccaccgtcgacacggccgacgtctccagctatgaagctcgtgaggtttttgatgaaactgaacaatgaaaccgtgtcaattgagctgaagaacgggaccgttgttcatggaaccattacaggagttgatgtcagtatgaacacacacttaaagactgtgaaacttactccaaaagggaaaaatccagtcactttcgatcaccttagtgtgcggggtaataatatccgctactatatccttcctgatagcttaaatcttgaaaccctgctagtggaagagacgccaagggtgaagcccaagaagccaactgctgggaaggctttgggacgtggtcggggccgaggacgtggtcgtggacgtggccgaggccgctgagttggtggatccgat

SEQ ID NO: 2195 - DNA, 640 bp, Zamia vazquezii
gctaccggattcaaaataataagcgagtagggaggaggcctgaaatccgatcttttccagaactgctggaaaaggtaaccagtagccagtgcgaatcggagataattttctggtattttttttttcccagaactgctgggcgctgctgctgtttcgagcctttagaacatgaagcttgtgaggtttttgatgaagttgaacaatgaaacggtctctattgaactcaagaacggaacggtggtccatgggactattacaggagttgatataagtatgaatacacacttgaagacggtgaaattgaccttgaaagggaaaaatccagtaacacttgatcatcttagtgtaaggggcaacaacatacgatactatattctgcctgacagcttaaacttggaaactttactggtggaggatacacccagaatcaagccaaggaaggcaactgctggcaagcctctgggacgtggacgtggacgtggacgtggtcgtggtcggggtcgtgggcgttaatttgtaacactttcgatgggttttgtgacaattcatggacggcacaggatcttctatgctggcactatatttggctgcatgaaatatggcagtggcttctttttgtctggcccaacctgatgtgtag

SEQ ID NO: 2196 - DNA, 687 bp, Zostera marina
gcttagctgatcaacgtctctcgctgccgacttcccacttctttttcgtcttcaaagaaaaccctaaagatgaaactcgtcaggtttttgatgaagctaaacaacgagaccgtctctatagaactgaaaaatggcacggtggtacacggcaccatcataggggttgataacagtatgaatactcatttgaagacagtgaagatgacactgaaaggaaaaaatccagtgacccttgatcatctgagtgtgagaggaaacaatatccgttattatatattaccagacagtttgaatcttgagactttgctggttgaagaaaaacctaggataaaaccaagcaagccaactgcaggaaaatctatgggacgggggcgagggcgtggtcgtggacgtggtcgtggacgcggtcgttaggtttaccattatatgtagaaatagtcgttaggcttatcagtgagatttatttcctgttgaccaaaaattcttaggcacacttttctttggccatttatctcctgatgtaaccttaaaattgcaagttgcagaattcactatgttatgaacgggtgccgtcttttgttgtttaacattaatagtttgatatgtgtgaagatattagcatttatgtgatactctccttagtttgaataattttcatctgttggataaaatatttaggtaattgat

SEQ ID NO: 2197 - DNA, 542 bp, Flaveria ramosissima
tcgttctcaatcagaagccctaaaacaccaaaaaccctcttctccttcacgtttctccggcatacagttcgtgaatcctccgtcatttcaacactatctccggcaatgaagctcgttcggtttttgatgaagctgaacaacgagacggtctcgatcgaactgaagaacgggactgttgttcacggcacaatcataggagtggatattagtatgaatacacatctaaagacggttaaacttaccctaaaggggaagaatccagtgaccttagatcacctaagtgttaggggcaacaacatcagatactacatcctgcctgacagcttaaatcttgagactttgctggttgaagaaacacccgtgtcaaaccaaaaaaccaactgcagggagaccggtggacgcggaagggccgtggacgcggcgtggtcgcggtcgaggccgtaattctaagattgttatatttggtttgtaaactatttgtattgttgtaggtctgtagatggataacacgatactatttgactaaatttttccttgtattg

SEQ ID NO: 2198 - DNA, 797 bp, Sarracenia psittacina
ggagaaggcccgtggttgcgctgtggatcatttgtataattcgtgtctcccgcttcttcactgacctatctctttaaaaaccctaatttcaatttgtgagaagttgcccatcctgcaattccacgatgaagctcgtcaggttcttgatgaagtcgaacaacgagactgtctcaatcgagctcaagaatggcactgttgtccacggaactatcacaggtgtggatatcagtatgaacacacatttgaaaacggtgaaattaacgctgaagggaaaatccggtaactcttgatcacctgagtgtaaggggaataacattcgctattacattctcccggatagcttgaatctcgaaactttgcttgtggaggagacacccagagtcaagcctaaaaagccaactgcagggaggcctctgggacgtggtcggggccgaggtcgtgggcgtgggcgtggacgtggccgttaatcatgtggcactgtttattctctccagcacgtgggctgtgtaaaaacattatgttgtagagagtgtttaatgttgttgaggcaccgaagacaacgattacatcaaactcttcacattgctgttgcttaactctattttgtttcttctatttggttagtgggagcagttatttctcttggattcttcagtttgggctgcacatataacgaactctcttccttttaagaaacatgaaggtatgaccacacttgttggttgcatacttttctggctctagttaagcctccatttaatttcatctggcacatatattcacaaaaaaaaagaaaa

SEQ ID NO: 2199 - DNA, 1023 bp, Papaver somniferum
ctggatttactccgtttccatcctctagtttctccctctaactccaagatgaagctcgtcaggtttttgatgaagttgaacaacgagactgtttcgattgaactcaagaatggaactgtcgttcatggcacaatcatcggtgtggatatcagtatgaacacccatttgaagacagtgaaactgacgctgaagggtaaaaatccagtgacattggatcacctgagtgtgaggggtaacaatatccgctattacatccttcctgacagcttaaacctcgagacgttattggtcgaggagacacctagggtcaaacccaagaaggcaactactggtaagccagtggggggacgaggtcgtggccgtgggcgtggtcgtggacgtggcagaggaggccgctaaacttgtttgttttctgtacaaattgcttagcctgcgtaggggaagctttcagggacatgttgtgcttgtttggaggaaatgctggtttgaactttttatgtggaggctaattctgtagaattgttatttaaaaatgttttaaattttaaacagaaaccttagtaggggactactggattttgtttcgcccctgtagggttgaaatagaacaagaagtgaatcagatccatccagtttgtctcaactcagcaaccatctgattcctgtatttgcccttgcatcatctcttcctgatgctgtcttaactcagcaaccatctgattcctgtatttgcccttgcatcatctcttcctggtgcaaatttaactctaccgggcttagttctgttctgtgtttatgagcaacttcttgcctttcttattggaaatgactgaccgaacagaggtagtgggatggaatgcgtccttgacactagtaggacttttcttttcttattttcaacaatggaatttgaaatacagctagtcgtgttggcctgttgttcagcttcctttgctagagtcgaatgactacagtatttagctcatacaagtatttgctagtatatcatgtataacattctag

SEQ ID NO: 2200 - DNA, 731 bp, Papaver somniferum
ggatttactcgtttccatcctctagtttctccctctaactccaagatgaagctcgtaaggtttttgatgaagttaaacaacgagactgtttcgattgagctcaagaatggaactgtcgttcacggcacaatcatcggtgtggatatcagtatgaacacccatttgaagacagtgaaactgacgctgaagggtaaaaatccagtgacgttggatcacctgagtgtgaggggtaacaatatccgctattacatccttcctgacagcttaaacctcgagacgttattggtcgaggagacacctagggtcaaacccaagaaggcaactactggtaagccagtgggtggacgaggtcgaggccgtggacgtggtcgtggacgtggcagaggaggccgctagacttgtctgttttctgtacaaattgcttagtctgcataaagaaagctttcagggacatgttgtgcttgtttggaggttaagatggaggaaaatgctggtttgaatttttttatatgtggaggctaattctgtagaattgttacgtaaaaatgttttaaatttttaaacagaaaccttagagggagtactggatttcgtttccctcctgtagggttgaaatagaacaagaagtaaatcctatccatccagtttgtcttaacatagcaaccatctggttcctgttttttccctgcatcatctgttctttatgcaaatttaactttaccttagagatt

SEQ ID NO: 2201 - DNA, 740 bp, Papaver somniferum
tggctcctctctcacctctttcttttcttcgactggatttactcgtttccatcccctagtttctccctctaactccaagatgaagctcgtcaggtttttgatgaagttaaacaacgagactgtttcgattgagctcaagaatggaactgtcgttcatggcacaatcatcggtgtggatatcagtatgaacacccatttgaagacagtgaaactgacgctgaagggtaaaaatccagtgacattggatcacctgagtgtgaggggtaacaatatccgctattacatccttcctgacagcttaaacctggagacactattggtcgaggagacacccagggtcaaacccaagaaggcaactactggtaagccagtggggggacggggtcgtggccgtggccgcggtcgtggacgtggcagaggaggtcgctagacttgtttgtttcctgtacaaattgcctagccttcatagggaaagctttcagggagatgttgtgcttgtttggatgttaagatggaggaaaatgctggtttgaactttttatgtggaggctaattctgtagaattgttacgtaaaaatgttttaaatttttaaacagaagccttaggtaggggagtgctggattttgtttccctcctgtaggttgaaatagaacaagaggtaaatccgatctatccagtttgtcttaaccaagcaaccatctgattcctgtatttcccttgcatcatctgttctttatgc

SEQ ID NO: 2202 - DNA, 760 bp, Rosa hybrid cultivar
cccccccccgccgtccgttccgccaccggcccgctacagcacagacagacctccccccccccccacaactctcccgctttgtttttggaaaagcttggagccctagctctccaatttctcatcgccacaatgaagctcgtcaggttcttgatgaagttgaacaacgaaaccgtgtcgatcgagctcaagaacggcaccgttgtgaatggcaccatcacaggtgtagatatcagtatgaatacacatttgaagacggtgaaacttacactcagggggaagaatccagtgactctggatcatctcagtgtgaggggtaacaacattcgatactacatccttcctgacagcttgaatcttgagactctgctggttgaagagacgcctagggtcaaacccaagaagccaactgcagggaggcctgtgggaaggggaaggggccgtggacgtggacgcggtcgtggccgtggtggtcgttaaatacgctgcattggttaatttttgtggcaagaacttggcctgcctggtttgtaaacacctctgtaggacgaacttgtttgtgatcttggagacatgaaatgagtggcactttttcctggttatgtaaacacctttgtaggaagtacttatctatgatcttggagacatgaatgaagcattgcactgttattcgattgtctattcccagtagaaattacttaaaatgctattatgaacttggtaatcaatattgttttgtacttctacaaaaaaaaaaaaaact

SEQ ID NO: 2203 - DNA, 636 bp, Lotus japonicus
ggagagtaggacacaaaacaagttcactactctagtgactccctccgtcccgcttctccttcgttgttgaagctgctgctgctgctttcaccaccgactcgtcgtgctccgctctgctcaaattttccgccaccatgaagctcgtcaggtttctgatgaagttgaacaatgaaaccgtatcaatcgaactcaagaatggtaccattgttcatggcaccattacaggtgttgatatcagtatgaatacacatttgaaggcagtaaaactaacactgaaagggaaaaacccagtgactctggatcatcttagtgtgagaggtaccaacattcgttattatatccttcctgacagcttgaatcttgagactttgctggttgaagaggcacctagagtcaagcctaagaagccaactgctgggaagcctttggggcgtgggcgaggccggggtcgtggacgtggtcgtggtcgtggtggtcgttgaattgcatttcctcaaatttgtggttgtgttgtagggagaatttgtgtgctgttttatggatatcaatggaatgttcttgctgattattcactttgactttgtttatgatgttatttccttatacaagtgctttcaagtttcttctgtacaaaaa

SEQ ID NO: 2204 - DNA, 448 bp, Rosa hybrid cultivar
gcacgagccgctttgtttttggaaaaagcttggagccctagctctccaatttctcatcgccacaatgaagctcgtcaggttcttgatgaagttgaacaacgaaaccgtgtcgatcgagctcaagaacggcaccgttgtgaatggcaccatcacaggtgtagatatcagtatgaatacacatttgaagacggtgaaacttacactcagggggaagaatccagtgactctggatcatctcagtgtgaggggtaacaacattcgatactacatccttcctgacagcttgaatcttgagactctgctggttgaagagacgcctagggtcaaacccaagaagccaactgcagggaggcctgtgggaaggggaaggggccgtggacgtggacgaggtcgtggccgtggtggtcgttaaatacgctgcattggttaatttttgtggcaagaactt

SEQ ID NO: 2205 - DNA, 918 bp, Glycine max
attcaaaatcacaaaattgtcccttaaacccttacaaaagaaccgcttcttcttctgttcatctctcccactctcacttttaattttttgccctaaaaccctcgctaccgccgtggtggccgccgaagaaggagagtagagagcgcaatcgagtcttcatcttcgactcaccatgaagctcgtcaggtttttaatgaagttgaacaatgaaaccgtgtcaattgagctcaagaatggcactattgttcatggcaccattacaggtgttgatatcagtatgaacacacatttgaaaacagttaaactaactctgaaagggaaaaatccagtcactctagatcatctcagtgtgaggggtaacaacatccgttactatattcttcctgacagcttgaatcttgagaccttgctggtggaagagacacccaagatcaaacccaagaagccaactgctggcaaacctttgggacgtggacgaggaaggggccgtggccgtggtcgtggtcgtggtggtggccgttgatttgcacctttcttcatttttgtggcatgtggttgtaagctatgcagcaagaatttctgggtggttttaggaacttctacggagcatattttttattcctgctattttcttgcaagagcttatcatgctttagtgtacaaccatcttccttctgaaactgatgtaacatgaattacctatctgctattgccttatactagttgttaatggggatctattcattgagcagtatgacaaatcgcccacgactttggtcatacataacacagtaaataggcccaagagttgcctaatgagtttgaactagatgatggatttcctgatggcacatattgtgttatttatttatttacatgtatgaatggtatttcttaaacgtcttatttttgtttgct

SEQ ID NO: 2206 - DNA, 445 bp, Flaveria ramosissima
gtttctccggcgtacagttcgttaatcctccgtcgtttcaacactatctccggcaatgaagctcgttcggtttttgatgaagctgaacaacgagacggtttcgatcgaactcaagaacggcactgttgttcacggcacaatcacagggagtggatattagtatgaatacgcatttaaagacggttaaacttaccctaaaggggaagaatccagtgaccttagatcacctaagtgtcaggggcaacaacatcagatactacatcctgcctgacagcttaaatcttgagactttgctggttgaagaaaccccccgcgtcaaaccaaagaaaccaactgcagggagaccggtgggacgtggaaggggtctggacgcgggcgtgggtcgcggtcgaggccgttaagtttctaagattgttatatttggtttgtaacatttgtattgttg

SEQ ID NO: 2207 - DNA, 411 bp, Manihot esculenta
tcaggtttttgatgaagttgaataatgagactgtgtcaattgagctgaagaatggaaccgttgttcacggcaccattacaggtgtggatattagtatgaatactcatctgaagaccgtaaagttgacactaaaggggaaaaacccagtaactttagatcatctcagtgtgcggggaaacaatatccgatattatatccttcctgacagcttgaacctcgagactttgctggttgaagagacacctagggtcaaacctaagaagccaactgctgggaggcctttggggcgcggtcggggccgtgggcgcggtcgtggacgtggcagaggccgttagttgggtcgcagtaattctaatttttgtggcatatagtcatgtaaacatctatgttgtaaggagaatttgttggtaa

SEQ ID NO: 2208 - DNA, 703 bp, Cleome spinosa
tcggatttcatttcatttcaacgagacgagggttttggggggcgagggtttcagcagcttcaccacttactttctccgctgttctcgtctccgttcgaagatgaagctcgtcaggtttttgatgaagttgaacaatgagaccgtgtcgatcgagctgaagaacggaactgttgtccacggcacaatcactggtgtggatgtgagcatgaacactcacctgaagaccgttaaactgactttgaaggggaaaaacccggttacacttgatcatctaagcgttaggggtaacaatatccgctactatattcttcccgatagcttgaatctggaaactttactcgtggaggacactcccaggatcaagcccaagaaagctgccgctgggaaacctgttggacgtggtcgtggacgtggacgtgggcgtgggcgtggcagaggccgttagatgtattctctgtgcatgtgcccttggtgggcattgttggctactgtccaggataaaaatgatgaggtcagtgacttaaatttgtaggaaggggaacttgtgcttcgatttgtaggatatgtaaccgagttatgcttctaggaactcttggaaggaggaaatttgttttaaccaaatggtagtaatatgcaacatgtttcttcaatgcagttgcaatcccacaaacatacatatttaattgagctaagagctttatac

SEQ ID NO: 2209 - DNA, 798 bp, Gossypium hirsutum
tttgcatttgaaaatttgaatcgccatcaaactcagttctggagctttactctcatttcactgctcaaagttttcaaacatgaagctcgtgaggtttttaatgaagttaaataacgagactgtctccatcgagctcaagaacggaactgttgtccatggcaccatcacaggggttgatgttagcatgaatacacatttgaagacggtgaaactaacgctcaagggaaaaaaccccgttactcttgaccatctgagtgtccggggtaacaccattcgttattatattctccctgacagcttgaatctggaaactttgcttgtggaggagacaccaagagttaagcctaagaagccagctgcaggacggcctttgggacgtggtcggggtagggggcgtggacgtggtcgtggcagaggtcactaattggctctctgcaatttgccttcattgggtaccttactattttagtgtgctcgagcagaatttaagggagcgaagtttgaagtatacagtaagaatctgtctatttatatctgcccctagtttcctgctctagtttaattgttatatatagttgaacctgagattgtatgcaagtgaataaaaacggctgtcctctttctgtatggtctaaattagtaagcatttgatggtgcggttaaagggaggatgatgtgcatatggggatgacttggactaatggttcatcaagccaaggctagctatgtttttgcaacaaacaaacctctcaaatttgagtgagtgtttatatatatagtgatatactagtattgtac

SEQ ID NO: 2210 - DNA, 671 bp, Cryptomeria japonica
  misc_feature (495)..(495): n is a, c, g, or t
gaatgtcttcgtcatcgaattgtcgaatttgttatattagtcatttttactacttatgagtgtcttacatttggagctatacctgcatgtttagaacaataacagtcgattaagaactacttccgagtcttgcaacatttgcaaccatgaagcttgtacggtttctgatgaagttgaacaacgaaacagtcaacattgaactcaagaatggaactgtagtgcatgggaccattacaggggttgacataagcatgaacacacacctgaagacagtgaaactgacgctcaaggggaaagctcctgtaacactcgaccatctcagtgtcaggggcaataatattcggtactatattttgcctgatagcttgaacctggaagcgctgctggtggaagatacaccaagaatcaagccaaagaagacaactgctggcaaacctattggtcgtgggcgtggacgaggaaggggccgtggccgtggtcgtgggcggtaaattntatatatatatttgagagtttcaatgtagtacttggttgtacaaaattattgcaaacacttttgaagctaatctgtagcactctacgttgctgtctgagtattttcttcgggtgtggaaatttctgtgaattgaggttttacttggggctactttcttggtccttagatcaccatg

SEQ ID NO: 2211 - DNA, 719 bp, Euonymus alatus
cggccgggggaaacgagtcttcccacaaggaatcctgcatcatcgccattttaactctgaagtcccaactcccaagtagatacagatctctctcctctccggcttctcttacagtggccgtttgctccgagcctagttctttgtattctctccacgatgaagcttgtcaggtttttgatgaaattaaacaacgagaccgtttcaatcgaattcaagaatggaactgttgttcatggcacgattacaggtgttgatgtcagcatgaacactcatctaaagtctgttaagcttacactgaaggggaagaatccggtaactttggatcatcttagtgttaggggcaatagtattcgctattacatccttcctgacagcttgaatcttgagactctactggttgaagagacacctagagtaaaaccgaaaaagccaactgccgggagagctatgggacgtggtcggggcaggggtcgcggacgaggacgtggtcggggccgttagatacgtcgcactaagtttcaatttgtgttacatgttttgtgtaaacagcaatttgtgtgagagttgcttggtaactttagacatgaaagtattgtattcaacgtacttctggtgaacatttcccttgatggtggaacttgattgcgcattctgaattctcacctaaaacagtaattcttctcaggataatgcttgaggtctcaaactcaagttgagat

SEQ ID NO: 2212 - DNA, 750 bp, Euonymus alatus
gcgaaacaaagttttgaggcccagttagcccacaaaaagtagtgaaacgagtcttcccacaaggagtccggcatcatcgccatttcaactctgaagtaccaagtagatacagatctctttcctctccggcttcttacagtggccgtttgctccgaccctagttctttgtattctctccaagatgaagcttgtcaggtttttgatgaaattaaacaacgagaccgtgtcaatcgaattcaagaatggaactgttgttcatggcacgattacaggtgttgatgtcagcatgaacactcatctaaagtctgtgaagcttacactgaaggggaagaatccggtaactttggatcatcttagtgttaggggcaatagtattcgctattacatccttcctgacagcttgaatcttgagactctactggttgaagagacacctagagtaaaaccaaaaaagccaaccgccgggagagctatgggacgtggtcggggcaggggtcgcggacgaggacgtggtcggggccgttagatacatcgcactaagtttcaatttgtgtgacatgtttttgtgtaaacagcaatttgtgtgagagttgcttggtaactttagacatgaaagtattgtattcaacgtacttctggtgaacatttcccttgatggtggaacttgattgcgcatcctgaattctcacctaaaacagtaattcttctcaggatataatgcttgaggtctcaaactcaagttgagatcta

SEQ ID NO: 2213 - DNA, 626 bp, Unknown
  Sequence found in Organisms: Euphorbia peplus, Euphorbia esula
cgacagcaacggttcatttcctctgcaatcatgaagcttgttaggtttttgatgaagctcaacaatgagactgtctcaatcgagctcaaaaatggaactgttgtccacggcactatcacaggtgtggatatcagcatgaatacacatttgaaggctgtgaaacttactctaaaggggaaaaatccagttaccatggatcttttaagtgtgaggggtaacaacatcagatattatattctacccgacagcttgaatcttgagactttacttgttgaagagacacccagggtcaagcccaagaaaccaactgcagggagacctttgggacgtggacgaggacgtggccgtgggcgtggtcgtgggcatggacgctagatttgtggcagttgtttcaatttttgagacctgtagtgtaaacacttgcattgtagggaaagattatgaattttgggacacaaaaaagtggtattgcatttcactgtccaatctcgtatgtagtttattacaatgctatccagttgtttttcctatgattgatatagccttgctatgttttcttctagtgcttggatctgttaatgatttactctaatatcatcacaatgataaaaccctagcatgtctct

SEQ ID NO: 2214 - DNA, 656 bp, Linum usitatissimum
gaaaggggagagccctaaactaaggtcggtccgcctcctctgctcctcgccggactccgaaccctaacttttccttcgtgtttcttcgtcttccaccttcgcaatgaagctcgtcaggtttttgatgaagttgaacaacgagaccgtttcgattgagctcaagaatgggaccgttgttcatggcaccattataggtgtggacataagcatgaacactcatctgaaaacggtgaaattaacactgaaagggaagaatccagtaactctagaccatctcagtgttagaggcaataacatccggtattacatccttcctgacagcttgaatctcgagacattgctggtcgaagagacgcccaagatcaaaccaaagaaggcagttgctggaagggctgtgggtcgtggacgaggtcgtggccgtggacgaggacgtggtcggggacgttagtcggggacgagatctggtgtgtaatcatttgtgttgtagtcgaaaatttcatggaaaagtacttgtttcgaattgaattgtaagcttttaccgttcgtccgtaatgatttccgagtagttttacctctagcagcttagttacattcgaaactgatgttgttacaaccggactgtagtaggtcaaaccgaaacatgagagaatcatttc

SEQ ID NO: 2215 - DNA, 690 bp, Gnetum gnemon
actttcaagggtttttcttttagctgttagaagccacaatgaagctcgtgagatttctgatgaaactgaacaatgaaactgtgtctattgagttgaagaatggtactgttgtccacggcacaatcacaggtgttgacataagtatgaacacacatctgaagactgtgaaactgacattgaaagggaaaaatcccattacacttgaccatctcagtgtgaggggcaacaatattcgatactatattttgccagacagcttgaatttagaaacattgctggttgatgacactcctaagatcaagccgaagaaaccaactgcagggaagcctcttggccgtggccgtggtcgtgggcgtggaagggggcgtggccgtggacgttaatgaaacagctttattatgtaagaaacaggaattggaatcttgccagattttttgccattatattgtcttgctggaacaaaacactcaaatctttgattgcgtctttcgaggctgcatctgtctagaaagagttttataaatattttgggaaatgtagaagagattgtaacattgccacattttcataacagttaacacacttggctgcattttaggttgctatacatgtatttgtaatttgaccatatcagggattttgtcttctaattttcttccacttttctgagaatctgttacaaaggggcat

SEQ ID NO: 2216 - DNA, 677 bp, Capsicum annuum
tcagcatagtagtgctggcgctccttgccctaaacgggaggctgtatcgggagtatcttcaatttctccagcaagaatgaagctcgtcagatttttgatgaagctcaacaacgagactgtctcaattgagctcaaaaacggcaccgctgttcatggaaccattacaggtgtggatgttagcatgaacacacacctgaaggctgtcaaaattatgcttaagggaaagaatccagtgactttggatcacctgagtgtgaggggtaacaacatccgttattacattctccctgacagcttaaatcttgagacgctgctggtggaagatacacctagggtgaagccaaagaagccaacagctgggaagcctttgggacgtggtcgtgggcgcggtcgtgggcgtggacgtggtcgaggccgttaagtgcattccagctgctctaattttttgcagtattgcctatgtaaacatatgtacggattgagagatttgttcttagtttgccagtggacaaaagatcgatcttatgcaacaattattctggatccttagagcacgttattcgttgcatcatatggtctactagtattacttttgtatctcgttcaattttgctctgcctagtcatgtcactgaactatatttgtcccttttacatctggccaatttcaagcggccg

SEQ ID NO: 2217 - DNA, 629 bp, Capsicum annuum
ggagtatcttcaatttctccagcaagaatgaagctcgtcagatttttgatgaagctcaacaacgagactgtctcaattgagctcaaaaacggcaccgctgttcatggaaccattacaggtgtggatgttagcatgaacacacacctgaaggctgtcaaaattatgcttaagggaaagaatccagtgactttggatcacctgagtgtgaggggtaacaacatccgttattacattctccctgacagcttaaatcttgagacgctgctggtggaagatacacctagggtgaagccaaagaagccaacagctgggaagcctttgggacgtggtcgtgggcgcggtcgtgggcgtggacgtggtcgaggccgttaagtgcattccagctgctctaattttttgcagtattgcctatgtaaacatatgtacggattgagagatttgttcttagtttgccagtggacaaaagatcgatcttatgcaacaattattctggatccttagagcacgttatttcgttgcatcatatggtctactagtattacttttgtatctcgttcaattttgctctgcctagtcatgtcactgaactatatttgtcccttttacatctggccaatttcaagcggccg

SEQ ID NO: 2218 - DNA, 718 bp, Lippia dulcis
tgtttcaactttcaatttttggagccctagctactcagtagcaaccccaagatccgagcaaccatgaagctcgttagattcttgatgaaattgaacaacgagaccgtctcgattgaactgaagaacggcaccgttgttaatggaacgattataggagttgatgtgagcatgaacacacatttgaagaccgtgaaactgacaccaaaaggaaagaacccaataacccttgatcatctgagtgttaggggtaacaccattcgctactacatccttcctgacagcttaaatcttgaaactttacttgttgaagaaactcctagagttaagcccaagaagccaactgcagggagacctataggccgtggtcggggcagaggacgtggcagggggcgcggacgcggacgttaggttttttctatcgtttataatagtttgaaacttctgaaacgcagcccattattgtaaagaattgttgttgggaagtttggttacgtatgggatgattattgacactatgtacggcctttggttgcctgcaagccaggctgatacgatttatctcatcaggaaaccggcttcattttatggatatctatatgtaacagagatcacataatttgtgagattttgatgctgggattttcttctgttggccattttccgttcccaaactactgtatggtgcatttagctggatattaattgtgacttcattcat

SEQ ID NO: 2219 - DNA, 427 bp, Sciadopitys verticillata
ttgctacttaatttttgtaatcagacgccatgaagctcgtcaggtttttgatgaagttgaacaatgaaacagtgtctattgagctaaagaatggaacaatagtccatgggacaattacaggagttgatataagtatgaatacacatctcaagacagtgaagctgacactgaaggggaaggcttctgtagcacttgatcatctgagtgttagaggcaataatatccgttactatatcttgcctgacagcttaaatttggaaacattattggtggaagaaacccccagaattaagccaaagaaggcaactgctggaaaacctcttggtcgtggtcgaggacgtggccgtggtagaggtcgtggtcgtgggcgttagttactgcacccacactagaatgggttacaggaggatgttaagcgcctggctta

SEQ ID NO: 2220 - DNA, 997 bp, Sequoia sempervirens
tttttaagtctgctttcatttatacccttttcccacgctgttctgagtgtctaacatatggagctatacctgcatggttagaacaataacagcgaattaggaactacttctgagcgtcgtaacatttgcaaccatgaagcttgtccggtttctgatgaagttgaacaacgaaacagtcaacattgaactcaagaatggaactgtagtacatgggaccattacaggggttgacataagcatgaacacacacttgaagacagtgaaactaacgctgaaggggaaagctcctgtaacacttgaccatctcagtgtcaggggcaataatattcggtactatattttgcctgatagcttgaacctggaagcgctgctggtggaagatacacccagaatcaagccaaagaaggcaactgctggaaaacctattggtcgtgggcgtggacgaggaaggggccgtggccgtggtcgtgggcggtaacttgtatacatgtatttgagagtttcaatgatagtacttggttgtacaaaaatattgcaagcactttttaaactttttgagctaatctgtagtactctgtcgctgtttgagtatttttttggggtggcaatttctatgaattgaggttttactgggggctactttcttagtcctttgattacaatgattgagtagaaatttcttgcatgttattactaatgttttgtgaggcaatttttccctgatgacaatattttatgctgccattttttgctaacatgaagtctcacaagttacaataatggcacatgagggtgttattttgcggagttgcacttggtttgttaaggtttggtagcccttgtatgctctcttctcagctgtgaggatatttgtacccagtgaaagtactttcctgagctttattttgtaccttcatatagacttggataattaattagccatctcagttggaacggtttttcttggttaaaatcttgttaaataattatgtaagaa

SEQ ID NO: 2221 - DNA, 1013 bp, Nicotiana tabacum
  misc_feature (34)..(34): n is a, c, g, or t
  misc_feature (525)..(526): n is a, c, g, or t
  misc_feature (531)..(531): n is a, c, g, or t
  misc_feature (537)..(538): n is a, c, g, or t
  misc_feature (542)..(542): n is a, c, g, or t
  misc_feature (574)..(574): n is a, c, g, or t
  misc_feature (646)..(646): n is a, c, g, or t
  misc_feature (669)..(669): n is a, c, g, or t
  misc_feature (762)..(762): n is a, c, g, or t
cccctcatgcggccgctggaaaaggagcaatttnctctctgcttctgtaaaaccctaagcgtctgtacatcttcgtggacgacaatgaagctagtgagattcctaatgaagttgaataatgagacggtctccattgagctcaagaacggcaccgttgttcatggaactattacaggtgtggatgtcagcatgaacacacacttgaaagctgtcaaaattatgctaaaaggaaagaatccagtgacattgggtcacctgagtgtgaggggtaacaacatccgctattatatcctccctgacagcttgaatcttgagacgctgctggtggaagaaacacctagggtcaagcctaagaagccaactgctggaaaacctttgggacgtggtcgtggacgtggccgtggacgtggtcgtggtcgaggccgctaaatgtgttctagctcttctaattttttgtgatgtctatgtaaacatgtctgtacggatgaagatatttactcttagttttccagcgcaagtatattnntctcntgcaannagtngtctctgagcgcttaacatgagacttagaggngttattctaatgcaactgtggtagttacttgtagctctttctactgcattcagtcttgatcccccctggtcnagtcactcaaccatcttagcttngcgtccattttttcaactaggtttaagctttgaatcatttatcattttaatcaggtgctgctgtcaaacctctgttagcgtgtgtattaaagnggaaagattgttaattgatgttatgtcaatgtcatagataattccttgaaaaggatgctgctagtccatagaagggttataagatgtaagatcaaagcgcagctactgggtgaaagcagaaatactctaagaataattttatctatactgttgtcattatcattgtgatacaatttgtgagattttgcagcggccgctgggaatgtgtgatgaagaatattactatatgtatcaatataggctacagacag

SEQ ID NO: 2222 - DNA, 542 bp, Utricularia gibba
atcgagttaacatgaagctcgtaaggtttttgatgaaactgacgaatgagactgtttctcttgagctcaagaatggcactgttgtccatggtaccattataggtgttgatgtcagcatgaacacccacttgaagactgtgaaactgacactgaagggaaagaaccccatcacccttgatcatctaagcgttaggggaaataacatccgctattatattctcccggacagcttaaaccttgaaactttactcgttgaggagactccaagggtcaagccaaagaagccaactacagggagaccagtgggccgaggtcggggcagaggacgtggccgtgggcgtggtcgagggcgttagctgctaccgttgctctgatccttggttttcagttgcaaaatgtagaaggtttttcttcactagttatgtgttaatgatgtttcgctgactgcccttgtttaagaaagggtgcaacatccatgtggggactgtagatgcaacaatgtttcttgagcatccgtgcgaaggagggttgtgcggttttcc

SEQ ID NO: 2223 - DNA, 642 bp, Valeriana officinalis
taggactcgttctacttcaagccctaatttactagtctatcgtccgtctttcatctcatcatccacaatgaagctcgtaaggtttttgatgaagctcaacaacgagaccgtctccattgagctgaaaaacggcaccgtcgtacacggcactataataggtgttgatgtcagcatgaatactcatttgaagacggtgaaaatgacgctgaaggggaaaaatccaataacacttgatcatctaagtgttagagggaataacatccgctattatatcctccctgacagcataaatctagagaccttacttgttgaagagacccctagagtcaaaccaaagaagccaacagcaggcaaagctttggcaaggggacgtggaagagggcgtggccgtggtcgtggacgtggccgctaatcgcatcaaacccatataatatctactcttgcttctttttctgtttgcagtattacaaaaatgtagaaacctttttatctcctaagaatttctgattatcttattttgaggtaaagaattgagtattgaccagagaatgcttgtattttcagtgttacaaacttgcattgtaattttaggagataatttcatatctgagtactttattaattttggtagccaacttattc

SEQ ID NO: 2224 - DNA, 698 bp, Fagopyrum esculentum
aaatctcgctgctagtcttgtgccttttctcagggtttggtttccggctgccatcgccaccacttcgccgtccattaccaaccatattctgcgaagatgaagctcgtcagatttttgatgaagctgaacaacgaaactgtttcaatcgagctcaagaatggcaccattgtccatgggacaattacaggtgtggatataagcatgaacacacatttaaagactgtgaagcttacactcaaggggaaaaacccagttactctagatcaccttagtgtaaggggaaacaacatccgttattatatcctacccgatagcttaaatctcgagactttactcgttgaagaaacacctagagttaagcctaagaagcccactgcagggagggcagtgggtcgtggtaggggacgcggacgtggacgtgggcgtggtggaagaggaggccgctaattcattgagaccgggtgacgagcttcagagatgtataaacaaggttgtattaccaggttttgaaatcatttcaccagatccttgtttcatcaggataactttgtggttgagttttagcttaatagttgtggttatcaagttatcatgctattattgtcttgttttgagctacatctgatcagctaattcccattctattttgacattggaccttattatctttgatgggaattgaaatgtttgttcagcat

SEQ ID NO: 2225 - DNA, 535 bp, Epimedium sagittatum
acgaagacttttttaaattaggcttcttctcccgcttgtcgactgactttcctgccgagccctagtttcgctctctccgtctcttcaagatgaagctcgttaggtttttgatgaagttgaacaacgagactgtctcgattgagctgaaaaacggcacgattgttcatggcaccatcacaggtgtggacattagtatgaacactcatttgaagaccgtcaaattgacactgaagggaaagaatccagttactcttgatcacctgagtgttcggggtaacaacattcgctattacatcctacctgacagtctaaacctggagactttattggtggaggagacgcctagggctaagcccaagaaggcagtggctggaaggcctgttggtcgtggtcgtggtcgtggccgtgggcgtggacgaggacgtggccgaggccgctagttgtcctgcgcaatcacaattttttgcagcatctgcttatgtgcaaagatcatgcgtgcatagggagaaatcgtaccggggatgtttggagatac

SEQ ID NO: 2226 - DNA, 735 bp, Cajanus cajan
gctgttgtagctgttttgttttggctcaaaatctaaaacaaacgggtcggtggtgccgcgaccagcgagtactgtgtgtgtgaaaaccctgccttcaccatgaagctcgtcaggtttctcatgaagttgaacaacgaaactgtatcgatcgagcttaagaacggtacagttgttcacggcaccattacaggtgttgacatcagtatgaatacacatttgaaaacagttaaactaactctgaaagggaaaaatgcagttactttggatcatctcagcgtgagaggcaacaacattcgttgttatatccttcctgacagcttgaatcttgagactttactggttgaagagactcctaggatcaagcctaagaagccaactgctgggaagcctttgggacgaggacgggggagaggacgtggacgcgggcgtggtcgtggtggtggccgataaattgtggcatttggttgtacctttaccgtagggaaattttctgagcagttttaaagacgttgtagtagtgcggttgttagctaagtagttatgcagactctgttgatgttgttattttcttgcataattgtagaagtgctttgaaggtctagtgtataattcctacctgctgactaattgccttatacctctcgaccgaaagaaagaaactgcttatagtttgtagttctattttacgggacagggtgaaattataggaattactaatgatagcctttaatgtag

SEQ ID NO: 2227 - DNA, 682 bp, Eutrema halophilum
ttttcctcctcccgctctcgcttcttgccattgctgtttcgagctctcgctcaaagccctaattttccttttcgtctttcctctctcgccatgaagctcgttaggtttttgatgaaattgaacaacgaaacagtttcaatcgagcttaagaacggaaccatagttcacggaaccattacaggtgtagatgttagtatgaacactcatttgaaagctgtgaaactcactttgaaagggaagaatccagtcacattagaccacttaagtgtcagaggaaacaacattcgctattacattcttccagacagcttgaatctcgagactctactggtcgaagacactccaagaatcaaaccgaaaaagccaactgcagggaaggttccaccaggtggtcggggacgtgggcgcggaagaggccgtggacgtggccgtggtcgttaaggattttggcgtgttccaaagtttggtctctcttcttttattgtaacagcaggattataaaagatctatcttgtagtgagatttggttgtcatgaagaagacaaattcttcttatctttaagttttcatgattttgagttttgatacgttattgctaaacttatagcattctgcaatatcagtatcgtttattgttgatttcattactttgttacataatctgacaactctagggttcgag

SEQ ID NO: 2228 - DNA, 513 bp, Catharanthus roseus
gctaaaacctctctcgttcaaagatgaagctcgtaagatttttgatgaaactgaacaatgagactgtctcaattgaactaaaaaatggctccgttgttcatggaaccatcacaggggtggacattagcatgaacacacatttgaagacagtgaaactaacacctaaggggaaaaatccaattactctcgatcatctaagcgtcaggggtaacaacattcggtattatatcctccctgacagtttaaacctggaaacattgcttgtggaagagactccaagggtcaagcctaagaagccagtagcaggaaagcccataggacgggggcgtggcagaggacgtggacgaggccgtgggcgtggcgggcgctaaactttttaatatggttttttaatattggtgtaacttggatgtgtaaacagttcaatgatccactgaattttgtatgactgcagctttgaacatggtggttcccatgctattattaggttgtcaggccttacttgtgaaaaaa

SEQ ID NO: 2229 - DNA, 808 bp, Fragaria vesca
agcctttgggtgtcgtaaaatacgaagcgtctacttatgtgatgtcgtttggtcagccacaacccgagccctagaggttaaaaccagctagcgagtgcggcacagacggacagatccaccactctcccgcttcgtttttggaaaaccctctcgagccctagctctccagtttctctatcgccaaaatgaagctcgtcaggttcttgatgaagctgaacaacgaaaccgtatcgatcgagctcaagaacggcaccgttgtcaatggcaccatcacaggtgtagatattagtatgaatacacatttgaagacggtgaaacttacactcagggggaagaatccagtgactcttgatcatctcagtgtgaggggtaacaatattcgatactacatccttcctgacagcttgaatcttgagactctgctggttgaagagactcctagggtcaagcccaagaagccaactgcagggagggctgtgggaaggggacgtggccgtggacgtggacgcggtcgtggccgtggtggtcgttaagtacgctgcactgattaatttttgtggcaagaacttggcctgcctggtttgtaaacacctctgtaggacgaacttatttgtgatcttggagacatgaaatgagcggcactttttcctggttatgtaaacacctttgtaggaagtacttatctatgatctttgagacataaaatgagagcactgcctgttatttgaatgtctattcctagtgaaattcttaaaatgctattatgaacttggtgattgatatggtaatggcttctcatatctacttt

SEQ ID NO: 2230 - DNA, 882 bp, Cephalotaxus harringtonia
cttttgagtcggagctcgatctttgacgaaggctagggtttaaggctgtgtgattaattactgagcaaagccttgctctatattatttttgtaaccaggtgaattcattgtcgccatgaagctcgtcaggtttttgatgaagttgaacaatgaaacagtgaatattgagctaaagaatggaacagtagtccatgggacaattacaggagttgacataagtatgaatacacatctcaagacggtgaagctgacactgaaggggaaagctcctgtgacacttgatcatctgagtgtcagaggcaataatatccgctactatattttgcctgatagcttaaatttggaagcattattggttgaagacacccccagaattaagccaaagaaggcaactgctgggaaaactcttggacgtggacgaggccgtggccgtggtagaggtcgtggtcgtggacggtagttactgcacccactctagattgggttacagggggaagataaggccttggcttgcaggatttttttgggcattttcttgcaatggtgcataaacttactcaggtagcattgaaatggtagtcccatctttttgcctccaagttatgggtatcaaaggcagtttattctctttattaatgttgtgctgctttcgttcatagttcaagacgtgttggtagtgctttatttattctgttgttagattcttatgtatgcttatggtctccatgtgaccgaaccttttctgactgtctaatctgtcaaatattagctatattacttgcatcatatggacaaatcactggcattcttgttgaccaacacatgctttggtggaatcttatgaagttgcgcttgacatatttatggggtattgaacatcaa

SEQ ID NO: 2231 - DNA, 858 bp, Cephalotaxus harringtonia
ctcattgaaaccaggaatttctcgcactcgcaaccactttcctgtgtcaggaatttgttatattgtcattttaacatgaaatatttgctttgttagaacaactaaagtaagcaacgaatttcttccaagtgtctcaacatttgcagctatgaagctcgtcaggtttctgatgaagttgaacaacgaaacagtcaacattgaactcaaaaatggaactatagtccacgggaccattacaggggttgacataagcatgaatacacacttgaagacggtgaaacttacactgaaggggaaagctcctgtaacacacgaccatctcagtgtcaggggcaataatattcgttactatattttgcctgatagcttaaacctggaagccctgctggttgaagatacaccaagaatcaagccaaagaagacaactgctggcaaacctatcggtcgtggccgtggccgtggaagaggccgtggtcgtggccgtgggcggtaagttgaagtcccacaagttgcaacaatggcacatggagtactttttagttgagcagtgcttggtctgttaagtttttgtagcccttatgtgttctctgcagcctgtagggtatttgtagcccgtgaaagtacttcaatgcaaatttgggcaactaattagccatttcaatttagaatggttttgtttgattacaaatctagttggatagttttggtactgcttttgcggtagccttcccatcgatcatgtcattatttagaaactttataaacattatttaccttgtcgtttagagaattttattttcatgaatgggctattgaattactgatatttagtatgtctcattgtaaataaaggctctc

SEQ ID NO: 2232 - DNA, 807 bp, Linum usitatissimum
gacgagctgaccactgctgccgacgacaatccccccccaccgtgctcagctgcgctttcagacctacgctccaaagatgaagctcgtcaggtttttgatgaagctgaacaacgagacggtgtcaatcgagctcaagaacggaaccgtcgttcatggaaccatcataggggttgatattagtatgaacacgcacttgaagacggtgaagatgacactcaaggggaagaatcctgtaactctcgatcatctaagtgtcagaggaaacaacatccgctactacatcctcccagacagcttgaatctggagactttactggtggaggagactccgaagatcaagcccaagaaggctgtcgctggtagggcagtgggacgtggtcggggaaggggtcgtggacgaggacgtggccgtggtcgttaaacgtcgtaagagttgggggtatcgagctttccagatctcgttaggaactttgaagagtcggagtctttgtaagtgttttgagtgtgcttttgagaatttgaagcagaacattttgaaccaaattctaggctcttcccatatggccatataaagccatgagggttgttcatatgctttgcgggtagacagtctggagaaagtgccgagatggtgaaaaattgcagctgaatagagatgttgatgccactttctcctttgagctttactggattatgtactattagtcacttggaatgcttattatcttagtagtaacaaacttttttgagttgcctatgtgctcgagtaataagccgggctacgaaacgtgcaaagcttgaacagag

SEQ ID NO: 2233 - DNA, 870 bp, Linum usitatissimum
acgagctgaccactgctgcggacgacaatccccccaccgtgctcagctgcgctttcagacctcgctcctaggatgaagctcgtcaggtttttgatgaagctgaacaacgagactgtgtcaatcgagctcaagaacggaaccgtcgttcatggaaccatcataggggttgatattagtatgaacacgcacttgaagacggtgaagatgacactcaaggggaagaatcctgtaactctcgatcatctaagtgtcagaggaaacaacatccgctactacatcctcccagacagcttgaatctcgagactttactggtggaggagaccccgaagatcaagcccaagaaggctgtcgctggtagggcagtgggacgtggtcggggaaggggtcgtggacgaggacgtggccgtggtcgttaaccgtcgtaagagttgggcgtattgagctttccagatcttgttaggaactttgagaagtcggagtctttgagtgtgcttttgagaatttgaagcagaacattttgaaccaaattctaggctcttcccatatggccatataaagccatgagggttgttcatatgctttgcgggtgtagacagtctggagaaagtgccgagatgatgaaaaattgcagctgaatagggatgttgatgctactttctcgtttgagctttactagattatgtactattagtcacttggaatgcttattagcttaatagtaacaaacttttttgagttgtctatgtgctcgagtattaagccgggctacgaaacgtgctataagctcgaacagagagtactacctgttcatagcacatctgatagatcagcatggtgaaattgaaacttccagtccgagtttcctttaa

SEQ ID NO: 2234 - DNA, 1212 bp, Pinus pinaster
gaagtcctgtttggaaaagcgatctaaaaatagaaggaagactattgaaagggtttttgagactgccatcatttgcttatgacgcctagggtttaaccatagcatcggtcgattcctgctcggagaagcagaagcattcgccaaaacatttttttgaaaacgggccggtgccattgtcgccatgaagctcgtcaggtttttgatgaagctgaacaatgaaacagtgtctattgagctaaagaatggaacagtagtccatgggaccattacaggagttgacataagtatgaatacgcatctgaagacggtgaagcttacactcaagggtaagagccctgtaacacttgatcatctgagtgtgaggggcaataatatccgctattatattttgccggacagcttaaatttggaaacattattggtggaggacacccccaaaattaagccaaagaagccaaccgctggtagagctcttgggcgtggacgtggtcgtgggcgtggtaggggtcgtgggagggggcggtagttctgacacttgtagaattgaatcacagagggaagataaggctcttggtggaagtatttttgataggaaaatttttaggagcacattaaactggaataccttgttctttttaagtagaatctcgttctctttacatatcttacagggtatgcttatgatagatgaaaagtctgttctgttcattctgactattgtccaaggtcactgttcttgtacattgttcgagatttgtggtaatattggtaaacgttttgtcgattgggaggtttgtttgagtgtcactcaaaagatacaatgatctttgatattgaacttttgctattcattcacagcagtgtcttgagttaaacatgtggcaataaactgaacgctaatcctcaaagttactctaattgctggtactagtgtcaagcaatctgaaggcaattcactttttgctaaaatgtataatactcctgtattaagaagttcaatctattttctacgttatagacaaatttgaaaggtgattatacaattggcatttctgccattaatggcttaaggtagagtctcctttagaaaatagcatcctcaatgaatttggtcatctttagtggttctgtaagagattctctctagaaatgaatggagtaccaactttagtattggaggatgtttaatttcaaatatgacagatttgattg

SEQ ID NO: 2235 - DNA, 1177 bp, Pinus taeda
aagtcaggtttggaaaagcgaacgaaaaatagaaggaaagactcttgaaagggtttttgagactgcgatcattttcttatgacccctagggtttaaccataccatcggtcgattcctgctcggagaagcagaagccttcgccaaacatttttttgaaaacgggccggtgccattgtcgccatgaagctcgtcaggtttttgatgaagctgaacaatgaaacagtgtctattgagctaaagaatggaacagtagtccatgggaccattacaggagttgacataagtatgaatacgcatctgaagacggtgaagcttacactcaagggtaagagccctgtaacacttgatcatctgagtgtgaggggcaataatatccgctattatattttgccggacagcttaaatttggaaacattattggtggaggacacccccaaaattaagccaaagaagccaactgctggtagagctcttgggcgtggacgtggtcgtgggcgtggtaggggtcgtgggagggggcggtagttctgacacttgttttagaattgaatcacagagggaagataaggctcttggtggaagtatttttgataggaaaatttttaggagcacattaaactggaataccttgttctttttaagtagaatctcgttctctttacatatcttacagggtatgcttatgatagatgaaaagtctgttctgttcattatgactattgtccaaggtcactgttcttgtacattgttcgagatttgtggtaatattggtaaacgttttgttgattgggaggtttgtttgagtgtcactcaaaagatacaatgatctttgatattgaacttttgctattcattcacagcagtgtcttgtgttaaacatgtggcaataaactgaacgctaatcctcaaagttactctaattgctggtactagtgtcaagcaatctgaaggcaattcactttttgctaaaatgtataatactcctgtattaagaagttcaatctattttctacattatagacaaatttgaaaggtgattatacaattggcatttctgccattaatggcttaaggggtagagtctcctttagaaaatagcatcctcaatgaatttggccatctttagtggttctgtaagagattttctctagaaatgaatggaagtaccaactttagt

SEQ ID NO: 2236 - DNA, 974 bp, Populus trichocarpa
cgttcatctctctcgcttccaacactggcctttgctcttgcttcttcaaaccctagctccacaatgaagctcgtcaggtttttgatgaagctgaacaatgagaccgtctcaattgaactgaagaacggaactgttgttcacggaaccatcacaggtgttgatatcagtatgaacactcatctgaaaacagtgaaattaacagtgaaagggaaaaatccagtaactttggatcatctcagtgtgaggggcaacaacattcgttattacatccttcctgacagcttgaatcttgagactttgctgatcgaggagacacctaaggtcaaacctaagaagccaacagctgggaggcctctgggtcgcggtagaggccgaggccgtggacgtggccgcggccgctaatcatgtcttgcttgcttaaatttttgcagcgtctggttatgtaaacacctatgttgtagcaagaatctgctggtaaagttaggaacagttagagaatgctactgcattattttgctgtttgccttgtggaggcaaattgcaggactcgagtttgtctgtcggttaatccttttcaaattcaacccgaagatcaaaagtcatgagcttacgtcatgttactcttctgtatccagtttcattaaccaatgctggaatgctatcattcatggaacattctgatttgaattacctgcatgtagcggatactagtactgcgcaactggagcaagtggttaaaaaatccacttccggtggcctgattgatggctcgaaccgtctgaatgtctcttttaattgcttagttgtgctgctgatacatagcaaagttggctgactgatcagatgatcacctaaaacccatctgcgcattctttccaactgctggcaaggtttatcctgagaattgtttccgattattattgcaactgctagttctttcgtattaaatcctagcatgttgttttttcatccca

SEQ ID NO: 2237 - DNA, 680 bp, Silene vulgaris
ctccttctctcctctcccgctacaacacactctccatcttcttcaaactcaaaaccctaatttctcaatttcaaaatcatgaagctcgtcaggtttttgatgaaattaaacaatgagaccgtctccattgagctcaagaatggcactgttgttcatggcactatcataggtgttgacattagcatgaacacacatttgaagacagtaaaactcactccaaaagggaaaaaccccatcacaatggatcacttaagtgttcgtgggaataacattcgatattacattcttcctgacagcttaaatcttgaaactttgcttgtggaggaaacgccaagaatcaagccaaagaaggcagttgcagggagacccgtgggacgtggaaggggcagaggccgtggtcgtggacgtggccgtggccgttagtttttggactcctctaaagcactttcatcattctctagaattgcttaaagtgaagactattgtttcaaattaaggacggctggtaatagtgggtgctccatgggtgtagtgtacctcttaaaaacttggtaaatgttggcacactgtaaaatttagtttatgttggatatgatgtttgtgtttatttcaccgacttgagtaatttaggatgttacagcaagtgttgatttctacgaaatacagttcccgtgttattg

SEQ ID NO: 2238 - DNA, 841 bp, Silene vulgaris
aagccaacaaaaatactccccccttccaaagccctagcgtttctctctctacttttccccctttctcttccacaagatgaagctcgtcaggtttttgatgaagttgaacaacgaaactgtctccattgagctcaagaatggcactgttgttcatggcactatcacaggcgttgacatcagcatgaacacacatttgaagactgttaaacttacacctaaagggaaaaatcctctcacaatggatcacttgagtgttcgtgggaataatatccgatactacatacttcctgacagcttgaatcttgaaactttactggtggaggaaacacctagagtgaagcccaaaaaggcagttgctgggagacctgtggggcgtggaaggggcagaggtcgtggtcgtggacgcggccgtgggcgttaattttttggcatgctggtcagcttcgtttggtcactgtgatcagatcttatatgagcagagagtacatacatcactgtatggtatgggatgctggctactgtttcgactttaccgttatgctttcagtattcactagaattgcttatgacttaattttcaagttaaggatgatcagtaacggtaggtgttctgtggagtagtgtgtgacactttgtagaatatagttataatggatataatcgtagtagtttaccctcgatcatgttgcttagattgttttcttttgggtacatacgcgattactgttaacatgagcagcagttactttttatgggcggagaacactataaactcctcacaaagggggagctcaccaaggtgattgggctcagctgagaacactggacatgttggcttgat

SEQ ID NO: 2239 - DNA, 563 bp, Valeriana officinalis
ttcttcttcttcttcagtagctatgaagctcgtcaggtttctcatgaaattgaccagcgaaaccgtctcaattgagctcaaaaacggaaccattgttcatggaactattacaggtgtggatattagtatgaacacacatcttaagactgtaaaactgacactcaagggtaaaaatccagtgacgctagatcaccttagtgtccgtggtaacaacattcgttactatatccttcctgatagcatcaacctcgagactttgcttgtagaagagactcctcgtatcaagcccaaaaaacctactgctgggaaggcattggcacgtggaaggggacgtggacgcgggcgaggacgtggccgaggtcgttagttgtgttgcatcgtttcctatttttggaaagttcaaaaaaagaagaggaaatcaggtttatgcttattgtttcaagagaattattgtatggatctttttgttgtgaagaatattatttgtgattatgtttttgtgttggctaagtttgtaattggaagtcatacatggttttgtgtcgatcaacttttgtgccttt

SEQ ID NO: 2240 - DNA, 640 bp, Arabidopsis lyrata
ctcctcccgctcttgcttcttgccattgctgtatcgagctctcctcaaagccctaattttcttctctcaccatgaagctcgttaggtttttgatgaaattgaacaacgaaacagtttcaattgagcttaagaacggaaccattgttcatggaaccattacaggtgtagatgttagtatgaacactcatttaaaagctgtgaaactcactctgaaagggaagaatccagttacattagaccatttaagtgtcaggggaaacaacattcgctattatattcttccagacagtttgaatctcgagactttgctggttgaagacactccaagaatcaagcccaaaaagccaactgctggtaagcttccaccaggtcgtggacgtggtcgtggaagaggccgtggacgtggacgtggtggtcgttaagcattttgcagtgatcaaaagtttggtcctttttgttttgtaacagcaggattgtaaaagatctatcttgtagtgagatttggtgtcattaagacaaattcttgttatctcttaagttttcatgattttgagatttgatacgttattgccaaacgttttattattgacttcatcactttattacatagaatctgaaaaaacttggggaattcgagaaa

SEQ ID NO: 2241 - DNA, 683 bp, Arabidopsis thaliana
attgctgcttttcctcctcccgctcttgcttcttgccattgctgtttcgagctctcctcaaagccctaattttctcctcttcttcttcattctctcaccatgaagctcgtcaggtttttgatgaaattgaacaacgaaacagtttcaatcgagcttaagaacggaaccattgttcatggaaccattactggtgtagatgttagcatgaacactcatttaaaagctgtgaaactcactctgaaagggaagaatccagttacattagaccacttaagtgtcaggggaaacaacattcgctattatattcttccggacagtttgaatctggagactttgctggttgaagacactccaagaatcaaacccaaaaagccaactgcaggtaagattccagcaggtcggggacgtggtcgtggaagaggtcgtggacgtggccgtggtggtcgttaagcattttgcagtaatcaaaagtctggtcctttttggtttgtaacagcaggattgtaaaagatctatcttgtagtgagatttggtgtcactaagacaaattcttgttatctctttaagttttcatgaatttgagatttgaaacgttattgccaaacatacatcactcaatatgttttattattgacttgatcactttattacatagtctgataaaacgtggggagttcgagaaa

SEQ ID NO: 2242 - DNA, 648 bp, Helianthus annuus
aaaaactccaaaattttggaaccctagcttcttctctctctcgacaatgaagctcgtcaggtttctgatgaagttgaacaacgaaatggtctccattgagctcaagaacgggacagttgtacatggaactatcactggtgttgatattagcatgaacacacacttgaagaccgtgaagttgacaatgaacggcaacaatcccttaacccttgatcatctgagtgtgagaggcaataacattcgttactatatacttcctgacagcttaaatttggagactttgctagttgaggaaacacctagagtcaaacccaagaagccaactgcagggcgggctgtaggacgtgggaggggacgaggacggggccgtggacgtggacgtgggcgatagtcgtgtcactatctttttgttatatgtaagtgttgacctaatgttaaaggtgtaatcgtggtttttatgactgtatcaacaacagatacactgcaagtaggaccaagttactgctgaacagattcgggcaagatctaccactagttgaatgattatgggttttctactgcattttagatctttttgaccttcattgtactaaactcttgctagagtgtatatgcctttagcctctcgatgaaaagccaaacttgatg

SEQ ID NO: 2243 - DNA, 572 bp, Abies balsamea
taagacttggaaaaccaaaggtaaaagaaaagggagattcttaagagggttttaagacttgcatcggtttgcctgtgacgcctagggtttaaccatagcggtcgattcctgctcgtagaagcagaagccttcgtcagtacatttttttggaaacaggcgctgcaattgtcaccatgaagctcgtcaggtttttgatgaagctgaacaatgaaacagtgtctattgagctaaagaatggaacggtagtccatgggactattacaggtgttgacataagcatgaatacacatctgaagacagtgaagctaacactcaagggtaagagtcctgtaactctcgatcatctgagtgtgaggggcaataatatccgctattatatcttgcctgacagcttaaatttggagacattattggtggaggacacccccaaaattaagccaaagaggccaactgctggtagggctcttgggcgtggccgtggtcgtggccgtggcaggggtcgtggcagggggcggtagttcgttacactccctttagcatggcttacaaagggaagataaggctcttgctag

SEQ ID NO: 2244 - DNA, 921 bp, Arabidopsis thaliana
acacctttcgctgtttcctcgtcaatttctttgtttggttgttctttcttcgcatccaaagatgaagctcgtcaggtttttgatgaagttaaacaatgaaactgtgtctatcgagctgaagaatgggactgtggtccatggaaccatcactggtgttgatgtgagcatgaacactcacttgaagacagtgaagatgagcctgaaggggaaaaacccagtaacacttgatcatcttagcttgaggggtaataatattcgctactacattcttcctgatagcttgaacctcgagactttacttgtggaagacactcctagagttaaacctaagaagcctgttgctgggaaagctgttggacgcggtcgcggacgtggccgtgggcgtggtcgcggcagaggtcgttagatgtagcagcgctctggaacatgttgaaggtttgtgagtttaatttttaggagaatgtacgagttatgtaactagcaactctggcaaaggaaagatttgattgagaaatagtatgattgatgctctagtaaggagttactttgtaatggaattccatggataacaagatttggctttacatgttataagagcatctacaagtagagaatttgtgtgatactgatagctcaagactttttattcatttaacaaatctgactatcaaattgcattaacatgttgacaatcttagtatagaaaaactgctatctcctccgttaatcttccacatgaaacctatctcacatgatcctgcaattgggatcttgattgtaaacgggttccccgatctgattgggtagggataggaagatggcacaccatatccatcatgaggccatggttgataacatggctcaggtttttgccatggttgacaacatggctcaggtttcttctcttcaggtttcttctct

SEQ ID NO: 2245 - DNA, 1039 bp, Marchantia polymorpha
  misc_feature (750)..(750): n is a, c, g, or t
  misc_feature (757)..(757): n is a, c, g, or t
ggaaggcgtcggaagcgcgaactgagcagcagctgttgccagcaatcgagagattgagagtgagcgcaaaagagctcaacaaattttggaaatttgtggtatcgatgcgtggtttgtctctgtgttttagtgcagaaaaatcaggtcgacacctcgaataagttttcatttttctatatttcaagcgtcggtcttcacttcggttccatcaattcttggcaagtgagcaagagtagcagacatgaagctcgtcagatttttgatgaaactgaacaatgagacggtgacgattgagctaaagaacggcactatagttcacggaacgatcacaggtgtggacatcagcatgaacactcacttgaagacggtgaagttgaccttacggggaaagaatcctgttcctcttgatcatctcagcatcagagggaacaacattcgctattacattcttcccgacagtttgaacttggacacacttctggttgatgacaccccgagagtgaaggccaagaagccctctgcaggcaagccagtcggccgtggccggggtagaggcagaggtcgtgggcgtggacgcggtcggtagttgtacgttgattttcttcttctttggtggagaaagtttcaattattcttcgcttagcatctcttctagaggaatcttcacatcattgctatatgttaaactggggtgagtttcccagcgaagatacatgagagccttctttctgttttcctcccattgtgagncgaagangtaagctgtcaatgggacaggtactgagggcgaagtgattatctcaatagaggaggttatgagagggccatagattgatattggacttcagagtcagaatgaccctcaaaactaggtcctgagatgtgagtcctcggctttttgattgacgaaatcaaccatctgtataaatgtagttgcaggtgatttgtaaacaagactagttagactcgttaaaggcttgtcaattttgcgtgaaattgaagttcttgcagatcactgaggttctgcgaaagtttgggg

SEQ ID NO: 2246 - DNA, 821 bp, Pseudotsuga menziesii
cgtagaggcataagccttcgacagtacatttttttgaaaacaggcggtgccattgtcgccatgaagctcgtcaggtttttaatgaagctgaacaatgaaacagtgtccattgagctaaagaatggaacaatagtccatggcaccattacaggagtagacataagtatgaatacgcatctgaagacagtgaagctaacactcaagggtaagagccctgtaactctggatcatctgagtgttaggggcaataatatccgctactatatcttgcctgacagcttaaatttggaaacgttattggtggaggacactcccaaaattaagccaaagaggccaactgctggtagggctcttgggcgtggacgtggtcgtggccgtggacgtggtcgtggccgggggcggtagttttgatactccatttagcatagactacagagggaagataaggctctggctggaagtatttttggttggacaaattttaggagcactttggaacagtagtacctggttcttttcaagtagagctttgttcttttcacatatcttacaagctatgggcatgatggatgaaaagtcttttctgttcatcatgagtattgtcaaggccattgttcttgtacattgttcaagattttgtggtgatattggtaaatgttttgcttatttgggaggtaaatctcgtgtacatcttgggaggtaaatgttttacttatttggtaaatgttttgttcatgtcagatgaacatttttgtactgtttgcaaaagcctaaccgtgttacttttagatccattggatctataacatatttgctcttac

SEQ ID NO: 2247 - DNA, 1422 bp, Picea glauca
cggggattaaaactcgcgcaaaggcagcatactaaagcatcgataacataattcaatgtggccatatcactaccgtaatatacccaaagcttcttcataccttgatcatccacatagccacccttccccaaagaagaacggttttggaagttagacttggaaaagcgaaggaaaaataaaaagggttttttaaacttacatcatttttcctatgacgcctagggtttaaccatagcggttgattcctgctcggagaagcagaaggcttcgccattacatttttttgaagacggggcggtgccattgtcgccatgaagctcgtcaggtttttgatgaagctgaacaatgaaacagtaaatattgagctaaagaatggaacagtagtccatgggaccattacaggagttgacataagtatgaatacacatctgaagacggtgaagctaacactcaagggtaaaagccctgtaacacttgatcatctgagtgtgaggggcaataatatccgctattatatcttgcctgacagcttaaatttggaaacattattggtggaggacacccccaaaattaagccaaagagaccaactgctggtagggctcttgggcgtggacgtggtcgtggccgtggtaggggtcgtggccgagggaggtagttctgacactacctttagcatggattacagagggaagacaaggctcttgctggaagtatttttggttggacaaatttaggagcacattggaactgtagtatcttgttatttttacatatcttagagcgatgggcatgatagatgaaaagtctcttctgttcattatcagtattgtccatggccattgttcttgtacattgttcaagattcgtgggaatattggtaatgttttgttgatttggtaggtaaatctcgtgtacaggtatgtcagatgaacttttttatactatctctgaaagactaactgtgttacttttcttagatcctttagatggataacatatttggtcctaacatactttcacggagttttgcaattgggtttgtgggagtatcgctcaaaagatacagtaatctttgatattgaacgtttgctattcattgacagaactggcttgtgttaaatatgtggcaataagctaaatgctaatcctcaatgttaatctaattgctggtactagtgtcaagcaatctgaaggcaattcacattttgctagaatgtataacactccctgtattaagaagttcaatctatttttctacattatagacaattttgaaaggtgattatacatcgacatttctgccactaatggcttaaggtagagtgttcatggaaactagcatcctcaatgaatttggtctttagtggttttgtaagagattctctttactagaaatgaatggaagtacggattttaggtac

SEQ ID NO: 2248 - DNA, 684 bp, Helianthus annuus
aaaaaaaaactccaaaattttggaaccctagcttcttctctctctcgacaatgaagctcgtcaggtttctgatgaagttgaacaacgaaacggtctccattgagctcaagaacgggacagttgtacatggaactatcactggtgttgatattagcatgaacacacacttgaagacggtgaagttgacaatgaaaggcaaaaatcccttaacccttgatcatctgagtgtgagaggcaataacattcgtgacgagagacttcctgacagcttaaatttggagactttgctagttgaggaaacacctagagtcaaacccaagaagccaactgcagggcgggctgtaggacgtgggaggggacgaggacggggccgtggacgtggacgtgggcgatagtcgtgtcactatctttttgttatatgtaagtgttgacctaatgttaaaggtgtaatcgtggtttttatgactgtatcaacaacagatacactgcaagtaggaccaagttactgctgaacagattcgggcaagatctaccactagttgaatgattatgggttttctactgcattttagatctttttgaccttcattgtactaaactcttgctagagtgtatatgcctttagcctctcgatgaaaagccaaacttgatgggtttactgttattgttattaatctgttaatt

SEQ ID NO: 2249 - DNA, 612 bp, Citrullus lanatus
caggtttttgatgaagctcaacaatgagactgtctcaatcgagctcaaaaatggaactgttgtccacggcactatcacaggtgtggatatcagcatgaatacacatttgaaggctgtgaaacttactctaaaggggaaaaatccagttaccatggatcatttaagtgtgaggggtaacaacatcagatattatattctacccgacagcttgaatcttgagactttacttgttgaagagacacccagggtcaagcccaagaaaccaactgcaggtatgcctttgggacgtggacgaggacgtggccgtgggcgtggtcgtgggcgtggacgctagatttgtggcagttgtttcaatttttgtttttgagccatgtagtttaaacacttgcattgtggggaaagattatgaattttgggacacaaaaaagtggtattgcatttcactgtccaatctcgtatgtagtttattacaatgctatccagttgtttttcctatgattgatatagccttgctatgttttcttctagtgcttggatctgttaatgatttactctaatatcatcacaatgataaaaccctagcatgtctctagattggaatctcgtttttta

SEQ ID NO: 2250 - DNA, 537 bp, Antirrhinum majus
atgaaattgaacaatgagactgtatcgattgagctcaagaacggcactgttgttcacggcacaattacaggtgttgatatcagcatgaacacgcatctgaagactgtaaagcttacactaaaaggaaagaatccagtgaccatggatcacctgagtgtaaggggcaacaatatccgttattacatccttcccgacagcttaaatcttgagactttgttggttgaagagacacccagagtcaagcccaagaaaccaactgctggcaaacctttgggccgtggcaggggccgtggtcgtgggcgtggacgtggaagaggccgttaagttagttccaatcatttcattttttgtagtatttggttatgtaaagatatgtattcaatgagatatatcacatgcttatgtgcctagctagcatgagttgatgttttcagaaatgaaatttgtgatggcctatgaattatgatatatttcacgttgtgttgtggcgcgatagtcgtcttctttaagcattgactctatgttcacagttattgt

SEQ ID NO: 2251 - DNA, 811 bp, Arabidopsis lyrata
caccttttgctctttcctcgtcaatttctttgtttggttgggttgttctttgtcgcatccaaagatgaagctcgtcaggtttttgatgaagttaaacaatgaaactgtgtcaatcgagctgaagaatgggactgtggtccatggaaccatcactggtgttgatgtgagcatgaacactcacttgaagacagtgaaaatgagcctcaaggggaaaaacccagtaactattgatcatcttagcttgaggggtaacaatatccgctactacattcttcctgatagcttgaacctcgagactttacttgtggaagacactcctagagttaaacctaagaagcctgttgctgggaaggctgttggacgcggtcgtggacgtggtcgtggtcgtggtcgcggcagaggtcgttagatgtagcactgcactggaaaaagttgaaggtttgtgagttaaatttttaggagaatgtaccgagttatgtatctagcaattctggcaaagcaaagatttgattacgaaatggtatgattgatgctagtaaggagttactatgtaatggaattccatggataacaagatttagctttacatgttataatcgcatctacaagtagagaatttgtgtgattttgagagctcaaggcttttttattcatgtaaaaaatctgactatcaaagtgcattaacttgttgacaatcttagtatagaaaaatgctatctcctccgttagtcttccacttgaaacctatctcacatgattctgcaattgggatcttggttgtagacaggttccccgatctgatggtagggat

SEQ ID NO: 2252 - DNA, 401 bp, Cedrus atlantica
gccatgaagctcgtcaggtttttgatgaagctgaacaatgaaacagtgtccattgagctaaagaatggaacggtagtccatgggaccattacaggagttgacatcagtatgaatacgcatctgaagacagtgaagctgacactcaagggtaaaagccctataacactcgatcatctgagtgtgaggggcaataatatccgctattatatcttgcctgatagcttaaatttggagacattattggtggaggacacccccaaaattaagccgaagaggccaactgctggtagggctcttgggcgtggacgtggtcgtggccgtggtaggggtcgtggcagggggcggtagttcttacactcctttagcatggattggattagaaagggaatataaggctctcg

SEQ ID NO: 2253 - DNA, 938 bp, Ceratodon purpureus
gctgtatcgcaccacagcgagctcggccttgccccgctcgacttcactttgcgccattacgagttgccggatcgttgcgcctcacgcgtccaaagtcttccctgcattgcctcgtgaacccggcgcatctcttttttggaagctttctggcagggtcgcccagtagcccgccattatgaagctcgtcaggtttttgatgaaattgaacaatgagacggtgtcgatagagctgaagaatggaactattgtgcacgggactattacaggtgtggatatcagcatgaacacgcatttgaagaccgtgaagcttactctgaagggaaaggttcctgtggctctcgatcacctgagcatccgtggcaataatatccgatattacatcttgccggacagtttgaatctcgatacacttctcgtcgatgacacgccgcgcgtgaaagctaagaagcccgttgcaggcaagccagtggggaggggaagagggcgtggtcgtggcaggggacgtggacgtgggcggtaaaaatgtatattttaggccactctgggatttcaggtgtagttctcagagcttcaggtgcaagaagagaactttaaaaagtgtgttttttcatgttgtagttaaccactccactttgtctcaattttgagtagtctccggcaggactcggcactggcaggtgacaacaaagagtcagaagcgttcgagaatatgtagtggcctacaacagtggattaaggaagtgcttagcaatgtcactctagtttgaagtagtcacatatgctcacagtgctgaagctggcacttctattcactagtagcttttgtggcacacaatttagctgcaatatcagctggaaattgacttttgtactgatttttgtttcaatctctcttttaatgttcactgcttgcagtgcgatgcacttgacttgaaaat

SEQ ID NO: 2254 - DNA, 640 bp, Cucurbita pepo
atgaagctgaacaatgagacagtctcaatcgagctcaaaaatggaactgttgtccatggaactatcacaggtgtggacatcagcatgaatacacatttgaaggctgtgaagcttactctaaagggtaaaaatccagtcaccatggatcatttaagtgtgaggggcaacaacatcagatattatattctacctgacagcttgaatctcgagactttacttgttgaagagacaccgagggtcaagccgaagaaaccaactgcagggaagcctatgggacgtggacgaggacgtgggcgtgggcgcggtcgtggtcgtggacgctagatttgttgcagttgtttcaagttttgagaccggtagtgtaaacacttgtattgtagcgaaggattctgaatttagtgacggtatagcaattcactgctcaatctcatgtgtttattacaacgttatccagttgtttttctatgattgacgtagccttactatgtttttttgatgcctggggtctgttattgatttacactcttaatatcatcacaatgatcaaactctggcatgtctctagattggaatctcgtctcttatcttccaactttgatagacgtagtcatgctgttcttaagttggttacaatgaaaga

SEQ ID NO: 2255 - DNA, 681 bp, Heritiera littoralis
gagccctaaattttactccctacagaggaaacctggcagcaagcaggtccttctctctcccgcttccatcgacagctcgactggctctctcgctttttgcttcaggccctgcctctcctctctctcttcaacacgaagctcgtcaggttttttaatgaagttgaacaatgaaacggtgtcgattgagctcaagaacggaaccgttgttcacggcacaattacaggtgtggatatcagtatgaatacccatctgaaaacagtgaaacttacattgaaggggaaaaatccagtaagtttggatcaccttagtgtgaggggtaacaatattcgctactatatcctgcctgacagcttaaatcttgagacattgctggttgaagagacacctagggtgaaacccaagaaaccaacagctgggaagcctttgggacgtgggcggggtcgtgggcgtggacgtggacgtggacgaggccgttaaatatgtagcccttcttgcaaatttttgtgacggctggatgtgtacacagcttttctgtagggagaatttgcaggtgatgtaacgagtattaaaggaattgtattggtattatgtgattattagcctggtttgaatggcttaatcatggatattgagattctcgatgtaggattatttgacctaatgctaatagctgagcagaa

SEQ ID NO: 2256 - DNA, 699 bp, Mimulus guttatus
gtgccagtgtcacttcgattcctaaaacccttcccttccgcagatttttattttctttggttgctttcgcaaaaaccctagttcttcatcgactacctctcgcaacgatgaagctcgtcagatttctgatgaaattgaacaacgagtctgtgtcgattgagctaaaaaacggcaccgtcgttttcggcactattattggtgttgatatcagcatgaacacgcatctgaaagctgtaaagcttactttgaagggaaagaatccagtgactatggatcaccttagtgtaaggggtaataacatacgttattacatccttcccgatagtctgaatctcgagacattgctagttgaagagacacctaagatcaagcccaagaagccaattgcagggagagctgtgggccgcggtaggggcaggggtcgtgggcgtggacgcggtagaggccgttaaatatctaaccaatcgtatcagtttttgtagtattttttgttatgtaaaatctgtatttgaagaagtgaatgtgtttctagaagaacttgaatatgatctgtgcaatgtttacaggtaaaagatcattgtgattttaatgacattgttccgtggtttagctcaacttttacatgccgcctcttccgtttgcatgcattgtggtttgatatatacgatgtttatggtgaactacggctttttggttact

SEQ ID NO: 2257 - DNA, 694 bp, Tropaeolum majus
aggtttttgatgaaattgaataatgagactgtatcgatcgagctcaagaacggaacgatagttcatggcacaataacaggagtggatatcagtatgaatacacacttaaagactgttaagttgacactgaagggaaaaaatccagttactcttgatcatctaagtgtaagaggcaacaacattcgttactatattctacctgacagcttgaacctggaaactcttcttgtggaagatacaccaagggttaagccaaagaaagcaactgctggaagagctattggacgaggtcgtgggcgtggacgtggccgggggcgtggccgaggtcgctagatgtatccatgttttgcggttgtatctgcgttgaatcatacatgtgcactgcactgggaaaccaaatacgatttcatcaatttatccaattacaaagaaacccaactttcacgcacaggtaatccacatttatatgagaagaactccgtaactggttgttatcttaggtttgtttaatttagaggtagttaaatttttcgtttctaaaattgagttttatttcactcttgtcccttgtgtttttataaaccatatagttgccaaattttttatggacattaaggttgagcatgtttttttgttttcctgctgactaaccaaactgcattatgcgtgatagtttttatattgtaattttatg

SEQ ID NO: 2258 - DNA, 966 bp, Physcomitrella patens
gctgagcttggttgccgacggatttgctggccgattgttgcaattcctcggatgcaagttgtttactacttcggtgctatccctcaccagcggccaattttcattttttaagcttagcagcaggttcagcaagtatcagtcacaatgaagctcgtcagatttttgatgaaactgaacaatgagacggtatcgatagagctcaagaatggaaccattgtgcacggtactatcacaggtgtagatatcagcatgaatacgcatttgaagtctgtgaagctcactttgaagggaaaggttcctgtggctctcgaccatctcagtgtccgcggcaacaacattcgatattatatcttgcctgacagcttgaatcttgacacgcttcttgttgacgatacaccgcgcgtgaaagtcaagaaacctgttgcaggcaaacccgttggaaggggaagagggcgcggtcgtggcagagggcgtggacgtgggcgatagtttgtggttcatatccctcattagggtttccagtgttgctgagcgaccccctggtataagtacagtgctactaaatgcacatgtgtatcttattgatgttggccgcgtcaatttatctcaattctgagtattctttggcaggataaggtgcttgcaggtgatgagaaagagcctctgtgttcgagggtcaatagtagcgtcaagggtggatcatggaagtgcttggtaatgtgactttttaggaaagagccacggatatatgtattgccgatgcttctgtcatcctgtaacatctgtgatacacaaagtaactgcgatatcagctggaaattggcactcgtgttttttttgcccggcccaatagttcctccttatgttaatatctgggtgggtctagtttcgaaacaatttgtacttgcgtgaagccgagaaggttattgacgctgtgaaatacaacagcactcccagatctaagct

SEQ ID NO: 2259 - DNA, 545 bp, Utricularia gibba
agattcttgatgaaactgacgaatgagactgtttcacttgagctcaagaacggcaccgttgtccatggtaccattataggtgttgatgtcagcatgaacactcacttgaagacagtgaaactaacactgaagggaaagaatccgatcacccttgatcatctaagcgttcggggaaacaacattcgctactatatcctccccgatagcttaaacctggaaactttactcgtcgaggagactccaagggtaaagccaaagaagccaaccgcagggagaccagtgggccgtggtcggggcagaggccgtggtcggggtcgggggcgtgggcgttagtcgtccccattgttctgatccatggagttcattttagttccaaactgtagaaggtttgtgtgaaagctgtgttttgttcactacccatgttcaaggacgagcaactatccaacttttctccatgagcagctttggagagctgtgcccatttccgtcatttcctactctccccaaacattcaggaccataacaatcgcgaggtaactctttag

SEQ ID NO: 2260 - DNA, 562 bp, Triticum aestivum
  misc_feature (336)..(336): n is a, c, g, or t
  misc_feature (340)..(340): n is a, c, g, or t
  misc_feature (365)..(365): n is a, c, g, or t
  misc_feature (454)..(454): n is a, c, g, or t
  misc_feature (528)..(528): n is a, c, g, or t
caaaaaccctagctttacctccccacaagcgcctccaagatgaagctcgtcaggttcttgatgaagctgaacaacgaaacggtgaccatcgagcttaagaacggcaccgtcgtacacggaaccattaccggtgttgacatcagcatgaatactcatctgaagactgtgaagctgacactaaaagggaaaaatcctgttacccttgatcaccttagtgtgaggggaaacaacatccgctattatatccttcctgacagcctaaacctgggagactttgctggtttgaggaaacaccaagggtcaagcctaagaagcctacttctgggaacccttggncgtngggcgtggccgtggccctgggcgcngtccgggtccgggactttagcatgctaactgcttttgggaatgcattgcgtgcatctgcagtgtatccacattccctatcaattgtacnaattatcctttgattatcaacattatcaatgtttttttgccgtggttaagttgataagtacagtgtaatagtcntcccaaaactttagacattaatacatcttagact

SEQ ID NO: 2261 - DNA, 641 bp, Brassica juncea
tccattcttcctctctcgccatgaagctcgtaaggtttttgatgaaattgaacaacgaaacagtttcagtagagcttaagaacggaaccatagttcatggaaccattacaggtgtcgatgtaagtatgaacactcacttaaaagcagtgaagctcactttgaaagggaagaatccagtcgcattagaccacttaagtgtcaggggaaacaacattcgctattatattcttccagacagcttgaatctcgagactttgctggtcgaagacacacctagaatcaaaccgaaaaaacctactgctggaaagattccaccaggtggtcgtggacgtgggcgtggaagaggtcgtgggcgtggtggtcggtaaacattatgcagtgatccgaagtatgatctatcttgttatctttgaacttttcatgattttagatttcatttcatacgttattgctaaactaatcaaacacggaaacaatctctttcgtttattactgaattcattacacaatctgataagactcaaaaggttcgagattattggttttgacattttccaagaatctggataaactcaaagattaaactaagacagagccgttcatcacagtcacagctttgccagtgagcaagacccccgcgt

SEQ ID NO: 2262 - DNA, 752 bp, Brassica juncea
cccaattattattattttctctcttcctcccgcttcctcccggattcccttcttcccgattgcagtatcgagattatgggaggagctctcccttagaaataaaccctatatctcttctattccattcttcctctctcgccatgaagctcgtaaggtttttgatgaaattgaacaacgaaacagtttcagtagagcttaagaacggaaccatagttcatggaaccattacaggtgtcgatgtaagtatgaacactcacttaaaagcagtgaagctcactttgaaagggaagaatccagtcgcattagaccacttaagtgtcaggggaaacaacattcgctattatattcttccagacagcttgaatctcgagactttgctggtcgaagacacacctagaatcaaaccgaaaaaacctactgctggaaagattccaccaggtggtcgtggacgtgggcgtggaagaggtcgtgggcgtggtggtcggtaaacattatgcagtgatccgaagtatgatctatcttgttatctttgaacttttcatgattttagatttcatttcatacgttattgctaaactaatcaaacacggaaacaatctctttcgtttattactgaattcattacacaatctgataagactcaaaaggttcgagattattggttttgacattttccaagaatctggataaactcaaagattaaactaagacagagccgttcatcacagtcacagctttgccagtgagcaaga

SEQ ID NO: 2263 - DNA, 792 bp, Beta vulgaris
taggatagctaaactcaaaaactcacatttcctctcccgctcttagactgcactttcactctcattcttacccaaaggccaaaaccctagcccctttctctctctctcaaaaagatgaagctcgtaagatttttgatgaaattgaacaacgaaactgtctccattgagctcaagaatggcactgttgttcatggaactatcacaggtgttgatataagcatgaacacacatttgaagactgttaaactcacaccaaaagggaaaaatccacttactatggaccacttgagtgttcgtgggaataacatccgatattacattcttcctgacagcttgaatcttgaaactttacttgtggaggaggcgccaagagttaagcctaaaaaggcggctgctgggagacctgtggggcgtggaaggggccgtggtcgtggacgtggccgtggccgtggtggtcgataagtgttttagcagtttggtccttgtaaacagatcttatgtgggcagaaaagttcaatcagtgatgaggtgtgaatgcagattatgttttgactttatcttattggctgatctataaatgtaccttttcttagaaccttgatattggtagatgttgcaaaaagtgtacttgttaagaagtaagcagtcgctaattgtttgtagaaattagtcaattactagaccaattattttgtttttcacgtgtttctttgacaaatagaactacgataaatcccgcgatttgctacttgattagcacacaatatgaaatctccagcacttgattagcac

SEQ ID NO: 2264 - DNA, 587 bp, Beta vulgaris
  misc_feature (561)..(561): n is a, c, g, or t
ctctcattcttacccaaaggccaaaaccctagcccctttctctctctctcaaaaagatgaagctcgtaagatttttgatgaaattgaacaacgaaactgtctccattgagctcaagaatggcactgttgttcatggaactatcacaggtgttgatataagcatgaacacacatttgaagactgttaaactcacaccaaaagggaaaaatccacttactatggaccacttgagtgttcgtgggaataacatccgatattacattcttcctgacagcttgaatcttgaaactttacttgtggaggaggcgccaagagttaagcctaaaaaggcggctgctgggagacctgtggggcgtggaaggggccgtggtcgtggacgtggccgtggccgtggtggtcgataagtgttttagcagtttggtccttgtaaacagatcttatgtgggcagaaaagttcaatcagtgatgaggtgtgaatgcagattatgttttgactttatcttattggctgatctataaatgtaccttttcttagaaccttgatattggtagatgttgcanaaagtgtacttgttaagaagtaaaaa

SEQ ID NO: 2265 - DNA, 484 bp, Thellungiella halophila
ggagcaaagctttagacgggttttagcttctgcttctttgcttctttctcccccaaactccgaaaaaatgaagctcgtcaggtttttgatgaagctgaacaacgaaactgtatcgatcgagctgaagaacggtactgttgtccatggcaccatcactggtgttgatgtgagcatgaatacgcacctgaagactgttaaaatgactctgaaggggaagaaccctgtgactctcgatcatctaagcttgaggggtaacgatatccgctactacattcttcccgatagcttgaaccttgagactttacttgtagaggacactccaagggttaagcccaagaaggctgctgctactgggaagtctgttggacgtggccgaggacgcggtcgtggacgtggtcgtggaagaggtcgttagatgtattttctttttgcatataacctttgctggctactacttatctactgggaaaaaaaaagttaaagg

SEQ ID NO: 2266 - DNA, 847 bp, Ceratodon purpureus
cctcgttgagggttgtcttcgctctcgcctgttggcagctgagtttgcagtgcttcgcgttttgtttggcgcccaacgccagcactgtccgcaaggtgctggccgatcgtcactgcattgcattgcttccagtcacccggaagatcctcaacaaccaggcacaacatccaggccgtcaccatgaagctcgtcaggtttttgatgaagctgaacaatgagacggtgtcgattgagctcaagaatggtactatcgtacacggcactatcacaggtgtggatatcagcatgaacacgcatttgaagactgtgaagctcactttgaagggcaaggttcctgtggctctggatcatctcagcattcgtgggaataacatccgatattacatcttgccggacagcttgaatcttgacacgcttctcgttgatgatgcccctcgtgtgaaagcaaagaagcctgttgcaggcaaaccagtgggaagaggaagaggacgcggccgtggcaggggacgtggacgtgggcgttaattttgtatttttatttccttcttgggggtttctggtgtacttctcagagactctgcttccagaagagttcttgtaaacgtggttttctttaccttttagttggccagtctattttgagtagtctgggataggactaggcgctcgcaggtgacaacaaatagccaaaatggatcgagaatatgtagtggcctacaccggtggattaaggaggtacttgacaatgtgactctatgtagatacttgcattgctcgaggtgtgcttctgttatgtagtagcttctgtgaacacgcaatttggctgcaatatcagctggaaatttac

SEQ ID NO: 2267 - DNA, 553 bp, Cucurbita pepo
tgaagctgaacaatgagacagtctcaatcgagctcaaaaatggaactgttgtccatggaactatcacaggtgtggacatcagcatgaatacacatttgaaggctgtgaagcttactctaaagggtaaaaatccagtcaccatggatcatttaagtgtgaggggcaacaacatcagatattatattctacctgacagcttgaatctcgagactttacttgttgaagagacaccgagggtcaagccgaagaaaccaactgcagggaagcctatgggacgtggacgaggacgtggacgtggacgtgggcgcggtcgtggacgctagatttgttgcagttgtttcaagttttgagatcggtagtgtaaacacttgtattgtagcgaaggattctgaatttagtgacggtatagcaattcactgctcaatctcatgtgtttattacaacgttatccagttgttttctatgattgacgtagccttactatgttttttgatgcctggggtctgttattgatttacactctaatatcatcacaatgatcaaactctggcat

SEQ ID NO: 2268 - DNA, 643 bp, Mimulus guttatus
aataaaattgaacacctcccgctcccccaaatttattcaactttcaatttttggagccctagctactcagtagctaacctcgacgagatccgagcaaccatgaagctcgtaagattcttgatgaagttgaacaacgagactgtgtcaatcgaaatcaagaacggcaccgttgtaaatggaacgatcataggagttgatgtcagcatgaacacacacttgaagagtgtgaaacttacaccgaaaggaaaaaacccaatcagcctcgatcatttaagtattaggggtaacaccattcgctactatatacttcccgacagcttaaatcttgaaactttacttgttgaggagactccaagagttaagcccaagaagccgattgcagggaaacctttgggtcgcggtcggggcagaggacgtggtagggggcgtggacgtggtcgttaagttttttccgtcgtctcgaacatttgcgattaccgtaaagaatctatgttgaaaatttgggtgaattttcttgacttttagaatattctaattgtattttcagcacatttggtgtaatgaatctttttaactgttttttttcgtatttgaggcgaacagtattatcgagttgcatattcggttgccaactattttactt

SEQ ID NO: 2269 - DNA, 556 bp, Physcomitrella patens
tgcttcgcagccccgggtcgtccttcttcctcggcccacgcttctaagctacgttgcatttcgaagctgcagccgattcctcctccggactttgtttgagaagattcgacaaattggggagtcaccatgaagcttgtcagatttttgatgaaactgaacaatgagacggtatcaatagaactcaagaatggtactatcgtgcacggcactattacaggtgtggatatcagcatgaacacccatttgaagtctgtgaagctgactctgaagggcaaggttcccgtgtctctcgaccacctcagtatccgtggcaataatatccgctattacatactgcctgacagcttgaatctcgacacacttctcgtggatgatacgcctcgcgtgaaagcgaagaagcctgttgcaggcaagccagtgggtagaggaagagggcgtggtcgtggcaggggacgagggcgtgggcggtagttttatcttgattaccctattcggggtttttgatgtggttctcacagctactggttcaagtagagtactttcaaacgtgcgtttt

SEQ ID NO: 2270 - DNA, 674 bp, Primula obconica
ctccggttgaacttattcagtaaaaccctagtttcgatctttctctctctctctctctctaccaaacatgaagctcgtctaggtttttgatgaagctgaacaacgagaccgtctcgattgagctcaagaacggcaccgtcgttcacggcaccattacaggagtggatattagcatgaacacacacttgaagactgttaaactcacagtcaagggaaagaatccagtgaccttggatcacctaagtgtaaggggtaccaacattcgatactatatccttcctgacagtttgaacctagagacattattggtagaagagacgcctagggtcaagcccaagaagccaactgcaggtaagcctttgggacgtggcagaggccgtggtcgtggacgtggacgtggtcgaggccgttaatcacaatttttggagcatttggttttttaaacctctgttatggaacttggtaatactattgctgttatgatttatgagctgtctagtgaaattaggagttgtcttttgtgctttatatgggtctatgcatcattcccaacatgtcgaagttaaattcctaggctactatatgatgtttgatttcagctcttttgtagtacttattgtgaaagttcctgcaggtgcaaaacatgttgtgttagtagactccgactatattta

SEQ ID NO: 2271 - DNA, 635 bp, Primula obconica
ctctctctctctaccaaacatgaagctcgtctaggtttttgatgaagctgaacaacgagaccgtctcgattgagctcaagaacggcaccgtcgttcacggcaccattacaggagtggatattagcatgaacacacacttgaagactgttaaactcacagtcaagggaaagaatccagtgaccttggatcacctaagtgtaaggggtaccaacattcgatactatatccttcctgacagtttgaacctagagacattattggtagaagagacgcctagggtcaagcccaagaagccaactgcaggtaagcctttgggacgtggcagaggccgtggtcgtggacgtggacgtggtcgaggccgttaatcacaatttttggagcatttggttttttaaacctctgttatggaacttggtaatactattgctgttatgacttatgagctgtctagtgaaattaggagttgtcttttgtgctttatatgggtctatgcatcattcccaacatgtcgaagttaaattcctaggctactatatgatgtttgatttcagctcttttgtagtacttattgtgaaagtccctgcaggtgcaaaacatgttgtgttagtagactccgactatatttagacatgaaa

SEQ ID NO: 2272 - DNA, 771 bp, Pteridium aquilinum
cttgaaaccctgttgtacccccctctctcctcgtcaggaagaaccctaaacgttcagtctcttcttcctcttcgttcgctcagcatgaggctcgtcaggtttttgatgaagctgaacaatgaaactgtttcgatagagctgaaaaatggaactattgttcacggcaccatcacaggtgtcgacatcagtatgaatacacatttgaagactgtaaaattgaccttgaggggaaagaatcctgtgactttggatcatctaagtgtgaggggtaacaacatacgatactacattcttcctgatagtttgaatttggatactttactcgtggatgatacccccaaagctcgacctaaaaggccaacagctggaaaaccattgggcaggggacgaggtcgtggtcgtggaaggggacgagggcgtggacgctaggctaggctctcttgtttatccatggtgtggctgccaaattttgcttaacctccatgagtcttttcttctgaacctaaccatcgccccatggatcctgctattgtttgctctaagaaatctacagacctgttttcttttggcctggtcctgatttctaggcatttctcgtctttgaaggtagtgcaagatttggtctgagctttttaatgctatagcctcttttggctttttgggccgtcgagctctgttacagttaagttgtggatgctatagatgtgtaagttcacctcttgattgcttacattctagctgacgctggattgtttaaccttcaaaaaagaa

SEQ ID NO: 2273 - DNA, 570 bp, Selaginella moellendorffii
gcaagaactcccagtgtagaaggcggctttgcgagcgaggagacgccgccgagatgaagctcgtgagatttctgatgaagctaaacaacgagacagtatccatcgagctcaagaatgggactattgtgaatggaacaatcacaggcgtggatatcagcatgaacacccatctcaaagccgtgaagctggtgttgaaagggaagaaccccgtcacaatggatcatctcagcatccgagggaacaacatccgctactacattctacccgacagcttgaatctcgagacgctgctcgtggacgatacgcccagagtgaagcagaagaaaccagcggcgggcaaaccggctggccgaggacggggccgaggtcggggccggggccgaggccgaggccgataggagtcgaccggagtgtatgatattttgtgaaagcaagaagccgccagcctcccagttaaccggaagaagaaaaaaaaatggtagtccctcgaggttgtatctttcctttccatgtcaactcctttcgttcaccatcaatagttgcaagagtgctccagccttggactttgcc

SEQ ID NO: 2274 - DNA, 362 bp, Aquilegia formosa
taattacttattttgttggtttgaaaaacaggtttttgatgaagttgaacaatgagacggtctcgatcgagctcaagaatggtactgttgttcatggcactatcacaggtgttgatataagtatgaatacacatttgaagacagtcaaactgacgctgaaaggaaaaaatccagtgactcttgatcacctgagtgtgaggggcaacaacattcgctactacatactccctgacagcataaaccttgagactttactggttgaggagacacctagggtcaagccaaagaaaccaactgctgggaggcctatgggacgtggacgcggccgtgggcgtgggcgtggacgtggccggggtcgttag

SEQ ID NO: 2275 - DNA, 798 bp, Brassica juncea
gactgtgacaaagaagaggttttagggttccacagcttcttcctcgtcttcttcttcttcacacccaacgatgaagctcgtcaggtttttgatgaagttgaacaacgaaactgtatcgatcgagctgaagaacgggactgtggtccatggaaccatcactggtgttgatgtgagcatgaacactcacttgaagacggttaagatgactctcaaggggaagaacccagtgacaatggaccatctgagcttgaggggtaacaacatacgttactacattcttcctgatagcttgaacctcgagactttgcttgtggaagacactcctcgagttaagcctaagaagcctgttgctgggaaacctgttggacgaggccgtggacgtggtggtcgtgggcgtggtggtgctggtcgtggcagaggtcgttaagtgcagcaacaagggttaaggtgagagtgagtgttgaattgaatctgttaggaagaagaaaccctttggtgtctgtgtaatgcaactctatggattaagcttttcatgttataagaggatgtacaagtaaaagccttttcattcatttgaatatgcatactgagatgaaataggtcaaagtagacaaaatagaactgaaggtatatccaagttcaaaagtatgacaatgcaagacaaatcaagtatctcagttactaaccgaattgtaaagatttaaactatcaaaactttaagatcattaaacattttctctcaacgagctttctgtaacacccatcctgaagagtgggtttcacagaggtcgtgcatca

SEQ ID NO: 2276 - DNA, 649 bp, Brassica oleracea
gtacgcgggggaagtcggatccgtcccccgcttgcgaagaagggttttgaggttttcgcagcgtctgcagtttcgtcgccagtctcttcttcctcacacccaaagatgaagctcgtcagatttttgatgaagctgaacaatgaaactgtgtcgatcgagctgaagaacgggactgtggtccatggaaccatcactggtgttgatgtgagcatgaatactcacttgaagactgttaaaatgaccctgaaggggaagaacccagtgacaatggaccatctaagcttgaggggtaacaacatccgctactacattcttcctgatagcttgaacctcgagactttgcttgtggaagacactcctcgagtcaagcctaagaagcctgttgctgggaaacctgttggacgaggccgtggacgtggtggtcgtgggcgtggtggtgctggtcgtggcagaggtcgttaagtgcagcagtgcaatggaaaatgttggaggcgagtgagttgaatttttaggaagtggaaaccctttggtgtctagtgagaatgtactgaactatgtatttaggaacctcttgaagaggaaacatctgttatgaagttacttatgtaatgcgactctatggataagaagatttagcgtttcatttcat

SEQ ID NO: 2277 - DNA, 821 bp, Brassica napus
tgaagaatcgctgtaatgggttcttgattaaccatgtttgatattgatttgagaaggaagctcaaaacccactacagagaactctagagtaagaagatgaagagcatcaaacgaagaggaccccgcttgcgaagaagggttttgaggttttcgcagcgtctgcagtttcgtcgccagtctcttcttcctcacacccaaagatgaagctcgtcaggtttttgatgaagctgaacaatgaaactgtgtcgatcgagctgaagaacgggactgtggtccatggaaccatcactggtgttgatgtgagcatgaatactcacttgaagactgttaaaatgaccctgaaggggaagaacccagtgacaatggaccatctaagcttgaggggtaacaacatccgctactacattcttcctgatagcttgaacctcgagactttgcttgtggaagacactcctcgagtcaagcctaagaagcctgttgctgggaaacctgttggacgaggccgtggacgtggtggtcgtgggcgtggtggtgctggtcgtggcagaggtcgttaagtgcagcagtgcaatggaaaatgttggaggcgagtgagttgaatttttaggaagtggaaaccctttggtgtctagtgagaatgtactgaactatgtatttaggaacctcttgaagaggaaacatctgttatgaagttacttatgtaatgcgactctatggataagaagatttagcgtttcatttcataagagcatgtgcaagtgtactaagtttggagttcgtattttgttttattcgtatggtcactaattgactatcaaaat

SEQ ID NO: 2278 - DNA, 894 bp, Raphanus sativus
  misc_feature (680)..(680): n is a, c, g, or t
gcattttggtccatcataagaaggagcagagccatgtagaagagcataaggagtctgtccatggagtaacggcgatggtgttcgttaataacgtgagccaccgtgagaatactttcaccccaaaacatgaccggcaaatttgcttgaaataacagagcgcgagccacattaagtatatgtcgatgcgtgcgttccactctgcgttgataccactgcttacggccgggggccgtgcccgcttgctaagaagggttttgagggtttcgcagtttctgcagtcttctctcctctccgatctcttcgtcttctccacaggatccccaaagatgaagctcgtcaggtttttgatgaagttgaacaatgagactgtgtcgatcgagctgaagaacggaactgtggtccatggaaccatcactggtgttgatgtgagcatgaacactcacttgaagacggttaaaatgactctcaaggggaagaatccagtgacaatggaccatttaagcttgaggggtaacaacatccgctactacattcttcccgatagcttgaacctggagactttgcttgtggaagacactcctcgagttaaacctaagaagcctgttgctgggaagcctgttggacgaggccgtggacgtggtggtcgtgggcgtggtggggctggtcgtggcagaggtcgntaagtttcagcaaagcagtgcactggaaacagttgaaggcgagtgagtttgaattttgtaggaagtgggaaccctttggtgtcttaggagaatgtactgaactatgatgtatttagcaactctttgcaaaggaaacatctgtggtaagatttgggctgtgtaatgcgacttcgtggaagatttagcttttcatttcataagagcatgtgcaagt

SEQ ID NO: 2279 - DNA, 511 bp, Chelidonium majus
ttgaacaacgagactgtgtcgatcgagttaaaaaacggaaccgttgttcatggcacaatcataggtgtggatattagtatgaacacacatttgaagacagtgaaactaacactgaagggcaaaaatccagtgacactggatcacctgagtgtgaggggtaacaacattcgctattacatcctacctgacagcttaaaccttgagactttgctggtggaggaggcgcctagggtcaagccaaagaagcctactgctgggaggccaatggcaggacgtggtcgcggccgtgggcgtggacgaggacgtggccgtggtcgctaattgtcctatgctcttatcaattttttgcagcctttgttatgtacaaatagctagcctgcttagggatagcttagtgaagatgtgtttgttggagattcagatgagggaattttgctgcttgaccttttaaatttcgaggttatttgaatgtagcttaaaatttgtctgtcgaaatgatttgaacagaaat

SEQ ID NO: 2280 - DNA, 677 bp, Adiantum capillus-veneris
cagacactctccaatttttttggcaactatcgagctcgcgggtcgatttcagcagcatgaggctcgtcaggttcttgatgaagctgaacaatgaaacggtttctatagagctgaagaacggaaccattgtacatgggactataacaggtgttgatgtaagcatgaacactcatctgaagacagttaagctgaccttacggggaaagaaccctgtcgcattggatcatctgagtgtcagggggaataacattcgatattatattcttcctgacagcttgaacctggatactttgcttgttgatgacaccccaaaagtgcgaccaaagaagccaacacccgggaaattgatgggcagaggacgaggacgaggtcgtggaaggggccgggggcgtgggcgctagagctgtagctaaggatacagtaagaatgtcttacagaacaatcaaagtaacttggcattgcagcatgtaaagttaatgagccttgagaggacttttgaagtgtcttcatggggttatgacagccttgataatgtgtttagttgctgctggtcttgcgatgcagaatccccactggtttttttcaggatgtataccagctagtctaacagtttacagttctcgtggaatttttttggaaattttatcatgccttaaaactttaaactgcctgctgtg

SEQ ID NO: 2281 - DNA, 480 bp, Panax ginseng
attcgctcgttagcccttttaagaagttaaataatgagaccgtctcgattgagcttcctaacggaactgttgttcacggcaccatcacaggtgtggatattagtatgaacacacatttgaagacagtaaaactcacactcaagggaaaaaatccggtgactctagatcacttgagtgtcaggggcaacaacattcggtactatatcctgcctgacagtataaaccttgagactttgctggtggaagagacacctagggtcaagcccaagaagccaactgcagggagggcgatagggcgcggtcggggacgtggtcgcgggcgcggccgtggtcgaggccgttagtcctgttgcagtattccaattttttttttgaaagttggtcgctttgtactgtgagagttaatatggtaaccttttaggagtacctcaaatgaatgttttgatgttattatttcttagtataattgggaattaacgc

SEQ ID NO: 2282 - DNA, 815 bp, Physcomitrella patens
tgcgtatgcccgtcttcttcgacttcttcttctgcgtgatcgtgccactgacccagctgaacgcttcatcgctgcattcctccaccctgaagctgctgctgctgcagccaattgcgcttctatcaagccgtgtcgtcacggggttaacaatccggtagtcgccatgaagctcgtcagatttttgatgaaactgaacaatgagacggtatcgatagaactaaaaaatggtaccattgtgcacggcactatcacaggagtggatatcagcatgaacacgcatatgaagtccgtcaaactcactttgaaggggaaggttcctgtggctctggatcatctcagcatccgtggaaacaacatccgatattacatacttcctgacagtttgaatctcgacacgcttcttgtggatgatacacctcgcgtgaaatccaagaagcctgttgctggcaaacctgtgggtagaggaagaggacgcggtcgtggcaggggacgtggacgtgggcgttaattttgtattctagtgccctttttagggtttccattgtagttagagtttccggtgtacgaagatgaacctcaaacttgcttttctatcaccttgtgggtggccgctccacttttttttctcaatttagtagtcccaagtaggaactaagcgcttgcaggtgacaatcaacagcctaaagcggtcgagaatcagtagtggcctgtagtcatgtatcaaggaagtgcttggcaatggttctctaatcacgaagcaacttatttaaaaaaaaagagacactagcatttctcaatcttctgtcaacttgcag

SEQ ID NO: 2283 - DNA, 1119 bp, Musa acuminata
gcatctgcttgtgaaaactcttcttctaggttcctgatgaagcttaacaacgagaccgtctcgatcgagctcaagaacggcaccgtcgtccatggaaccatcacaggtgtggatattagcatgaacacacacttgaagaccgtgaaacttaccgtgaaagggaaaaatccagttacccttgatcacctaagcgtgagaggtaacaatatacggtattacatcttgccggacagcttgaaccttgagacattattggtcgaggaaacacctcgggtaaagcccaaaaagcctactgcagggagaccagtgggacgtggtcgtggacgcggccgtggtcgtggacgaggtcggggccgttgacaatgtcatgctcatggtgtttggcgcacagggatagccatccttcatgtgttatataggagggtccaaactaacgggtacgaggcacttatgctgcctttaatccctcgccttgcattactaacgagaagtgtcattggagtaggacgccaaccaatccttgcaatgctaaccaaaagaccataacttattcctttctctccaaacttctccttcaagattgaagaagatgagaaggaacaaaacaaaagccaactcagtataattcacataaaacatgcctaggatgtgcatctgcgtgtcacgtgctgccctgatgagaccaacatccaacccaattctataaaccatacatacttccactcttcccctctgcattctgtttcttgctttcttcttccttccccctctcatcctctatctgcaggcagccgcaggcgatgtgctgccctacgcggttgtgctgcctgtgcctcctgctgctcgcggcggtgattgtcgtcgggttcatcttcggttttggcgtcttcacccatggcttccacaagctcaaggacaccttgcgcttggaaccctcccctccttagtgatgcccaccttgcatacaagaatcgagaggttcctctccttctctgaagttttaggttgtgtggtgaggtgtcttttgcattccagaaggcattttggaacttgaggtacattatatacaaattaaatgttaggaattctgtttgttatgtaacatctgaatgaaatgag

SEQ ID NO: 2284 - DNA, 1129 bp, Brassica rapa
ggatccaaaaatagaagtcggatccgtgcccgcttgctaagaagggttttgagggtttcaccagctcctgcagtttcgtcgccgatctcttcttcgtcgcacccaaagatgaagctcgtcaggtttttgatgaagctgaacaatgaaactgtgtcgatcgagctgaagaacgggactgtggtccatggaaccatcactggtgttgatgtgagcatgaatactcacttgaagactgttaaaatgactctcaaggggaagaacccggtgacaatggaccatctaagcttgaggggtaacaacatccgctactacattcttcctgatagcttgaccctcgagactttgcttgtggaagacactcctcgagtcaagcctaagaagcctgttgctgggaagcctgttggacgaggccgtggacgtggtggtcgtgggcgtggtggtgctggtcgtggcagaggtcgttaagtgcagcagtgcaatggaaaatgttggaggcgagtgagttgaatttgtaggaaccctttggtgtcttggtttgtaggagaatgtactggattgtgtattaaaagcaactctagaaagattggtgctcttatccatggagtctcattacatagtaacttccttacgtggttatggaagctcaacggtatttattcatgcgacaaatctgactatcaaaatgcattaacatgttgagacttgaaatacttagtatacataaggtgttatctcttccgttgtagtcttctcacatgaacctccaattgggtccgtagttgtagaaaggttccccagtataatctctaaagttatacccgtagggatcacacggatgtggaaaggaagatggcacaccatatccgtaaggccatggttgataacatgggttacaacaacatggctctggctttttctcatctgtttttttctcgtcggctttcttctcatcaggtttcttttcatcgggtttcttgcattccttcttcttgtcgtcctctttcttgggtggttcaactttgtttacgcttacaagctcagcgaaggctaccttcttcctcagtgtgttggttagacagatcatattgacttcaacaccggtcacctcaatctggttcctgtgatctcc

SEQ ID NO: 2285 - DNA, 608 bp, Brassica napus
agggttcctccacagcttcttcttctccacacccacccaaagatgaagctcgtcaggtttttgatgaagttgaacaacgaaactgtatcaatcgagctgaagaacgggaccgtagtccatggaaccatcactggtgttgatgtgagcatgaacactcacttgaagacggttaagatgactctcaaggggaagaacccagtgacaatggaccatctgagcttgaggggtaacaacatccgctactacattcttcctgatagcttgaacctcgagactttgcttgttgaagacactcctcgtcttaaacccaagaagcctgttgctgggaagcctgttggacgaggccgtggacgtggtggtcgtggccgtggtggtgccggtcgtggcagaggtcgttaaggtgagtcactagcaaccgctggcaaaggaatacatcttgattaagagattgattgctcgtaaggaagttactatttgcaactccatggttaagcttttcatgttataagagcatgtactagtaaagaatttgcgttgattaggagctcaaggctttttttttcattcatgtgacaaaacctgcctattaaaatgcgttaacatgtttc

SEQ ID NO: 2286 - DNA, 643 bp, Brassica napus
ggttccacagcttctccctcactcccaaagatgaagctcgtcaggtttttgatgaagttgaacaacgaaactgtatcaatcgagctgaagaacgggaccgtagtccatggaaccatcactggtgttgatgtgagcatgaacactcacttgaagacggttaagatgactctcaaggggaagaacccagtgacaatggaccatctgagcttgaggggtaacaacatccgctactacattcttcctgatagcttgaacctcgagactttgcttgttgaagacactcctcgtcttaaacccaagaagcctgttgctgggaagcctgttggacgaggccgtggacgtggtggtcgtggccgtggtggtgctggtcggggcagaggtcgttaaaggtgagtgagtggtaggaagaagaacccttttggtgtctcggttatgcaaaggaaacatctgattaagagattgattgcttgtaaggaagttactatggataaggagattaagcttttcaatgttataagagcatgtacaagtaaagtcttttcattcatttgaaaaaaaatctgactattaaaatgcattaaacatgttgaaacactttagtatagaagaaaaaaaaagaactgttatctcgaaaaaaaaaaaa

SEQ ID NO: 2287 - DNA, 658 bp, Raphanus sativus
  misc_feature (347)..(347): n is a, c, g, or t
gggaagccggatccgtgcccgccgctaaagagctaaccacttcgaggtacagtctccactgccaaagaagggttctagggtttcgcagctccttcttcctcttcttcgcaatcccaaagatgaagctcgtcaggtttttgatgaagctgaacaacgaaactgtgtcgatcgagctgaagaacgggactgtggtccatggaaccatcactggtgttgatgtgagcatgaacactcacttgaagactgttaaaatgactctcaagggcaagaaccctgtgacgatggaccatctgagcttgaggggtaacaacatccgctactacattcttcctgatagcttgaacctngagactttgcttgttgaagacactcctcgacttaaacctaagaagcctgttgctgggaagcctgttgggagaggtcgtggacgtggtggtcgtggccgtggtggtgctggtcgtggcagaggtcgttaaatgcagcgacaagtttaaggtgtgtgagttgaattgaatctgtaggaagaagaaccctttggtggtgtctcagttatgtatttagaaactcttgcagaggaagttaatgtgtaatgcaactctatggatttaaaggattaagcttttcatgttataagagcatgtactaaagccttttaatt

SEQ ID NO: 2288 - DNA, 449 bp, Brassica juncea
gtcggatccgtgcccgcttgctaagaagggttttgagggtttcaccagctcctgcagtttcgtcgccgatctcttcttcgtcgcacccaaagatgaagctcgtcaggtttttgatgaagttgaacaatgaaactgtgtcgatcgagctgaagaacgggactgtggtccatggaaccatcactggtgttgatgtgagcatgaatactcacttgaagactgttaaaatgactctcaaggggaagaacccggtgacaatggaccatctaagcttgaggggtaacaacatccgctactacattcttcctgatagcttgaacctcgagactttgcttgttgaagacactcctcgacttaaacccaagaagcctgttgctgggaagcctgttggaagaggtcgtggacgtggtggtcgtgggcgtggtggtgctggtcgtggcagaggtcgttaa

SEQ ID NO: 2289 - DNA, 1222 bp, Brassica rapa
gttttctaactgtgtgcagcaaaagatcctgataagagttactatgactgatgataaaaccagagcaaaagcaatgaaaactgccgctcagtttaaaggagtctcggctgtggaaataaagggagatcacaggaaccagattgaggtgaccggtgttgaagtcaatatgatctgtctaaccaacacactgaggaagaaggtagccttcgctgagcttgtaagcgtaaacaaagttgaaccacccaagaaagaggacgacaagaagaaggaatgcaagaaacccgatgaaaagaaacctgatgagaagaaagccgacgagaaaaaaacagatgagaaaaagccagagccatgttgttgtaacccatgttatcaaccatggccttacggatatggtgtgccatcttcctttccacatccgtgtgatccctacgggtataactttagagattatactggggaacctttctacaactacggacccaattggaggttcatgtgagaagactacaacggaagagataacaccttatgtatactaagtatttcaagtctcaacatgttaatgcattttgatagtcagatttgtcgcatgaataaataccgttgagcttccataaccacgtaaggaagttactatgtaatgagactccatggataagagcaccaatctttctagagttgcttttaatacacaatccagtacattctcctacaaaccaagacaccaaagggttcctacaaattcaactcactcgcctccaacattttccattgcactgctgcacttaacgacctctgccacgaccagcaccaccacgcccacgaccaccacgtccacggcctcgtccaacaggcttcccagcaacaggcttcttaggcttgactcgaggagtgtcttccacaagcaaagtctcgagggtcaagctatcaggaagaatgtagtagcggatgttgttacccctcaagcttagatggtccattgtcaccgggttcttccccttgagagtcattttaacagtcttcaagtgagtattcatgctcacatcaacaccagtgatggttccatggaccacagtcccgttcttcagctcgatcgacacagtttcattgttcagcttcatcaaaaacctgacgagcttcatctttgggtgcgacgaagaagagatcggcgacgaaactgcaggagctggtgaaaccctcaaaacccttcttagcaagcggg

SEQ ID NO: 2290 - DNA, 443 bp, Brassica juncea
gggatccgtgcccgcttgctaagaagggttttgagggtttcaccagctcctgcagtttcgtcgccgatctcttcttcgtcgcacccaaagatgaagctcgtcaggtttttgatgaagctgaacaatgaaactgtgtcgatcgagctgaagaacgggactgtggtccatggaaccatcactggtgttgatgtgagcatgaatactcacttgaagactgttaaaatgactctcaaggggaagaacccggtgacaatggaccatctaagcttgaggggtaacaacatccgctactacattcttcctgatagcttgaacctcgagactttgcttgtggaagacactcctcgagttaaacctaagaagcctgttgctgggaaacctgttggacgaggccgtggacgtggtggtcgtgggcgtggtggtggtgctggtcgtggcagagg

SEQ ID NO: 2291 - DNA, 486 bp, Antirrhinum majus
  misc_feature (1)..(1): n is a, c, g, or t
  misc_feature (245)..(251): n is a, c, g, or t
  misc_feature (253)..(253): n is a, c, g, or t
  misc_feature (260)..(260): n is a, c, g, or t
  misc_feature (307)..(307): n is a, c, g, or t
  misc_feature (363)..(363): n is a, c, g, or t
  misc_feature (366)..(366): n is a, c, g, or t
  misc_feature (385)..(385): n is a, c, g, or t
ntgaagtcttgtaagattcttgatgaaattgaacaacgagactgtttctatcgaactcaagatggtactgttgttcacggcactattataggagttgatgtcagcatgaacacacatttaaagactgtgaaactgacaccaaaaggaaagaacccaattacccttgatcatttaagtgttaggggaaacaacattcgctactatatccttcctgacagcttgaatcttgaaactttgcttgttgnnnnnnntncaagagntaagccaaagaagccaactgcagggaaacctctgggccgtggtcggngcagaggacgtggacgcggacgtggcagaggtcgttaggatttctctgtttctgantanagcatcaagggatccagtnccctgttggaaatactttctgctgaagtttttgtggtatgtaagagacgaggttactggtagtttttgcgagactattgcaacgttttaaaacccatactg

SEQ ID NO: 2292 - DNA, 845 bp, Eutrema halophilum
gtttttgatgaagttgaacaatgaaactgtgtcgatcgagctgaagaacgggactgtggtccacggaaccatcactggtgttgatgtgagcatgaacacgcacttgaagacagttaaaaaatgagcctgaaagggaaaaacccagtaacactcgatcatctaagcttgaggggtaacaacatccgctactacattcttcctgatagcttgaacctggagactttacttgtggaagacactcctcgggttaaacctaagaagcctgttgctgggaaacctgttggacgcggccggggtcgtggccgtgggcgtggtcgtggcagaggtcgttagatgcattggaaaaaggtttaagggaagaggaactcttgttgtcttagtttgtaggagaatgtacggaattgtgtatctagctactctttgcaaaggaaacatctgattaagaaaaatggtatgattgatgctctcgtaaggaagttactatgtaatgctgactccatggataagaagctttagatttttcaagttataagagcatgtacaagtatagaatttgcgtggttttttggagctcaaggctttttattctcaagttacaaattttgactatcacaatgcattaacatgttgacccactaagtattggaaaactattatctcttccgttggtcttgtcacaggatcctgcaattaggttcttgattgtagacgggttctccgggatcacacgggtggggataggaagatggcacaccatatccatagggccatggtggataacatggctctggtttcttctcttcgggtttcttctcatcaggtttcttctcatctggtttcttgtc

SEQ ID NO: 2293 - DNA, 571 bp, Sesamum indicum
aaattgaacaatgagactgtgtcgattgagctcaagaacggcaccgttgtacacggcaccattacaggtgttgatatcagcatgaacacgcatttgaagactgtaaagcttatcttgaagggaaagaatccagtgactatggatcatttgagtgtaaggggtaataatattcgttattacatccttcctgacagcttaaatcttgagacattgctggtggaagagacacctagagtcaagcccaagaagccaactgcagggagacctctggggcgtggcaggggccgtggtcgtgggcgtggacgtggtagaggccgctagattttgctgcaatcatatcatttttgtagcatttgtcatgtaaacatctgtattgaagaattgcatgttcctagctagcagtacgggtacctgagtattgatccgtggaatgtttacaggtaaagatcattggaagtttagtaacttttgtgaggttccgctcaattcacacggtctattttgtacttttgcatgtcttgtgggttcaatatatgatgatcttatcactatctacatgccatatcgacct

SEQ ID NO: 2294 - DNA, 437 bp, Pteridium aquilinum
ctttgagaagttgaaggttgagaggtgtgcgacaaaaccccacctgtcatttttgaaaatcgtcgagcttcgtcgctgtctttggcaacatgagactcgtcaggttcttgatgaagttgaacaacgaaactgtctctatagagctgaagaacgggacaatcgtgcatggcaccatcacaggtgttgacatcagtatgaatacccatctgaaaactgtgaagctgaccttgagggggaagaatcctgtctctttggatcatctgagtgtcagagggaatagcattcgttattacattcttcctgatagcttgaacttggatactctacttgtcgatgataccccaaaagtgcgacctaagaggccaacgcctggaaaaataatgggcagaggacgaggacgaggccgtggaaggggacgaggtcgtgggcgttagcgt

SEQ ID NO: 2295 - DNA, 642 bp, Brassica rapa
aagtcggatccgtaaccgccgctaagaggtatccatttcgaggtgcctccgccaaaaggttttagggttccacagcttctccctcactcccaaagatgaagctcgtcaggtttttgatgaagttgaacaacgaaactgtatcaatcgagctgaagaacgggaccgtagtccatggaaccatcactggtgttgatgtgagcatgaacactcacttgaagacggttaagatgactctcaaggggaagaacccagtgacaatggaccatctgagcttgaggggtaacaccatccgctactacattcttcctgatagcttgaacctcgagactttgcttgttgaagacactcctcgtcttaaacccaagaagcctgttgctgggaagcctgttggacgaggccgtggacgtggtggtcgtggccgtggtggtgctggtcggggcagaggtcgttaaaggtgagtgagtggtaggaagaagaacccttttggtgtctcggttatgcaaaggaaacatctgattaagagattgattgcttgtaaggaagttactatggataaggagattaagcttttcaatgttataagagcatgtacaagtaaagtcttttcattcatttgaaaaaaaatctgactattaaaatgca

SEQ ID NO: 2296 - DNA, 438 bp, Vinca minor
ttgaacaatgagactgtctcgattgaactaaaaaacggctcagttgttcatggtaccattacaggtgttgatatcagcatgaacacgcatttgaagactgtcaaacttactgtaaagggaaagaatccagtgacattggaccacctgagtgtaaggggtaataatattcgctattacatccttccagatagcttaaatcttgagactttgttggtggaagagacgccaagggtgaagcctaagaagccaacagcaggaaagcctgtggggcggggtcgtggacgtggtcgcggtcgcggcggacgtggccgaggccgctagatcactgatttcaatttttgtggtatctagctgtataaacatcttttgtaatgagacagcattaacttagtcgatgacatcctgattattatcttgtgagagcttccattaatcata

SEQ ID NO: 2297 - DNA, 680 bp, Cajanus cajan
aacccttctttctatgaaatctggaacaggtttttgatgaagttgaccaacgaaactgtgtcaatcgagctcaagaatggtaccattgttcatggcactattacaggtgttgatatcagtatgaatacacatttgaaaacagttaaattgactctgaaagggaaaaacccagtgactctggatcatcttagtgtgagaggcagcaacattcgatattatattcttcctgacagcttgaatcttgagactttgctggttgaagagactcctaggatcaagcctaagaaaccaactgctggaaaacctatgggaagagggcgtggtcgaggacgtggacgtggtcgggggcgtggtcgtgaacattaacgtgaacactagtttcacattaataaattttgtgccatcgggttgtattgtaaggagaatttctgagcggttgtggatatcaaaggagtgttcatgttgatttttccatgttgccattctataacatactagtaggtgcttacatgttttgtaaaattcctttatagtattctacaattgagtaaggcagggtttgcgatcacactttgttgggtggtcccaaaagatgccttatgcctcttggctgaaaaactgcagatagttgtagctttcggtacaagatgaagttaatggaattactgatgcaatgttgt

SEQ ID NO: 2298 - DNA, 364 bp, Brassica napus
cccaacgatgaagctcgtcaggtttttgatgaagttgaacaacgaaactgtgtcgatcgagctcaggaacgggaccgtggtccatggaaccatcactggtgttgatgtgagcatgaacactcacttgaagacggttaaaatgagccttaaagggaagaacccagtgacaatggatcatctaagcttgaggggtaacaacatacgctactacattcttcctgatagcttgaatttggagactttacttgttgaagacactcctcgtcttaaacctaagaagcctgttgctgggaagcctgttggacgaggccgtggacgtggtggtcgtggccgtggtggtgctcgtggaggcagaggtcgttaa

SEQ ID NO: 2299 - DNA, 351 bp, Arabidopsis lyrata
tgggtctctctcaggtttttgatgaaattgaacaatgagacagtttcaattgagcttaagaacggaaccattgttcatggaactattacaggtgtagatgttagtatgaacactcatctaaaggccgtaaaactaactctgaaagggaaaaacccggttacgttagaccacttaagtgttaggggaaacaacattcggtattatattcttcctgacagcttaaatctcgagactttgttggttgaggacacaccaagaatcaaacccaaaaagccaactgctgggaagacaccagctcgcgggcgtggccgtggaaggggtcgtggacgcagccgtgttggtggtcgttaa

SEQ ID NO: 2300 - DNA, 706 bp, Brassica rapa
atggccacaaaccctggaattccgttttctatcaatttgccacctgataatggatccaaaatcggagtccggagccgtgcctgctactattcctattccgaggttctcactgccgagaagaagggttttgaaggtttcacagattcgttctcttcacacccaacgatgaagctcgtcaggtttttgatgaaattgaacaacgaaactgtgtcgatcgagctcaagaacgggaccgtggtccatggaaccatcactggtgttgatgtgagcatcaacactcacttgaagacggttaaaatgagccttaaagggaagaacccagtgacaatggatcatctgagcttgaggggtaacaacatacgctacttcattcttcctgatagcttgaatctggagactttacttgttgaagacactcctcgtcttaaacctaagaagcctgttgctgggaagcctgttgggcgaggccgtggacgtggtggtgctcgtggaggcagaggtcgttaaatagagcactggaccttttttgtgtctgaatttgtagtaggagaatgtattgaactatgtatcttgcaatgggaacatctgattaggaaagtggtatgatttaacgctcgtaaagaaagttactaagtaatgcaatttcattgatatagaagatttagcttttcatgttgtgagagcatgtacaagtatatagctattg

SEQ ID NO: 2301 - DNA, 616 bp, Taraxacum officinale
gggggctccgcttccgtctgaaattggataatttttggaaccctagcttctcctccagcgattcgcgacaatgaagcttgtcaggtttttgatgaagttgaacaacgaaactgtttcgatcgagctcaagaatggcacagttgtacacggaaccatcacaggtgttgatattagtatgaacacacacttgaagacggtgaagtcgacactgaaagggaaaaatccagtaacccttgaccacttgagtgtgagaggcaataatattcgttattatatacttcccgacagcttgaatttggagactttgctagtggaagagactcctagagtcaagcccaagaaacccaccgcagggcggcctgtgggactattagtgagtttggagatggtgaatttcggttgatgaagtcatttggcgaagagatagagtttggattttcatgaacgcctagaatcttgaatgatatctatattgtttagtacaattgcaagatatgtactttataagtatctaggacttaattccttgattataattatgaaatgcacttggtagaattttatttacatatgttaacgtcttgatagttgatacaaagaaaaaaaaaaaaaaaaa

SEQ ID NO: 2302 - DNA, 329 bp, Fraxinus spp
gaacaacgagaccgtctcaattgaactcaagaatggcactgtcgttcatggaactattacaggagtggatgttagcatgaacacacatttgaagacggtgaaactgacactgaaagggaagaatccagttactcttgatcatctaagtgttaggggtaacaccatacgctactgtatccttcccgacagcttaaatctggaaactttgcttgttgaagagactcctagagtgaagcccaagaagcctactgcagggagacctttggggacgcggtaggggaagaggacgtggacgtggtcgtggccgaggccgttaaattattatctgt

SEQ ID NO: 2303 - DNA, 576 bp, Amsonia hubrichtii
ttgaacaacgagactgtctcgattgaactcaaaaatggctctgttgttaatggcaccattacaggagtggacattagcatgaacacacatctgaagactgtgaaattaacacccaagggaaagaatccaataacccttgatcatctaagtgtcaggggtaacaacattcggtattatattctccctgacagcttaaatctggaaaccttgcttgtggaagagactccgagagtcaagcctaagaagccagtagcagggaagcctataggacgggggcgtggcagaggacgtgggcgaggtcgcggtcgtggacgctagagtttttcatatggtttttaatctgtgtaacttcgaccattccatgatccattctaagttcagaaaactgtggggaacgatgcaagacaaaattttgtgtaactatagcttttaacatggttcaccatgctgtcgggatccggtggctgcgcctatgttcttaaagcttatgcttagttttgtttaaaagttacattcttatgtattagttgccgcatgatacaagaggctattactaaaattgttgttgcgtttata

SEQ ID NO: 2304 - DNA, 555 bp, Cycas rumphii
tggatccaaagaattcggacgagggttgaacaacgaaacagtctctattgaactcaagaatggcactgtagtccatgggaccattacaggagttgacataagtatgaatacacacttgaagacagtgaaactgaccttgaaggggaaaagtccagtaacacttgatcatcttagtgtgaggggcaataacatccgatactatattcttcctgacagcttaaacttggaaactttattagtggaggacacacccagaatcaagccaaggaaagcaactgctgggaaacctctgggtcgtgggcgaagacgtggacgtggccgtggccggggtcgtggacgttaagtcgtacactttcagtggtattcttcatattcaaggatggcacatggtcttccacggtggcaccatatttggctgtatacaacatggcaatgccttgttttttcctgacctaacctaatgtgtagcaataaaggattttgctgttttctctgggggcatcaaacaaagatctttttatcgatatttatatgaatgagtattttttcgtggtt

SEQ ID NO: 2305 - DNA, 627 bp, Mimulus guttatus
tttttgtgatgaaattgcatctcatttttttcaggtttttgatgaaattgatcaacgagagcgtgtcgattgagctcaagaatggcactgttgttcaaggcacaattataggtgttgatattagcatgaacactcatttgaaggctgtaaagcttactctgaagggcaaaaatccagtgagcatggatcaccttagtgtaaggggtaacaatattcgttattacatccttcccgacagtttaaacctcgagacattgttggtggaagagacacctagagtcaagcccaagaagccaattgctgggagagccttggggcgtggtaggggccgcggtcgtgggcgtggacgtggtaggggccgttagatacggcttcaatcatctctattttttgatacatttgtgtaactgatggagagatcatcgtatactatagggttcgtacctaaccggaattgattgtgagtaccgagtaaaaagatatttggcatttttagtccttgttattttcgtgctaattgaagcagtctttttcgtatatgcaaagtttgcagtggccgttgatcttaatcatgctgtatgcatctgaaacagccgttaatagcagcaaagttatcgttcaaacttc

SEQ ID NO: 2306 - DNA, 610 bp, Brassica oleracea
tgtattaagggtgggggagggtttcacagattcgctctcttcacacccaacgatgaagctcgtcaggtttttgatgaagttgaacaacgaaactgtgtcgaacgagctcaagaacgggaccgtggtccatggaaccatcactggtgttgatgtgagcatgaacactcacttgaagacggttaaaatgagccttaaagggaagaacccagtgacaatggatcatctaagcttgaggggtaacaacatacgctactacattcttcctgatagcttgaatttggagactttacttgttgaagacactcctcgtcttaaacctaagaagcctgttgctgggaagcctgttggacgaggccgtggacgtggtggttgtggccgtggtggtgctcgtggaggcagaggtcgttaagtgcagcactgggaaaagttttaatgtgagtgagttctgtaggaggaagaggaaccctttttgtgtctgaatttgtagtaggagaatgtattgaattatgtatcttgcaatgggaacatctgattaggaaaaatggtatgattaacgctcgtaagaatgttgctatgtaatggaaatttcatggatatagaggatttagcc

SEQ ID NO: 2307 - DNA, 854 bp, Eutrema parvulum
tgatttgtattggatcgagcaggtttctgatgaagttgaacaatgaaactgtctcggtcgagctgaaaaacgggactgtggtccatggaaccatcactggtgttgatgtgagcatgaatactcacatgaagacagttaaaatgagcctgaaggggaaaaacccagtaacactcgatcatctaagcctgaggggtaacaatatccgctactacattcttcctgatagcttgaacctggagactttacttgtggaagacactccacgagttaaacctaagaagcctgtcgctgggaagcctgttggaggacgcggacgtggtcgtgggcgtggtcgtggcagaggtcgttaatgcggcagtgtactggaaaagagtttaaggtgagtgagttaatttttttgtaggagaatgtactgaattatgtatctagcaactcttgcaaaggaaacatctgattatgaaatggtgtgattgatgctcgtaaggaagttactatgtaatgcgactccatggataaagaagatttagcttttcatgttataagagcatgtaccagaatagaatttgcttggtttttgagctcaaggctttttattcatgttacaaatctgactatcaaaatacattaacacgtcgacccatttggtatagaaatactgtttatctcttccgttagtcttctcacatgattctacaatcaggttcctgattgtagacgggttctccaggatcacacgggtggggataggaagatggcacaccatatccgtaaggccatggtagataacatggctccggttttttttcctcgtcggatttcttctcatcgggtttcttgtcatcgggtttcttgtc

SEQ ID NO: 2308 - DNA, 488 bp, Helianthus annuus
aatcatcgatcatttcgcgctcttagcgccgtgtcatgaagctcgtcgcggtttttgatgaaactgaaatccgagacggcttctatccaactccacaacagtactggcgctcaaggaacaatcccaggagtggatataactatgaatacacctttaaagacggtgaaacttaccctacaggggaaaaatccagtgaccttggatcaccaacgtgtcaggggcaaccaccccagatactacatcttacctgacagcttaaatctcgagactttgcttgttgaagaaacaccccgggtcaaaccaaagaagccaactgctgggaaaccggttggacgtggaaggggccgaggacgcggacgtggacgtggtcgaggtcgttaattttctaagacttatatttggttttgtcaacatttgtattgttgttggtctgaacatggatgctatgataatccttcgagggaatttttcttactgctagaaaaaaa

SEQ ID NO: 2309 - DNA, 1130 bp, Podocarpus macrophillus
caaataaatactcagtacttgagatcattgttctaaaaagctattaatgtttccatcatagcttagatattttttaatatattatgctaatgataatacactaagagtctttggtgaacccttttatggctttttggaaatctctattaacgtttcttttattcttttgcaggtttttgatgaagttgaacaatgaaacagtgtcaattgagctaaagaatggaacaatagtccatgggacaattacaggagttgacataagtatgaatacacacctcaagactgtgaagatgacactgaagggaaagcctcctgtagcagtggatcatctcagtttgaggggcaataatattcgctactatattttacctgacagcttaaatttggaaacattgttggtggaggacaccccgaaaattaaagcaaagaaggcaactgctggtaaacctcttgcacgtggacgaggccgtggacgtggtagaggtcgtggtcgtgggcggtagtttctgcatccatgcttgcatgggttagacaaggaagaaaaggccttgacttccccaagttttttgacattcatgcaatggttcctgggacattcataggtagcattcaaattgtagttgtatcattggactggtagcttcttcttttgtcttttacgtgcaaagggcatttaagtttgatttttcttgttactaatgatgatcattttctgaagcattgcctcgttcgtggtcaagttacactggtaaatgttttgtttggttgggatctaagatatgtgccattgatcgctttgctggggtattcatggggataattattgcagtgatagttgagtttagaggtttgctttaaccaatcgaaactcaggcaatttccaactgtatgttcttgaagcattggagaggcaacaacctcatgcagaaaacaaagttgcgaaaacaagaagcacttctgaggttatcacagttccatgtttagtaacctagatgtagttttttctggtatgattaaaatatagactttaccagttacactttctcacatgcaaagccatgattttcaattttcttgtgtgcaaacatggtttcagctttgttacactcctggggaaatgaatgcatgaa

SEQ ID NO: 2310 - DNA, 435 bp, Plantago ovata
agtgcgacttcaaaatataaagcaaaaagtaaaaacccttacttcttcctcccgctcctagtttttcaactttgggagatttttggtagcgtagaatcttagatccgcagagcaacaatgaaactcgtaaggttcctgatgaaattgaacaacgagactgtttcaatcgagctcaaaaatggtactgttgttcacggcaccattacaggagttgatgtcagcatgaacacacatttgaagactgtgaaactcacacccaaaggcaagaatccacttacccttgaccatctgagtgtccggggcaataccattcgatactacatacttcctgacagcttgaatcttgaaactttacttattgaagagactccaagagttaaaccaaggaagccaacaacagggaaacctttgggccgtggccggggcagaggacga

SEQ ID NO: 2311 - DNA, 531 bp, Thalictrum flavum
agacagtctcgattgagctcaagaatggtactgttatccatggaactatcacaggtgttgatataagtatgaatacacatttgaagacagttaaactgacactgaaaggaaaaaatccagtgactcttgatcacttgagtgtgagaggcaacaacattcgttattacatactccctgacagcataaaccttgagactttactggttgaggagacacctagggtcaagccgaagaaaccaactgctgggaggcctgtgggacgtggacgcggtcgtggtcgtgggcgtggacgtggccgaggtcgttagttgtgttgtgcatttactagtttttgcaagatcggattctgtaagtgtgggcctagtgagatatttggaggagattaaactagccggattttcatttagcattctactttaatggaagctttgtagcttaatgtatgttacactggctgttttataggaattagtttagacaatagaataaataataaaactacaatttaacctagtagggatagacaataga

SEQ ID NO: 2312 - DNA, 432 bp, Eutrema halophilum
ctgaccttgctttgttttggacggattaggtttttgatgaagctgaacaacgaaactgtatcgatcgagctgaagaacggtactgttgtccatggcaccatcactggtgttgatgtgagcatgaatacgcacctgaagactgttaaaatgactctgaaggggaagaaccctgtgactctcgatcatctaagcttgaggggtaacaatatccgctactacattcttcccgatagcttgaaccttgagactttacttgtagaggacactccaagggttaagcccaagaaggctgctgctactgggaagtctgttggacgtggccgaggacgcggtcgtggacgtggtcgtggaagaggtcgttagatgtattttctttttgcatataacctttgctggctactacttatctactgggaaaaaaaaagttaaagg

SEQ ID NO: 2313 - DNA, 590 bp, Eutrema parvulum
tttgatttcgtatcgggatttttttgcaggtttttgatgaaattgaacaacgaaacagtttcaatcgagcttaagaacggaaccatagttcatggaactatcacaggtgtagatgttagtatgaacactcacttaaaagctgtgaaactcactttgaaagggaagaatccagtcacattagaccacttaagtgtcaggggaaacaacattcgctattatattcttccagacagcttgaatctcgagactttgctagtcgaagacacaccaagaatcaagcccaaaaaaccaactgcaggaaagattccaccaggcggtcggggacgtgggcgtggaagaggtcgtggacgtgcccgtggtggtcgttaagcattttgcaatgatccagagtttggtatttcttttgtaagagcacgattgtaaaagatctatcttgtagtgagatttggtgtcatgaagacaaattcttgttatctttaagttttcatgattttgagattttgataacgttttttcgccaaacttacagcactctgcaaaagatcaatgtcgttttattatcgagttcattactttattccaacaatctg

SEQ ID NO: 2314 - DNA, 420 bp, Eutrema parvulum
ctgatcttcctttgttttggacggatcaggttcctgatgaagttgaacaacgaaactgtatcgatcgagctgaagaacggtactgttgtccatggcactatcactggtgttgatgtgagcatgaatacgcacttaaagactgttaaactgactctgaaggggaagaacccagtgactctcgatcatctaagcttgaggggtaacaatatccgctactacattcttcccgatagcttgaaccttgagactttacttgtagaggacactcccagggttaagcccaagaaggctgctgctgctggtaaggctgttgggcgtggcagaggacgaggccgtggacgtggtcgtggcagaggaggtcgttagatgtattttctgttgcatataacctttgttatctactggagaaaaactttaagg

SEQ ID NO: 2315 - DNA, 640 bp, Brassica rapa
tttcgaatggggattttgattattcgcaggtttttgatgaaattgaacaatgaaacagtttcagtagagcttaagaacggaaccatagttcacggaaccatcacaggtgtagatgttagtatgaacactcacttaaaagcagtgaaactcactttgaaagggaagaatccagtcgccctagaccacttaagtgtcaggggaaacaacattcgctactatattcttccagactccttgaatctcgagactttgcttgtcgaagacacaccacgaatcaaaccgaaaaaaccaactgcaggtaaagttccaccaggtggtcgtggacgtgggcgtggtagaggtcgtggacgtggcggccgttaagcattttgcagtgatcccaagtttttttctgtcttgttatcttttaaattttcatgattttaaaatttgatacgttattgccaaactaatcaaacacggaaacactcactttcgtttattattgagttcattactttattacacaatctgataagactcaaaaggttcgagattattggttttgaccttttccaagaatctggatatagtcaaaggttaaactaagacatagccgttcatcacagtcacagctttgccagtgagcaagaccctctgc

SEQ ID NO: 2316 - DNA, 351 bp, Primula obconica
accaaacatgaagctcgtcgtaggtttttgatgaagctagaacaacgacgaccgtctcgattgagctacaagaacggcaccgtcgttcacggcaccattacaggagtggatattagcatgaacacactacttgaagacttagttaaactcacagtcgaaagggaaagaatccagtgaccttggatcacctaagtgtaagggtaccaacattcgatactatatccttctgacagtttgaactagagacattattggtagaagagacgcctagggtcaagacccaagaacgcaactgcaggtaagtccgtttgggacgtggcagacggcgtggtcgtggagtggacgtggtcg

SEQ ID NO: 2317 - DNA, 355 bp, Physcomitrella patens
atttttgggatttgtgggttgttggtgggtccagatttttgatgaaactgaacaatgaaacggtttcaatggagctgaaaaatggtaccattgtgcacggcactatcacaggtgtggatatcagcatgaacacgcatttgaagtctgtaaaacttactttgaaaggaaaggtccccgtatcttagtgttcgtggcaataacattcgatattacatcttgcccgacagcttgaatctcgacacgctcctcgtcgatgacacaccacgtgtgaaggctaagaagcctgttgcaggcaaaccagtgggcagagggagagggcgtggtcgtggaagggggcgtggacgtgggcgctagt

SEQ ID NO: 2318 - DNA, 575 bp, Raphanus sativus
ggccattgctggaggctggagctctccctttaaaaagaaaaaccctagatctcttctcttctgttccgtccttcctctctcgccatgaagctcgtaaggtttttgatgaaattgaacaacgaaacagtttcggtcgagcttaagaacggaaccatagttcatggaaccatcacaggtgtagatgttagtatgaacactcacttaaaagcagtgaaactcactttgaaagggaagaatccagtcgcattagaccacttaagtgtcaggggaaacaacattcgctattatattctcccagacagcttgaatctcgaaactttgctggtcgaagacacaccaagaatcaaaccgaagaaaccaactgctggaaagattccaccaggtggtcgtggacgtgggcgcgggaggtcgtggacgtggtggtcgttaaacattatgcagtgatccgaagtatgatctatcttgttatctttgaactcttcatgattttttttgagatttgatacattattgcaaaactaatcagacacggaagcaaaatcaattccatttattaatgagttcaatactttgtt

SEQ ID NO: 2319 - DNA, 581 bp, Lactuca sativa
ggaattaagacattatggacgcttgaccgggcccaacaattggataattttatggaaacctaacttctcctcctgcgattcaccacaatgaacctcgtcacgtttttgatgaagttgaacaaccaaactgtctcaatccacctcaagaatggaacacctgtacatggaaccataacaggtgttgatattaacatgaacacacacttgaacacggtgaacttgacactgaaagggaaaaatccagtaagccttgaccatttgagtgttagaggcaataacattcattactatatacttcctgacagcttgaatctggagacattgctaatggaagagacacctagagtcaagcccaagaaacccactgcaaggcggactgtgggacatggaacagggcggggccgcgggcgtggacacaaacatgggcgctaatcatgtttttctatctatgatatatcttaagcttgagctatgtggaagattttgtattttcatcaccgcactcgaatcttacatgatatctatattatctaagaggacacttgcgaaatctttacttttattgatgatgcatatttatt

SEQ ID NO: 2320 - DNA, 833 bp, Cenchrus ciliaris
gtcccccgggtggcagggtttatgtctcttcccccccccgaatccggtgaagccagcagcttcccccccaaaaaccctagttttacccccccccccgtgtcccccccccaagcccctccacagattaacccttgtcaggttctttgatgaaacttcacaaacgaaccggtaaccatcaagctcaaagaacggcacccgtggtcccatggcccccatcccaggcgttgacatcagcatgaatattcatttaaagactgtgaagttcccattgaaaggaaaaaatcttgttacccttgcccccttcagtgtgaggggaaacaacatccgctattatatccttcctgacagcttaaacctggagactttgctggttgaggaaacaccaagggtcaaacctaagaagccaacttcagggaaacctttgggacgtgggcgcgccccgtggtcgtgggcccggtcggggtcggggacgttaagtctgctgcccatttggaaattgcattgcactcatctttgcaatgtaatctgctttcctatctgtttgcaaggagttctgcttttaaggcaatggcgttgatgtcacccgttctgtggattcatgttgatgttagaggttactccgatgcaactatatatgatgttcccctgaactcctgttgacttaacccttgcaatgttaactgttcgcagtctatctatctctgttctgtgttagctaatcacagatgttcaatcccttacattctcagcgtgtttagcaaatgagatcattctgtgaccagcattgctggcaggtacaacttccctaggaattttaagatggattaccagat

SEQ ID NO: 2321 - DNA, 991 bp, Avena sativa
gggccattccaaagataagctgctaactagcggccacatgccgatttcatgtacaacaaaatctagaagcaaacgagtcaagagttatttgagtttcctatcatcactagaggaagaagagagtaggggaagcggaagtagaaatggctgcaatatcagcagcgatctccggctgctgctcttcctcctgcctgccccagtcccagcggggtctcctgccctccacaaggagaaggcacttcaaggtcacggccatggctcccaagaacaaggtgaacaagtacgacgaggggtggtcgaagcagtggttcggggccgggatcttcgcggaggggagcgaggaggcatcggtggacgtgttcaagaagctggagaagcgcaaggttctgagcaccgtggagaaggcgggtctgctgtccaaggcggaggagctcggcgtcactctctcctcgctggagaagctcgggctgctctccaaggccgaggacctgggcctcctcagcctcgtcgagagcgccgccaccgtgtccccagccgtgctcgcgtccctctcactgccgctgctcgtcgcctccattgccacagtcgtcttcgtaccagacgacaccacgctgctcgtcacgctccagacggtcgtcgccacgctgttcgcggccgtcgcagcgggcctgttcgtcggctccgtggtgctagacggcctgcaggaagattagcacttcactccattcgaggacgttccttttgtagtaggataataacactactactacaaatagtgagttaacgatatggtcgtaagcgtattagcatcatgcaagcttatgctcaattgctaatgaaatcgcagttactaagtgtgtgccgtggagtgtgctcgtgtaattaggaagcaagtgttcttttgcatgtttatccaattcaaatgtactccgtcatatagtatcttgtgccgactttccttgtgagagcatctctaacagtgattgtaaat

SEQ ID NO: 2322 - DNA, 960 bp, Hordeum vulgare
aaagcagacaagtgaaaaaaataacctgtgtttcgtatcactagaggaagaagggagcaggggaagaggaggcagaaatggctgcaatatcagcagcaatctccggctgctgctcttcgtcctgtctgccccagtcccagcggggcctcccgtcctccgcaaggagaaggcacttcaaggtcacggccatggctcccaagaacaaggtgaacaagtacgacgatgggtggtccaagcagtggttcggcgcggggatcttcgcggaggggagcgaggaggcgtcggtggacgtgttcaagaagctggagaagcgcaaggtgctgagcaccgtcgagaaggcagggctgctgtccaaggcggaggagctcggcgtcacgctctcctcgctggagaagctcggactgctctccaaggccgaggacctgggactcctcagcctcgtcgagagcgcagccacagtgtccccggccgtgctcgcatcgctgtcgctgccgctgctcgtcgcctccatagccacggtcgtcttcgtgccggacgactccaccctgctcgtaacggtccagacggtcgttgctacgttgttcgcggccgtctctgctgggctgttcgtcggctctgtcgtgctcgatggactgcaggacgattaacaccttcactccgttaatggagtatatgtttgttttgtagtaggatacaccaccagtcgaccactgctactacgaatagtgaatgatgtgccttcaagggcttcgtatcagattcagatttcagatattccagcgtcccatttgattttcacccacttcggatttgctagtacgaccagtgtcccataaaaaaattgctgggcacaccaatttttcggatgtttttgtaacttttgaactgaggttttcactttcaaaaacaagcacgtacttcccgcagcataaaatgttaatactgggaatatttttactc

SEQ ID NO: 2323 - DNA, 1079 bp, Hordeum vulgare
tcagcttgtatctcgtagccctcggggccatcccaaagataagccgctgctaactagcggccacgttccagtttcgtgttcaacaaaagccgagaaagcagacaagtgaaaaaaataacctgtgtttcgtatcactagaggaagaagggagcaggggaagaggaggcagaaatggctgcaatatcagcagcaatctccggctgctgctcttcgtcctgtctgccccagtcccagcggggcctcccgtcctccgcaaggagaaggcacttcaaggtcacggccatggctcccaagaacaaggtgaacaagtacgacgatgggtggtccaagcagtggttcggcgcggggatcttcgcggaggggagcgaggaggcgtcggtggacgtgttcaagaagctggagaagcgcaaggtgctgagcaccgtcgagaaggcagggctgctgtccaaggcggaggagctcggcgtcacgctctcctcgctggagaagctcggactgctctccaaggccgaggacctgggactcctcagcctcgtcgagagcgcagccacagtgtccccggccgtgctcgcatcgctgtcgctgccgctgctcgtcgcctccatagccacggtcgtcttcgtgccggacgactccaccctgctcgtaacggtccagacggtcgttgctacgttgttcgcggccgtctctgctgggctgttcgtcggctctgtcgtgctcgatggactgcaggacgattaacaccttcactccgttaatggagtatatgtttgttttgtagtaggatacaccaccagtcgaccactgctactacgaatagtgaatgatgtgccttcaagggcttcgtatcagattcagatttcagatattccagcgtcccatttgattttcacccacttcggatttgctagtacgaccagtgtcccataaaaaaattgctgggcacaccaatttttcggatgtttttgtaacttttgaactgaggttttcactttcaaaaacaagcacgtacttcccgcagcataaaatgttaatactgggaatatttttactcctaatgtctcagttgacaggctagc

SEQ ID NO: 2324 - DNA, 841 bp, Leymus cinereus x Leymus triticoides
  misc_feature (37)..(37): n is a, c, g, or t
  misc_feature (40)..(40): n is a, c, g, or t
  misc_feature (42)..(42): n is a, c, g, or t
  misc_feature (821)..(821): n is a, c, g, or t
ccgttgctgtcgccgttgctgtcgccgttgctgtcgnctngnggaagaagagagcagaggaagaagaggcagaaatggctgcaatatcagcagcaatctccggctgctgctcttcgtcctgtctgtcccagtcccagcggggcctcccgtcctccgcaaggagaaggcacttcaaggtcacggccatggctcccaagaacaaggtgaacaagtacgacgatgggtggtccaagcagtggttcggcgcggggatcttcgcggaggggagcgaggaggcgtcagtggacgtgttcaagaagctggagaagcgcaaggtgctgagcaccgtggagaaggccgggctgctgtccaaggcggaggagctcggcgtcacgctctcctcgctggagaagctcggactgctctccaaggccgaggacctgggactcctcagcctcgtcgagagcgcagccacggtgtccccggccgtgctcgcatccctgtcgctgccgctgctcgtcgcctccatcgccacggtcgtcttcgtgccggacgactccaccctgctagtggcactccagacgatcgtcgctacgctgttcgcggccgtcgctgccgggctgttcgtcggctcagtcgtgctcgatgggctgcaggacgattagcaccttcactcagttaatggagtatgtttgttttgtatagtataatagtaggattcaccactagtcgaccacttgctactaatagtgagttatgtgcattcaagggcctcgtatttgctattccagcaccctactttttttttttacccacacggcaaatgaacgattttccccccnaaaaattgctgggcacacca

SEQ ID NO: 2325 - DNA, 786 bp, Secale cereale
  misc_feature (480)..(480): n is a, c, g, or t
  misc_feature (770)..(770): n is a, c, g, or t
ggacaggtccaaaaataacctgtgtttcgtatcactagaggaagaagggagcaggggaagaggaggcagaaatggctgcaatatcagcagcaatctccggctgctgctcttcgtcctgtctgtcccagtcccagcggggcctcccgtcctccgcaagcagaaggcacttcaaggtcacggccatggctcccaagaacaaggtgaacaagtacgacgatgggtggtccaagcagtggttcggcgcgggcatcttcgctgaggggagcgaggaggcgtcggtggacgtgttcaagaagcttgagaagcgcaaggtgctgagcagcgtggagaaggcggggctgctgtccaaggcagacgagcttggcgtcacgctctcctcgctggagaagctcggactgctctccaaggccgaggacctgggactcctcagcctcgtcgagagcgcagccacggtgtccccggccgtgctcgcatccctgntcgctgccgctgctcgtcgcctccattgccacggtcgtcttcgtgccggacgactccaccctgctcgtgacagtccagacggtcgtcgctacgttgttcgcggccgtcgctgccgggctgttcgtcggttccgtcgtgctcgacggactgcaggacgattagcaccgtcactctgttcatggagtatgtttgttttgtagtaggatacaccaccagtcgaccactgctactacgaatagtgggttatgtgtgttcattcaagggcctcgtatttgttattccagcgcccncacttgtgatttcttt

SEQ ID NO: 2326 - DNA, 1259 bp, Secale cereale
tcaggttgcaacgctgacatcgtaacacatcccccatgacatatctcgtggctcagcttgtatctcgtggccctcggggccatcccgaagataagccgctgctaaccagcggccacgttccagtttcaggtacaacaaagccgagaagcagacaggtccaaaaataacctgtgtttcgtatcactagaggaagaagggagcaggggaagaggaggcagaaatggctgcaatatcagcagcaatctccggctgctgctcttcgtcctgtctgtcccagtcccagcggggcctcccgtcctccgcaagcagaaggcacttcaaggtcacggccatggctcccaagaacaaggtgaacaagtacgacgatgggtggtccaagcagtggttcggcgcgggcatcttcgctgaggggagcgaggaggcgtcggtggacgtgttcaagaagcttgagaagcgcaaggtgctgagcagcgtggagaaggcggggctgctgtccaaggcagacgagcttggcgtcacgctctcctcgctggagaagctcggactgctctccaaggccgaggacctgggactcctcagcctcgtcgagagcgcagccacggtgtccccggccgtgctcgcatccctgtcgctgccgctgctcgtcgcctccattgccacggtcgtcttcgtgccggacgactccaccctgctcgtgacagtccagacggtcgtcgctacgttgttcgcggccgtcgctgccgggctgttcgtcggttccgtcgtgctcgacggactgcaggacgattagcaccgtcactctgttcatggagtatgtttgttttgtagtaggatacaccaccagtcgaccactgctactacgaatagtgggttatgtgtgttcattcaagggcctcgtatttgttattccagcgccccacttgtgatttcttttttcacccacacttggtaagaaagaatctactacatactccctccctccgaaaatacttgttatcaaaatgaataaaagggaatgtatctaaatgtattttagttctagagatacattttttttttcattttgatgacaagtattttcggacggaggaagtatatagtggcactggcgtcacattgcattgacgtagtttatttttaagaaaatctagaggatcttaagggtattaatcgcatcatatacatcaggtttttttattttcctttgagtgagtgtagtctgttttaaacattaaaattgtagagccgaacgcaaaaaa

SEQ ID NO: 2327 - DNA, 968 bp, Triticum aestivum
aaaagccgagaaagcagacaagtcaaaaaataaccagtgtttcgcatcagtagaggaagaagagagcaggggaagaggaggcagaaatggctgcaatatcagcagcaatctccggctgctgctcttcgtcctgtctgtcccagtcccagcggggcctaccgtcccccgcaaggagaaggcacttcaaggtcacggccatggctcccaagaacaaggtgaacaagtacgacgatgggtggtccaagcagtggttcggcgcggggatcttcgcggaggggagcgaggaggcgtcggtggacgtgttcaagaagcttgagaagcgcaaggtgctgagcagcgtggagaaggcggggctgctgtccaaggcggaggagctcggcgtcacgctctcctcgctggagaagctcggactgctctccaaggccgaggacctgggactcctcagcctcgtcgagagcgcagccacggtgtccccggccgtgctcgcatcgctgtcgctgccgctggtcgtcgcctccatcgccacggtcgtcttcgtgccggacgactccaccctgctcgtgacggtccagacggtcgtcgctacgttgttcgcggccgtcgctgccgggctgttcgtcggctccgtcgtgctcgacggactgcaggacgattagcgccttcactccgttaatgtttgttttgtagtaggatagaccaccagtcgaccactgctactacgaataatagtgagttatgtgcgttcaagggcctcgtatttgctatttcattgccccactactgattactagtataatgcccgtgatttgccacgggcctttaaatatcttttgtaattgcaagtaatgtgtagaaaagacaacctctaacaatcagaaagtaatcaaaatccactacatttactatgcaatttgatgatgtatacacagagagcaaattcaaagaattagcttcgggataggggaggc

SEQ ID NO: 2328 - DNA, 999 bp, Triticum aestivum
ccacgcgtccgcttgtatctcgtggccctcggggccatcccaaagataagccgctgctaaccagcggccacgttccagttttacgtacaacaaaagccgagaaagcagacaagtcaaaaaataaccagtgtttcgtatcactagaggaagaagagagcaggggaagaggaggcagaaatggctgcaatatcagcagcaatctccggctggtgctcttcgtcctgtctgtcccagtcccagcggggcctaccgtcccccgcaaggagaaggcacttcaaggtcacggccatggctcccaagaacaaggtgaacaagtacgacgatgggtggtccaagcagtggttcggcgcggggatcttcgcggaggggagcgaggaggcgtcggtggacgtgttcaagaagcttgagaagcgcaaggtgctgagcagcgtggagaaggcggggctgctgtccaaggcggaggagctcggcgtcacgctctcctcgctggagaagctcggactgctctccaaggccgaggacctgggactcctcagcctcgtcgagagcgcagccacggtgtccccggccgtgctcgcatcgctgtcgctgccgctgctcgtcgcctccatcgccacggtcgtcttcgtgccggacgactccaccctgctcgtgacggtccagacggtcgtcgctacgttgttcgcggccgtcgctgccgggctgttcgtcggctccgtcgtgctcgacggactgcaggacgattagcgccttcactccgttaatgtttgttttgtagtaggatagaccaccagtcgaccactgctactacgaataatagtgagttatatgcgttcaagggcctcgtatttgctatttcattgccccactactgattactagtataatgcccgtgatttgccacgggcctttaaatatcttttgtaattgcaagtaatgtgtagaaaagacaacctctaacaatcagaaagtaatcaaaatccactacatttactatgc

SEQ ID NO: 2329 - DNA, 1032 bp, Setaria italica
gtccagccgaaagataagcccctctaccagtggtcacattcagatttcttcgattgctgcggacagcgaagcagggagccgtgcggaaaaaaaaaacagtgttgggaacacagggcaggaccaaattgcgttgttgcagccggggagaagagtaggaagaagaaatggctgcgataccagcagcgatctccggctgctgctcttcgtctcggctgtcccagcctgctggcctcctgccatcctcgagccgacggcgcttcaaggtgacggccatggcgcccaagaagaaggtgaaccggtacgacgagaactggtcgaagcagtggttcggcgcgggcatcttcgcggaggggagcgaggaggtgtcggtggacgtgttcaagaagctggagcggcgcaaggtgctgagcacggtggagaaggccggcctgctgtccaaggccgaggagctgggcgtcacgctctcctcgctggagcagctgggcctgctctccaaggccgaggacctgggcctgctcagcctcgtcgagaccgcggcgggcacgtccccctccgtgctcgcgtccatctcgctgccgcttctcgtcgccgccgtcgccgaggtggtcgtcgtgcccgacgactccgtcgcgctcgtcgccgtccaggccgtcgtcgccgccgtgctcgcggccggggccgccgggctgttcgtggggtccgtcgtgctcgccggcctgcaggagtcggattgatcagcggctgctcgctcgccgatagcttcgcggagctgggtaaaccatgctgcgtacgccgtcgtcagcgctaccgcatccgagtaattaagccttgtagcataggatcgttattgttaacaattaatggaattatgtgatgcaatgtaatagccttttggtatttactccatgcaatgcaagtgtgaaatgctgaagaaagtacggtgaaagggatggtcgctttccttgtacagttggggaatcacgaagtgtttcttctgtttgcccaatgcaaatacaggcatctgtgtgcttg

SEQ ID NO: 2330 - DNA, 1590 bp, Sorghum bicolor
gtgggtccagcccaaaagataagcctttcaaccagtggtcacattcagatttcttcgatttctgcagacagcgaaactgaggagaatcccaagaagcagagctggtgaaacaaggcaaaggcaaggcaaggcaaggctgccccaaattacattgttgcgtcaggcaagaagaggagcaggaagaaatggctgcaatacctgcagtgatctcgggctgctgctcttcgtctcgcctgtcccagcctgctggcctcctgccctccacaagcagcagaaggcgcttcaaggtcacggccatggcgcccaagaagaaggtaaaccgctacgacgagaactggtcgaagcagtggttcggcgcgggcctcttcgcggagggcagcgaggaggtgaccgtggacgtgttcaagaagctggagcggcgcaaggtgctgagcaccgtggagaaggccggcctgctgtccaaggccgaggagctgggcgtgacgctctcctcgctggagcagctgggcctgctgtccaaggccgaggacctgggcctgctcagcctcgtcgagaccgcggcggggacgtcgccctccgtcctcgcctccgtctcgctgccgctcctcgtggccgccgtcgtcgccgtggtcgtcgtgcccgacgactccgccgcgctcgtcgccctacaggccgtcgtcgcgacggtgctcgcggcgggagccgccgggctgttcgtaggctccgtcgtgcttgctggcctgcaggagtcggattgacccaccggctgagttacgtcgtcaacagtaccgcattcgagtaagctttgtgtagtaggatcgatcttgttagcagagcagaaattcatcattaattataaaaatctacagtatgtgctgcaatatacataatataattagctttttgataatttgccgtgcaaatgtgatcacattattatgaagaaaaattgcgactaaatggatggttaactcggattcgactcctcacttctacaaccatgcaaatatgtacgctaaatctacacgttgcttgagtgatttttggactccggtcactcgattcctggtggccgtcggatgacgctgccaatggattggatgctcagttgtggtgtggtcgtgggccaggtgttgcggtcgctcaacgctgcatgcggacgcttggccagggtgcctgctctcctctcaacgcaactgcactgaagacccaaccgcaggcgcatcacgtgcatgttgctccaagccgactacgccgccggtggagtgcatgcagctacagtgctttctattttgcaggtgaagggtcaggttgtcccatcaaatcacctagccccataagagtatatgatatttcctttacgagagcagattacacggtattgtaacatattttactacttctattttggtgtaaattctatgtttaactggtgtaaattgattatttgtaaatagaaatagttagaattactcgaactattatatgatcttttttgatttttttctgatcttttgtatgttttatttggttctcctttaaattttttaatttggctttcatagtattaatctggttttttttggcttt

SEQ ID NO: 2331 - DNA, 1601 bp, Sorghum bicolor
gcccgtcgcccgtgggtccagcccaaaagataagcctttcaaccagtggtcacattcagatttcttcgatttctgcagacagcgaaactgaggagaatcccaagaagcagagctggtgaaacaaggcaaaggcaaggcaaggcaaggctgccccaaattacattgttgcgtcaggcaagaagaggagcaggaagaaatggctgcaatacctgcagtgatctcgggctgctgctcttcgtctcgcctgtcccagcctgctggcctcctgccctccacaagcagcagaaggcgcttcaaggtcacggccatggcgcccaagaagaaggtaaaccgctacgacgagaactggtcgaagcagtggttcggcgcgggcctcttcgcggagggcagcgaggaggtgaccgtggacgtgttcaagaagctggagcggcgcaaggtgctgagcaccgtggagaaggccggcctgctgtccaaggccgaggagctgggcgtgacgctctcctcgctggagcagctgggcctgctgtccaaggccgaggacctgggcctgctcagcctcgtcgagaccgcggcggggacgtcgccctccgtcctcgcctccgtctcgctgccgctcctcgtggccgccgtcgtcgccgtggtcgtcgtgcccgacgactccgccgcgctcgtcgccctacaggccgtcgtcgcgacggtgctcgcggcgggagccgccgggctgttcgtaggctccgtcgtgcttgctggcctgcaggagtcggattgacccaccggctgagttacgtcgtcaacagtaccgcattcgagtaagctttgtgtagtaggatcgatcttgttagcagagcagaaattcatcattaattataaaaatctacagtatgtgctgcaatatacataatataattagctttttgataatttgccgtgcaaatgtgatcacattattatgaagaaaaattgcgactaaatggatggttaactcggattcgactcctcacttctacaaccatgcaaatatgtacgctaaatctacacgttgcttgagtgatttttggactccggtcactcgattcctggtggccgtcggatgacgctgccaatggattggatgctcagttgtggtgtggtcgtgggccaggtgttgcggtcgctcaacgctgcatgcggacgcttggccagggtgcctgctctcctctcaacgcaactgcactgaagacccaaccgcaggcgcatcacgtgcatgttgctccaagccgactacgccgccggtggagtgcatgcagctacagtgctttctattttgcaggtgaagggtcaggttgtcccatcaaatcacctagccccataagagtatatgatatttcctttacgagagcagattacacggtattgtaacatattttactacttctattttggtgtaaattctatgtttaactggtgtaaattgattatttgtaaatagaaatagttagaattactcgaactattatatgatcttttttgatttttttctgatcttttgtatgttttatttggttctcctttaaattttttaatttggctttcatagtattaatctggttttttttggcttt

SEQ ID NO: 2332 - DNA, 749 bp, Setaria italica
gtgggtccagccgaaagataagcccctctaccagtggtcacattcagatttcttcgattgctgcggacagcgaagcagggagccgtgcggaaaaaaaaaacagtgttgggaacacagggcaggaccaaattgcgttgttgcagccggggagaagagtaggaagaagaaatggctgcgataccagcagcgatctccggctgctgctcttcgtctcggctgtcccagcctgctggcctcctgccatcctcgagccgacggcgcttcaaggtgacggccatggcgcccaagaagaaggtaaattggtcggtacgacgagaactggtcgaagcagtggttcggcgcgggcatcttcgcggaggggagcgaggaggtgtcggtggacgtgttcaagaagctggagcggcgcaaggtgctgagcacggtggagaaggccggcctgctgtccaaggccgaggagctgggcgtcacgctctcctcgctggagcagctgggcctgctctccaaggccgaggacctgggcctgctcagcctcgtcgagaccgcggcgggcacgtccccctccgtgctcgcgtccatctcgctgccgcttctcgtcgccgccgtcgccgaggtggtcgtcgtgcccgacgactccgtcgcgctcgtcgccgtccaggccgtcgtcgccgccgtgctcgcggccggggccgccgggctgttcgtggggtccgtcgtgctcgccggcctgcaggagtcggattgatcagcgg

SEQ ID NO: 2333 - DNA, 777 bp, Sorghum bicolor
aggaagaaatggctgcaatacctgcagtgatctcgggctgctgctcttcgtctcgcctgtcccagcctgctggcctcctgccctccacaagcagcagaaggcgcttcaaggtcacggccatggcgcccaagaagaaggtacgctacgacgagaactggtcgaagcagtggttcggcgcgggcctcttcgcggagggcagcgaggaggtgaccgtggacgtgttcaagaagctggagcggcgcaaggtgctgagcaccgtggagaaggccggcctgctgtccaaggccgaggagctgggcgtgacgctctcctcgctggagcagctgggcctgctgtccaaggccgaggacctgggcctgctcagcctcgtcgagaccgcggcggggacgtcgccctccgtcctcgcctccgtctcgctgccgctcctcgtggccgccgtcgtcgccgtggtcgtcgtgcccgacgactccgccgcgctcgtcgccctacaggccgtcgtcgcgacggtgctcgcggcgggagccgccgggctgttcgtaggctccgtcgtgcttgctggcctgcaggagtcggattgacccaccggctgagttacgtcgtcaacagtaccgcattcgagtaagctttgtgtagtaggatcgatcttgttagcagagcagaaattcatcattaattataaaaatctacagtatgtgctgcaatatacataatataattagctttttgataatttgccgtgcaaatgtgatcacattattatgaagaaaaattgcgact

SEQ ID NO: 2334 - DNA, 877 bp, Zea mays
gtccagcccaaagataagcccctgaactaccagtggccacacacagattccttcgattcccgctgacagcgaagctgaggagaatcccaagaaacagagctggtgaaattgcattgtcgcaacaggcaagagaagaggagaagaaagaaatggctgcaatacctgcagcgatcccgggctgctgctcttcgtctcgcctgcctcagcttgctggcctccctgcctccacaagcagaaggcgcttcaaggtcacggccatggcgcccaaaaagaaggtgaaccgctacgacgagagctggtcgaagcagtggttcggcgcgggcatcttcgcggagggcagcgaggaggtgtccgtggacgtgttcaagaagctggagcggcgcaaggtgctgagcaccgtggagaaggccggcctgctgtccaaggccgaggagctgggcctgacgctctcctcgctggagaagctgggcctgctctccaaggccgaggacctgggcctgctcagcctcgtcgagaccgcggcggggacgtccccgtccgtcctcgcctccatctcgctgccgctcctcgtggccgccgtcgccgcggtggtcgtcgtgcccgacgactccgtcgcgctcgtcgccctacaggccgtcgtcgcggcggtgctcgcggcgggagccgccgggctgttcgtgggctctgtcgtgctcgctggcctgcaggagtcggattgatgcattgatctgcagctgcgcaaggtagaaccaagctgtgtacgtacgtcgacagtaccgccttgtgtagtaggatcgatcttgttagcagagcagaactcgttactaaaaaaatctatagtgtctgtaatataatataatactttagctttttgata

SEQ ID NO: 2335 - DNA, 742 bp, Saccharum officinarum
accggctcagatacccgtctcgacccacgcgtccggcgatctcgggctgctgctcttcgtctcgcctgtcccagcctgctggcctcctgccctccacaagcagaagacgcttcaaggtcacggccatggcgcccaagaagaaggtgaaccgctacgacgagaactggtcgaagcagtggttcggcgcgggcatcttcgcggagggcagcgaggaggtgtccgtggacgtgttcaagaagctggagcggcgcaaggtgctgagcaccgtggagaaggccggcctgctgtccaaggccgaggagctcggcgtgacgctctcctcgctggagcagctgggcttgctctccaaggccgaggacctgggcctgctcagcctcgtcgagaccgcggcggggacgtccccctccgtcctcgcctccatctcgctgccgctcctcgtggccgccgtcgtcgaggtggtcgtcgtgcccgacgactccgtcgcgctcgtcgccgtacaggccgtcgtcgcggcggtgctcgcggcgggagccgccggcctgttcgtgggctccgtcgtgctcgctggcctgcaggagtcggactgactgaccaccggctgaatatcgtcaacagtaccgcatccgagtaagctttgtgtagtaggatcgatcttgttacttgttagcagagcagaattcattaatttaaaaatctacagtatgtgctgcaatataatataatacagtagctttttgatatc

SEQ ID NO: 2336 - DNA, 2305 bp, Brachypodium distachyon
caacggcatcaaccctctccttatccccttgcgtctcccgctctcccccaaccaaagctcgcccgccatggccatggcctccacctcctcctgctcctcgcggccgccgctcctccacccggcctccagaaccccgaacccctcccgcctcccgccgctcgtctccagggcctcctcctctccccgcccgctcctcctctccttcgctccgcccgcgcgcgggcggttccgcgccgccgctgtgcagcaatccgacttcgaagacggggaggaggaatgggatggggaggtggaagaggagtattacagagaggaggaggaggtggaggaaggggaggagatggacgtggaggcgatggaggaggaggcgcgggccgccgccgccgacctcgccgcgcgcctcgaccgcgagctccgcgtcgatggtgatgttcgggagaaaagaagaaccatgagggataagacatcgacatctaaacatatcccagacaataatcttccgaaggtggcaattattggcaggccaaatgttggtaaatctgcactgttcaatcgtcttgtcgggagcaacagggctatcgttgtcgatgaacctggtgtgaccagagatcgtttgtatggacgatcttactggggtgatcaagagtttatggttattgatactgggggtgtgattactctttcaaagtctcaagcaggtgtaatggaagagcttgccatcacaactactgttggtatggatgggattcctctggcctctagagaagctgctattgccaggatgccatcaatgattgaaaaacaagctgttgctgctgttgaagaagcaactgtacttctattccttgtggatggtcaggctggtcttgtggcagctgacatagaaattgctgattggttacgtcggaacttctcacacaagtgcatcatacttgctgtaaacaagtgtgaatccccaaagaaagggcaaatgcaagcattagaattttggtcactagggtttacacctgtatcaatatctgctattactggcactggaactggagagctccttgacatggtctgttcagaactgaaaaatttcgagggactagaagggttggatgatgttgaagaagacgaaaaccgtgttcctgcaatttccatcgttggaagaccaaatgttgggaaaagtagtattctaaatgctttggttggagaagatagaactattgtaagcccagttagtgggaccacccgtgatgccattgacactgagttcaccacagaggatgggcagaaattcaaactcattgataccgcaggcatccggcgaagagcagcagttgcttctgctggcagcacaactgaaacgctttcagtaaaacgtgcatttagtgccattcgtcggtctgatgtggttgcccttgttgttgaagcgatggcctgcgttacagagcaggattataaaatcgcagaaaggatcgagaaagagggaaaggcgtgtgtcattgttgtgaacaaatgggatacaattccaaacaagaacaatgagagcactacgcattatgaactagatgtaagagagaagctccgagtacttgactgggcacctattgtttattgctcggcaatcaatgggaacagcgttgaaaagattatttcggccgcttctttggtcgaaaaggaaaggtccagaagacttggcacctctattcttaatcaagtggtaagagaagccgtagcattcaaagcaccgccgcggacaagaggcggcaaaagaggccgtgtctactacacaacacaggccgctgtccggccgccgacgttcgtgctcttcgtgaacgacgcgaagctcttcccggagccgtaccggcggtacatgcacaagcagctccggtctgacgccgggttcccgggcacgcccatccggctgctgtggcgcagcaggaagcgggcggacaagcagcggcggaagtccaacaacacggaggctcgtggctcgctcgtaggagccagttcgtagcacgtgaaaaggaatgccagaaaaggaatgcatgcctctatgtcgcgaaagaaaaagagaagaaatgtactagcgagttattaggaccgtcacaaggctatagagctttgaagctttgaactttggtttcaaccagattttccggtctagagatcatattcatatctcatagtaatataagtcaatactaacaccatggatacagagcgattaacacagcaagtaactaacggcatagcgccatgatttcctcgtcggtgtagcaatcgcagacccagccgtaggcgcggccgtagacgc

SEQ ID NO: 2337 - DNA, 3362 bp, Triticum aestivum
ggttaatcaaacggcagagtaccgcggggttggtcgccgttggccgctctcctcgccgccttacagctggtttggctcaggtggcgcggcgcaatgcatagggaatctccggaggttttacatacacaggtcaaaagcaatgtaaacaaggccctcggaacaacaacacaatccgtacatgatagtaatgatgcatgttgtgcaactcatgaaaatagcttttcagagctatctatttctgaaggaatgactattaatgaattggagtgccgggctagtatttcgtgcatataccctgtaaataagacaacgcaggcggtttctgtaactaatccaggggcaatgttacacacattagttgatgtatctcggcaagaagaagttggttgctcaacttcagcagaaaaaagaaattctacagaaaatgttatggatgttcttgcaacgccttattccggtccaccaggacaacataaaagcaagtatgtctctaacagaattggctggcaaggtgggctctcataccaatttttatccctttcagaactacagaaagatgctcaaaatggcaatggtcttggtgacagccaaacaaacagcaacaatgctcatttacttcgatgccatcagagtaatgatgatgaaaatattgatttgacatctttttcatccttcaaaagaacagtggaatgccctctcaattttgttccgcaagtcagtattggaaatttgttcagaccaagaaaagcaattgagtttgctgattcatatgtagggggctctcatctgacaccagggaaattagctctatttgcatgcttaagggagggtcctgccagcaaacaacagaaagcagtgaaagaccatgatgatgcaaaaactattggctggagtatttctgatatactgaacaaagagaatctagataaattcattccagcgacaacagctggattaaacggcacagtggatacatcagattacatgaggcgatacaagagttctttaacagatggaaggttgaaggactgtgtggatttgttggaaagcatggagcagaagggattgcttgatacgaagaagatccaccatgccagctttttgagtgcatgtaaaaaacaaagggctgttatggaagctgttcgcttctgccgattgattgaaaatccgaaaatgagcaccttcaatatgcttttatcggtttgtgctaattcaaaagattttgaaggggccctccaagttatggtgctcctaaaggaggctgggctaaaacccgattgtaaactttacaccacattgatatcaacttgtgcaaagtgtggaaaagttgatgcgatgtttgaggtcttccatgagatggttagtgctggaatagagccaaatgttaacacatacggtgcactaattgatggctgtgctaaagctgggcaagtagcaaaagcatttggtgcttacgggatcatgagttcaaagaaggtgaagccagatcgagttgtcttcaatgctttgatcagtgcatgtggtgaatctggagctgttgctcgagcttttgatgttttatcagaaatgacagcagaatcctcagaatcgaaaggatgcaagccaattcttcctgatcatgtcacagttggagcactcatgaagacatgtattcaggctggccaggctgatcgagctcgtgaggtttacaaaatgcttcaggagtacagtataaaaggtactccagaagtttacacaattgcactgagaagctgtagcttgactggcgatttagggtttgcattgaagatctatgaagatatgaacaagatcggagttcaacctgatgagatgtttctgagtgctctagttgatgtagccggccacgctaggagggctgatgctgcttttgaaataatcaaagatgtaagagcaaagggatttcatgttggaatcatggcatacagttcctgtatgggcgcttgctgcaatgccaaggactggaaaaaggcgctgcagctatttgaggagatcaaggctatcaaattaattccaacagtcccgatgatgaatgctttaattacttccctctgtgacggcgatcaagttttaaaagctgctgaggtccttaatgagataaaggaactacgtgtccgtccaaatgagataacctattcggtcttatgtgtggcttgcgaaagaaatggtgaagcacaactagctcttgatttatttgagcaactaaaagtagatggtattggcctcaatcccaccattgtcggttgtcttactggtttatgtctacaaatgttttcctatgatctttcacttggcaacatcattgtcagattcaaccaagggaagccacagattgacaataaatggacttcctcagcaattatggttttccgtcaggcaatcaccgctggtctgctaccctcaagcgatgttttatctcaagtgctgggttgtttgaggtttcctcatgacagttcattgaaaaccactttcattgataatatgggaataagttgtgatatgccacatcaccccaatacaaattcactgttggaaggattcggtgaatatgatatccgtgctttttcagtactggaggaaggtggcttgttaggagcagttgcaagcacttccacaaaatatagtcaaattgtcattgatgcaagaaagtcaaacatctacacagccgaggtttctcttctatcgacattgaagtctttgaagcatcgactagctgcaggtgcaaggttaccaaatgttacaattctattacccaccgaaaagaaacaagttgatcttgatgaaagggagaaaacacttaaacttgctggaagagtcggccaagcagttggctccctgctgagaagattaggaattaaatatcaaggcgaggagtcccacgggaggatgaggatcaacggcctcacattaagaaggtggtttaacccaaaatttacaagcgcaccctccacaggagctccagttgagttgcttccactgccctcgcggttagcgaaagggattgctgatcagcagcgtgatatcagaagcctttctctatagtgcaggtcttaccttttctgtgtcccgatttttgtgtatgccaagaaggcaattactgtacaatcagcagatagcagggccggtcttggctcttattttttttgagaacgttgacactttattaattaagcaacaaagttacatagtcttgcggatacagcccggagcggcagaatgaaaaatacaaagactaacaaagtttatacaagacttggtacatgggccagaaaattaaagtgttggctcacattgcaggtgagagtgggactaagactactcacagtggggagtaacttagacta

SEQ ID NO: 2338 - DNA, 526 bp, Lolium multiflorum
cgccgcaacaaccagacctcgatcccgacgagcggagcagcagcaggagagcggagcaatcgccggagagcggatcggagatggccaagttcgacccgtggcccgtcttcttcaagcgggagtggggccgcaactggcccttcctcgccggcttcgccgtcaccggcttcctcatcaccaagctcaccgccggcttcaccgaggaggacctcaagaactccaagttcgtccaggagcacaagcgctgaggccaggccaggttggggtgaaggaaaatggctgctcatctttctcaccgaattagtcacatcaacattgccggcagttttatatgttatttggatgaacctaccggatacatgccttaggctaccaaagtttcttctattgtatttttgtaataagaggtttctgaatacctaaaccaagaaattaattttaagcgtttcaagacgcttgtttggttatgtgcccggtgacaagattttcattgatgttcaacttgtctaaaaaaaaacaaaaaaaa

SEQ ID NO: 2339 - DNA, 667 bp, Brachypodium distachyon
cccaggcccaatctggcccgatccaattaccattctctcttctccctcttcccgtagtcgccggccgctacgaacgaagcaacacatcgaaggagagagagaggagctgattcgcggactgaatccaaagggaggagagatcggagatgaagaccttcgacccgtggcccgtcttcttccgccgggagtggcgccgcaactggcccttcctcgccggcttcgcagtcacggggatcctcatcaccaagctcaccgccgggttcaccgaggaggacctcaagaactccaagttcgtccaggagcacaggcgctgatccgccgatcggccactcgccaggccacaggaacagcaccagtgttgcctgcgtctgtcctcaatgcggcgagccagttctctacttcgcctttctaattgaacatttatctttttgttgaaacacaatcatgcacactttttgccccagtttgtaatctaataagtggctattgaattgctggcttcaggttaagtatgatacatggtgccattgttgacttgattccttttggtataacagagctcagaatttcttttggagtattaaaagaagttcattcgaactttattactgtagtacagatgagttaacggagtcaaaaagtcaaaatacaacaagctgctgcggct

SEQ ID NO: 2340 - DNA, 2791 bp, Sorghum bicolor
cggaaacatcgcgccgcatcccctagcgccatcggcatcgcacacaagcgtcaacaagatcggggacgagatctagaagcggacggatcgggggggctcacctggtcggtcagtgcctcttgtgctcctggacgaacttggagttcttgaggtcctcctcggtgaagttggccgtcatcttggtgatgaggaatccggtgatggcgaaccccgtgaggaagggccagttgcgcctccactcccggcggaagaagaccggccacgggtcgaacgtcttcatcttctcggcctccggctccggctccggctccggctgctcgcgatctccttcctccctcctccgcctccggcttcgcttctggtgagatttgaggggcgaatgggaatctccttcgctctcctctcgtggatgctcctcctctgctccccttccccctcgtggcggcgaggaggaggaggaggaggaggaggagaggaccaccacccgactcccgaccggacgggacgcggacgggacccgcgaagagagagagagagagagagggagagggacagaggcggaggatccggaatctcgccggagaccggcgtggtgatgccggtgggggaggtggcggcgcggccaggaggaggaggagggatggttctgggcggcggcatggcggcggccgccgtgggaggcgacgacgccgtcgtcatgcagctggccgccgccgagggcgaggagactgtcatcaccgtcaactgccccgaccaggctggcctcggctgcgacctctgccgcaccatcctcgagttcggcctccgcatcacccgcggcgacgtgtctacggacggacactggtgcttcgtggtgttctgggtggtgccccgctcctcgtccatcaaaatccggtgggcgagcctcaagaaccggctcatgtcaatgtgcccttcctcctactccatcccgttctacccggacatcagccagccaggtccctcgcagtactacctcctgaagctcttgtcgccagaccgcaaagggttgctgcatgatgtgacgcacatactatcagatttagagcttataatccacagagtgaaggtgtgtaccacaccggatggaagagttgtggacctcttctttatcaccgacggcatggaactgctgcacaaaaaggaaaggcaagaggagacttgctcgacgttaattgctaccctgggtccttccataagctgtgaggttctgtcagcagaagggttccagcagggattctcttctcttccaccgaaaattgctgaggaactcttcagggtggaactagctgacagcgagatctgctcgagttcgcttagcgtggagttgaagaaggttcagacggccactattaactttgacaattccctgagccctgcacacacgctagttcaaattatctgtgctgatcagaaggggctcatttacgacatattgaggacgatgaaggactgcaacattcagatattttacgggcggttcagatcagacaagaaagggtcagtcagtaaaggttgtcgagaggttgacctttttgttaaacaagtagatggcaaaaaggttatggatcctgagaaacaggatgctctgcggtcgcgcctgagatctgagatgctccatcctcttagggttatgattgtcagtcgtggacctgatacagaactccttgttgccaacccagttgagctctctgggaagggacggccacgcgtattctacgatgctactcttgctttgaaagcacttgggatctgcatcttctctgctgaaattgggagacaagcagcatccgagcgccaatgggaggtctacaggttcctcctggatgacagcaaagagttccccttggcaaacagcctcactaacaggaaccgtgttgtcgatagggtaaggaagacactgatgggatgttacaactaagactcggtgtccatctgtctgcgagaatccaaagcttgaaggtgactgacacagtcagctccatcgaatgtaccctgtaaattatgtatccccaaattatggccactccagaatttcgaaatacagttggcgatctcaatgataatctcttgctggccaaactggtatgtctagattctgttgtcgctgcccacagatgcctgctccgtcaaggtaaataaatggcgatagaaagtgcgtgcaagcttcatctcgcaccttgggatttcagagctagccacaatctataacaaagcagtgcaagattttccacaaatgatacttcctggagtgtgcatggccacggggatggttgaaatcagagtttgcagcacagactggaatgaatcttcctaccatggatccgttgtctgcatgttgagaaaggggagagaaaaaagagcatgtttggtgggaggtgcaaatcgcgggagcaatgattgagcttttgtttggttcagggggatggattactggatgctgacacagatacatgaacgagcctttctgttgtaacttattttagtgcaaaatgatgttgtcttctcccacatctgcttcaccagtcaccacctccttgcttgttgttttcctgcctccttcctaccttccctgtatgattgccccgctagtagtactttctctcaaatagaaaagagtaatgtgaggctttgtcccctgtctcctcgtgtaagcacaatttgtacttgtctgtaaggatgcatatttgtatgtactccatctgtttaactattactacgaaagagtacaattgtttgtgcagagcatacgtgtttaagttggaaagtaatc

SEQ ID NO: 2341 - DNA, 454 bp, Brachypodium distachyon
gtagtcgccggccgctacgaacgaagcaacacatcgaaggagagagagaggagctgattcgcggactgaatccaaagggaggagagatcggagatgaagaccttcgacccgtggcccgtcttcttccgccgggagtggcgccgcaactggcccttcctcgccggcttcgcagtcacggggatcctcatcaccaagctcaccgccgggttcaccgaggaggacctcaagaactccaagttcgtccaggagcacaggcgctgatccgccgatcggccactcgccaggccacaggaacagcaccagtgttgcctgcgtctgtcctcaatgcggcgagccagttctctacttcgcctttctaattgaacatttatctttttgttgaaacacaatcatgcacactttttgccccagtttgtaatctaataagtggctattgaattgctggcttcaggtt

SEQ ID NO: 2342 - DNA, 441 bp, Festuca arundinacea
ggcacgaggcaagacccgagaggaggagagtgatcggagatgaagaccttcgacccgtggccggtgttcttccgccgggagtggggccgcaactggcccttcctcgccggcttcgccgtcaccggcatcctcatcaccaagctcaccgccggcttcaccgaggaggacctcaagaactccaagttcgtccaggagcataagaagtgaacgaccgaccggccggttcgccaggaacagtagcggagttaccagcctgcgtcctgaaatgcggctagccagttctttctgccgttctgatctcactttaccccgttgttcaatgtcaaccatgcacacttttttggtccattctgtaatctaataagaggcgtttgaatattggctccgggttaagtagacatgcatgatgccattgctgacctgaattcctcggacatcttt

SEQ ID NO: 2343 - DNA, 584 bp, Zea mays
aggtcgtcgcagcgccgctacgagggggaggggatcgaactcgaaggagaatttccattcgaccccatccacttctcacctcaatctcgcgagaagcgaagccggaggaggagggtgcgaggagatcgcgagcagccggagccggagccggagccggaggcctagtagatgaagacgttcgatccgtggccggtcttcttccgccgggagtggaagcgcaattggcccttcctcacggggttcgccatcaccggcttcatcatcactaagatgacggccaacttcaccgaggaggacctcaagaactccaagttcgtccaggagcacaagaagcgctgaccaaccaggtgttgtccgaattgcctgtctggacagccagttatgttatgctgtttgaatgaaaaattagcttctttttcttcatctaaatgcgtgcagcctatgctccatctgtaatgtaataagaggcaactgacttgatccaaaagctaccagcttctgattatgaatgatacttcaagtttgatctggttctctgacctgggcatcgatccacttatatgcatgcaacaaatgcttatatc

SEQ ID NO: 2344 - DNA, 692 bp, Zea mays
gccggcccacaggccataggattgaggctgccactcagcacggcccattcaagtcgtaaccctagcaggccgccacgaccacgaggtgcatccacgagaggagatcgaaggagactccaattccagtcgcccccatccgttgctcatctcaccagaagcgaagccggaggagggaggaaggagatcgcgagcagccggagccggaggccgagaggatgaagacgttcgacccgtggccggtcttcttccgccgggagtggaagcgcaactggccctttctcacggggttcgccatcaccggcttcatcatcaccaagatgacggccaacttcaccgaggaagacctcaagaactccaagttcgtccaggaacacaagaagcgctgaccaaccgggtggagtcgtccgaatcgcctgcggatgaaaaattagccccctatttttcttgtcttttttttatctagatgcgtgcactctattgtaataatgtaataagaggcaattggattgatccaacagcaaccggcttctgattttgatccgcttcgctgacatatgcatgcagcaaacgaatatgtgccttttttttttcttgatgttggattgcatctaatcctgttgaattggtgagctgggtcctctgtgatttcatctttccctgataaagtcctgaagatagattggtcttgtttg

SEQ ID NO: 2345 - DNA, 818 bp, Sorghum bicolor
ccaatccaatcgctacgggcccgtccccctcccaccacgcaaacgagctcgcacggaggcgtcgccggcgcggacggacagattccaatcgcccccatccatttctcaccagaagcgaagccggagcccggaggcggaggagcggaggaggaaggcgatctcgagcaagccggaggcggagaagatgaagacgttcgacccgtggcctgtcttcttccgccgggagtggaggcgcaactggcccttcctcacggggttcgccatcaccggcttcctcatcaccaagatgacggccaacttcaccgaggaggacctcaagaactccaagttcgtccaggagcacaagaggcactgacgaaccaggtgaaggagttgtgccagaattcagaaatgcctgtttggccagccaattctgttatgcttttgaatgaaaagaaatagacccctctttttcgtttttcttaatcgaaatgcttgcactctatgttccactttttatgtaataagaggcaaatgatttgaaccaacagcaatcagcttctgattgaaaaatattgatgtgtggcctcggtgttgtgggattgcatctaatcctgtcgatttggtggcgaaaatgaagattttgctatatgattgcagcctatttgaaaatgaggggtggagagcttgtacgagtgtatggcctttagcactgtaacttacaaattgtgagagcaagttcaataatagagccaagtgcttggctataagccaagtaattagagtcaagttatacaataagttgtctcatgcttgtctataaaacacttctcttttct

SEQ ID NO: 2346 - DNA, 1308 bp, Sorghum bicolor
ggaaaccacatttatttgggtaagggaggtaattaatatggttaatagttcagaagtaaagattttttctcctaaaatgcaaatgctatggaactctctctaaacaactctgtaaacgagctgagcgaatggcaggccagcagccaccgaacagcccatgaggatgaggcccaatccaatcgctacgggcccgtccccctcccaccacgcaaacgagctcgcacggaggcgtcgccggcgcggacggacagattccaatcgcccccatccatttctcaccagaagcgaagccggagcccggaggcggaggagcggaggaggaaggcgatctcgagcaagccggaggcggagaagatgaagacgttcgacccgtggcctgtcttcttccgccgggagtggaggcgcaactggcccttcctcacggggttcgccatcaccggcttcctcatcaccaagatgacggccaacttcaccgaggaggacctcaagaactccaagttcgtccaggagcacaagaggcactgacgaaccaggtgaaggagttgtgccagaattcagaaatgcctgtttggccagccaattctgttatgcttttgaatgaaaagaaatagacccctctttttcgtttttcttaatcgaaatgcttgcactctatgttccactttttatgtaataagaggcaaatgatttgaaccaacagcaatcagcttctgattgaaaaatattgatgtgtggcctcggtgttgtgggattgcatctaatcctgtcgatttggtggcgaaaatgaagattttgctatatgattgcagcctatttgaaaatgaggggtggagagcttgtacgagtgtatggcctttagcactgtaacttacaaattgtgagagcaagttcaataatagagccaagtgcttggctataagccaagtaattagagtcaagttatacaataagttgtctcatgcttgtctataaaacacttctcttttctatttcttctcacaacacttgctatttgggttcactatttacatatgcatccgtggctagcttggtgcttatataagagccaagctatctctcgtctcttcttttcttcatatcagcattagcttggttatagggttgttgtaccaaacggtgccacattgatagcagaattggaactgtggcgtggatttcggagctgaaacgtttcaggtttttttttaaaagtttagaaacggcctgtgggttttgtatggattcccttatatttttagttaatctttttaagtgatataaatttaaatgggtttaagttgttcaccc

SEQ ID NO: 2347 - DNA, 634 bp, Sorghum bicolor
gcagaggaggagcatccacgagaggagagcgaaggagattcccattcgcccctcaaatctcaccagaagcgaagccggaggcggaggagggaggaaggagatcgcgagcagccggagccggagccggagccggaggccgagaagatgaagacgttcgacccgtggccggtcttcttccgccgggagtggaggcgcaactggcccttcctcacggggttcgccatcaccggattcctcatcaccaagatgacggccaacttcaccgaggaggacctcaagaactccaagttcgtccaggagcacaagaggcactgaccgaccaggtgaaggagttgtccgaatttcctgtggacagccagttatgttatgccgtttgaatgaaaaattagccccctctttttcgttttttaaatctaaaaatgcgtgcactctatgctccatttgtaatgtaataagaggcaactgaattgattcaacagcaatcagcttctgattaagatacataaagtttaatccggtttgctgacccgatttcttttatacgcatgcgacaaatgaatgtgtgtgtatggatgttgaattgcatcgaatcttgttgaattggtggcgaaatgaagattttgctaaatgattg

SEQ ID NO: 2348 - DNA, 1081 bp, Sorghum bicolor
ccggcccaacaggccacaggaccgagcctgccacccaccacggcccattcaagtcctaaccctagcaggtcagcgcaccgccgccacgagggggaaggggagcagaggaggagcatccacgagaggagagcgaaggagattcccattcgcccctcaaatctcaccagaagcgaagccggaggcggaggagggaggaaggagatcgcgagcagccggagccggagccggagccggaggccgagaagatgaagacgttcgacccgtggccggtcttcttccgccgggagtggaggcgcaactggcccttcctcacggggttcgccatcaccggattcctcatcaccaagatgacggccaacttcaccgaggaggacctcaagaactccaagttcgtccaggagcacaagaggcactgaccgaccaggtgaaggagttgtccgaatttcctgtggacagccagttatgttatgccgtttgaatgaaaaattagccccctctttttcgttttttaaatctaaaaatgcgtgcactctatgctccatttgtaatgtaataagaggcaactgaattgattcaacagcaatcagcttctgattaagatacataaagtttaatccggtttgctgacccgatttcttttatacgcatgcgacaaatgaatgtgtgtgtatggatgttgaattgcatcgaatcttgttgaattggtggcgaaatgaagattttgctaaatgattggaacctttatgaaaatgaggggtggagattggagaaccgttctattttgccatgctagcacggcaagaacgtgagggcgtctgttcgtttattttataagtcgtattttccagtgaacaggctcacatgtaactagaatctcaggcatgataagctccatggcttggtctattcactactggtcattattctgatgtggttacttcttttttccatcgactatacaactgaaacatgacactcgaggagctgtcccagtccaacatcttcctaaaaggctaaaactgatctcccatccatgtgtgttgaatgctaggcatgcagctgtcctggtccaacatcttcg

SEQ ID NO: 2349 - DNA, 424 bp, Saccharum officinarum
tctcaccagaagcgaagccggaggcggaggaggaggaggcaggagatctcgagcaagccggaggcggagaagatgaagacgttcgacccgtggccggtcttcttccgccgggagtggaggcgcaactggcccttcctcacggggttcgccatcaccggcttcctcatcaccaagatgacggccaacttcaccgaggaggacctcaagaactccaagttcgtccaggagcacaagaggcactgacgaaccaggtaaagtagctgtgtcagaaacgcctgtttggccagccagttctgttatgcttttgaatgaaaagaaatagaccccttttttcatttttcttaatcgaaatgcttgcactctgttccattttttatgtaataagaggcaaatgaattgagccaacagcaatcagcttctgatt

SEQ ID NO: 2350 - DNA, 516 bp, Saccharum officinarum
tctcaccagaagcgaagccggaggaggcggaggagggagagaggagatcgcgagcagccggagccggaggccgagaagatgaagacgttcgacccgtggccggtcttcttccgccgggagtggaggcgcaactggcccttcctcacggggttcgccatcaccggattcctcatcaccaagatgacggccaacttcaccgaggaggacctcaagaactccaagttcgtccaggagcacaagaggcactgaccgaccaggcggagtcgtcgtccgaattgcctgtgtggacagccagttgtgttatgctatttgaatgaaaaattagcccccactttttcgtttttttttaatctaaatgcgtgcatctatgctccatttgtaatgtaataagaggcgactgaattgatccaacagcaatcagcttctgattaagatacttcaagtttgatacggtttgctgacctgatatgcggggcatcgattttttttatatgtatgcaacaaatgaatattatc

SEQ ID NO: 2351 - DNA, 557 bp, Panicum virgatum
gccacgattcctttcgccccccaatccgttccccaggagaagccggaggcggaggaagtgagatcgcgaggagcagcaggcggagatgaagacgttcgacccgtggccggtgttcttccgccgggagtggaagcgcaactggcccttcctcaccgggttcgccatcaccggattcctcatcaccaagatgacggccaacttcaccgaggaggacctcaagaactccaagttcgtccaggagcacaagaagcactgacgaggccaggtggaggagttgccagatttgcctatgcggtcggccagttctgctatgcctgtctgaatgaaaaaatagttcccctctcttttcccccttttatttaatctgaatatctgcactctatgctccatttgtaatgtaataagaggcaaaagaattgttgaaccaaaagaaaccagcttatgatgatgatacttaagtttgatccattttactgacttgatatgtgggccgtcgatcttgttatcttgttaattgattggagcccgtttgaaaagaaagggggtcgaaatcttgt

SEQ ID NO: 2352 - DNA, 669 bp, Panicum virgatum
tagcaggtcgccgcttcgaggagacgccacgattccattcgcccccatccattcccaggagaagccggaggcggaggaagtgagatcgcgaggagccgcaggcggagatgaagacgttcgacccgtggccggtgttcttccgccgggagtggaagcgcaactggcccttcctcaccggattcgccatcaccggattcctcatcaccaagatgacggccaacttcaccgaggaggacctcaagaactccaagttcgtccaggagcacaagaagcactgatgaggccaggtggagttgccagaatcgcctatgccgtggccagttctactatgcctgtctgaaggaaaaaatagttcccctcctttttccccccttttatttaatctgaatatctgcactctatgctccatttgtaatgtaataagaggcaaatgaattgttgaaccaaaagaatccagcttctgatgatacttaagtttgatccagtttactgacttggtatgtgggccaccgatcgtgttatcttgttaattggttggagcctgtttgaaaagaaaggggtcgaaatcttgtatgagatttaacattgtttacagatttgaatgtaaggcccccttaaaggaacatctcgttttttttgagggaaactgtttttggttttgttttttct

SEQ ID NO: 2353 - DNA, 854 bp, Zea mays
aagccctacctgcccatccccctcccaccacccaatcgcgctcgcacggaggcggcgccggcgcggacggacatattccattcacctcccatccatttctcaccagaagcgaaggcggaggcggaggagcggaggtaggagatctcgagcaagccggaggcggaggagatgaagacgttcgacccgtggccggtcttcttccgccgggagtggaagcgcaactggcccttcctcacgggtttcgccatcaccggattcatcatcacgaagatgacggccaacttcaccgaggaggacctcaagaactccaagttcgtccaggaacacaagaagaagcactgacgaaccaggtgaaggagttgtcagaaacgcatgtttggccagccagttctgttatgcttttgaatgaaaaatttagacccctctttctcgtttccttaatcgaaatgcttgcactctatgttccatttgtaatgtaataagaggcaaatggattgaaccaacaacaatcaacttctgattgaaaaatatcgatgtgtggcctgaatgttgtgggatcgcatctaatcctgtcgatttggtgaagtgaagattctgccatattactgcagctatttgaaactgaggtgtggagagcctgtatggtcttttagcacttgcaacgtactaattctgaagcagatgtgttgtaccacgagtccatgactctcatgagtagtttgtaaaaactattcccttccaactatatggatcgaggagggaagtgagctaaggccctgattggatctcaggagctaaaatttagttattgtagaagctaaagttttaaacaagagagaactaaaaatgacaaa

SEQ ID NO: 2354 - DNA, 561 bp, Pennisetum glaucum
cgattccatttcgcccccaatcgattccccaccagaagccgtcaagccggaggcggaggaggaggaggagccggaaggagatcgacgcagccggagatgaagacgttcgacccgtggcccgtgttcttccgccgggagtggcgccgcaactggcccttcctcaccggcttcgccatcaccggattcctcatcaccaagatgacggccaacttcaccgaggaggacctcaagaactccaagttcgtccaggagcacaagaagcactgacgggaccaggtgatggagttgtccgagttgcctaggtggccagccaattatgttatgctgtttgaatgaaattaatccaccttccttttctctcctttttcatctgaatgcgtgcactctatgctccatttgtaatgtaataagaggcaaatgaattattgaaccagaaaaaatcagcttctgattataatactcccaagtttgcttaggtttcctggccgatatctgggacatgtgcacactctgtatccttttggtagtggtcgctggaatgaattaaattcgcagcttttc

SEQ ID NO: 2355 - DNA, 602 bp, Pennisetum glaucum
cgcctggcgatgtgagcatgttgcgcagggtgttggagaccatggcccccaatcgattccccaccagaagccgtcaagccggaggcggaggaggaggaggagccggaaggagatcgacgcagccggagatgaagacgttcgacccgtggcccgtgttctttcgccgggagtggcgccgcaactggcccttcctcaccggcttcgccatcaccggcttcctcatcaccaagatgacggccaacttcaccgaggaggacctcaagaactccaagttcgtccaggagcacaagaagcactgacgggacccggtgatggaggttgtccgtgttgttggctcggtggccagccaattctgttatgctgtttgaatgaaattagtccaccttccttttctctctctttttcatccaaatgcttgcactctatgctccttttgtaatgtaataagaggcagatgaattgttaaaccaggaaaaaaatcagcttctgattataatactcccaagtttgcttaggtttcctggccgatatctgggacatgtgcacactctgtatccttttggtagtggtcgctggaatgaattaaattcgcagcttttctg

SEQ ID NO: 2356 - DNA, 572 bp, Festuca arundinacea
  misc_feature (60)..(60): n is a, c, g, or t
  misc_feature (95)..(95): n is a, c, g, or t
  misc_feature (114)..(114): n is a, c, g, or t
  misc_feature (146)..(146): n is a, c, g, or t
  misc_feature (191)..(191): n is a, c, g, or t
ggcacgaggcaacaaccagacctcgatcccgacgagcggagcagagaggagaggaatcgncggagagcggatcggagatggccaagttcgacccntggcccgtgttcttcaagngggagtggggccgcaactggcccttcctcgcnggcttcgccgtcaccggcatcctcatcaccaagctcaccgccggnttcaccgaggaggacctcaagaactcaaagttcatccaggagcacaagcgctgaggtcaggttgggttgaaggaaaatggctgctcctgttctcaccgaattagtcacatcaacattgccggcagtttttatatgttatttggatgaacccaccggatacatgccttaggctaccaaagtttcttctattgtattttttgtaataagaggtttctgaatacctaaaccaagaaattaattttaagcgtttcaagacgcttgtttggttatgtgccgggtgacaagatttacatggaggttcaacttgtcaaatatttgttttgctgctttgtttgattcacattggagcctcgttttgcacttgttttcacgtgtaatcct

SEQ ID NO: 2357 - DNA, 573 bp, Setaria italica
gccagatcgattcctttttcgcccccaatccattccccaccagaatccgtcaagccggaggcggaggaggaaggagatcgagcggaggcgacgcagccggagatgaagactttcgacccgtggccggtgttcttccgccgggagtggcgccgcaactggcccttcctcaccggcttcgccatcaccggtttcctcatcaccaagatgacggccaacttcaccgaggaggacctcaagaactccaagttcgtccaggagcacaagaagcactgatgggaccaggtggagttgtccatgttgcctaggtggccagccaattctgttgttctgtttgaatgaaattagtccaccttccttttctctcctttttcatccaaatgcgtgcactctatgctccgtttgtaatgtaataagaggcaaatgaattgttgaaccagaaaaaaatcagcttctgattgtaatactcccaagtttgatgaggtttcctgacttatatctgggacatgtgcgcatgcactcactctatatccttttgactacttaattagaaaactattgaagatcttgtcaatt

SEQ ID NO: 2358 - DNA, 755 bp, Avena sativa
cccctccaccattcccctaccctcgccgcaacaaccagacctcgatcccaaccacgcgcggagcagcaagatggccttcctgaacaagttcgacccgtggcccgtgttcttccgtcgggagtggaagcgcaactggcccttcctggcgggcttcgccgtcaccgggatcctcatcaccaagatgaccgccgggttcaccgaggaggacctcaagaactcccagttcgttcaggagcacaagaagcactgaggctggcctgaaggaatgcctgctgcgcttcttgctgaattaatggcatcaacattgccggcagttttaatatgttgtttggatgaactcactcaatgcatgtcttagtctatccagttttctattatacttctttttatgtaataagaggtttctgaatgcatgaaccaagaaattccagcttctcaagatgtgataccttgtttcttcttttggttatatgccgggggacaagattaacgaggggcttgactggttatctatctatgaagccagatcatttggtttttacataacatagcattctggtacctgctgtgctgtgtggcagatggtcgaagatttgttttgctgcccgcttgattaatagggggaagctttttttgcagttcttttcatgtgtaatcctgtatttgctgtgtgtggtcctggtatgttggaagaggttttcttcaggagttttaaactttctatctgtgtaatgcttggaaagtttgatttgtta

SEQ ID NO: 2359 - DNA, 415 bp, Avena sativa
gagatggccttcctgaacaagttcgacccgtggcccgtgttcttccgccgggagtggaagcgcaactggcccttcctcgcgggcttcgccgtcaccgggatcatcatcaccaagatgaccgccgggttcaccgaggaggacctcaacaactccaagttcgtccaggagcacaagcgctgaggctgggatgaaggaatggctgctgcgcttcttgctgaattagtcgcatcaacattgccggcaattttctgttgcatttttgttttgtagtaagaggtttctgaatgcatgtaaccaagaaattccagcttctcaagatgtgataccctgttttggttatatgctggggaacaagattaacgagggcattgactggtgatctatctataaaccaagggcattgactggttttttc

SEQ ID NO: 2360 - DNA, 306 bp, Avena sativa
cccctccaccattcccctaccctcgccgcaacaaccagacctcgatcccaaccaaacgcgcggagcggagcggagcagcaagatggccttcctgaacaagttcgacccgtggcccgtgttcttccgtcgggagtggaagcgcaactggcccttcctggcgggcttcgccgtcaccgggatcatcatcaccaagatgaccgccggattcaccgaggaggacctcaagaactccaagttcgttcaggcgcacaagaggcactgaggctgggctgaaggaatggctgctgcgcttcttgctgaattagt

SEQ ID NO: 2361 - DNA, 605 bp, Saccharum officinarum
ctcccaccacgcaatcgcgctcgcacggaggcgtcgccggcgcggacggacagatgggattcgcctcccatccatttctcaccagaagcgaagccggaggcggaggaggcaggagatctcgagcaagccggaggcggagaagatgaagacgttcgacccgtggccggtcttcttacgccgggagtggaggcgcaactggcccttccttacggggttcgccatcaccggcttcctcatcaccaagatgacggccaacttcaccgaggaggacctcaagaaactccaagttcgtccaggagcacaagaggtactgacgaaccaggggaagtacctggtgtagatacgacctgttgggccgcccggtctggtatgcgtctggatgaaaagaaatagaccccgtgtttcatttttgttgaatcgaaagcttggcactctgtgccaatgtgtatgcaataagaggccaaatgactgggccaacacgcattcaacttttgattggaaaaattctcatgtgtgcactgggggttgggggattggtcgactacatgacaatagcgaccaacgtcgaggatggtgggggcggggcgtctatgaaggcgaccacg

SEQ ID NO: 2362 - DNA, 638 bp, Triticum aestivum
atttctcaccagaagcgaaggcggaggcggaggagcggaggtaggagatctcgagcaagccggaggaaaaggagatgaagacgttcgacccgtggccggtcttcttccgccgggagtggaagcgcaactggcccttcctcacgggtttcgccatcaccggattcatcatcacgaagatgacggccaacttcaccgaggaggatctcaagaactctaagttcgtccaggaacacaagaagaagcactgacgaaccaggtgaaggagttgtcagaaacgcatgtttggccagccagttctgttatgcttttgaatgaaaaatttagacccttctttctcgtttccttaatcgaaatgcttgcactctatgttccatttgtaatgtaataagaggcaaatggattgaaccaacaacaatcaactcctgattgaaaaatatcgatgtgtggcctgaatgttgtgggatcgcatctaacctgtcgatttggtgaagtgaagatctgccataaaaaaaagggggccggtaccaatcgcctatatgatcgtatacgcgcgctcacgggcgtcgtttaaactcgtgacgggaaaacctgggttccaacttaacgccttgagaaatccccttcgcagctgcgtaaca

SEQ ID NO: 2363 - DNA, 761 bp, Zea mays
gtctgttgccggcccacagaccataggattgtggctgccactcaccacggcccattcagtcgtaaccctagcaggccgccacgaccacgaggtgcatccatgagaggagatcgaaggaaactccaattccagtcgcccccatccgttgctcatctcaccagaagcgaagccggaggagggaggaaggagatcacgagcagccggagccggaggccgagaggatgaagacgttcgacccgtggccggtcttcttccaccgggagtggaagcgcaactgtcccttcctcacggggttcaccatcaccggcttcatcatcaccaagatgacagccaacttcaccgaggaggacctcaagaactccaagttcgtccaggaacacaagaagcgctgaccaaccggaaacatttttagtctattagctcagcgggagctctcacctcgaacaaaaaaccaagcaaaaaatctttggaccaaacctccaagacttgatgcttgtcctattgaatcgaaattttggggcacctatgctcagcatgatctcctttcttgggctgaagcagagttcttgcattggtggattcccaaagattgccctctcacgccttcttcgaaggcaactattgcagccgcatttagtacagatgggagagtacttgcatctacacatggtgaccatactgtcaaaataattgattggcaaactgggaaatgcttgaatgtactgcttggacatcaccgcactccatgggtggtacattac

SEQ ID NO: 2364 - DNA, 466 bp, Elaeis guineensis
ctttcgacccgtggccggtgttcttccgccgggagtggcgccgcaactggcccttcctcaccggcttcgccatcaccggtttcctcatcaccaagatgacggccaacttcaccgaggaggacctcaagaactccaagttcgtccaggagcacaagaagcactgatgggaccaggtggagttgtccatgttgcctaggtggccagccaattctgttgttctgtttgaatgaattagtccaccttccttttctctcctttttcatccaaatgcgtgcactctatgctccgtttgtaatgtaataagaggcaaatgaattgttgaaccagaaaaaatcagcttactgattgtaatactcccaagtttgatgaggtttcctgacttatatctgggacatgtgcgcatgcactcactctatatccttttggacttaaaaaaaaaaaacagtagacgtagcgaacgagaacc

SEQ ID NO: 2365 - DNA, 531 bp, Pseudoroegneria spicata
  misc_feature (362)..(362): n is a, c, g, or t
  misc_feature (366)..(366): n is a, c, g, or t
ggagagagaggcagcagatccgcggactcaaatccaatccaaggcgcaggcggagaggagagcgacgccggagatgaagttcttctcggccttcgacccgtggcccgtgttcttccgccgcgagtggggccgcaactggcccttcctcgccggcttcgccgtcacggggaccctcatcaccaagctcaccgccgggttcaccgaggaggacctcaagaactccaagttcgtccaggagcaccacaagaagaagtgaccggccggtccgccgccaggccacaagggacgccagctgagttaccggcatgtgtcctcaatgcagcgggccagtcccaaccctccttattctgattgaactttancttnttgttcaaatccaactgcgtgcatttctgttgctccagtttgtaatgtaataagcgacgtttgaattgtcgaatccaagaaaaaggaaatcttgcttcaggttaactacattgccatggctagattagagcgaagatgcgctctgtgtttcgtttaaaaaaaaaa

SEQ ID NO: 2366 - DNA, 644 bp, Triticum aestivum
aggccccttctccaccggctgcacggcgacgacggtgtacgtcctccccccgtccacgccgcaacgcaacaagagagagagagaatcagatcttggcggactcgaatccaatccaatccaatccaaggcggaggtcgagatcaaagccaccggagatgaagttcttctcggcgttcgacccgtggccggtgttcttccgccgggagtggggccgcacctggcccttcctcgccggcttcgccgtcacggggaccctcatcaccaagatgaccgccggcttcaccgaggaggacctcaagaactccaagttcgtccaggcgcacaagaacaagtagtcgccgcccgcccggcccgtccgccgccaggtcacaggggcagcagctgagttaccggcatgtgtccttgatgcggcgagccaatccccaccctcactattgtgattgaactttctgttttttgttcgaatccaactgcgtgcatttttgccgctctggtttgtaatgtaataagcgacatttgaatcgtcgaatccaagaaaaaaaacggcttcggataaagtagctgccatgggtcactctgtctatgcacaatgaagacgctctctgtttcgtttcgcagatctgttaccgtgtgtgcttcgcttt

SEQ ID NO: 2367 - DNA, 600 bp, Triticum aestivum
cccccgtccacgccgcaacgcaaccagagagagagagagaaccagatcttggcggacacgaatccaatccaatccaacccaaggcggaggtcgagatcaaagccaccggagatgaagttcttctcggcgttcgacccgtggccggtgttcttccgccgggagtggggccgcacctggcccttcctcgccggcttcgccgtcacgggcgccctcatcaccaagatgaccgccggcttcaccgaggaggacctcaagaactccaaattcgtccaggcgcacaagaacaagtagtcgccgcccgcccggcccgtccgccgccaggtcacaggggcagcagctgagttaccggcatgtgtccttgatgcggcgagccagtcctcaccctcactattgtgattgaactttatgttttttgttcaaatccaactgcgtgcatttttgctgctctggtttgtaatgtaataagcgacatttgaatcgttgaatccaagaaaaaaacggcttcggatcaagtagctgccatgggtcactctgtctatgcacaatgaaagacggtctctgtttcgtttcgcagatctgttaccgtgtgtgcttggcttt

SEQ ID NO: 2368 - DNA, 573 bp, Triticum aestivum
ttcggcacgaggctcttttcccctcgtctcctccccgtccacgccgcaaagcaccgagaaccagatcggagcgctacccaccggagatgaagttcttctcggcgttcgacccgtggccggtgttcttccgccgggagtggggccgcacctggcccttcctcgccggcttcgccgtcacgggggccctcatcaccaagatgaccgccggcttcaccgaggaggacctcaagaactccaagttcgtccaggcgcacaagaagtagtcaccgcccgcccggcccgtccgccgccaggtcacaggggcagcagctgagtaaccggcatgtgtccttgatgcggcgagccagtcctcaccctcactattgtgattgagcttttatgtttttcttttcaaatccaactgcatgcatttttgctgctctggtttgtaatgtaataagcgacatttgaatcgttgaatccaagaaaaaaacagcttcggataaagtagctgccatgggtcactctgtctatgtacaatgaagacgctctctgtttcgtttcgtggatctgttaccgtgtgtgcttcgcttt

SEQ ID NO: 2369 - DNA, 595 bp, Triticum aestivum
cccgtccacgccgcaacgcaacaagagagagagagaatcagatcttggcggactcgaatccaatccaatccaatccaaggcggaggtcgagatcaaagccaccggagatgaagttcttctcggcgttcgacccgtggccggtgttcttccgccgggagtggggccgcacctggcccttcctcgccggcttcgccgtcacgggggccctcatcaccaagatgaccgccggcttcaccgaggaggacctcaagaactccaagttcgtccaggcgcacaagaacaagtagtcgccgcccgcccggcccgtccgccgccaggtcacaggggcagcagctgagttaccggcatgtgtccttgatgcggcgagccaatccccaccctcactattgtgattgaactttatgttttttgttcaaatccaactgcgtgcatttttgctgctctggtttgtaatgtaataagcgacatttgaatcgtcgaatccaagaaaaaaacggcttcggataaagtagctgccatgggtcactctgtctatgcacaatgaagacgctctctgtttcgtttcgcagatctgttaccgtgtgtgctttgcttt

SEQ ID NO: 2370 - DNA, 950 bp, Triticum aestivum
gggaaccactcctcttttcccctcgtctcctccccgtccacgccgcaaagcaccgagaaccagatcggagcgctacccaccggagatgaagttcttctcggcgttcgacccgtggccggtgttcttccgccgggagtggggccgcacctggcccttcctcgccggcttcgccgtcacgggggccctcatcaccaagatgaccgccggcttcaccgaggaggacctcaagaactccaagttcgtccaggcgcacaagaagaagtagtcaccgcccgcccggcccgtccgccgccaggtcacaggggcagcagctgagtaaccggcatgtgtccttgatgcggcgagccagtcctcaccctcactattgtgattgagcttttatgttttttttttcaaatccaactgcatgcatttttgctgctctggtttgtaatgtaataagcgacatttgaatcgttgaatccaagaaaaaaacagcttcggataaagtagctgccatgggtcactctgtctatgtacaatgaagacgctctctgtttcgtttcgtggatctgttaccgtgtgtgcttcgcttttttggtagtcgatactgctgattactgccattggtcgttaagagcatttacttgcttacgctggttgaatcttaattactggatgtcaggaaaagcttgatcaacttgatgatctccaatcaagtttaattccgcttaaaatttattatcttgaagtaagtttaattgtagtcatgcctcccaggcgtccctcgcaaggaaacgtacattagttatacttgtaagtaaatttaagttcactctgttttcttaaaacaaactatagtaaggtaaggttaagggttaaagttgttacaactagttacgttactttacccctacccggaagtaactaaaacctaccttcggtcgacctttagtttttggtttttaggt

SEQ ID NO: 2371 - DNA, 505 bp, Triticum aestivum
tctcatcctctccgttggtcttgccgcagccaccggagcagcgacgtcgaccggatcgaccccgacgagcggcggcggagatggcgcggttcgacccgtggccggtgttcttccggcgggagtgggcccgcacctggcccttcctggcgggcttcgccgtcaccggcgccctcgtcacaaagctcaccgccgggttcaccgaggaggacctcagggcctccaagttcgtccaggcgcacaggcgctgagcccctcaggatgggacggctcctgtaattctcactgaattaatcccatcaacgtggttggcagatttttttttaatacgttattagtcgaatgaactcgctgagtgcaagccaatagtataccccaactttctattgtaatttttgtaataagaggtttcctaaaggcctaaacaaagaaattaaattccagcttctcaagatgcatgaggtatcttggttcttatatggttatattggcggcggggataacattc

SEQ ID NO: 2372 - DNA, 702 bp, Cynodon dactylon
gccgggggtgaggtgcggatcgagaccgaccgattcattccccattcctgtctttcccatccgcgacgaaccgcacccaatcgccggagcgagatcgcgagcggcgccccgtcggaggagatgaagacgttcgatccgtggccggtcttcttccgccgcgagtggaaccgcaactggcccttcctcacgggcttcgccatcaccggctacctcatcgtcaagatgacggccaacttcaccgaggaggacctcaagaactccaagttcgtccaggagcacagcgcttacaagaacaagaagcactgactcgcccccgtcaccgccaaaggtgaaaggagcaactgatttcctttgaagttgtccctgtcatctatgtggcctgccaactctgttatcctgcatgaatgaaattagcccccctttttttcttttccctcccttaaatgtgtgcgcctgatgctgctccatttgtaatccaataagaggcaaatgaattgttggaccacaaaaatttagcttccgcttatggcgcttgaaatttgattatgttttgctgacttatccgagacattgtgtgatatgtaaacatccaatgcttgtgttaccatttaaatgtgcctgtagggctcatctggataaactaaagtcctctccaatacaggtaaaattcctcagacagtgaacatgaagtaatcctcatcg

SEQ ID NO: 2373 - DNA, 761 bp, Zea mays
gtctgttgccggcccacagaccataggattgtggctgccactcaccacggcccattcagtcgtaaccctagcaggccgccacgaccacgaggtgcatccatgagaggagatcgaaggaaactccaattccagtcgcccccatccgttgctcatctcaccagaagcgaagccggaggagggaggaaggagatcacgagcagccagagccggaggccgagaggatgaagacgttcgacccgtggccggtcttcttccaccgggagtggaagcgcaactgtcccttcctcacggggttcaccatcaccggcttcatcatcaccaagatgacagccaacttcaccgaggaggacctcaagaactccaagttcgtccagtaacacaagaagcgctgaccaaccggaaacatttttagtctattagctcagcgggagctctcacctcgaacaaaaaaccaagcaaaaaatctttggaccaaacctccaagacttgatgcttgtcctattgaatcgaaattttggggcacctatgctcagcatgatctcctttcttgggctgaagcagagttcttgcattggtggattcccaaagattgccctctcacgccttcttcgaaggcaactattgcagctgcatttagtacagatgggagagtacttgcatctacacgcggtgaccatactgtcaaaataattgattggcaaactgggaaatgcttgaatgtactgcttggacatcaccgcactccatgggtggtacattac

SEQ ID NO: 2374 - DNA, 761 bp, Zea mays
gtctgttgccggcccacagaccataggattgtggctgccactcaccacggcccattcagtcgtaaccctagcaggccgccacgaccacgaggtgcatccatgagaggagatcgaaggaaactccaattccagtcgcccccatccgttgctcatctcaccagaagtgaagccggaggagggaggaaggagatcacgagcagccggagccggaggccgagaggatgaagacgttcgacccgtggccggtcttcttccaccgggagtggaagcgcaactgtcccttcctcacggggttcaccatcaccggcttcatcatcaccaagatgacagccaacttcaccgaggaggacctcaagaactccaacttcgtccaggaacacaagaagcgctgaccaaccggaaacatttttagtctattagctcagcgggagctctcacctcgaacaaaaaaacaagcaaaaaatctttggaccaaacctccaagacttgatgcttgtcctattgaatcgaaattttggggcacctatgctcagcatgatctcctttcttgggctgaagcagagttcttgcattggtggattcccaaagattgccctctcacgccttcttcgaaggcaactattgcagctgcatttagtacagatgggagagtacttgcatctacacatggtgaccatactgtcaacataattgattggcaaactgggaaatgcttgaatgtactgcttggacatcaccgcactccatgggtggtacattac

SEQ ID NO: 2375 - DNA, 1126 bp, Zea mays
aattccagtcgcccccatccgttgctcatctcaccagaagcgaagccggaggagggaggaaggagatcacgagcagccggagccggaggccgagaggatgaagacgttcgacccgtggccggtcttcttccaccgggagtggaagcgcaactgtcccttcctcacggggttcaccatcaccggcttcatcatcaccaagatgacagccaacttcaccgaggaggacctcaagaactcaagttcgttcaggaacacaagaagcgctgaccaaccggctcagcgggagctctcacctcgaacaaaaaaccaagcaaaaaatctttggaccaaacctccaagacttgatgcttgtcctattgaatcgaaattttggggcacctatgctcagcatgatctcctttcttgggctgaagcagagttcttgcattggtggattcccaaagattgccctctcacgccttcttcgaaggcaactatttgtgaacacatttgtagtttaccctcagctgtgaacaccttctggtttatctatttacttgcacgagaaacttatatgacaagaatttgttttgatagttatgccatagttagtgatatgagtgctgctggacttggattaaacaagttttgttatgctggattgataactgcattcaagaacaagacaccaaccactgaggaaactatggcgaagattcttgacttcgtcgggcagtcgaaaggttggcaatatgttgaaagagtatcaaaggacattgctgagaatataatgatgaatgtgttagaggaagaactgtacaacctcccaacagcagaatatgtaaataggcgaggaggatttgtctttaaacaacatacagtttatcatgttgctctccaagcttgtgcagaattgcgaagcaaagagacacttgaagcacttctggaaatgttcaataaggataatagagatggatctacttatgatgcctacatggtgatgcaagctatgaggtgttacctacgatgtggagatattgattctgctgttaagatgtttgaagagtattcaagctcgaggtccccacccgctgagttgtatgcggaagaggagctggaagcaaggatcagattgcttgaagtgtga

SEQ ID NO: 2376 - DNA, 1041 bp, Oryza sativa
tggcgacatggcggtagagcttgaattgttccagaaggacagcaaaggcagattcccttgggggcccactaaaatctggcccacgtggaggagaggcgaggcccatctccatgcggcggcgcccctgcctaaccctaaacgcgatgcgataaccaccaccaccatccgcttcttcccccttcggatcgagaaaaaagcgaaaggacctcttgaccccccaaccacaccgaggccgccgcggaggaggaggaagaggaggagatcgaggatgtttttcagccgcttcgatccgtggccggtgttcttccggagggagtggaagcgctgctggcccttcctcaccggcttcgccgtcaccggcgccatcatcaccaagatgaccgccggcttcaccgaggaggacctcaagaactccaagttcgtccaggcgcacaagaagcactgatctgatccgtgcctccatggtgaaggaacagctggtattgcctaagtcttcagtttggcctatttttctgttccaaatgaacctacctgttttttgtttatccatttgggtggacaaccgctccagttgtatctaataagaggcgtttgaatctttggaccaaaaaatttgagcttctggtataaacctgtaatactcttcaagtgccatcctgcttcctgatttattttttgtaaaagcttgtatcgatggtaagtatacatcgaaagggctttcctggctggttgccaaacgttgggcttaggcacgacatagtttcttgggcaagacatttggttcattgctgtaacttccgcacacttgtcttaggcacgtttcttttgccaaactttgtctaaggtgaggcgagtaaattgctagacacaccgtagacaagatttggccgagaagtgtcgtgtcgaaatgaaccaaatctgcccgtaaaacttgcagcgtttgttccattcccatttaaaacacagctttgggtttatttgtttgtgtgaagcccaatagaaaaatttcagtcttccggcctagctacgtaccggtttcag

SEQ ID NO: 2377 - DNA, 237 bp, Scabiosa columbaria
tacttctcttgttttcattgcaattgatacgagcaaatactaaaaagcaaaatcaaattttcgacatgaggcaattcgatccatggccagtatttttccggcgagaatggaagaggaactggccgttcctcgtcggctttgccatcaccggcactcttatcaccaaaatgactctcggtctaactgaggaggatgcgaagaattctaagtttgtgcagaggcacaagtgtagagttt

SEQ ID NO: 2378 - DNA, 622 bp, Platanus occidentalis
gataacaggggcgagcgacacagagaacgagaggtaaaggggcggaaaaaaggaagaagcaaagatggcgaagtttgatccgtggccagtatttttcagacgagagtggaaacggaactggccgttcttggtcggattcgccgtcaccggcactctcatcactaagctctctcttggacttaccgaggaggatgcgaagaactctccattcgtccagaggcacaagaggtgagcctctgattcctgatgtagtttccagatggacactcttttacttggaagtggaggttggcagtttgcccttgtctttttgagttttaaaatgaaaattgggatgatgaatttcaatttttgaattttcttttaagcagtccttgacttgaataagaaagcagaccttgatttattttggaagtatgcgatctcaaatgttaaaacaaattagggctgggtttggagtataatctatattaccatatctcaaatacggagtctttcctgtacccaatcagttggtggatcatgtaggctacttacccagatcacttctattggattatgaagaatacaatttcatattttcattgaatgttaaaaaatcatctgaagggctgattagttt

SEQ ID NO: 2379 - DNA, 1627 bp, Triticum aestivum
gcacgaggccccacggctctccctcctcctccgccactcctccccgccttaaagctctcccgcattgcaatcccccatggcctcctacacccgcccgaaccccgccaaccctagtagcccggccccgtcggcgccgccgctctacccgtcgctcaccatggcggacctggcgccggtcgagatcccgcggtccccggcctcccccgacgcgccggcgccgtcggacgacgtgctgctgcgcgcccccggcgcgcagctccacctaatcgaccgccagcgcagccacccgctggccgccggcgacctctccctccaccgcatccgcgccggcgacacctccctcgccgccatcgcggccctgggacccgtccagtggccgctcgcccgcgacgtcgccgccgtcaagctcgacccgcgccactactccttctccttcgccgtccccgcctccgccgacgacccggcccccgagccgctccactacggcctcacgctctccgcccccgacccgcgcctggacgccctgctcggcgcctacaccaggttctccgcccactccgtggccggcagcgaggggctcgccgacggggtgcgcggtgaggtggaggccgccgcgtactggaccgccgtcgcgcccaacgtcgaggagtacggcagcgccgtcgccagggccatcgcgtccggcgccgagaacgtcgccaaggggatcctgtggtgcggggtgatgaccgtcgacaggctccggtgggggcaggaggttctcaggaagaggattcagcccggcgataccgaggccgaggtcagtccggagatgctcaggcggatcaaaagggctaagaaggtgacaaaaatgtccgagaaagtggcaactggaatactgtctggagttgtgaagcttactagctctgttacaagctcattggttaactcaaaagctggcaagaagttcttcagcctattgcctggagaggttattcttgcttcacttgatggatttggcaagatttctgacgccgtagaagtggctgggaaggatgtgctatcaacatcgtcgacggtgacgaccggtcttgtatcccacaagtacggagagaaagctgctgcggcaaccaacgaagggctcgatgcggcaggccacgccatcggaacggcgtgggctgtgttcaagctccggcaggcattgaacccgaagagcgtcctgaaacccacgtcgctcgccaagtccagcatcaaggctggagccgcggagctccgggcgaagagcagcaagagcaagtagggtctgaagcagtcttcgccgcagccggtggtattggggcctgacgagatcagaagcttgcataccctgtcagtccccgctgatgtgccgccttgtttgtagatatgtgtgctggaaacagagaacaacctgcctgtcatgtctttcgctctgctgatgtgcttcctagtggagtatctgttgcttagtttcgttatgtgctctgtctggagtatctgttgcttagtttcgttatgtgctcggtctgtcgatgaaatggagtaggttcactggattttactgctgttattgtggtgttggcccttgctgtaatgctgaaggcctaagcttgaactgaatggttgatgc

SEQ ID NO: 2380 - DNA, 1539 bp, Triticum aestivum
gctctcccgcattgcaatcccccgaatggcctcctacacccgcccgaaccccgccaaccctagtagcccggccccgtcggcgccgccgctctacccgtcgctcaccatggccgacctcgcgccgcccgagatcccgcggtccccggtctcccccgacgcgccggcgccatcggacgacgtgctgctgcgcgcccccggcgcgcagctccacctcgtcgaccgccgccgcagccacccgctggccgccggcgagctctccctccaccgcatccgcgccggcgacacctccctggccgccatcgcggcgctcggccccgtccagtggccgctcgcccgcgacgtcgccgccgtcaagctcgacccgcgccactactccttctccttcgccgtccccgcctcccccgacgacccggcccccgacccgctccactacggcctcacgctctccgtccccgacccgcgcctcgacgccctgctcggcgcctacaccaggttctccgcccactccgtggccggcagcgaggggctcgccggcggggtccgcggcgaggtcgaggccgccgcgtactggaccgccgtcgcgcccaacgtcgaggagtacggcagcgccgtggccagggccatcgcgtccggcgccgagaacgtggccaaggggatcctgtggtgcggggtgatgaccgtcgaccggctccggtgggggcaggaggtgctcaggaagaggatccagcccggcgataccgaggccgaggtcagcccggagatgctccggcggatcaaaagggctaagaaggtgacaaaaatgtcagagaaagtagcaactggaatactgtctggagttgtgaaggttactagctatgttacaagctcattggttaactcaaaagctggcaagaagtttttcagcctattgcctggagaggttgttcttgcttcgcttgatggatttggcaagatttctgacgctgtagaagtggctgggaaggatgtgctatcaacatcgtcaacggtgacaaccggtctggtatctcacaagtacggagagaaagctgctgcggcgaccaacgaagggctcgatgcggcaggccatgccatcggaacggcgtgggccgtgttcaagctccggcaagcattgaacccgaagagtgtcttgaaacccacgtcgctcgccaagtctaccgtcaaggctggagccgcggaactccgggcgaagagcagcagcaagagcaagtagggttcgaagtcgagccggtcgtgtcagggatctgaccatcagaagtttgcatctcccgccagtcccagttgatgtaccgtcttgtttgtagatatgtgcactggaaaaggagaactacctgcctgtcatgtctttccctcggctgatgcgtttctcagtggagtatctgttgcttggttttcgttatgtgctctgtcagtcgatgaaatggagtaggttaatcactggattttactgctgttattgcggtgttggcccttcattcatttggcataggctgactgactttggatttggcaaaaaaaaaa

SEQ ID NO: 2381 - DNA, 1557 bp, Triticum aestivum
gcacgaggccctcctcctcctccgccactcctccccgccttaaatctctcccacattgcaatcccccatggcctcctacaaccccgccaaccctagtaccccggccccgtcggcgccgccgctctacccgtcgctcaccatggccgacctggcgccgcccgagatcccgcggtccccggcctcccccgacgcgccgccgccctcggacgacgtgctgctccgcgtccccggcgcgcagctccacctaatcgaccgccagcgcagccacccgctggcggccggcgagctctccctccaccgcatccgcgccggcgacacctccctggccgccatcgcggcgctcggcgccgtccagtggccgctcgcccgcgacgtcgccgccgtcaagctcgacccgcgccactactccttctccttcgccgtgcccgcctccgccgacgacccggcccccgacccgctccactacggcctcacgctctccgcccccgacccgcgcctcgacgccctgctcgccgcctacaccaggttctccgcccactccgtggccggcagcgaggggctcgccggcggggtgcgcggcgaggtcgaggccgccgcgtactggaccgccgtcgcgcccaacgtcgaggagtacggcagcgccgtggccagggccatcgcgtccggcgccgagaacgtggccagggggatcctgtggtgcggggtgatgaccgtcgaccggctccggtgggggcaggaggtgctcaggaagaggatccagcccggcgataccgaggccgaggtcagcccggagatgctccggcggatcaaaagggctaaaaaggtgacaaaaatgtccgagaaagtggcaactggaatactgtctggagttgtgaagcttactagctctgttacaagctcattggttaactcaaaagctggcaagaagttcttcagcctattgcctggagaggttattcttgcttcgcttgatggatttggcaagatttccgacgccgtagaagtggctgggaaggatgtgctatcaacatcgtcgacggtgacgaccggtcttgtatctcacaagtacggagagaaagctgctgcggccaccaacgaagggctcgacgctgcaggccacgccatcggaacggcgtgggccgtgttcaagctccggcaggcattgaacccgaagagcgtcctgaaacccacgtcgctcgccaagtccagcatcaaggccggggccgcggaacttaggtcgaagagcagcaagagcaagtagggtctgaaggagtcttcgccgcagccggtcgtatcggggcctgacgagatcagaagcttgcatatgtgtagcagcttgtagatatatgtgctggaaacagagaacaacctgcctgtcatgtctttccctccgctgatgtgcttcctagttgagtatctgttgcttggtttggttctgtgctctgtaagtcgatgaaatggagtaggttaatcgctgaattttactgctgttattgtggtgttgacccttcatttcatttgctgtaatgctgaaggcgtaagcatgatttaccaaaa

SEQ ID NO: 2382 - DNA, 1568 bp, Secale cereale
tctccggcattgccaatcccccatggcctcctacaaccacccgaaccccaccaacccgtcggcgccgccgctctacccgtcgctcagcatggcggacctggcgccggtcgagatcccgcgctcccccgacgcgccggcgccctcggacgacgtgctgctgcgcgtgcccggcgcgcagctccacctcgtcgaccgccagcgcagccacccgctggcggccggcgacctgtccctccaccgcatccgcgccggcgacacctcgctcgccgccatcgccgccctcggccccgtccagtggccgctcgcccgcgacgtcgccgccgtcaagctcgacccgcgccactactccttctccttcgccgtccccgcctcccccgacgacccggcccccgacccgctccactacggcctcacgctctccgtccccgacccgcgcctcgacgccctgctcggcgcctacaccaggttctccgcccactccgtggccggcagcgaggggctcgccgacggggtccgcggcgaggtcgaggccgccgcctactggaccgccgtcgcgcccaacgtcgaggagtacggcagcgccgtcgccagggccatcgcgtcgggcgccgagaacgtggccaaggggatcttgtggtgcggggtgatgactgtggaccgtctccggtgggggcaggaggtgctcaggaagaggatccagcccggcgataccgaggccgaggtcagcccggagatgctccggcggatcaaaagggctaagaaggtgacaaaaatgtccgagaaagtggcaactggaatactgtctggagttgtgaagcttactagctatgttacaagctcattggttaactccaaagctggcaagaagtttttcggcctattgcctggagaagttgttcttgcttcgcttgatggatttggcaagatttctgatgccgtagaagtggctgggaaggatgtgctatcaacatcgtcaacggtgacgaccggtcttgtatctcacaagtacggagagaaagctgccgctgcgaccaacgaagggctcgacgctgcaggccacgccatcgggacggcgtgggccgtgttcaagctccggcaggcattgaacccgaagagcgtcctgaaacccacgtcgctcgccaagtccagcatcaaggccggggccgcggaacttcggtcgaagagcagcaagcacaagtagggtctgaagcagtcttcgccgcagccggtcgtatcgggacctgacgagatcagaagcttgcatgcataccctgtcagtccccgctgatgtgcggccttgtttgtagatatgtgtgctgcaaacacagaacaacctgcctgtcatgtctttcccgcggctgatgtgcttctcagtggagtacatgttgcttggtttggttatgtgctctgttagtcgatgaaatggagtaggttcactggattttactgctgtaatgatgaaagcctaagcttgaactgaatgggttgatgctttaactaaataaaaatatgctttaactaagcagtatgaaactataaagaagttgaaactatatgctgaaggccta

SEQ ID NO: 2383 - DNA, 1550 bp, Triticum aestivum
aaccccgccaaccctagtagcccggccccgtcggcgccgccgctctacccgtcgctcaccatggccgacctggcgccgcccgagatcccgcggtccccggcctcccccgacgcgccggcgccctcggacgacgtgctgctgcgcgtccccggcgcgcagctccacctaatcgaccgccagcgcagccacccgctggccgccggcgagctctccctccaccgcatccgcgccggcgacacctccctggccgccatcgcggcgctcggccccgtccagtggccgctcgcccgcgacgtcgccgccgtcaagctcgacccgcgccactactccttctccttcgccgtccccgcctccgccgacgacccggcccccgacccgctccactacggcctcacgctctccgcccccgacccgcgcctcgacgccctgctcggcgcctacaccaggttctccgcccactccgtggccggcagcgaggggctcgccggcggggtgcgcggcgaggtcgaggccgccgcgtactggaccgccgtcgcgcccaacgtcgaggagtacggcagcgccgtggccagggccatcgcgtccggcgccgagaacgtggccaaggggatcctgtggtgcggggtgatgaccgtcgacaggctccggtgggggcaggaggtgctcaggaagaggatccagcccggcgataccgaggccgaggtcagcccggagatgctccggcggatcaaaagggctaagaaggtgacaaaaatgtccgagaaagtggcaactggaatactgtctggagttgtgaagcttactagctctgttacaagctcattggttaactcaaaagctggcaagaagttcttcagcctattgcctggagaggttattcttgcttcgcttgatggatttggcaagatttccgacgccgtagaagtggctgggaaggatgtgctatcaacatcgtcgacggtgacgaccggtcttgtatctcacaagtacggagagaaagctgctgcggccaccaacgaagggctcgacgctgcaggccacgccatcggaacggcgtgggccgtgttcaagctccggcaggcattgaacccgaagagcgtcctgaaacccacgtcgctcgccaagtccagcatcaaggccggggccgcggaacttaggtcgaagagcagcaagagcaagtagggtctgaagcagtcttcgccgcagccggtcgtatcggggctgatgagatcagaaacttgcatatgtgtactagcttgtagatatgtgtgctggaaacagagagcaacctgcctgtcatgtctttccctctgctgatgtgcttcctagttgagtatctgttgcttggttttgttctgtgctctgtaagtcgatgaaatggagtaggttaatcgctgaattttactgctgttattgtggtgttgacccttcatttcatttgctgtaatgctgaaggcgtaagcatgatttaccaaaatctatccatctattattccctctgaaataatataagaccttttagatcggtactaaagtactaatctaaagcg

SEQ ID NO: 2384 - DNA, 2669 bp, Brachypodium distachyon
agaagaggagaagaaaacaaaaacccagatgccggccagcatcatcatcccgtctcgtcttctccacctccacacatccaaaacccaaaatccaaagccctcctccctcctctcttcccttaccctctcaatcgagactgcaacaacgaacacaaatgcaaacaccaaccatgtacacgtccatggcagctcgggcaacgtcggcggcggcgaacctccctgcaccaccaccaaggcaatgctactaccacctcctgccacccgcaggtcgccgctccgtgtgggcgctctccgcgtccccgaagaagaagaacccatggctggacccgttcgacgacgggcccgacgaggacttcgactacacgggcgtctactcaggcggcaagcaagacgaggatccacggcccccagaagacccgtcaaacccctacggcttcctccggttccccatgggctacaacccggagctcgacagcctcgcctccaaggtgcgcggcgacgtgcgccgggcctgctgcgtggtgtccggcggcgtgtacgagaacgtgctcttcttccccgtcgtgcagctcctcaaggaccgctaccccggcgtcctgatcgacgtcgtggcctccgcccggggcaagcaggtctacgagatgtgcaagaacgtgcgctacgccaacgtgtatgaccccgacgacgactggcccgagcccgccgagtacacgcaccagcttggagtcctcaagaacaggtattatgacatgatcctgtccacgaaactggctggcacgggccacgcgctgttcttgttcatgtcgtcggctcgcgagaaggtgggttacgtttaccccaacgtcaatggcgccggcgccgggcttttccttactgagatgttcaagccgcccacaaccaacctctccgatgggggatataacatgtaccaggaaatgctggagtggctgggccggccgggcaagggcgtgccgcagcagccgataccgccgctcagggtgtccatctccaagaagctgaggggcattgtggaggacaagtacagccgcgctggcgtcgagaagggcaagttcgtcgtcgtccatggtatcgcctctgactccgtcgccaacatgacgtccaggggagacgatgactgcctcctcccccttgaacaatgggcagagatcgccaaagcgatcagctctcaaggcaatggactgaggcctctgtttgtgatgccacatcagaagcatagagaagagatcgaggacattgtgggcagggagaccagctacctgtttatcaccactcccgggcagctcacctgccttatcaatgactccgccggcgttgtcgcgaccaacaccgccgctgtccagctcgccaatgcccgtgacaggccatgtgtggcgctgttctcctccaaggagaaggcgaagctgttcctgccatacgcggaggataagaagagctgtactgtcgtggcgtccgcaactggcaagctggccgacattgacatcgaggctgtgaagaacgcagtgaaggagttcgagcctgctcccagcttcgcattggcacaaaaatgatcaaaacgataatctttcttgattgtgttgtaaatagatctgcacagcgagctcatctgaccagcgagaggctaagagttcagtgccttgtagctttctaattcagcacatacacatgtttacctctggtttggatgggtgaacaaaaataccatcgtagatagctctaaaagtaaataagatcctcagcaatatcatgagatgatcacacaataatactggaatttaacgaagcatgaaaatttatgtcatcaactggttcactgcgcacggcagcgtagaactttccatgttgacaaatagtgcagcacttaaatcatggttgtatcaataataaattcaccacatctcagatcagctaaagtgtgcaataaatccaaccagaacaatacagctaaagagcagcccacacttgaaggttcttagtctccttgttgcttagccttggtaagcaataccatacctattcacactagcgataggaatctatacaaagagataactgtaagtttcatggttttcggaacctagattctctgtcgaaacttctgtcaatccggtggtgctccacagaatgccgaccctcatctcatatacagaagctaacacaacaacagctcacagaaccaataaatataaataccacaaactaatgcattagtcaaatcgaacctaacctcacagaattaattgttttggacaggaactaccgcagaagtatctttgagaagggaattcttcatgtcatccgggttcgttacgctgagcagggtttgtgcactctccacccccttctcacctccatgttctaaagttgtgtccttaatggactcggtttcagcagccttctgtgtgctggagctggttgaaggtttctgatctgatattgaagccactgtgacggtttgatcagtggctgtcactgctgaagtgatcaaagaaattgatccatcccttgactcattgctgctttgaaatggttgatcatggttgtgcttaccttcataagtcacaaccatattatttatgtcatctgctgctttttcgacatgtttacggacaggacacccatcatgtgtgcagcggtaatagctcctgcag

SEQ ID NO: 2385 - DNA, 1803 bp, Avena sativa
caaaaccaaaatccaaagacctcctccctcctctcatctctaggttgagaagaaaaagcaatagagatatccaccaaagccaatgcaaagaacactctaccactgcaagaacaaatgcaaacactaaccatgtccacgtacatggccacgcccatggcgagggccacgtcgacggtagcagcagcgaacctccccgcgccgaggcaatgctacctcctgccagggcgccgggccaggctcgcgggcggcgccccctcggcgaagaagaagaacccgtggcttgacccgttcgacgacggccctgacgaggactttgactacacgggcgtgtactcaggcgggaagcaggaggaggacccgcggccgccggaggaccccgcgaatccatacgggtttctccggttcccgatggcgtacatgccggagctggacagcctcgcgtccaaggtgcgcggcgacgtgcgtcgcgcgtgctgtgtggtgtctggcggcgtgtacgagaacgtgctcttcttccccgtggtgcagctgctcaaggacaggtaccccggcgtgctcatcgacgtggtggcgtcggcgcgggggaagcaggtctacgagatgtgcaagaacgtccggtacgccaacgtgtacgaccccgacaacgagtggccggagcccgcggagtacacccaccagctcggcgtaatgaaaaataggtactacgatatgatcctgtcgacaaagttagccgggacgggccacgcgctgttcctcttcatgtcgtcggcacgcgagaaggtcggctacgtctacccaaacgtcaatggcgccggtgccgggctgtttctcaccgagatgtttaagccgccgactaccaatctctcggacggcggctacaacatgtaccaggacatgttggagtggctcggccggccggcgaagggcgtgccgcagcagccgacaccgccgctgaaagtgtccatctccaagaggttgagggcgatcgtggaggacaagtacaatcgtgccggcgtcgagaagggcatgtacatcgttgtccacggcatagaatcggactctgtcgccaacatgacgtccaggggcgacgacgactgccttctgcccctcgaacaatgggcagagatcgccaaagagatcagctctggaggcaatggattgaggcctctgtttgtgatgccacatgagaagcacagagaagagatcgaggagatcgttggtcaggagaccagctacctgttcatcaccactcctggacagctcacctgcctcatcaacgactctgctggtgtcgtcgcgaccaacaccgccgctgtccagctcgcaaatgcccgtgacaagccatgtgtggcgctgttctcttctaaggagaaggcaaggctgttccttccgtatgcagaggagaggaggagctgcactatcgtcacgtcggcgacagggaagctgggcgccattgacatccaggcggtgaagaatgcagtgaagggcttccagcccgctcccagcttcgcgctggcacaacagtgatcggcttgatcgtgttgttaatagatacagacagcaagctcatcagaccaacaatagatacagacagcaagctcatcagaccaacaagagagaccgagagctcagtgcctttactcctccaattcagcacgcatacataagtcacttttggttagcatgggtgacaagaaacaacagataaacgaaactcatgtttcctctctgtcaaatcctgtgctccttgcctatctcgagtacacatcaacaaattatcaatgaccacaccctaacttttta

SEQ ID NO: 2386 - DNA, 2549 bp, Setaria italica
atccaggctcaaacccaacctcttctccctccactcttccctcatccaaagggaaaaaaggacccggaaaagaaacagtcacagacagataccagcaccaacaatatccaaattattccgaagctagcagcagctcatcgacacgctcaagagcaagagctagcaagtgagcaagaaggaagcccgccatgcagacgccagccatgtcgacgtccatggccgccacgcccacgacgacccgtgccgtggcgccggcgccggcggcaaagtcccccgcgccacggcaatactgcaaccacctcctcccctccgccaccagccaccgccgccgccgcggcagcgtcgtggcgcggtcggcgaagaagaggaacccgtggctggacccgttcgacgacggtcccgacgaggagttcgactaccagggcatgttcgccggcgggaagcaggaggaggacccgcggccgcccgaggacccggcgaacccctacgggttcctccggttcccgcaggggtacaacccggagctggacagcctggcgtccaaggtccgcggcgacgtgcgccgcgcctgctgcgtggtgtcgggtggcgtctacgagaacgtgctcttcttccccgtcgtgcagatgctcaaggaccggtaccccggcgtgctgatcgacgtggtgacgtcggcgagggggaagcaggtctacgagatgtgcaagaacgtcaggtacgccaccgtctacgaccccgacgacgactggccggagcccgccgagtacactcaccagctcggcatcctcaagaatagatactatgatttgatcctgtcgacgaggctggccgggatcgggcacgcgctcttcctcttcatgtcgtcgtcgcgggacaaggtcggctacgtttaccccaacgtcaacagcgtcggtgcggggctgttcctcaacgagatgttcaaggcgccgaccaccaacctctcagacggcggctaccacatgtacacggagatgctggagtggatcggccggccggcgaagaacgtgccccggcagccgacgccgccgctgcgggtgtccatctccaagaagctgcgggcgtacgtggagggcaagtacagccgcgccggcgtcgagaagggtaagtacgtcgtcgtccacggcatcgcctccgactccgttgccagcatgaagtccaggggcgacgacgactgcctactccccctcgagcactgggctcaaattgccaaggagatcagctctgacgacaaggggctgaagcctctgttcgtgatcccccatgagaagcacagggaggagattgaggaggaggtgggggaggacaccaacatcctgttcctcactaccccaggccagctcacctgcctcatcaatgactccgccggagtcgtcgcgaccaacaccgccgccgtccagctcgccaatgcccgcgacaagccatgtgtggcgctgttctcctcggctgagaaggcgaagctgttcctgccgtacgtcgaggataaggggagctgcaccgtcattgcatcggcaacagggaagctgatcgacatcgacatcgaggccgtgaagaaggcagtgaaggacttcgagcccgctccaagcttcgcattggcataacagtacatagagattcacagagaatttatatgagccacaaagctggcaacaagatttcagtgtctttcgcaatttcaattcagcactaatgccatttctagattagtataagaatcagagggattccacacacaatgttgcagctattacaactgcaaataccagacaatgcgctttctggtgccataccgataaattaatcaccatatctcagatcagctatgcaataaatggaactagaacatacagcacacaatgttctgaagaagaacaccccacacgtcatctggtctcttcgttgcttagcctcaggtaaagaaatacagtacctatacacactagggattgaaattctatacaggtacacgaccagtcatggcttccagaacctaaatgctttctcaactgttccccagtgctccacggaatgccgaacaccaaccctcacctcatacacaagctaacacaataacagaaccaataaatatcacaggctaatacgtcaatagaatcaccctatctcaaccgaactcagctgttttggacaggaactgcagcggaagtttctttcagaacagagttcttcatgtcgtcggaattagttttgatgctgagcagcgtttgtgcagattcgagtgccttctcacctccaaattccaaagttgtctccttatcagacacaccgttggcatccttctgagtgatggttggaggtctctcatctgctgttgtgattgatgtgctgggttgctcaatggctgccactggttgactgatcgcagaaacaggtatgctgttgcttctaaatggttcatcatggttgtgtttaccttcgtaagttacaacgatattgttgacatcatctggtgccttttccacatgcttacggacaggacacccaccatgtgtgcagcggtaataactcctgcg

SEQ ID NO: 2387 - DNA, 3701 bp, Hordeum vulgare
ccccccgtccttccccttgcctgctttcgaatccacaccactgcaccaccaatcgccctcttctcccacccagtcccccgctcccctcccctcccctccacgccgcctccatccccttctagggttaagggttccatgcgatctcgccgccccgacggacgggaaccctaagcgcgtctcctctccggtcgaatctcgagccgtcgccgcgaaacaaatgggcaagggcgggcaggacgaggccgttcggcccgatggatccggttcccccgggcccgaccccgacgtgcccgtcttcccgttctgggcgcgcaccccgagcgagtgcctggcggagctcggcgtttcggctgaccgcggcctcagctccgacgacgcggcggcgcggctgcacaagtacgggcccaacgagctggagcgccacgcgccgccgtccgtgtggaagctggtgctcgagcagttcaacgacacgctcgtgcgcatcctcctcgccgcggccgtggtctccttcgtgctcgcgctctacgacggcgccgagggcggcgaggtcagggccaccgccttcgtcgagccgctcgtcatcttcctcatcctcatcgtcaacgccgtcgtcggggtctggcaggagagcaacgccgagaaggcgctcgaggcgctcaaggagatccagtccgagcacgccaccgtcaagcgcgacggccgctggaagcatgggctgcccgcgcgcgacctcgtcatcggagacatcgtcgagctccgcgtcggcgacaaggtccccgcggacatgcgtgtgctccagcttatcagctctacccttcgtgttgagcagggatccctcactggcgagacctcttcggttaacaagaccagccacaagattcatctcgaggacacagatatccaggggaaggagtgcatggtctttgctggcaccaccattgtcaacggcagtgccgtctgtgtcgtgacgggaactggcatgtccactgaaataggcaagatccattcgcagatccaggaggcatcgcaggaggaggatgacacaccgctgaaaaagaagctcaatgagtttggtgaggcgctcactgccattattggagtgatatgcatcttggtttggctcattaacgtgaagtatttcctcacctgggagtatgtggatgggtggccaacgaattttaagttctcgttcgagaagtgcacatattactttgagattgcagtggcactggctgttgctgcaattccagagggcctgcctgctgtcatcaccacatgcttggcactaggaaccaggaagatggctcagaagaatgcacttgtcagaaagttaccaagtgttgagacattaggttgcacaacagtgatttgctctgataagacaggaactctgaccaccaaccagatgtcagcggtgaggcttgtggcaattgggaggtggcccgatacacttaggaactttaaggttgatggtaccacttatgatccaagtgatggcaagatacatgactggccaactttgaacatggatgataacctccagatgatcgcgaagatagctgcactctgcaatgatgcaagtattgcacactctgagcatcagtatgttgctactgggatgcccacagaggctgcattaaaggttttggtcgagaaaatggggctccctggtggatatactccatcactggattcatctgatttgctaaggtgctgtcaatggtggaacaacgatgccaaaagagtagggactctggaatttgaccgtactagaaaatcaatgggagttattgtgaaaaaagctgagactggaaagaatttgttgcttgtgaagggggcagtagaaaatctgctagagagaagtgcctatattcagttacttgatggatccgtcgtgctcttggatgagggtgccaaggcactcgtattgtcaacacttagggaaatgtctggcagtgcgttgcgctgtttgggctttgcatacaaggaagatctggcagattttgcaacatatgatggagaagaacatcccgctcacaaatatctacttgatcctgcatactactcttccattgagagtaatctgatattctgtggttttgttggtctaagggaccctccacgagaagaagtccacaaagcaattgaagattgcagggctgctggtatacgtgttatggtgataacaggtgataacaaagaaacagcagaggcaatatgccgtgagattggggtttttggccccagtgaaaatattagctccaagagctttgcagggaaggaatttatggctcttcctgataagaagaagctgttgaggcaaacaggtggccttctcttctcaagggcagagccaaaacataagcaagaaattgttaggctgctcaaagaagatggtgaagtcgttgcaatgactggtgatggagtgaatgatgcaccggctctgaagttagctgatattggaattgcgatgggtattacggggactgaggttgcaaaagaagcttcagatatggtgcttgcagatgataacttcagtacaattgtctcagctgttggtgaaggaaggtctatttacaacaacatgaaggcttttataagatatatgatatcttcgaacattggagaagttgcctccatattcctcacgtcggctttaggcatcccagaaggcctcattcctgtgcaacttctgtgggtcaatcttgttacggatggccctcctgcaacagcattaggattcaatccaccagataaggatatcatgaagaaacctcctagaagaagtgatgattcattgatcactccttggatcctgttccgctacatggttattgggctgtatgttgggattgcaacagtggggatctttatcatctggtacactcatggctctttcctgggaattgatctggctagtgatggtcacactcttgtttcatactcccagctctcaaactggggccagtgcccctcatgggagggtttcaatgtgtcatcattcacagcaggggcaaggacattcaactttgatgaaaacccttgtgattacttccagggtggcaaaataaaagcgacaaccctctccctgtccgtcttggtgtccattgagatgttcaactcactgaatgccctgtctgaagatggcagccttctgagcatgcctccatgggtgaacccctggcttcttctggcaatgtcggtgtcttttgggcttcattttttgatcctctacgtgcccttccttacccaaatcttcgggattgtgcccctcagtttcaacgaatggcttttggtggtagcagtggccttcccagtggtcctcatcgatgaggttcttaagtttgttgggcggtgcttgacagctcgtgcaagaaaacaattaggaaagcggaaggaagagtagaaggtagtgattgagtaatagattgcaggcttgccacgggggagtagacgtctggtgataccccattatttttcttgagatctgagggctctgctctttgttgagcatgaaggaagttagggtactctatagaactcataatcatgcctcgagtttaacagactcatttattcatttgtaacaaaaaatggtgttatgaatgtgctggagatacagcatggtttcttgcccacttactgcagtaaccttgcacttatatccatgattttttctgctctgaatgcaatggcgtgac

SEQ ID NO: 2388 - DNA, 3666 bp, Secale cereale
cgaatccacaccactgcaccaccaactcgccctcttctcccacccagcccagtcctccgctcccctccccgccgcctccatccccttctagggttaagggttccatgcgatctcgccgccgcgacgacggacgggaaccctaggtaggagcgagcgtctcctctccgttcgaatctcgactcgtcgccacgaaacaaatgggcaagggcgggcaggacgaggccgcgcggccggatggatccggttcccccggggccgaccccgacgtgcccgtcttccccttctgggcgcgcaccccgagcgactgcctggcggagctcggcgtctcggccgaccgcggcctcagctccgacgacgcggcggcgcggctgcacaagtacgggcccaacgagctggagcgccacgccccgccgtccgtgtggaagctcgtgctcgagcagttcaacgacacgctcgtgcgcatcctcctcgccgccgccgtcgtctccttcgtgctcgcgctctacgacggcgccgagggcggcgaggttagggccaccgccttcgtcgagccgctcgtcatcttcctcatcctcatcgtcaacgccgtcgtcggggtctggcaggagagcaacgccgagaaggccctcgaggcgctcaaggagatccagtccgagcacgccaccgtcaagcgcgacggccgctggtcgcatggactccccgcgcgcgacctcgtcatcggagacatcgtcgagctccgcgtgggcgacaaggtccccgcggacatgcgtgtgctccagcttatcagctctaccctccgtgtcgagcagggatccctcaccggcgagacctcatctgttaacaagaccagccacaagattcatctcgaggacacagatatccaggggaaggagtgcatggtctttgctggcaccaccattgtcaacggcagtgctgtctgtgtggtgacgggaactggcatggccactgaaataggcaagatccattcgcagatccaggaggcatcgcaggaggaggatgacacaccgctgaaaaagaagctcaatgagttcggtgaggcgctgactgccattattggagtgatatgtatcctggtttggctcattaacgttaagtatttcctcacctgggagtatgtggatgggtggccgacgaattttaagttctcattcgagaagtgcacatattactttgagattgcagtggcactggctgttgctgcaattccagagggcctgcctgctgtgatcaccacatgcttggcactaggcaccaggaagatggctcagaagaatgcacttgtgagaaagttacccagtgttgagacattaggttgcacaacagtgatttgctctgataagacaggaactctgaccaccaaccagatgtcagccgtgaggcttgtggcaattgggaggtggcccgatacacttaggaactttaaggttgatggaaccacttatgatccaagtgatggcaagatacatgactggccaactttgaacatggatgataacctccagatgattgcgaagatagctgcactctgcaatgatgcaagtattgcacactctgagcatcagtatgttgctactgggatgcccacagaggctgcactaaaggttttggtcgagaaaatggggctccctggtggatatactccatctctggattcatccgatttgctaaggtgttgtcaatggtggaacaacgatgctaaaagagtagggactctggaatttgatcgcactagaaaatcaatgggagttattgtgaaaaaaacagagactggaaagaatttgctgcttgtgaagggggcagtagaaaatttgctagagagaagtgcctacattcagttgcttgatggatctgttgtgctcttggatgagggcgccaaggcacttgtattgtcaacactccgtgaaatgtctggcagtgcattgcgctgtttgggctttgcatacaaggaagatctggcagaatttacaacatatgatggagaagagcaccccgctcacaaatatctacttgatcctgcacactactcttccatagagagtaatctgatattctgtggttttgttggtctaagggatcctccacgagaagaagtccacaaagcaattgaagattgcagggctgctggtatacgtgttatggtgataacaggtgataacaaagaaacagcagaggcaatatgccgtgagattggggtttttggtcccagtgaaaacattagctcaaagagctttgcagggaaggaatttatggctcttcctgataaaaagaagctgttgaggcaaacaggtggccttctcttctcaagggcagagccaaaacataagcaggaaattgttaggctgctcaaagaagatggtgaagttgttgcaatgactggtgatggagtgaatgatgcaccggctctgaaattagctgatattggaattgcgatgggcattacagggactgaggttgcaaaagaagcttcagatatggtgcttgcagatgataacttcagtacaattgtctcagctgttggtgaaggaaggtctatttacaacaacatgaaggcttttataagatatatgatatcttcgaacattggagaagttgcctccatattcctcacgtcggctttaggtatcccagaaggcctcattccagtacaacttctgtgggtcaatcttgttacggatggccctcctgcaacagctttgggattcaatccaccagataaggatatcatgaagaaacctcctagaagaagtgatgattcattaatcactccttggatcctgttccgctacatggttattgggctgtatgttgggattgcaacggttggaatctttatcatctggtacactcatggctctttcctgggaattgatctggctagtgatggtcacactcttgtttcatactcccagctctcaaactggggccagtgcccctcatgggagggcttcaatgtgtcatcattcacagcaggggcaaggacattcaactttgatgacaacccttgcgattacttccagggtggcaaaataaaagcaacaaccctctccctgtctgtcttggtgtccattgagatgttcaactcactgaatgccctgtccgaggatggcagccttctgagcatgcctccatgggtgaacccctggcttcttctggcaatgtcggtgtcttttgggcttcattttttgatcctctatgtgcctttccttacccaaatcttcggaattgtgcccctcagtttcaacgaatggcttttggtcgtagcagttgcattcccagtggttctcatcgacgaggttcttaagtttgtggggcggtgcttgacagctcgggccagaaagcaattaggaaagcggaaggaagagtagaaggtagtgattgagtattagattgcaggcttgccacggggaagtagacgtctggtgagaccccagtatttttctcgagatccgatggctctgctctttgttgagcatgaaggaagttagggtactctatagaactcataatcatgcctcgagtttaacagactcatttattcatttgtaacaaaaattggtgttatgaatgtgctggagatacagcatggtttcctgcccacttactgcagtaatctttcacttatatccatgaattattctgctctga

SEQ ID NO: 2389 - DNA, 7160 bp, Oryza sativa
ttgaactacagtgccaattatattttcttcttcgtcacgatcgatgggatttttatttacccgagcgagaataataaagtagtttactccacgaaagagaggggaagggagaaaaagcttctcctctcttccgcattgcgttgcgccaccaatctcctctccccatctcggcctcctcgccgccaccatccgcctctagggtttcggttccatgcgatctcgccgcggcggcggaagggaaccctaggtaggaggctctcctcttgttgagtttgaatctgaggttcgtgaaccaatgggcaagggcgggcaggaggagggcaagcggcgggacggatccgacgcatccgggtcggagccggccgcagcggccttcccggcgtgggcgcgcacgccgagcgagtgcctcgcggagctgggcgtcgcggcggaccgcgggctgtcctccgaggaggcggcggcgcggctgcggcggtacgggcccaacgagctggagcggcacgcggcgccgtcggtgtggaagctggtgctcgagcagttcgacgacacgctcgtgcgcatcctcctcgccgccgccgtggtgtcgttcgtgctcgcgctctacgacggtgcggagggcggcgaggtcggggcgaccgccttcgtggagcccctcgtcatcttcctcatcctgatagtgaacgccgtcgtcggagtctggcaggagagcaacgccgagaaggcgctcgaggcgctgaaggagatccagtccgagcacgcaaccgtcaagcgcgacggccggtggtcccatgggcttccggcgcgcgacctcgtccccggagacatcgtggagctccgtgttggcgacaaggtcccggcagacatgcgtgtgctccagcttatcagctccaccctccgtgtcgagcagggttccctcactggtgagactgcttcggttaacaagaccagccataaaatcgagctggaggacacagacatccagggaaaggagtgtatggtttttgctggcactacaattgtcaacggcagcgctgtctgtgttgtgacgggcactggaatggacactgaaataggcaagatccatgcccagatccaggaagcctcacaagaggaagatgacacgccactgaaaaagaagctcaatgagtttggggaggcactgacagccataattggggtgatctgtgccttggtttggcttatcaacgttaagtatttcctcacctgggagtatgtggatgggtggcccaggaattttaagttctcatttgagaagtgcacgtattactttgagattgcagtggcactggctgttgcagcaattccagagggcctgcctgctgttatcaccacatgcttggcgctcggcaccaggaagatggcacaaaagaatgcacttgtgaggaagttgccaagtgttgagacactgggttgcactacagtgatttgctccgataagacaggaacattgaccaccaaccagatgtcagcggtgaagcttgtggcaattgggaggtggcctgatacacttaggagctttaaggttgatggaaccacttatgatccaagtgacgggaagataaacgagtggccaagtttgagcatggatgaaaatctccagatgattgctaagattgctgcagtttgcaatgatgcaagtattgctcactctgagcatcagtatgttgccactgggatgcccacagaggctgctttgaaggttttggttgagaaaatgggccttcctggtggatatactccatccctggattcatctgatttgctaaggtgctgtcaatggtggaacaatgctgctaagagagtagctactctggagttcgatcggactagaaaatcaatgggagttattgtaaaaaaagcagactctggaaagaatttgctgcttgtcaagggagctgtagaaaatttgctagaaaggagtggctatattcagttgcttgatggatctgttgtgctcctggatgaaggtgccaaggcgctcatattatcaacacttcgtgaaatgtctgctagtgcattgcgatgtttgggttttgcgtacaaggaggatttggcggaatttgcaacatatgatggtgaagagcatgcagctcacaaatatctacttgatccttcatactactcttccatagagagtaatttgatattctgtggttttgttggtctaagggatcctccccgagaagaagtccacaaagcaattgaagactgtagagctgctggaatacgtgttatggtgattactggtgataacaaagaaacagcagaggcgatatgccgtgagattggagtttttggttccacggaagatattagttcaaagagcttcacagggaaggaattcatgtctctttcagataagaagaaactcttaaggcaaacaggtggccttctcttctctagggctgagccgaaacataagcaggagatagttagattgctcaaagaagatggtgaagtggttgctatgactggtgatggagtgaatgatgcaccagctctgaagttggctgacattggagttgctatgggcattacagggactgaggttgcaaaagaagcttcagatatggttcttgcagatgataacttcagtacaatagtcgcagctgttggtgaagggaggtcaatctacgacaatatgaaggcatttataagatatatgatctcttcaaacatcggggaagttgcttccatatttctaacgtcagctttaggtattcctgaaggtctcatccctgtgcaacttctgtgggtcaatcttgttacagatggtcctcctgcaacggctttggggttcaacccacctgataaagatatcatgaagaaacctccacgaaggagtgatgactcgttgatcactccatggatcctattccgttatatggtcattgggatgtacgttgggattgccacagtgggagtgtttatcatttggtacacacatggctctttcctgggaattgacctggctggtgatggtcactctcttgtctcgtactcccagctctcaaactggggccagtgctcctcatgggagggtttcaaggtgtcaccattcacagcaggtgcccgtacattcaacttcgatgtgaacccatgtgattacttccagggcggcaaaattaaagcgacaaccctctccctgtctgtcttggtggccattgagatgttcaactcgctgaatgcgctgtcggaggatggtagccttctgagcatgcctccgtgggttaacccttggcttcttctggcaatgtcggtttcattcgggctgcatttcttgatcctctacgtgccattccttgcccaagtctttggtattgtgcccctaagcttcaatgaatggcttttggtgatagcagttgctttcccagtggttctcatcgacgaggtccttaaatttgtggggcggtgcttgacagcccgtgccagaaaacaatcaggaaagcagaaggaagattagatgctagtcatcagtgttttagatttctagttatgtcacgaggaaccaacacctgatgtagcacaaacattattttttctcgagttccaaaggctctcgttctttgttgagagaatgtttgcgaacatgactatgcagcgaacttaggtactctatagaactcataatcaggcagcgacacagaccgcatttattcattgtaactaagattgttatttgtgaatgtgctggagagacagcatgtttgcctgctcagctgctatgatcttggtcgtcttgcacttgcattcatgaaattttgtttagtactagtatttgtgaatgtgccggagtcacacatggagggagtgacttcctgctgcagtctctggattctaagttgttcagacaagattctgcctattttgttcgtttattcgtgagaatatatactcgttattactggtgtgttgctttgcatttgcattgtgtttactggcgtgatatactcctacattgccaactgtggtatcctatcactgtaccataatgcagtttagtgcatctttctcctacatgcaaaaaaaaaaatgtacatcatttgttgaaatttacatgcatataagatcaaaattgagatatacgcaatcctattgtgtaccagatgctagtatactagaacatttcttgcttcaatccttcacctgccctcttcctcgctcttgagcatctttgagaatactctcttcatggacatgccgtcgaggtcccccaggttcgcactcacggtggcgtctgtcacgacgcttgagatcgacgagctgcgctgaagcgtcgtgacagagctgtccggcgacgccacctgcagctgcagcgcgtactcgaggcaccagagcacgtcccccatgctcggccgctccacgccgtactccgcgaggcacttctcggcggtgtcggcgaacttcttgagcgagtccggccgtatcgtcccggcaattttctggtccacgatccggtcgagctcgccgtccctgagccgccgcgtcgcccactccgccaggttcaccatctcccggggcagcgtcgggtcgatgacggcgcgggcgcagagcacctcgagcaggacgacgccgaaggagtagacgtcggacttctccgtcagcatctgccgccggaagtactccgggtcgaggtacccgaagctgcccttgacggcggtgctgacgtgcgtcttgtccagctccggcccggtcttggacagcccgaagtcggcgaccttggccatgaagccgtcgtcgaggaggatgttggccgacttgacgtcccggtggatgatcgccttggccgagccggtgtgcaggtagtgcagccccctcgcggccccgatgcacgcctccagcctctgcttccacggcagcggcggcaggtcggagccgtacaggtggctccggagcgtgcccttcgccatgtactcgtacaccaggatcatctcgccgcgctcgtcgcagtagccgatgagcgagacgaggtggcggtggcgcagctgggacagcagctcgatctccgtgcggaactcgttgagcccctgctgcgacagccggttcccgcgcttcacggccacctgcgtgccgtcccggagcgtgcccctgtacaccttcccgaacccgcccacgccgatcaccatctcctcctcgaacccgcccgtcgcctcctgcagcgccgcgaacgggaagcggtacccggcgccggcgccggcgccgttctgccccagcgtgacgacgttgacgatgctgctcctgccgaagctggtgcgagagcgggcgcccagcgcgctcgccgagaacggcacccaggtgttcgacggctgcttcaccggcttcttcttcctccgcagcatcctgacggcgacgcacccgagagcaatcgccaacaccgccccgcccacggccgatccggcgatgatcccggtcttgatctttgagccgcgcggcgacgtggcgccgtcgatggagccggtgctcccgacaattctcatgatctcgaggccgttcaggaagccgccgggcaacgcgttggttgccgtcgatgacccgatgctcaccgtgattgtacccttcgccgcatcactggcggcaaggacgaagtccttatagagcggcgtggcaagaaggctgaacgtgtcgccggaagactcgtagtcttggagaacccgccactggccgacgtagacattgaacaccacaccgagcgtcgccttgctgacgatgtcgcacaagtggagccggaggaggtagtccgagacggccggtgcgttgaacttccacgtcaggttgagctgcgcctgcgtgttgccgaccatcgccgccgtcgtgttcaactccgtcacggtggtgtacaccgcggagggcgccgtcagcgaggtcgcgtagccactttggtacttgatcatcgccggagacacttgattgtgcgccgcgaagctgctctcgtgcaggaaggtccagtccggcagccatgtcctccacagcgtgtcgttgttcggcgtgaccttgggctctcccatgttgatccggtgcaccgtctccagcgccttcgccgtcaacccggtgtactgggactggttccgcggattcaccatcggcgcggtgtcgccgatgagctcgtcgggatgggacaccacctcgatggcgttgacgaacgccaccttcttgcccgtcggcgtgaacgcgatcaccagcgccctaccggtgatgttcacggagaactccctgaccacggccgtgccgttcttgggcgtgtacccgtcgacgaacaccacgccctgcacggacacattgaacgccgcgtccgcggcgaggtcgtaagactggtaccggaaggggaagaagcggaggcggacgaagtggcggccaggcttagcggagaacgcgtagttggccggcgccgtgaacacgcgcgctgactggtacagcgccggcgagtcgtcgccggcgccagtgacctggttcgccggcatgttggcctcggtgctctggggcgccatcagcaccgaggccggcagaccagcgtccccgacgaacgtccggccatcgacggtggcgttcccggacgtgccgcagaggaagaggtagctgtccgccggggtgtacgctcgcacggcggcgcatagcaccgtgacaacgacggcgagctgcacgagcatctcaagaacggttgccatggcgcaagaactccggccgccagagcatcggcgattgatcaacgcgctctaggctagaatagaaccagagccaagctgatcagagtaggttgccccaccatggccgcatgggtgacgatctcttgttcagaaacctgcagcttgacgacgacgatgtgaagctaggaacagggaaggcaactgctaccaacaggagaactgagcctgtgcctggttggattagggatggatgaagataatactcgagttttgtaggctttgtagtgatgaaagggcttgtggaataagaacttgttttgttgttggttgagatggggggtgtttgatcaagcttgtgtttagcatatgggtatttgattagttgggcaacccaaaagtgtcattttctgaggatcccaagtacagtacaacggtaagttgggaattgggatatattttatcaagaacctttaaacgctgtcattttcctggtttaca

SEQ ID NO: 2390 - DNA, 3999 bp, Sorghum bicolor
tttcgcttctgcgctgcgccaccaatcgccatcgcctcctcgccagtctccgcgccgccgcctcctccgcccgcttccctcctctagggtttctgttccatgcgatctcgcggcctcggtggcccgggacagtagggacgcctcctctccgttcgaatctagagagtcggcgacacaatgggtaagggagggcaggacgaaggcaagcggcgggacggatccgccgcctccgggccggaccccgccgagccggccttcccggcgtgggcgcgcaccccgagcgagtgcctcgcggagctgggcgtctcggcggaccgcggcctcagctccgaggaggcggcggcgcggctgcagcgatacgggcccaacgagctcgagcggcacgccccgccgtcggtctggaagctcgtcctcgagcagtttaacgacacgctcgtgcgcatcctgctcctggcggccgtggtctccttcgtgctcgcgctctacgacggcgcagaaggcggcgaggtcggggtcaccgctttcgtcgagccgctcgtcatcttccttatcctcatcgtcaacgccgtcgtcggcgtctggcaggagagcaacgccgagaaggcgctcgaggcgctcaaggagattcagtcggagcacgcaaccgtcaagcgtgatgggcggtggtcgcatggcctccccgcgcgcgacctcgtccccggggacatcgtcgagctccgggtcggggacaaggtccccgcggacatgcgcgtgctccagctcatcagctctaccctccgcgtcgagcagggatctctcaccggcgagaccgcttctgttaataagaccagccacaagatcgagttggaggatactgacatccagggaaaggagtgcatggttttcgccggtaccactgttgtcaacggcagtgctgtctgtgttgtgacgggcactggcatggccaccgaaattggcaagatccatgcgcagatccaggaggcatctcaggaggaggacgacacgccactgaagaagaagctcaatgagtttggtgaggcgctaactgccataattggggtgatctgtgccttggtctggctcatcaacttgaagtatttcctttcctgggagtatgttgacgggtggcctaggaatttcaaattctcatttgagaagtgcacatattactttgagattgcagtggcactggccgttgcagcaattccagagggcttgcctgctgtgatcaccacgtgcttggcactcggcacaaggaagatggcccagaagaatgcccttgtgaggaagctgcccagtgtggaaacattgggttgtacaactgtcatttgctctgataagaccggaactttgaccacgaaccagatgtcagcagtgaagcttgtggcaattgggaggtggcctgatacacttaggagctttaaggttgatggaaccacttacgatccaactgatgggaagatacacgattggccaagcttgagcatggatgaaaatctccagatgatcgcaaagattgctgcggtttgcaatgatgcaagcattgcccactccgagcatcagtatgttgctactggtatgcccaccgaagctgctctgaaggttttagttgagaaaatggggcttcctggtggttatactccatctctggattcatctgatttgctaaggtgctgtcaatggtggaacaatgctgctaagagagtagcaactctggaatttgatcgcaccagaaagtcaatgggagttattgtgaaagtaaactctgggaagaacttgctgcttgttaagggagcagtagagaatctgctagagagatgtacccacattcagttgctcgatggatctgttgtgctattggatgatggtgcgaaggcgctaatattatctacactccgtgacatgtctgccagtgctttgcgctgtttgggttttgcttacaaggaagaattggcagaatttgcaacatatgatggtgaagaacatgcagctcacaagtatctgcttgatccttcatactactcttccatagagagtaatatgatcttttgtggttttgttggtctaagggatcctccccgagaagaagtccacagagcaattgaagattgcagagctgctggaatacgtgttatggtgataacaggagataacaaagaaacagcagaggccatttgccgtgagattggggtttttggccctcatgaagatatcagttcaaaaagcttcacagggaaggaattcatggcgctttctgataaaaagaagctcttaaggcaacagggtggccttctcttctccagggcagaaccaaaacacaagcaggagatagttagactgctcaaagaagacggtgaagtggttgccatgactggtgatggcgtgaatgatgcgccagctcttaaactggctgatattggagttgcaatgggcattacagggactgaggttgccaaagaagcttcagatatggtacttgcagatgataacttcagcactatagtcgcagcagttggtgaagggaggtctatttacaacaatatgaaggcttttattagatatatgatctcctcaaacatcggagaggttgcatcaatattcctgacatcggctttaggtattccagaaggtctcatcccagtgcaacttctatgggtcaatcttgttacagatggccctccagcgacagctttggggttcaacccacctgataaagacatcatgaagaaacctcctcgaagaagtgatgactctttgatcactccttggatcctgtttcgctatatggttattggcctttatgttggggttgcaacagtgggaatcttcatcatctggtacacgcatggcagtttcctgggaattgacctggctagtgatggtcatacacttgtgtcgtactcccagctctcaaactggggccagtgctcctcatgggagggcttcaaggtgtcgccattcactgcaggagcgaggacattcaaatttgatgcaaatccatgcgattacttccagggtggcaagattaaagcaacgacactctctttgtctgtcttggtgtccattgagatgttcaactcactgaatgccctgtcagaggatggcagccttctgagcatgccgccatgggttaatccgtggcttcttctggccatgtctgtttcttttgggctgcatttcttgatcctctatgtgcctttcctcgctcaagtgtttgggattgtgcccctcagtttgaacgaatggctcttggtgatagcagtggccttcccagtggtgctgatcgatgaggttctcaaatttgtggggcggtgcctgacagcgcgtgcccggaaacaatcagggaagaggaaggcagagtagatgctagtgatcatcagtattagaatctgtagcaccacggggaattgatattggatgacaccctattgtttttgagttgctaagggctctcgatcctttctgagtgttttagattgggaatatgaccgtgcaggacaagctaggatattctatagaactcataatcagatcgcgttgaacacactgcatttttttttcgttgtaacaaatgctggtactgtgaacatgctggagatacagcaatggttacctgacgttttttcgctctaatggtgcactatatatgctactgttatgttgcgaatcttctgacatgttgctcagtaataatacgcttgttgcagtcgtatgttcagttatgttttcatatgagagattattcctcttgtgcagatgatgacgcgcagcattgtgcgtacattgtttctacatgtgtgaatgtacattgtttcttctatacttgttgaaattgacaaatatggaaccgaaatgggctattgtctttgccgttttgccgtcctgtacatgggatgatgcgaagatgcaagataattttagcttcacctaccctcctcgctcttgatcatctttgaaaaaactctcctcatggacataccatcgaggtcccccaagttg

SEQ ID NO: 2391 - DNA, 3922 bp, Sorghum bicolor
agttatattcccccaatctaaatctatcggtccatttacccccggaataataaaatagtttgtgccattatatagaactattattttatatattgaaattgaaagaaaaggcaggagaaaagcctcccctcccctcccctcccctccctttcgcttctgcgctgcgccaccaatcgccatcgcctcctcgccagtctccgcgccgccgcctcctccgcccgcttccctcctctagggtttctgttccatgcgatctcgcggcctcggtggcccgggacagtagggacgcctcctctccgttcgaatctagagagtcggcgacacaatgggtaagggagggcaggacgaaggcaagcggcgggacggatccgccgcctccgggccggaccccgccgagccggccttcccggcgtgggcgcgcaccccgagcgagtgcctcgcggagctgggcgtctcggcggaccgcggcctcagctccgaggaggcggcggcgcggctgcagcgatacgggcccaacgagctcgagcggcacgccccgccgtcggtctggaagctcgtcctcgagcagtttaacgacacgctcgtgcgcatcctgctcctggcggccgtggtctccttcgtgctcgcgctctacgacggcgcagaaggcggcgaggtcggggtcaccgctttcgtcgagccgctcgtcatcttccttatcctcatcgtcaacgccgtcgtcggcgtctggcaggagagcaacgccgagaaggcgctcgaggcgctcaaggagattcagtcggagcacgcaaccgtcaagcgtgatgggcggtggtcgcatggcctccccgcgcgcgacctcgtccccggggacatcgtcgagctccgggtcggggacaaggtccccgcggacatgcgcgtgctccagctcatcagctctaccctccgcgtcgagcagggatctctcaccggcgagaccgcttctgttaataagaccagccacaagatcgagttggaggatactgacatccagggaaaggagtgcatggttttcgccggtaccactgttgtcaacggcagtgctgtctgtgttgtgacgggcactggcatggccaccgaaattggcaagatccatgcgcagatccaggaggcatctcaggaggaggacgacacgccactgaagaagaagctcaatgagtttggtgaggcgctaactgccataattggggtgatctgtgccttggtctggctcatcaacttgaagtatttcctttcctgggagtatgttgacgggtggcctaggaatttcaaattctcatttgagaagtgcacatattactttgagattgcagtggcactggccgttgcagcaattccagagggcttgcctgctgtgatcaccacgtgcttggcactcggcacaaggaagatggcccagaagaatgcccttgtgaggaagctgcccagtgtggaaacattgggttgtacaactgtcatttgctctgataagaccggaactttgaccacgaaccagatgtcagcagtgaagcttgtggcaattgggaggtggcctgatacacttaggagctttaaggttgatggaaccacttacgatccaactgatgggaagatacacgattggccaagcttgagcatggatgaaaatctccagatgatcgcaaagattgctgcggtttgcaatgatgcaagcattgcccactccgagcatcagtatgttgctactggtatgcccaccgaagctgctctgaaggttttagttgagaaaatggggcttcctggtggttatactccatctctggattcatctgatttgctaaggtgctgtcaatggtggaacaatgctgctaagagagtagcaactctggaatttgatcgcaccagaaagtcaatgggagttattgtgaaagtaaactctgggaagaacttgctgcttgttaagggagcagtagagaatctgctagagagatgtacccacattcagttgctcgatggatctgttgtgctattggatgatggtgcgaaggcgctaatattatctacactccgtgacatgtctgccagtgctttgcgctgtttgggttttgcttacaaggaagaattggcagaatttgcaacatatgatggtgaagaacatgcagctcacaagtatctgcttgatccttcatactactcttccatagagagtaatatgatcttttgtggttttgttggtctaagggatcctccccgagaagaagtccacagagcaattgaagattgcagagctgctggaatacgtgttatggtgataacaggagataacaaagaaacagcagaggccatttgccgtgagattggggtttttggccctcatgaagatatcagttcaaaaagcttcacagggaaggaattcatggcgctttctgataaaaagaagctcttaaggcaacagggtggccttctcttctccagggcagaaccaaaacacaagcaggagatagttagactgctcaaagaagacggtgaagtggttgccatgactggtgatggcgtgaatgatgcgccagctcttaaactggctgatattggagttgcaatgggcattacagggactgaggttgccaaagaagcttcagatatggtacttgcagatgataacttcagcactatagtcgcagcagttggtgaagggaggtctatttacaacaatatgaaggcttttattagatatatgatctcctcaaacatcggagaggttgcatcaatattcctgacatcggctttaggtattccagaaggtctcatcccagtgcaacttctatgggtcaatcttgttacagatggccctccagcgacagctttggggttcaacccacctgataaagacatcatgaagaaacctcctcgaagaagtgatgactctttgatcactccttggatcctgtttcgctatatggttattggcctttatgttggggttgcaacagtgggaatcttcatcatctggtacacgcatggcagtttcctgggaattgacctggctagtgatggtcatacacttgtgtcgtactcccagctctcaaactggggccagtgctcctcatgggagggcttcaaggtgtcgccattcactgcaggagcgaggacattcaaatttgatgcaaatccatgcgattacttccagggtggcaagattaaagcaacgacactctctttgtctgtcttggtgtccattgagatgttcaactcactgaatgccctgtcagaggatggcagccttctgagcatgccgccatgggttaatccgtggcttcttctggccatgtctgtttcttttgggctgcatttcttgatcctctatgtgcctttcctcgctcaagtgtttgggattgtgcccctcagtttgaacgaatggctcttggtgatagcagtggccttcccagtggtgctgatcgatgaggttctcaaatttgtggggcggtgcctgacagcgcgtgcccggaaacaatcagggaagaggaaggcagagtagatgctagtgatcatcagtattagaatctgtagcaccacggggaattgatattggatgacaccctattgtttttgagttgctaagggctctcgatcctttctgagtgttttagattgggaatatgaccgtgcaggacaagctaggatattctatagaactcataatcagatcgcgttgaacacactgcatttttttttcgttgtaacaaatgctggtactgtgaacatgctggagatacagcaatggttacctgacgttttttcgctctaatggtgcactatatatgctactgttatgttgcgaatcttctgacatgttgctcagtaataatacgcttgttgcagtcgtatgttcagttatgttttcatatgagagattattcctcttgtgcagatgatgacgcgcagcatt

SEQ ID NO: 2392 - DNA, 5224 bp, Setaria italica
atggaggagacccttttcccgtgctcgcgcaggcccaacggccctggaagcccagatccccggacgcacacgtggcgtcacaaggcctcgcctgctgacgtcgccgcactcctcccggaaaaggagggagaaaagcctcgtccccctccgctttcgcttctgcgctgcgccaccaatcgccatcggcctcctcgcccagagtctccgcgccgccgcctcctccccccttctttcccgtctagggtttcggttccatgcgatctcgcgcccgcggcggccgggaacactagggagggcatcctctccgtgcgaatctcgagagccggcgacccaatgggcaagggcgggcaggacgagggcaagcggcgggacggatccgcctcctccggggcggacccggccgcgccggccttcccggcgtgggcgcggaccccgagcgagtgcctcgcggagctgggcgtcttggtcgaccgcgggctcagctccgacgaggcggcggcgcggctgcagcggtacgggcccaacgagctcgagcggcacgccccgccgtcggtctggaagctcgtcctcgagcagttcgaagacacgctcgtgcgcatcctgctcctggcggccgtcgtctccttcgtgctcgcgctctacgacggcgccgagggcggcgaggtcggggtcaccgccttcgtcgagccgctcgtcatcttcctcatcctcatcgtcaacgccgtcgtcggcgtctggcaggagagcaacgccgagaaggcgctcgaggcgctcaaggagatccagtccgagcacgcaaccgtcaagcgtgacggtcggtggtcgcatggcctaccggcgcgcgacctcgtccccggggacatcgttgagctccgcgtcggcgacaaggtccccgcggacatgcgcgtgctccagcttatcagctctaccctccgcatcgagcagggatccctcactggcgagactgcttcggttaacaagaccagccacaagattgagatggaggacacagacatccagggaaaggagtgcatggtttttgccggtaccactgttgttaacggcagtgctgtctgtgttgtgacgggcacaggcatggctaccgaaattggtaagatccatgcgcagatccaggaagcatctcaggaggaggacgacacgccactgaagaagaagctcaatgagttcggtgaggcactaactgccataattggtgtgatctgtgccttggtttggctcatcaacgtgaagtatttcctctcctgggattatgtggacggctggcctaggaatttcaaattctcatttgagaagtgcacatattactttgagattgcagtggcactggctgttgcagcaattccagagggtttgcctgctgtgatcacaacatgcttggcacttggcacaaggaagatggctcagaagaatgcccttgtgaggaagctgcccagtgtggagacattgggttgcacaactgtgatctgctctgataagacaggaactttgaccaccaaccagatgtccgctgtgaaacttgtagcgattgggaggtggccagatacacttaggacctttaaggttgatgggaccacttatgatccaaccgatgggcaaatacatgattggccaagcttaagcatggatgaaaatctgaagatgattgcaaagattgctgcagtttgcaatgacgcaagcattgcccactctgagcatcagtacgttgccacagggatgcccacagaagctgctttgaaggttttggttgagaaaatgggtcttcctggtggttataccccatcaatggattcgtctgatttgctaaggtgctgccagtggtggaacaatgctgctaagagagtggcaactctggaatttgatcgcaccagaaaatcaatgggtgttattgtgaaagcagattctgggaagaatttgttgcttgtcaagggagcagtagaaaatctgttagagagatgcagctttattcagttgcttgatggatctgttgtgctcttggatgatggtgcgaaggcaatcatattatctacacttcgcgatatgtctgctagtgctttgcgctgtttgggttttgcatacaaggaggatttggatgcttttgcaacatatgatggagaagaacatgcagctcacaagtacctgcttgatccttcatgctactctaacatagagagtaagatgatattttgcggttttgttggtctaagggatcctccccgagaagaagtccacaaagcaattgaagattgtagagctgctgggatacgtgttatggtgataacaggtgataacaaagaaacagcagaggccatttgccgtgagatcggggtgtttggtcctgatgaagatatcagttcaacaagcttcacagggaaggaattcatggcgctttctgataaaaagaagctcctaagacaacaaggtggccttctcttctccagggcggagccaaaacacaagcaggagatagttagactgctcaaagaagacggtgaagtggttgcaatgactggtgatggagtgaatgatgcacctgctcttaagttggctgatattggaattgcaatgggcattacagggactgaggttgccaaagaagcttcagatatggtgcttgcagatgataactttagtactatagtcgcagcagttggtgaagggaggtctatttacaacaacatgaaggcttttattagatatatgatctcctcaaacattggagaagttgcgtccatattcctgacatcagctctaggtatcccagaaggcctcatcccagtgcaacttctttgggtcaatcttgttacagatggccctcctgcaacagctttggggttcaatccacctgataaagatatcatgaagaaacctccccgaagaagtgatgactcgttgatcaccccgtggatcctgtttcggtatatggttattggcctttatgttggggttgcaacagtgggaatcttcatcatctggtacacgcatggctctttcctgggaatcgacctggccagtgatggtcatactcttgtgtcatactcccagctatcaaactggggccagtgctcttcttgggagggcttcaaggtgtcaccattcacagccggaacacagacattcaactttgatgcgaacccgtgcgactacttccagggtggcaagattaaagccacgaccctctctctgtctgtcttggtggccattgagatgttcaactcactcaatgccctgtcggaggatggcagccttctgagcatgcctccatgggttaacccgtggcttcttttggccatgtccgtgtcttttgggctgcatttcttgatcctctacgtgcctttccttgctcaagtgttcgggattgtgcccctcagtttcaacgaatggctcttggtgatagcagtggccttcccagtggtgctgatcgacgaggttcttaagttcgtgggacggtgcctgacagcgcgtgccagaaaacaatcagggaagaggaaggcagagtagacttgtgatcatcagtattagatttctagtagtgccacggggaatcgacattcgatgtgacaccccattgtttttgagttggaagggctctctatcttttctgagagtgttttagattgagcatatgaccgtgcagggcaagttaggctactatatagaactcataatcagatcgcaagttgaacacactgcatttattcgttgtaacggaagttggtactttgaacgtgctggagatacagcatgtttgcctgacgctttttcgctctaatgttgcactttctatgctgctgttaatgttgcgaatcttctgacatatgctgttcagtttctgcttgttgacagcgccctgtttcgttcggatttgctgtgcagacaatgatctgcagcaaagttaataattattgtcctacataagaattcaagaggatcagagtcggtctcctggcaaaatacagtactgtactttctttctagatgtgagaatgtacatcttttgtttacatttccatatggagccaaaactgagatgctgtccttgcagttctgtacatgggatgatgtgaagatgcgtaaggtaattttggcttcacctaccctcctcgcttttgatcatctttgagaaaactctcctcatcgacatgccgtcgaggtcccccaagttcgcggacatggtggccgcagtcccatcgctggcggtcgactggttgcgttggtacttggatgcaacgccgggaacgagctgcgtgttgtctgtgccggagctgcccggcgacgcctccggcagcttcagcgtgctggagctgtccggcgacgcctcctgcagctgcagcgcgtactcgaggcaccagagcacgtcccccatggcgggccgctccacgccgtactccgcgaggcacttctccgcggtgtccgcgaatttcttgagcgattcgggccgtatcgtcccggcgatccgctggtcgacgatgctgtcgagctcgccgttcttgagccgcttcgttgcccactcggcgaggttcaccgtttccgggggaagggtggggtcgatgaccgggcgggcgcagagcacctcgagcaggacgacgccgaaggagtagacgtcggacttctccgtcagcatctggcgccggaagtactccgggtcgaggtacccgaagctgcccttgacggcggtgctgacgtgcgtcttgtccagctccggcccggtcttggacagcccgaagtcggcgaccttggccatgaagctgtcgtcgaggaggatgttggccgacttgacgtcccggtggatgattgccttgtttgagcccgtgtggaggtagtgcaggcccctggcggcgccgatgctggcctcgagcctctgcttccacgacaggggaggcagctcggagtcgtagaggtggctccggagcgttcccctcgccatgtactcgtacaccaagatcatctcgccgcgctcgtcgcagtagccgatgagcgacaccaggtggcggtggcgcagccgggacagcagctcgatctccgtgcggaactcgttgagcccctgctgcgaccgcctgttgccgcgcttcacggccacccgcgtctcgtcccgcagcgtgcccttgtacaccttcccgaacccgccgacgccgatcaccatcccctcgtcgaacccggacgtggcctcctgcagcgccgcgaaggggaaccggtaccccgcgcc

SEQ ID NO: 2393 - DNA, 3516 bp, Zea mays
cgacccaatgggtaagggcgggcaggacgaaggcaaccgccggcgggacggatccgccgcctcggggccggaccgccccgcgccggtcttcccggcgtgggcgcgcaccccgagcgagtgcctcgcggagctgggcgtctcggcggaccgcggcctcagctccgaggaggcggcggcgcggctgcagcgacacgggcccaacgagctcgagcggcacgcgccgccgtcggtctggaagctcgtcctcgagcagtttaacgacacgctcgtgcgcatcctgctcctggcggccgtcgtctccttcgtgctcgcgctctacgacggcgcagagggcggcgaggtggggctcaccgccttcgtcgagccgctcgtcatcttccttatcctcatcgtcaacgccgtcgtcggcgtctggcaggagagcaacgccgagaaggcgctcgaggctctcaaggagattcagtcggagcacgcaaccgtcaggcgtgatgggcgctggtcgcatggcctccccgcgcgcgacctcgtccccggggacatcgttgagctccgggtcggggacaaggttcccgcggacatgcgcgtgctccagctcatcagctccaccctccgcgtcgagcaggggtctctcaccggcgagaccgcctctgttaacaagaccagccacaagatcgagctggaggacactgacatccagggaaaggagtgcatggtttttgccggtaccactgttgtcaacggcagtgctgtctgtgttgtgacgggcactggcatggctaccgaaattggcaagatccatgcgcagatccaggaggcatctcaggaggaggacgacacgccactgaagaagaagctcaatgagtttggtgaggcgctaactgccataatcggggtgatctgtgccttggtctggctcatcaacttgaagtatttcctttcctgggagtatgtggacgggtggcctacgaatttcaagttctcatttgagaagtgcacgtattactttgagattgcggtggcactggccgttgcagcaattccagagggtttgcctgctgtgatcaccacgtgcttggcactcggtacaaggaagatggcacagaagaatgcccttgtgaggaagctgccgagtgtggagacattgggttgtacaactgtgatttgctctgataagaccggaactttgaccacgaaccagatgtcagcagtgaagcttgtagcaattgggaggtggcctgatacacttaggagctttaaggttgatggaaccacttatgatccgactgatgggaagatacacgattggccaagcttgagcatggatgaaaatctccagatgatcggaaagatagctgcggtttgcaatgatgcaagcattgcccactctgagcatcagtacgttgctactgggatgcccacagaagctgctctgaaggttttggttgagaaaatggggcttcctggtggttatactccatctcttgattcatctgatttgctaaggtgttgtcagtggtggaataatgctgccaagagagtagcaactctggaatttgatcgcaccagaaagtcaatgggagttattgtgaaagcaaactctgggaagaacttgctgcttgttaagggagcagtagaaaatctgctagagagatgtacccacattcagttgctcgatggatctgttgtgctattggatgatggtgccaaggcgctcatattatctacactccgtgacatgtctgccagtgctttgcgctgcttgggttttgcttacaaggatgaattgtcagaatttgcaacatatgatggtgaagaacatgcagctcacaagtatctgcttgatccttcatattactcatccatagagagtaatatgatcttttgtggttttgttggtctaagggatcctccacgagaagaagtccacaaagcaattgaagattgcagagctgctgggatacgtgttatggtgataacaggagataacaaggaaacagcagaggccatttgtcgtgagattggggtttttggccctcatgaagatatcagttcaaaaagcttcacagggaaggaattcatgggtctttctgataaaaaggagctcttaagacaacagggtggccttctcttctccagggcagagccaaaacacaagcaggagatagttagactgctcaaagaagatggtgaagtggttgcaatgactggtgatggggtgaatgatgcaccagctcttaaactggctgatattggagttgcaatgggcattactggaactgaggttgccaaagaagcttcagatatggtacttgcagatgataactttagtactatagtcgcagcagttggtgaagggagatctatttacaacaacatgaaggcttttattagatatatgatctcctcaaacatcggagaggtcgcgtccatattcctgacatcggctttgggtattccagaaggtctcatcccagtgcaactcctatgggtcaatctagttacagatggccctccagcgactgctttggggttcaacccgccagataaagatatcatgaagaaacctcctcgaagaagtgatgactcgttgatcactccttggatcctgtttcgctatatggttattggcctttatgttggggttgcaacagtgggaatcttcatcatctggtacacgcatgacagtttcctgggaattgacctggctagtgatggtcatacacttgtatcgtactcccagctctcaaactgggacaagtgctcctcatgggagggcttcaaggtgtcaccattcaccgcaggagcgaggacattcagcttcgatgcaaatccatgcgattacttccagggtggcaagattaaagcaacgaccctctccctgtcagtcttggtggccattgagatgttcaactcactgaatgccctgtcagaggacggcagccttgtgagcatgccaccatgggttaatccgtggcttcttctggccatgtcggtttctttcgggctgcatttcttgatcctctacgtgcctttcctcgctcaagtgtttgggatcgtgcccctcagtttgaacgaatggctcttggtggtggcagtggccttccccgttgtgctgatcgacgaggttctcaaatttgtggggcggtgcctgacagcgcgtgcccggaaacaatcagggaagaggaaggcagagtagatgctagtgatcatcggtatttagaatctgtagtgccacggggaatcgatattcaatgtgacacccccattgtttttgagctgctaagggctctcgatcctttcagagtgttttaggttgggaatatgaccgtgcatgacaggctaggatactctatagaattggtaagcatatcgcgttgaacaacactgccttttgtttttcgttgtaacaaatgctggtactgtgaacatgctggagatacaacaatggttacctgacgtttttttctctctgacgatgagcagctatacatgctactgacctactgttatgttgcg

SEQ ID NO: 2394 - DNA, 3719 bp, Pennisetum glaucum
cagctccgaggaggcgtcggcgcggctgcagcggcacgggcccaacgagctcgagcggcacgccccgccgtcggtctggaagctcgtcctcgagcagttcaacgacacgctcgtgcgcatcctgctcctggcggccgtcgtctccttcgtgctcgcgctctacgacggcgccgagggcggcgaggtcggggtcaccgccttcgtcgagcccctcgtcatcttcctcatcctcatcgtcaacgccgtcgtcggcgtctggcaggagagcaacgccgagaaggcgctcgaggcgctcaaggagatccagtccgagcacgcaaccgtcaagcgtgacggtcggtggtcccatggcctcccggcgcgcgacctcgtccccggggacatcgttgagctccgcgtcggcgacaaggtccccgcggacatgcgcgtgctccagcttatcagctcgaccctccgtgtcgagcagggatccctcactggcgagacagcttcggttaacaagtccagccacaagatcgagtcggaggacacagacatccagggaaaagagtgcatggtttttgccggtaccactgttgtaaacggaagtgccgtctgtcttgtgacgggcacaggcatggctaccgaaattggtaagatccatgcgcagatccaggaagcatctcaggaggaggacgacacgccactgaagaagaagctcaatgagtttggtgaggcactaactgccataattggtgtgatctgtgccttggtttggctcatcaacttgaagtatttcctctcctgggagtatgtggatggctggccaaggaatttcaaattctcatttgagaagtgcacatattactttgagattgcagtggcactggctgttgcagcaattccagagggtttgcctgctgtgatcaccacatgcttggcacttggcacaaggaagatggcgcagaagaatgcccttgtgaggaagctgcccagtgtggagacattgggttgcacaactgtgatctgctctgataagacaggaactttgaccaccaaccagatgtccgctgtgaaacttgtagcgattgggaggtggccggatacacttaggacctttaaggttgatgggaccacttatgatccaactgatgggcaaatacacgattggccaagcttaagcatggatgaaaatctcaagatgattgcaaagattgctgcagtttgcaatgacgcaagcattgcccactctgagcatcagtacgttgccacagggatgcccacagaagctgccttgaaggttttggttgagaaaatgggtcttcctggtggttataccccatccatggattcgtctgatttgctaaggtgctgccagtggtggaacaatgctgctaagagagtcgcaactctagagtttgatcgcaccagaaaatcaatgggggttattgtgaaagctgactctgggaagaatttgttgcttgtcaagggagcagtagagaatctgttagagagatgtggctatattcagttgcttgatggatctgttgtgcttttggatgatggtgcgaagtcgctcatattatctacactgcgcgacatgtctgctggtgctttgcgctgtttgggttttgcatacaaggaggatttggcagaatttgcaacatatgatggagaagaacatgcagctcacaagtacctgcttgatccttcatattactctaccatcgagagtaatatgatattctgcggttttgttggtctaagggaccccccccgagaagaagtccacaaagcaattgaagattgcagagctgctgggatacgtgttatggtgataactggtgataacaaagaaacagcagaggccatttgccgtgagattggggtgtttggtcctgatgacgatatcagttcaaagagcttcacaggaaaggaattcatggcactttctgataacaagaagctcctaagacaacaaggtggccttctcttctccagagcggagccaaaacacaagcaggagatagttagactgctcaaagaagatggtgaagtggttgcgatgactggtgatggagtgaatgatgcgcctgctcttaaattggctgatattggagttgcaatgggcattacagggactgaggttgccaaagaagcttcagatatggtgcttgcggatgataacttcagtactatagtcgcagcagttggtgaagggaggtctatttacaataacatgaaggcttttattagatatatgatctcctcaaacatcggagaagttgcgtccatattcctgacatcagctctaggtatcccagaaggcctcatcccggtgcaacttctgtgggtcaatcttgttacagatggccctcctgcaacagctttggggttcaacccacctgataaagatatcatgaagaaacctccccgaagaagtgatgactcgttgatcaccccgtggatcctgtttcggtatatggttattggcctttatgttggagttgcgacagtgggaatcttcatcatctggtacacacatggttctttcctgggaatcgacctggccagtgatggtcatactcttgtgtcgtactcccagctatcaaactggggccagtgctcatcatgggagggcttcaaggtgtcaccgtttacagccggagcacagacattcagcttcgacacaaacccatgcgattacttccagaatggcaagattaaagcgatgaccctctcgctgtctgtcttggtggccattgagatgttcaactcactcaatgccttgtcggaggatggcagccttctaagcatgccaccatgggtgaacccatggcttcttttggcaatgtccgtgtcttttgggctgcatttcttgatcctctacgtgcctttcctcgctcaagtgttcgggattgtgcccctcagtttcaacgaatggctcttggtgatagcagtggccttcccagtggtgctgattgacgaggttcttaagtttgtgggacggtgcctgacagcgcgtgccagaaaacaatctgggaagaggaaggcagagtagatgctagtgatcatcagtattagatttctagtagtcccactggggaatcgacattggatgtgacaccccactgtttttgagttgcaagtgctctcgatcttttctgagagtgttttagattgagcatatgaccgtgcagggcaagttaggctactacatagaactcataatcagatggcaagttgaacacactgcatttattcgttgtaatggaagttggtattgtgaatgtgctggagatacagcatgttcgcctgacgctttttcgctctaatgttgcactttatatgcagctgttatgttgcgaatcttttgacatatgttgttcatttttctgcttgccgtattagttctgcagtggattcgcagcaaaactggtaggtattttgtcctgtaagaattcaagaggatcatttagagtcggtgtcctgacaaatacagtactgtactttctttctaaatctgagaatgtatgttcgtttgtttacatttccatatggtatcaaaactgagatgcttcctttgcagtttctgtactgtacacgggatgatgagaagatgcgccatgtaatttttggcttcacctgccctcctcgcttttgatcatctttgagaagactctcctcatggacatgccgtcgaggtcccccaagttggcagacatggtggccgcagtccc

SEQ ID NO: 2395 - DNA, 3164 bp, Triticum aestivum
caacgccgagaaggcgctcgaggcgctcaaggagatccagtccgagcacgccaccgtcaagcgcgacggccgctggaagcatgggctccccgcgcgcgacctcgtcatcggagacatcgtcgagctccgcgtgggcgacaaggtccccgccgacatgcgtgtgctccagcttatcagctctaccctccgtgttgagcagggatccctcactggcgagacctcttcggttaacaagaccagccacaagattcatctcgaggacacagatatccaggggaaggagtgcatggtctttgctggcaccaccattgtcaacggcagtgccgtctgtgtggtgactggaactggcatggccactgaaataggcaagatccattcgcagatccaggaggcatcacaggaggaggatgacacgccgctgaaaaagaagctcaatgagttcggtgaggcgctcactgccattattggagtgatatgtatcttggtttggctcattaacgtcaagtatttccttacctgggagtatgtggatgggtggccggcgaattttaagttctcattcgagaagtgcacatattactttgagattgcagtggcactggctgttgctgcaattccagagggcctgcctgctgtgatcaccacatgcttggcactaggcaccaggaagatggctcagaagaatgcacttgtgagaaagttacccagtgttgagacattaggttgcacaacagtgatttgctctgataagacaggaactctgaccaccaaccagatgtcagcggtgaggcttgtggcaattgggaggtggcccgatacacttaggaactttaaggttgatggaaccacttatgatccaagtgatggcaagatacatgactggccaactttgaacatggacgataacctccagatgattgcgaagatagctgcactctgcaatgatgcaagtattgcacactctgagcatcagtatgttgctactgggatgcccacagaggctgcattaaaggttttggttgagaaaatggggctccctggtggatatactccatctctggattcatccgatttgctaaggtgttgtcaatggtggaacaacgatgctaaaagagtagggactctggaatttgatcgcactagaaaatcaatgggagttattgtgaaaaaagcagagactggaaagaatttgctgcttgtgaagggagcagtagaaaatttgctagagagaagtgcctatattcagttgcttgatggatccgttgtgctcttggatgagggtgccaaggcactcgtattgtcaacacttcgtgaaatgtctggcagtgcattgcgctgtttgggctttgcatacaaggaagatctggcagaatttgcaacatatgatggagaagagcatcccgctcacaaatatctacttgatcctgcatactactcttccatagagaataatctgatattctgtggttttgttggtctaagggatcctccacgagaagaagtccacaaagcaattgaagattgcagggctgctggtatacgtgttatggtgataacaggtgataacaaagaaacagcagaggcaatatgccgtgagattggggtttttggtcccagtgaaaacattagctcaatgagctttgcagggaaggaatttatggctcttcctgataaaaagaagattttgaggcaaacaggtggccttctcttctcaagagcagagccaaaacataagcaggaaattgttaggctgctcaaagaagatggtgaagttgttgcaatgactggtgatggagtgaatgatgcgccggctctgaaattagctgatattggaatcgcgatgggcattacagggactgaggttgcaaaagaagcttcagatatggtgcttgcagatgataacttcagtacaattgtctcagctgttggtgaaggaaggtccatttacaacaacatgaaggcttttataagatatatgatatcttcgaacattggagaagttgcttccatattcctcacgtcggctttaggtatcccagaaggcctcattccagtacaacttctgtgggtcaatcttgttacggatggccctcctgcaacagctttgggattcaatccaccagataaggatatcatgaagaaacctcctagaagaagtgatgattcattaatcactccttggatcctgttccgctacatggttattgggctgtatgttgggattgcaacggttggaatctttatcatctggtacacccatggctctttcctgggaattgatctggctagtgatggtcacactcttgtttcatactcccagctctcaaactggggccagtgcccctcatgggagggtttcaatgtgtcatcattcacagcaggggcaaggacattcaactttgatgagaacccttgcgattacttccagggtggcaaaataaaagcaacaaccctctccctgtctgtcttggtgtccattgagatgttcaactcactgaatgccctgtctgaggatggcagccttctgagcatgcctccatgggttaacccctggcttcttctggcaatgtcggtatcatttgggcttcattttttgatcctctacgtgcctttccttacccaaatcttcgggattgtgcccctcagtttcaacgaatggcttttggtcgtagcagttgcattcccagtggttctcatcgacgaggttcttaagtttgttgggcggtgcttgacagctcgggccagaaagcaattagggaagcggaaggaagagtagaaggtagtgattgagtattagattgccacgggggagtagtcgtctggtgggaccccattatttttctcttccgagggctttgctctttgttgagcatgaagtaagttagggtactctatagaactcataatcatgcctcgagtttaacagactcatttattcatttgtaacaaaaattggtgttatgaatgtgctggagatacagcatggtttcttgcccacttactgcagttatctttcacttacatccatgaattattctgctctgaatgcaatgacgtgactgacacctcctggtttatgtattttttgtctcggccttgttcacatagcgattctgcttgtactcatcctggagtattgagccgctgagcctctctgtctctgc

SEQ ID NO: 2396 - DNA, 4615 bp, Triticum aestivum
gccgagaaggcgctcgaggcgctcaaggagatccagtccgagcacgccaccgtcaagcgcgacggccgctggaagcatgggctccctgcgcgcgacctcgtcatcggagacatcgtcgagctccgcgtgggcgacaaggtccccgccgacatgcgtgtgctccagcttatcagctctaccctccgtgttgagcagggatccctcactggcgagacctcttcggttaacaagaccagccacaagattcatctcgaggacacagatatccaggggaaggagtgcatggtctttgctggcaccaccattgtcaacggcagtgcagtctgtgtggtgaccggaactggcatggccactgaaataggcaagatccattcgcagatccaggaggcatcacaggaggaggatgacacgccgctgaaaaagaagctcaatgagttcggtgaggcgctcactgccattattggagtgatatgtatcttggtttggctcattaacgtcaagtatttcctcacctgggagtatgtggatggctggccgacgaattttaagttctcattcgagaagtgcacatattactttgagattgcagtggcactggctgttgctgccattccagagggcctgcctgctgtgatcaccacatgcttggcactaggcaccaggaagatggctcagaagaatgcacttgtgagaaagttacccagtgttgagacattaggttgcacaacagtgatttgctccgataagacaggaaccctgaccaccaaccagatgtcagcggtgaggcttgtggcaattgggaggtggcccgatacacttaggaactttaaggttgatggaaccacttatgatccaagtgatggcaagatacatgactggccaactttgaacatggatgataacctccagatgattgcgaagatagctgcactctgcaatgatgcaagtattgcacactctgagcatcagtatgttgctactgggatgcccacagaggctgcattaaaggttttggtcgagaaaatggggctccctggtggatatactccatctctggattcatctgatttgctaaggtgctgtcaatggtggaacaacgatgctaaaagagtagggactctggaatttgatcgcactagaaaatcaatgggagttattgtgaaaaaagcagagactggaaagaatttgctgcttgtgaagggagcagtagaaaatttgctagagagaagtgcctatattcagttgctcgatggatccgtcgtgctcttggatgagggtgccaaggcactcgtattgtcaacacttcgtgaaatgtctggcagtgcattgcgctgtttgggctttgcatacaaggaagatctggcagaatttgcaacatatgatggagaagagcatcccgctcacaaatatctacttgatcctgcatactactcttccatagagaataatctgatattctgtggttttgttggtctaagggatcctccacgagaagaagtccacaaagcaattgaagattgcagggctgctggtatacgtgttatggtgataacaggtgataacaaagaaacagcagaggcaatatgccgtgagattggggtttttggtcccagtgaaaacattagctcaatgagctttgcagggaaggaatttatggctcttcctgataaaaagaagattttgaggcaaacaggtggccttctcttctcaagagcagagccaaaacataagcaggaaattgttaggctgctcaaagaagatggtgaagttgttgcaatgactggtgatggagtgaatgatgcgccggctctgaaattagctgatattggaatcgcgatgggcattacagggactgaggttgcaaaagaagcttcagatatggtgcttgcagatgataacttcagtacaattgtctcagctgttggtgaaggaaggtccatttacaacaacatgaaggcttttataagatatatgatatcttcgaacattggagaagttgcttccatattcctcacgtcggctttaggtatcccagaaggcctcattccagtacaacttctgtgggtcaatcttgttacggatggccctcctgcaacagctttgggattcaatccaccagataaggatatcatgaagaaacctcctagaagaagtgatgattcattaatcactccttggatcctgttccgctacatggttattgggctgtatgttgggattgcaacggttggaatctttatcatctggtacactcacggctctttcctgggaattgatctggctagtgatggtcacactcttgtttcatactcccagctctcaaactggggccagtgcccctcatgggagggtttcaatgtgtcatcattcacagcaggggcaaggacattcaactttgatgagaacccttgcgattacttccagggtggcaaaataaaagcaacaaccctctccctgtctgtcttggtgtccattgagatgttcaactcactgaatgccctgtctgaggatggcagccttctgagcatgcctccattggttaacccctggcttcttctggcaatgtcggtgtcatttgggcttcattttttgatcctctacgtgcctttccttacccaaatcttcgggattgtgcccctcagtttcaacgaatggcttttggtcgtagcagttgcattcccagtggttctcatcgatgaggttcttaagtttgtggggcggtgcttgacagctcgggccagaaagcaattaggaaagcggaaggaagagtagaaggtagtgattgagtattagatcgccacgggggagtagacgtctggtgagacccctttatttttctcgagatccgagggctctgctctttgttgagcatgatggaagttaggctactctatagaactcataatcatgcctcgagtttaacagactcatttattcatttgtaacaaaaattggtgttacgaatgtgctggagatacagcatggtttcttgcccacttactacagtaatctttcacttatatccacgaattattctgctctgaatgcagtgacacctcctggtttatgtatttttgtctcggccttgttcacatggcgattctgcttatactcatcctggagtataagccgctgcctctgccgatcatatacatatccatagtgtggttacttttgtgaaatcaggagaatctgttactccttattggtacggtacataactatttgatataactttcttctacataaaagtttgtacatcgtttgtcatgtactacatgctataaacacaaaattgacatatacatgtgcttcagtttgtacaacgtggacgaagcatcttttggcttcacctgacctcgtcgctcttgatcatcttcgagaatactccgctcagggacattccgtctagatcacccaagttggtggtcatggcagcgtcagtcgccacggtagcggcggacaggcgacgctgaacctcaggcgttttcacgggcacgggcggcgccggcggcaacatggtgtcgacgtccgagctgtctgacgaccccacctgcagctgcagcgcgaactcgaggcaccagagcacgtcccccatggtgggccgctccaccccgtactcggcgaggcacttctcggccgtgtccgcgagcttcttgagcgaccccggccgtatcgtcccggcgatcctctggtcgacgatctggtcgagctggccgtttctgagacacggcgtcgcccactccgccaggctcaccatctcccgcggcagcgtcgggtcgatgacggtgcgggcgcagagcgcctccagcaggaccacgccgaaggagtaaacgtccgacttctccgtcagcatctgccgccggaagtactccgggtccaggtacccgaagctgcccttcaccttggtgctcacgtgcgtcttgtccagctccggcccgttcttggacagcccgaagtcggccaccttggccatgaagctctcgtcgaggaggatgttggccgacttgacgtcccggtggatgatggccttggcggagccggtgtggaggtagtgcagcccccgcgcggcgccgatgcaggcctccagcctctgctcccacgacaggggcgggaggccggcgccgtaggaggtggctccgcagcgtgcccatggccatgtactcgtacacgaggatcatctcgccgcgctcgtcgcagtagccgatgagcgagaccaggtgccggtggcgcagccgggacagcatctcgatctccgtgtggaactcgtgcagcccctgctgcgtccgccggttgccgcgcttcacggccaccagcgtctcgtcgcgcatcgtgcccttgtacaccttcccgaacccgccctcgccgatgaccatcccctcgtcgaacccgccggtcgcctcctggagcgccgcgaacgggatcctgtacccggcgccggcgccgttctgcccgagcaggacggtgttcccgttgctcttggagaagctccgggagcgcgagcgagagcccagcgcgctcgccgagaagggcgaccaggtgtcggacggctgcttcttctccggctccctcccgcgcagcgtcctgaaggcgatgaatccgagcaccatcacca

SEQ ID NO: 2397 - DNA, 4148 bp, Musa acuminata
tgggcctccaagacgcggactctcggccggcgaaaccacctcttctcaaggtgagagcgatcgggagatcgatcgcgtattttcgagcgtctctttctacgtcagaagcttgaacgaagcaagctaggtagtggagcgtttgggaacgaatcgaagaactccgcacgaagaagctttcttcggatcgggtaacgaaacccttttttccttttcccccgtctcttccgctggtttcttgctgcggagggatctgttgcgggcttgttcgattcgttgcgggctcttgaatcggtgaaagattggttgcttttcttcgtgggagaaggctttcgctcgggtttttgtatttgcttgtttagatcggttgggcgtgggatggtggtgtcggggagcgtggatttgagggttttgtaggaaagatttgacttttgggattctggttggggcggagtggggatggggaaaggagggcaggatgaggggaagaagggtggattggagccgccgacgtcgaactttccggcttgggcgaggaccgtccacgagtgcgaggccgaattcgtggtttcggctcacgacgggctccgatctgaggaggtagtgaagctgcgggagatttatggactgaacgagctttcgaagcactctgggccttcgatctggcagttggtacttgagcagttcaacgacacgctggtccggatccttcttgtggccgccgtcgtctctttcgtgctcgcgtggtacgatggggacgaaggtggtgagatggggatcactgcctttgtggagcccttggtgatattccttattctgatcgtgaatgcaatcgttggtgtttggcaagagaacaacgctgagaaggcactcgaggccctgaaagaaatccagtctgagcatgcctctgttagaaggaacggggagttgattccaaatctgcctgctaaggaacttgtaccgggtgacatcgtggagcttaaggttggggacaaggttccagcggatatgaggattttgcacctgattagctccactgtgagggtagagcaagcatctcttacgggagagaatgatgcggtgaacaaaaccaaccaccaagttgagtctgaagacatagatatccaagggaaggaatgcatggtttttgcaggtactacagtcgtgaatggcagctgcatatgcttggttatacagaccggtatgaacactgaaattggtaagatacattcgcagatacatgaagcttcacagagtgaagatgatacaccattgaagaagaaattgaatgagttcggggaggtccttacagcaattattggtgtgatttgtgctgtggtttggcttatcaatgtgaaatacttccttacctgggagtatgttgatggctggccaaggaatttcaagttttcctttgagaagtgcacttattacttcgagattgctgttgccttggctgttgcagcaatcccagaagggttgcctgcggttatcactacttgcttggcactgggtacacggaagatggcacaaaagaatgcactggttcggaagctaccaagtgttgagactttgggttgcacaactgtgatatgctctgataagactggtacattgacgacaaaccagatgtctgctgtaaggcttgttgcaatggggcgctgggcagatacacttagaacattcaaagtggatggtacaacatacaatcctcatgatgggattatccatgattggccgaccagtaacatggatgcaaatcttcaaatgattgctaagattgctgctgtttgcaatgatgcaagtgtcaatcattcagcacatcagtttgttaccagtggtatgccaacagaggcagccctgaaggttttggttgagaaaatgggacttcctggaggatatgagacatcatcattggactcagatgaaatattaaggtgctgtaaatggtggaatggaaaggcccagagggttgcgactcttgagtttgatcgttctcgaaagtcaatgggagttattgtgaaatcaaaatcaggaacgaattctttgcttgtaaagggtgctgtagaaaatttgttggaaagaagtgcctacgttcagctgcttgatggttctgttgtggtgttagatgacagatcaaaaagtcttattctggatgcccttcataagatgtcaacaactgcattgcgctgtttgggatttgcctatacggatgatcttgcagaatttgcaacatatgatggtgaagaccacccggctcataaaattttactagatccatcaaactactcatccattgaaactggtctagtgtttgttggattagtagggcttagggatcctccacggagtgaggtctacaaagcaattgaagattgtagagcagctggtatccgagttatggtcataactggagacaacaaggaaaccgcagaagcaatttgccgtgatataggtgtatttacgcctgacgaagagatacattcaaagagcctcacaggcaaaggttttatgtctatgtcatccagtgataaaaagacccttttgaggcaaagtggtggtcttcttttttctagagcagaaccaaagcataaacaagagatcgtgagattacttagagaagatggtgaggtagttgcaatgacaggggatggagtgaacgatgctcctgcattgaaaatggcagatattggtatagcaatgggcattgctgggacagaggttgctaaggaagcctcagatatggtgttggcagatgataatttcagttcaatagttgcagcagttggtgaaggaagatcgatttacaacaatatgaaagcttttataagatacatgatttcctcaaatattggtgaagttgcctccatttttttaacagcagctttaggtattccagagggactgataccggttcaacttttgtgggtcaatcttgtcacggatggccctcctgcaactgctcttggattcaacccacctgataaagatattatgaagaaaccacctcgaaggagtgacgactcattgattactgcatggattttattccgttatatggtcattgggctttatgtggggattgctaccgttggtatcttcattatatggtatactcatggttcttttatgggaattgactttagtggtgatggccacacccttgtaacctattcacagctttctaactggggagaatgctcctcatgggagggcttcaaggtctctccattcactgccggagcacgacaattcacctttgatgctaatccctgtgactatttccagactggtaaagtgaaggcaatgaccctttcgctgtctgtcttggtggccattgagatgttcaattcacttaatgcattatctgaagacgggagcctcctgagcatgcctccatgggccaacccatggcttcttttggccatgtccatctcatttggattgcatttcctaatattatatgtccctttccttgctcaagtcttcggaatagtgcctctcagtttcaaagagtggctcttggtgttggcggttgcatttccagtgatccttattgatgaggtcctcaaatttgtcgggcgtcacacgagttcttcgggtgccaagaactggtctgcaaagcacaaggatgagtaagatgctgacacacttcaatacagcaacagttgtgcaggagatgcaattctgcagttttgcatggcctttgataacgggagttgttctggtccctcatcgttctccggtcatgattatttttgagaatttggtaaccagtgaatattcagattaagtagtgaacttgacgtggagcctaatcgtgatttttgaacacatttttgacgttacagttatctatttcatagttttaaaggtgctctagttcggcgcacatgcagtacaagattacaaataatttttaataaactttgttcctcgaagagagaccgatgttgcgtcaaacagtgctgttgtcattgcaattctgtaaggttatatagttaagctggatttttctctgggagaagcattccagttcaggatgaatcaaaaaccttaacttgtgtattctggtggtatgcctgcaatctgtttgtcataaaggttcttcaagttgacaaagagttcatgaagttcatgaaaatgtaaga

SEQ ID NO: 2398 - DNA, 3618 bp, Elaeis guineensis
gaagggcggattagagcgccggacatccgccttccccgcctgggccagaagcattcaggaatgcgaggccgaattcggggtctccgctagcgaaggcctccgatccgatgaggtcttgaagcgccgcgagatctatggctggaacgagctcgagaagcactctgggccctcgatctggcagctggttcttgaacagttcaatgacacccttgttcggatcctcctcgtggccgccgtggtctcgttcgtcctcgcttggtatgatggggaggaggggggtgagttggagatcaccgcctttgtggaacccttggtgatctttcttatactcattatcaatgccatcgttggagtttggcaagagaataatgccgagaaggccctcgaagccctgaaagaaatccaatccgaacatgctatggttaggagggacggggacttgattcctaatttgcttgcaaaagagcttgttccgggtgatattgtggagctgagggttggggataaggtcccagccgatatgaggattctgtatctgataagctccactcttagggtagagcaggggtctctgacaggagagagtgcggcggtgaataaaaccagtcgccgtgttgattcagaggacacagatatccaagggaaagagtgcatggtctttgcaggtaccactgtggtcaatgggagctgtgtctgcttggtaacccagactggcatgaacacagaaataggtaagattcattcccagatccatgaagcttcccagagtgaagaggatacaccattgaagaagaaattgaatgaatttggtgaggttctcacagctataattggtgtaatttgtcttctggtttggctcatcaatgtcaagtactttttcacttgggaatatgttgatggctggccgaggaatttcaagttctcttttgagaagtgcacatactactttgagattgctgtggctttagctgttgctgcgattcctgagggtttaccggcagtcattactacttgcctggcactaggcacacggaagatggcacagaagaatgctttggttcggaagctgcctagtgtcgagactttgggatgcaccactgtcatctgttctgataaaactggtacgctgacaaccaatcaaatgtcagcaataaagcttctggccatggggcgatggacagatactattcgaagctttaaagtggatggtacgacatatgatcctcatgatgggaagatccatgactggccaactggtaacatggatgcaaatcttcaaatgattgctaaaatagctgctgtttgcaatgatgcaagtattgcacgctcaggacatcactttgtcgcaagtggaatgccaacagaggcagctttgaaggttctggttgagaaaatgggacttcctggagggtttgattcttcatctttagagtccactgagatattaaaatgctgtcaatggtggaatgaggttgcacaaagaattgcaactcttgagtttgaccgcattcgaaaatcaatgagcgttattgtgaagtctaaatcaggaagcaattccttgcttgtgaagggagctgtggaaaatctactggagaggagttcctacattcagttgctcgatggctcggttgttctgttggatgaaagttcaaaaggtcttattttgaaagcccttcatgaaatgtcaaccaatgctttgcgctgtttgggttttgcatacaaggatgatctatcagaatttgcaacctatgatggtgaagaccatccagctcacaagcttctacttgacccatctaactactcttcaattgaaagtgatctcatttttgttggcctggttgggctgagggatcctccacgagacgaggtccacaaagcaattgaggactgtagagcagctggcattcgagtcatggtgattacaggagataacaaagaaacagcagaagcaatttgccgtgaaataggtgtctttggacctgatgaagacttaactttgaaaagttacatagggaaagaatttatgtctctccctgataaaaaagtccttctacagcaaagtggtggtcttctcttctcaagggccgaaccaaagcataaacaagagattgtcagattgctgaaagaagatggtgaggtggtcgcaatgacaggtgatggggtgaatgatgcccctgctctgaaaatggcggatattggtattgcaatgggcattgctggaactgaggttgccaaggaagcttcagacatggtgttagcagatgataatttcagaacaattgttgctgctattggtgaaggaagatcaatttacaacaacatgaaggcttttataagatacatgatctcctcgaatattggtgaagttgcctctatttttctaacagcagctttaggtattcccgaagggcttataccagttcagcttttatgggtcaatcttgtcacagatggccctcctgcaacagctttgggatttaatccaccagataaagatattatgaagaaacctcctcgaaggagcgatgactcattgatcaatgcatggattctattccgatatatggttattgggctttatgtggggcttgcgactgttggtgttttcatcatatggtatacacatggttcattcatgggaattgacttgagtggtgatgggcatactcttgtcacgtattctcagctctccaactggggccaatgctcctcgtgggagggcttcaaggtcaactcgttcactgctggagcacgtcgttttgtctttgacactgacccctgtgagtatttccaggctggtaaagtgaaggcaatgaccctctctctttctgtgctggtggctattgagatgttcaattcactgaatgctctctctgaagatgggagcctcctgagcatgcctccttgggtgaacccatggcttcttttggccatgtctgtctcatttgggctgcacttcttgattttatatgtaccattccttgctcaggtgtttggaattgtacctctcagtttcaatgaatggcttttggtgttggcggttgctttcccagtaatccttattgatgaggttcttaagtttgttgggcggtgtgcaagctctgtgggtgccaaaagatggtctgagaagcacaagtatgagtagctgctaacgatagctgcaaactgggaagtttcaaacaggagattctattctacaactgtgcattgttattagcatgtggcaacgctattgttctaaaccctcgttctcttcttcttcgagggagggattgtttgagaatggtggaccaggacaatactgaagaatcaagatggtgctggataagtatgaaatctggggagactaccttaatttttgaacacaatttagattttaaaatgatgctgaaataaacagctgcttttttttatagatatttacaatgcaatgcaattaagattctaattcaaattataggctttgtatccaatgatgcttttgcagctgatgtattacagatcatattgaccatgtgcacgtgagagcgcaaaaaatgccaatttgagtcgcttttgaagagacttaatattggtttgactgtttgtatttggtgccttttattttattttgtaagc

SEQ ID NO: 2399 - DNA, 3932 bp, Musa acuminata
agccgttgcttttcccaagggccgatcgcttgctttgagggatcgctgttcccgtcgtagtgagacagcgctacgggagcgaagaactccgacccaagacgtctgcttcggatcgcaagcccgttttgatttccctcccattttcgatttgttcttcatgactgggattgcctgatcggtaactgggcctcatgtcggtgaaagattagggatttctttctgttcttctggcggggagattgttgctagggtttctggatttgggattttagatcggtcggttgattaccggaagcgtgggttcgagggatttgtagaaaagattggtttctagtttagggatttctggtcggaacgtggtggggatggggaaaggagggcaggatgagcggaagaagggtggattggatcccccgaccacgaattttccggcctgggcaaggaccgtccaggagtgcgaggctgagttcaaggtttcggcagagtacgggctccgatccgatgaggtgctgaagcgacgggagatttatgggttgaacgaactcgagaagcactctgggccgtcgatctggcagttggttctcgagcagttcaacgacacgctggtccggatcctccttgtggctgccgtcgtctcctttgtgctcgcttggtacgatggggatgaaggtggcgagatggggatcactgcctttgtcgagccgttggtgatcttccttattctgatagtgaatgcgatcgtgggcgtttggcaagagaacaatgccgagaaggcacttgaggccctgaaagaaatccagtctgagcatgctgccgttagaagggatgggaatttgattccgaatctgcctgctaaggatcttttgccgggtgacattgtggagctcaaggtcggagataaggtcccggcagatgtgaggattttatacctgattagctccactgtgagagtagagcaagcatctcttaccggagagaatgctgctgtgaataaaaccaaccaccatgttgagcatgaagacatagatatccaagggaaggaatgcatggtttttgccggtaccactgttgtgaatggcagctgtgtctgcttggtcacacagacgggcatgaacactgaaattggtaagattcattcgcagatccatgaagcttcacagagcgaggatgatgcaccattgaaaaagaagctgaatgaatttggagaggtccttacggctataattggagtaatttgtgctttggtttggcttatcaatgtgaagtacttctttacctgggagtatgtcaatggctggccaagcaatttcaagttctcttttgaaaagtgcacttattactttgagattgctgtggccttggctgttgcagcaatcccagaagggctgcctgcggtgatcactacttgcttggcactgggtacacggaagatggcacaaaagaatgccctggtcaggaagcttcctagtgttgagactttgggttgcacaactgtgatatgctctgataagactgggacattgaccacaaaccagatgtctgttgtaaggcttgttgcaatggggcgctggacggatacacttagaagctacaaagtggatggtaccacatacgatcctcatgatgggaagatctatgattggccagccagtagcatggatgtgaatcttcaaatgattgctaagattgcagctgtctgtaacgatgcaagtatcactcagtcaggacatcattttgttaccagtggtatgccgacagaggcagccttgaaggttttggttgagaaaatgggacttcctggaggatatgatccttcttcattggactcggctgaaatattaaggtgctgtaaatggtggaatggaattgcccagagggttgcaactctcgagttcaatcgcactcgaaaatcaatgggagttattgtgaaatcaaaatcaggaaccaattctttacttgtgaagggtgcggtggagaatttgttggaaagaagtacccacattcagctgcttgatggttctgtagtgttgttagatgacagttcaaaaaatctgattatgaatgctctgcgtgaaatgtcaacaaatgcattgcgctgtttgggatttgcctataaggatgatctagccgaattttcagcatatgatggaggagaccatccagctcataaacttctgcttgatccatcaaattacgcatccattgagactggtctcatatttgttggattagtagggctgagggatcctccacgaaaagaggtttacagagcaattgaagattgtagagcagctggcattcgtgtaatggtcataacaggagataacaaggaaacagcagaagcaatttgtcgcgatataggcgtattttcacctgatgaagatatacatttgaagagcctcacaggcaaagagtttatgtcatccaatgataagaaggcaattctgaggcaaaacggtgctcttctgttctctagagcagaaccagggcataaacaagaaattgtgagattgttgaaggaagatggtgaggttgttgcaatgacaggggatggagtaaatgatgctcctgctctgaaaatggcagatattggtattgcgatgggcattgctgggacagaggttgctaaggaagcctcagatatggtgttagcagatgacaatttcagcacgatagtggcagctgttggtgaaggaagatcaatttacaacaatatgaaagcgtttataagatacatgatctcctcaaatattggtgaagttgcttccatttttctaacagcagctttaggcattcctgaggggctgataccagttcaacttttgtgggtcaatcttgttactgatggccctcctgcaactgctcttggattcaacccacctgataaagatattatgaagaaaccacctcgaagaagtgatgattcactaattactgcatggattttatttcgttatatggtgatcgggctatatgtgggcattgccactgtaggtatcttcatcatatggtacactcatggttcctttatgggcattgacttgagtggtgatggccatactcttgtaacctatgctcagctttctaactggggagaatgctcctcatgggatggcttcaaggtcgctccattcactgctggttcacgtcgcttcacctttgacactaatccctgcgactatttccagactggtaaggtgaaggcaatgaccctctcgctctccgtcttggtggccattgaaatgtttaattcccttaatgcattatcggaagatgggagcctcctgagcatgcctccctgggttaacccgtggcttctcttggccatgtcagtctcatttggattgcacttcttgatactatatgtcccgttcctggcccaagtgtttggaatagtgcctctcagtttcaacgaatggctcctggtgttggcggttgctcttccggtgatcctcatcgacgaggttctcaagtttgtcgggcgctgcacaagttcttcaggtgccaggagacgatctgcatccgcaaaacacaaggatgagtagatgctaacagatttggagatgcatttcgacaattttgcgtcaccacggaaggtaaaggttgttctggtccctcattcagtttgagaattaggcaaccgggatctgttcagaaaccgacctggcaatgaacttatattggatttggagattctcgatttttaagaaacatttttttgtcatgctggattatacagatccatttcattggtaatactcatgatgttaatgttactacgaggggaaatgctcgtgcaactgtagatcgtcgcatgtgcaatgtgacagtcaataatttctatctagtttttgtttctataggggagagaatgttgttcgtacttccctgcagttcttttgttatcttcagcttcaatattttgatcttgg

SEQ ID NO: 2400 - DNA, 3848 bp, Musa acuminata
ctggcggagacggcgttctatttagggcgagcgatcgggagatcgcttcgcctgagggttttctctttcgtgtcgaaagcgagaaaggaagaagaagtgagggagggattcggaagcgagagaaccgcaagcgaagaagtcttcttcgtgttgggtgacgaatccctggtgcccttttccctctctctctgtctctctctctctctcggcttctctttgcgggtcggtggggtcggacttttgagtcggtgaggcatgaaatggcgttgtcgggaagcatggatttgagggttttgtaggatagatttggttttcgctgggattgtcggttggggcggcgtggggatggggaaaggagggcaggatgacgggaagaagggtgttgagacgccgatctcgaattttcccgcctgggcgaggagtgtccaggagtgcgaggccgaattcaaggtttcggctaagtacgggctccgatccgacgaggtgctgacgcggcgggagatttatgggctgaacgaactcgagaagcactctgggccatcgatctggcatttggttcttgagcagttcaaggatacgctggtccggatcctccttgtggccgccgtcgtttcctttgtgctggcttggtgcgatggcgacgaaggtggtgagatggggatcactgcctttgtcgaacccttggtgatcttccttattctgatagtgaatgcaatcgttggtgtttggcaagagaacaacgccgagaaagcacttgaggccctcaaagaaatccagtccgagcatgccaccgttagaagggacggtgagctaattccaaatctgcctgctaaggagcttgtgccaggtgacattgtggagctcaaggttggggataaggttcctgcggatctgaggattttgcacctgatcagctctactgtgagggtagaacaagcatctcttaccggagagaatgctgccgtgaataaaaccaaccatgtagttgagtctgaagacatagatatccaagggaaggaatgcatggtctttgcaggtactacagttgtgaatggcagctgtgtgtgcttggttacacagaccggcatgaacactgaaattggtaagatacattcgcagattcatgaagcttcacagagtgaagaagatacgccactgaagaagaaactgaatgagtttggtgaggtccttacagctatcatcggtgtgatttgtgctgttgtttggcttatcaatgtgaagtacttcttaacctgggagtatgttgatggctggccgagtaatttcaagttctcttttgagaagtgtacttattactttgagattgctgtggccttggctgttgcagcaatcccagaagggttgcctgcagttatcactacttgcttggcattgggtacacggaagatggcacaaaagaatgcattggtccggaagctaccaagtgttgagactttgggttgcacaactgtgatatgctctgataagactggtacattaaccacaaaccagatgtctgtcgtaaggcttgttgcaatggggcgctggacagatacacttagaacattcaaagtggatggtaccacatacaatcctcgtgatgggaagatccatgaatggccatccagtgatatggatgcaaatcttcaaattattgctaagattgcagctgtttgtaatgactcgagcatcagtcagtcaggacatcactttgtcaccagtggtatgcccacggaggcagccttgaaggtcttggttgagaaaatgggtcttcctggcgattgtgatacttcattggtggactcggatgacatattaaagtgctgtaaatggtggaatgaaatggctcagagggttgctactcttgagtttgatcgcattcgaaagtcgatgggagttattgttaaatcaaagtcaggaaccaactgtttacttgtaaagggtgctgtagaaaatttgttggaaagaagttcctacattcaactgcttgatggatctgtagtcctgttagatgacaggtcaaaaagtctgattctggatgctcttcatgacatgtcaacaaatcaattgcgctgtttgggatttgcttataaggatgatctaacagaatttgcaacatatgatggtgaagaccacccggctcataaacttcttcttgatccgtcaaattattcatccattgagactggtctcatatttgttggactagtagggcttagagatcctccacggaaagaggtccacaaagcaattgaagattgtagaacagctggcatccgagttatggtcataactggagataacaaggaaacagctgaagcaatttgccgtgacataggtgtatttacacttgacgaagatatacattcaaagagcttcacgggcaaagattttatgtctagatcgtctaatgagaaaaagtcccttttgaggcaaaatggtggccttctcttttctagagcagaaccaaggcataaacaagagattgtgagattgctgaaagaggatggcgaggtagttgcaatgacgggggatggagtgaatgatgcccctgcattgaaaatggcagatattggtatagcaatgggcattgctgggacagaggttgctaaggaagcctcagacatggtgctagcagatgataattttaatacaatagttgcagcagttggtgagggaagatcaatttacaacaatatgaaagctttcataaggtacatgatctcctcaaatattggtgaagttgcttccatttttcttacggcggctttaggtattcctgaagggttgataccagttcaacttttgtgggtcaatcttgtcacagatggccctcctgcaactgctcttggattcaacccacctgacaatgatattatgaagaagccacctcgtaggagtgatgattcattgattactgcatggattttattccgttatatggtcatcggactttatgtggggattgccactgtgggtatcttcattatatggtatactcatggttcttttgcgggcattgacttgagtggtgatggccatactcttgtaacctattctcaactctctaattggggagaatgctcctcatgggagggcttcaaggtcgcaccattcactgctggagcacggagtttcacctttgatgacaatccctgtgactacttccagaccggcaaggtgaaggctatgaccctttcgctgtctgtcttggtggcgattgagatgttcaattcactgaatgcattatccgaagatgggagccttctgagcatgcctccctgggccaatccatggcttcttttggccatgtccatctcatttgggctgcatttcttgatattgtatgtccctttccttgctcaagtgtttggaatagtgcctctcagtttcaacgagtggctcctggtgttggtggttgcatttccggtgatccttatcgacgaggtcctcaagtttgttggacgctgcacaaattcttcaggtgccaagagacgccccacaaagcacaaggatgagtagatgctagcatataagattcatattgtgaatcatatttgaccaaggtggtcgttctgattcttttctttcctccttttaagtgggttgtttgagaatcaggcaaccagggcaacattcaaaattagtttggctggcggtactagtattggatttagatatttaccattgattcttaaacacatcttttatgaatctggaattataccggaacccttctgtagtagtaattatgagctggaattacgaatctggaattatgctcgtccgtttaatatactcttcagtgaaggatcgacattaattttaaatatatttttgtttctcag

SEQ ID NO: 2401 - DNA, 4069 bp, Phalaenopsis aphrodite
ggctcatctaggtctggaaccactgtggcaatcaaacctactttctttttccgtcatcccttgtcaatcttcacaagcaaccctaatcccttccctcttcctccctgtcctcgtacccgcaagctcagatcccgaagagtttttgttccttacttttaccgtgcatttgccccagtttagcttggggttccgctttcatatttttggttatattcttccatcgaacgatcgaagccagagttgtacgagcctgttttttagccgtattgcttgtgttgcccgcgtgattctcgtttcacacgagcgatctaggtgtgatggggaaaggcgggcaggatcgtgggcgtggagccggtgcaaaacctaattcgtcgccgccttcatccacttttccagcttgggccaggacggttgcccagtgtgaggccgaattcggagtttctgctgacgtgggactaacctcggtagaggtttctcggcggctggagttatacggcttgaacgatctcgagaatcactccgggccatcaatctggcaattggtgctggagcagttcaacgacacactcgtacggatccttcttgttgccgcggtcgtctccttcgttctggcatggtatgatggcgacgagggcggcgagatggggatcacagcatttgtggagccgctggtgatcttcttgattctgatagtaaacgccgtagtaggggtctggcaggagaataacgctgagaaggcgctggaggcgctgaaggaaatacagtcggagcatgctgctgtgaaaagagatggggagctcatacctcgcttgccagctaaagagcttgttccgggtgatatagttgagcttagggttggggataaggtccctgcagatatgagggtgctgcacttgataagctcaactcttagagtagagcaggggtctcttactggagagagcgcagctgtgaataagaccaatcacaagattgattcggaagatactgatatacaaagcaaagtgtgcatggtttttgcaggaaccactgtggttaatgggagctgtgtgtgcttggtcacgcagactggtatgaacacggaaattggtaagatccactcccaaattcacgaggcttctcaatgtgaggaagatacacctttgaagaaaaaactgaatgaatttggcgaggttcttacagctttaattggagtgatctgtgcgcttgtgtggctcatcaatgtaaagtatttcttaacctgggaatatgtcaatggatggccgagaaatttcaagttctccttcgagaagtgtacctattactttgagattgcggttgcattagctgttgctgcaattcctgagggtcttccggctgtgattacaacttgtttggcattgggtaccaggaaaatggccgcaaagaatgcgcttgtaaggaagcttcctagtgttgagactttgggatgtacgactgtaatttgttctgataaaactggcacactgacaacgaaccagatgtcggcagcaaaactcgtggcaatcgggcggtcgactgatagtttgagaagctttaaggtagatggaactacttatgatcctaatgatgggaggattcatgattggcctgctggtcagttggatcaaaatctgcagatgattgcaaagatttctgcagtttgtaacgatgctagcatcagtcgttctggacaacattttgtttctactggagggcctactgaggcagctttaaaggttctagttgaaaaaatgggacttcctgctcggtttgatgcttcatctataggttctactaatacattgagatgctgccagtggtggaatgatttatctcctagggttgcaacgcttgagtttgatcgtactagaaagtccatgggagtcattgtgagatcaaaaaccaaaagcaataccttacttgtgaagggggctgtggagaatttactggagagaagtgtatctgtgcaactgcaggatggttctgttgtagaactggatgagcgcactaaaggtctaattttgaaataccttcatgaagcgacatctagtgcactgcgatgtctcggttttgcatataaggaagagcttgaggaattcagcacttacgatggtgaaaatcatcctgctcataagcttctgcttgatccatctaactattcatcaattgagagtgatttgatttttgttggatttgttggacttagggatcctccccgtgcagaagtgcacaaagcaattgaggattgcagagcagcaggaattcgtgttatggtaataactggagataacaaggagacagcagaagcaatttgccgagaaattggtgtatttggtccatatgaaaacatcaacttaaaaagctttacgggaaaaaattttaatgtctttacctaataaaagtgaaatattaagacagaaaggtggacttctcgtttctagagctgaaccaaaagacaagcaggaaattgttagattgctcaaagaagatggagaggtggttgcaatgactggtgatggtgtcaatgatgctccggctttgaaaatggctgacattggtattgctatgggtattgcaggaacagaggttgctaaggaagcctctgacatggttctggccgatgacaatttcagcacaatagttgctgcagttggcgagggaagatctatatacaacaatatgaaggcctttataaggtacatgatctcctccaacattggtgaagttgcatccatctttctgacagcagcgttaggtattcctgaggggctgatacccgttcagctgttatgggtcaatttagtcacagatggtcctcctgcaactgctttgggatttaatcccccagataaagatatcatgaagaaaccacctaggaaaagtgatgactctttaatcagtgcctggatcttgtttcgttatctggtcattgggttttatgttgggattgctactgttggagttttcatcatatggtacactcatggatccttcttaggcatcgatttgagtggtgatggacacactcttgtcacctactcccaactatcggactggggccactgcccctcatggcagggcttcaaagtgaccccattcaccgccggaaatcgtaaattctccttcgattcaaatccgtgtgattatttccagatgggcaaaatcaaggcaatgactctctcactctctgtgttggtcgctattgagatgttcaattcgctcaacgctctgtcggaagatgcgagccttatccggatgcctccgtgggtcaatccatggcttctcgtcgccatgtcggtgtccttcgcccttcactttttgatcttgtatgtgccgtttctagctcaagtttttgggattgttcccctcagcttcaacgagtggcttcttgttctagcggtagccttcccagttattcttatcgacgaggtgctcaaatttgtggggcggtgcacgagttctttgggtgctgagagagccataaagaaacataagggcgattagctgaataaaggagtcgatttcctcctttcattatcgaccaacctgctgccttctgttcttttctgaatcaggagcaggtttgagacttattccatttgatatcaagaaggatctgaaaattgaactagaattccctaatgaattccagttttattgataaattatagacgcgatgactttggacgctttagttttaataattgttgtaggaggtgattttggttctaattgatagtttagttttgctgcttgtatgaaactggaggactctactgatatgtctctgctgttgaaagctgtatgcggcatcatctctaaactatttatatccagcttaggtttattattggaaatatgtgtttttattttgcttctttgacaattgtttcttttattcggaattctaaaattgatttagggacgcatttcatggaatttgcgaattctctgtaatatcacagttaatgctgctacacgattatttaattctgctttgttttgtagcctattttttcttctatcatttaattcgcaccctttattctgcaaaaaaaaaaaaaaataa

SEQ ID NO: 2402 - DNA, 1332 bp, Hordeum vulgare
tcattttttctaacgaacaggggagggttcgtagcctccgccgccggcgccacccatccggccggagcctctagcaccgacgccgccaccttggaccatcccctcccgcccagcagcgactctctccctggagcagccgctcccgcctaaccccaagccgccgccggagccacgccgcgccacacgctccctccctcccccctcttcttggggacgggactggggccgaggaggaaccgagcctgcccttgtcgcccagcagctcccgctccaacgggctcgcccacgagtccggcagcgccagccgctcctccctcgtccgatcaaccaaacacgaccttcgtctctccggcaagaacttctcgagatgcccgccgcggtggtgcgctgccccctcctcctcaggcggcacccggcggccgccctccgacgctccttctcctcctccggcatgcggtctgtgcgcagagccgcggggggtgggagccaggggcgatcaccggcgtatcgtgggctgctgctcgacgccggtggcacgctgctgcagttggcgcagccagtcgctgagacgtatgcaaccctcggccgtccatacggtgtgatgaagtccaaagagtatatcatgcaaggattcaagcgggctttctcagcaccatggcccaagacgcttaggtaccagggtgatgggcgaccgttctggaggattgtcgtggcggaagcaactgactgcacaaacagtgattattttgaagaagtatatcagtactatgcacatggagatgcatggcgtctgcctgatggagcttacagaacactgcgtgatttaaaggatgctggagttaagctagctgttgtatctaactttgacacacggctaaggaaattgctcaaggacctcaacgtctccaacatgtttgatgccattgtggtatcatcggaggttggatatgagaaacctgctccagagatcttcaaaatagcattagaacaaattggcgtggaagccagcaatgcagtacatgtaggagatgatgaaactgcagacaaggcgggtgctaacgctattggactcgagtgctggctgtggggagaagatgtgaaggaattttctgagatacagcgccggatcgtagcaaaaggctcacgatgagcgcagggccttttgactctgtttgctcgatttgttcatttgtttggtaaggggccctaataacagttgtaatttgcccaaatatatctgtttctccacaaggtctgttgtggtccttgtaataagcgctgagaagaatactaatggtacatgtgcataatacttttcagtagcagttctgt

SEQ ID NO: 2403 - DNA, 1331 bp, Secale cereale
gactggcctcctgagcgaaatgtgaaagaaaaaaaaaacaccccgagcgaacgaacagaggagggctcgtagcctccgccgcgccgccggccgcccatccggccggagcctccagcagcagcgacgccgcctccccggagcagccccccgggcggccgcggcaccctccctggagcagccgctccgcccaagccgccgccgcacgctccctcctccctcttcttggggacgggattggggacgaggaggagcctgcccttgccgcccagcagctcccgctccaacgggatctctccacaagtccggcagaaccggccgctcctccctcctccgctcaaccaaacacaaccttcatctcccggcaagagcttctcgagatgcccgccgcggcgatgcgctgccccctcctcctcgggcggcacccagcggccaccctccgacactccttctcctcctcccgcacgcgtcgtgtgcgcagagccgcggggggtgggagccaggggcagccaccggcgtatggtgggctgctgctcgatgccggtggcacgctgctgcagttggcgcagccggtcgccaagacatacgcagccctcggccgtccatacggtgtgatgatgcccgaaaagtacatcatggagggattcaagcgggctttctcggcgccatggcccaagacgctcaggtaccagggtgatgggcgaccattctggaggattgtcgtcgcggaagcaactgactgcacagacaatgattatttcgaagaagtatatcagtactatgcacatggagatgcatggcgtctacctgatggagcttacagaacactgcgtgatttaaaaaaagctggagttaagctagctgttgtatctaacttcgacacacggctgaggaaattgctcaaggatctcaatgtctcagatatgtttgatgccattgtggtatcatcggaggttggatatgagaaacctgctccagagatcttcaaaatagcattagaacaaattggtgtggaagccagcaatgcagtacatgtgggagatgatgaaactgcggacaaggcgggtgctaacgctattggactcgagtgctggctgtggggagatgatgtgaagaaattttctgagatacagcgccggatcgtagcaaaaggctcacaatgagcgcagggcattgcctctgtttgccagatttgttgatttgattgctaaagggccctaataacagttgtgattttgcctagtatatctgtttctccacacgttctgttgacgtccttgtaataagcgccgagaagaatggtactacttgtggtacatgtgcaaatacttttc

SEQ ID NO: 2404 - DNA, 1447 bp, Triticum aestivum
cagaggagagttcgtaggctctcgtagcctccgccgcggcgccgcccatccggccggagcctccagcagcgacgcctcctgcctccccggagcatcctcgcccgcccagcagcgactccctccccggaacagccgcccccgcccaaatccgccgcccggagccacgccgacgcgcgctccctcccacctccctcttctcggggacgggattggggccgaggaggagcctgcccttgtcgccctgcagctcccgctccaacgggctcgcccacgagtctagcagcaccagccgctcctcccccctccgctcaaccaaacacaaccttcgcctccccagcaagagcttctcgagatgcccgccgcagtggtgcgctgccccctcctcctcgggcggcacccagcggccgccctccgacactccttctcctcctcccgcacgcgtcgtgtgcgcagagccgcggggggtgggagccaggggcagccaccggcgtatggtgggctgctgctcgacgccggtggcacgctgctgcagttggcgcagccggtcgccgagacgtacgcaacccttggccatccatacggtgtgaggaaacccgaaaagtacatcatggagggattcaagcgggctttctcggcgccatggcccaagacgctcaggtaccagggtgatgggcgaccgttctggaagattgtcgtggcggaagcaactgactgcacaaacaataattatttcgaagaagtatatcagtactatgcacatggagatgcatggcgtctgcctggtggagcttacagaacactgcgtgatttaaaagattctggagttaagctagctgttgtatctaacttcgacacacggctaaggaaattgctcaaggatctcaacgtctcacatttgtttgatgccattgtggtatcatcagaggttggatatgagaagcctgctccagagatcttcaaaatagcattagaacaaattggtgtggaagccagcaatgcagtacatgtaggagatgatgaaactgcagacaaggcgggtgctaatgctattggactcgagtgctggctgtggggagaagatgtgaaggaattttctgagataaagcaccggatcgtagcaaaaggctcacgatgagcgagcgcagggcattgtctctgtttacctgattcgttcatttgattgctaaggggccctaataacagttgtaattttgccaaatatatatgtttctccgcacggtctgttgacgtccttgtaataagtgctaagaagaagaatgctacttgtggtacatgtgcaaatacttttcggccctcatgatcatcttcatcatcgcctctgtcctgcgatcgttgcgcatatattgaactaatttgggcacgtcgacggactgattttttcggtttcgccaagttgatgtatgtatgcatgtatgctagtgttgtc

SEQ ID NO: 2405 - DNA, 1138 bp, Oryza sativa
gagattcgggcgctctctctctctctcttctcctcgccggcgagcgcgtctcgagatgcccgcggcggcggcggcggcggcgcgcggcccgctcctccatctccggcggaacccggcgccacgccttgccgccgcccgccgctccttctcctcttccgggatgcggtgcgtcagcgcggccgcgggcgcgggcggcggcgggagggagcggcggtcgtcgccggcgttcggcgggctgctgctcgacgccgggggcacgctgctgcagctggcgcggccagtcgcccagacgtacgcgtccctcggccggcgatacggtatgagcaagagtgaggagagcatcaaggagggattcaagcgggccttctccgcgccatggccaaagacgctcagataccagggagatggacggccgttctggaggattgtggtggcagaggcaaccgaatgcaccaataatgattatttcgaagaagtatatgagtattacgctcatggagatgcatggcgtctgcctgctggggcttacgaaacactgcgtgatctaaaggatgctggagttaagctagctgttgtatctaacttcgacacacggttacgaaaattacttaaggaccttcatgtctcggatatgtttgatgccattgttgtatcatcggaggttggacatgaaaaacctgctccagagatcttcaagagagcattagatcaaattggcgtagaggccagcaaggcagtacatgttggagatgatgaaactgcagacaaggcaggtgctaatgccatagggcttgagtgctggctgtggggacaggatgtgaggacattttctgagatacaagaccggattctaacaagatttccacaatgacatcatagaaacctcaccgcaggtgatcttcacaggctttctttttttttctctccaaagcttcgttgtcatgaccaagaggcgccaacttttgtaatgtattaagtcaaatatcactagcattggattatcgatgtatttgcattttgcaataaattagcacctttaccagcttgccactaaatgtggtaaaatccactaaaccagcccaacatattacagacacatcaaaaccaattttttcccgctcctatgcctgaatacact

SEQ ID NO: 2406 - DNA, 1122 bp, Triticum aestivum
cgcgctcctcccgcctccctcttctccggggctggattggggccgaggaggagcttgcccttgtcgcccggaagctcccgctcgaacgggctcgcccacgagtccggctgcaccagccgctcctccctcctctcctccgctcaaccaaacacaaccttcatctccccggcaagagcttctcgacatgcccgccgtggtgatgcgctgccccctcctcctcgggcggcacccagcggccgccctccgacactccttctcctcctcccgcatgcgttgtgtgcgcagagccgcgggagtgggggccagggacggtcaccggcgtatggtgggttgctgctcgatgctggtggcacgctgctgcagttggcgcagccggtcgccgagacgtacgccaccctcggccgtccatatggtgtgatgaagtcccaaaagtacatcatggagggattcaagcgggctttctcggcgccatggcccaagacgctcaggtaccagggtgatgggcgaccgttctggaagattgtcgtggcggaagcaactgactgcacaaacaataattatttcgaagaagtatatcagtactatgcacatggagatgcatggtgtctgcctgatggagcttacagaacactgcatgatttaaaagatgctggagttaagctagccgttgtatctaacttcgacacacggttaaggaagttgctcaaggatctcaacgtctcagatatgtttgatgccatcgtggtatcatcggaggttggatatgagaaacctgctctagagatcttcaaaatagcattagaacaaattggcgtggaagccagaaatgcagtacacgtaggagatgatgaaactgcagacaaggcgggtgctaacgctattggactcgagtgctggctgtggggagaagatctgaaggaattttctgagatacaacaccggatcgtagcaaaacgcttacgatgagcgagcacagggcatcgtctctgtttgcctgattcgttcatttgattgctaaggggccctaataacagttgcgattttgccaagtaaatctgtttctccacacggtctgttgacgtccttgtaataagcgccgagaagaatggtactactcgtggt

SEQ ID NO: 2407 - DNA, 1061 bp, Triticum aestivum
gccacgttgatgcgctgccccctcctgctcgggcggcaaccggagaccgccctccgacactccttctcctcctcccgcatgcgtcgtgtgcgcaaagccgcggggggtgggggccaggggccaccaccggcgtatggtgggttgctgctcgacgccggtggcacgctgctgcagttggcgcagccggtcgccgagacgtacgccaccctcggccgtccatatggtgtgatgaagtccgaaaagtacatcatggagggattcaagcgggctttctcggcgccatggcccaagacgctcaggtaccagggtgatgggcgaccgttctggaagattgtcgtggcggaagcaactgactgcacaaacaataattatttcgaagaagtatatcagtactatgcacatggagatgcatggcgtctgcctgatggagcttacagaacactgcgtgatttaaaagatgctggagttaagctagctgttgtatctaacttcgacacacggctaaggaaattgctcaaggatctcaatgtctcacatatgtttgatgccattgttgtatcatcggaggttggatatgagaaacctgctccagagatcttcaaaatagcattagaacaaattggcgtggaagccagaaatgcagtacacgtaggagatgatgaaactgcagacaaggcgggtgctaacgctattggactcgagtgctggctgtggggagaagatgtgaaggaattttctgagatacaacaccggatcgtagcaaaacgctcacgatgagcgagcacagggcattgtctctgtttgcctgattcgttcatttgattgctaaggggccctaataacagttgcgattttgccaagtaaatctgtttctccacacggtctgttgacgtccttgtaataagcgccgagaagaatggtactactcgtggtacatgtgcaaatacttttcggctttcggccctaatgatcatcttcatcgccgccttggcgtgtggtcgcgcatatatcagactaatttggacgcattgatgcactaactttttcgttttcaccaagta

SEQ ID NO: 2408 - DNA, 6010 bp, Setaria italica
cgagctgtcccccctgcttacgcatacccgcggcggggacacgcgacacccaccccgcctcggcgcctcctccctcctccgcccatcgaccgatcgattcttcgcggcctctccccccgagtcagatcctactcaatccccggcccaaaccctactcggccctcgcgaagcagccatgatggcagccgagccctcgccgttgtcggccgcggctggcgacctcgaaaccctcgccctcgactcctcgtcgtccgccgcctcggcctccaccgaccccctcctccgcccgccttcctcccagaccgccgccgccgcgaaccacgacgccttcgtcatcgacgacttcctcgacgaggaggacgacttctcccccgccccggcgcccagcatcgcccgccatcccgcgccgcgccccgacgcggcgccccccgtgttcgccagaatcaccgtgtccgatccgaagaagcacgcggagcccagcggcgggggtgccgccgccggcgtgatcccgggctccgggagctacttcacctacctcatcaccacccgcctcgcgggcggcggcggcggcggggaggtctgcgtgcggcggcgcttccgcgacgtggtagccctcgcggaccgcctcgccgcggcccaccggggcctgttcgtcccggcccggcccgacaagagcgtcctcgagggacaggtcatgcagcgccacgacttcgtgagccagcggtgcgccgcgctccagcgctacctctgccgcctcgccgcgcaccctgccgtcggacacagccccgacctccgtacgttcctcaccgagcctggtgccatccccgccttccagggcgaggcgccacggtactggactaccacggtgaatgctgctgctccgctagtgcaggccaaagctgggagggacttatttgggatgttcaagggtctgaagcagactgtggtgaacgggctggtcgcaaccaagcctccacctgtggagcaggagacagacacagaattcctggcgcacaaggccaggtttgaggatttacagcagcagctcaccacaacatcacagcaggctgaaacacttgtcaaagcccaagatgatcttagagaaactacaggtcacttgggaatgacactgattaagctggcaaaatttgaaagagagcaggccacatgtaattccctaagaagaagagccggtgaaatccataattttgcaaatcatgttttgaagatgagcagatcacagataaaattaaactctgaaattgtgaaacacctgggtagcatccatgaatacttggaggccatgatatctgtcaatcatgcatttacagatcgctccaatgctttacatcacgtgcaaagtttgtcagcagatttattttctttgcacacaagggcaggaagacttgaatcttcatcagcaagagatatggggcatgagtggtcgacatatcagaaggtggagggattgaaagaaacaataagatcagcagaagcagccaaaagtgacgcacttagagaatatgaaagcattaaggaaaacaacaagattgaaataaaaagatttgacaaggaaagacgccgcgatttcattgagatgctgaaaggttttgttgtaaatcaggtatcatattcagacaattttgctaacatgtggacgaaggtcggcacgcagagctccaggcctgcagcaactccgccggccgcgagcaatgttgtcccgcgtgccggctcaaagcccggccgcctccttcaaaccgcgccactcctccccccgctcccgcctcggcctcggcgccagttgcaaacccctcacggccaccaccaccgccccctcctcaacccgacgccgcgtgtccacctgcgccgcctctcgccgtggtttcctcctcctcgccccctcgctcgccgcggcctccgccgtcctccgcactctcccctccgccgccgccgagtccgatgacgcagacaccccgtcgtccacgccggcgccgcccaccgacgagctcccctccccttccccggagaccgaggcggaggtggaggctcagcctgagcccgaggagttgcccatgtcgagggtgtacgacgcgacggtcctcggggaaccggaggcgttggcgggggacgcgcgggggcgggtgtgggagaagctggcggccgcgagggtggtgtacctcggcgaggccgagctcgagcccgaccccgacgaccgcgcgctcgagctcgaggtcgtcaggggcctctcgggccgctgcgccgacgccggcaggggcctggcgctcgcgctcgaggcgttcccatgcgatctacagcagcagctcgaccagttcatggacggcaggattgatggcagaatcttaaagctgtacacatcgcactggccgcaggagctctggcagcagtacgaacctcttctgaattactgtcgtgatactggaattaagcttattgcttgtggaacgccattggaggtgaaaaaaactgtccaagcagatgggattagagctctcacaaaagccgaaagagaagcatatgcccctccagcgggctcaggcttcatctctggtttcatgtttagctcgggccggtcattgatagacaagatctcatcaatggacgactctctgtttggcactacctcatatctattagaacaggcaagagcagttgatgattataccatttcccagattattacgaaagaacttaatgatggagatctttcacggttgctaattgttgtcacgggtgcaagccatgttatgtacggaccacgaggaagtggtgttcctggtagaatatctaaaaaggtgccaaagaaagaccaagttgtggtactgcttgatcctgaaagtcaggttataaggagggaaggtgaactccctattgctgatttcttatggtattcagcagctaaaccgtgcactagaaattgctttgaccgtgctgaaattgctcgagttatgaatgctgctggtaggaggaccaaagctttacctcaggatcttcagaaaggaatagatcttggtgtagtttctcctgagatattgcagaacttttttgaccttgagaaataccctcttatggcagaactgattcatcgatttcaaggtttccgagaaagattgctggcagaccctaaattccttcaaagattagctattgaagaggctatatcaataacaaccactctactagcgcagtatgaaaggcggaaagaaagattttttgaagaaattgactatgtcctcacagatactattagagggtctgttgttgatttctttacagtgtggcttcctgctcctactatttcagtccttcaatttgctgatgatggttctggtcggagtttggagtttgtcagaggccttttaggatcattgccagataatgcattccaaaagaatatcttgggtcaggattggagtatcaagcaaagaattgcagcagtattggttggtggtttgaaacttgccagtgttggtttcatttctagtgttggggctggagtttcctcagatcttgtttatgctgctcgaggaatagtaaaaccttcagaaaaagtggaagcaggaaggaagagatctcctatttggaaatcggcagctgtttatagttgctttcttggaacatcagcaaatttgcggtatcagattattgctggtctagtggagtatcggctaggagagagcctggtgacatactacaatcaaccacttatcgccggtttgttgtccttcgttgcgaggacattgaactcatactggggaacacagcaatgggttgatcttgcacggtacactgggctacagaagagtgaggaaaagcctcctggtgaggccagcacgccacctgaatcgtggctacagaagagtgaggaaaagcctccttctggtgaggccagcacgccacctgaattggggctacagaagagtgaggaaaagcctccttctagtgaggccagcacgccacctgaattggcagacttggatggttgtacgattgaaggacataatttggatgacagtagtaataacaccaatgaatcaaggggtccgagctagtgatttggttactttgcggtggctgaagatcacatagcctatactttcataaacagtgaaagaggcggccttctacgagattgagcctcactcctgggatcacaaggagtggaaatttgaggaaatattagccacaatcatttgttcattttccttttcagtgcccccaccagagtgcagacactgtttcttgtttctatttatagagtaagtattgtttgtactctgtccatctgtaagaactcttgcagtccctagaggatttgctcatttgcagcaacaagggctgtagcctgtagcatagcatgttgttaattctggtttaggttgaatattagtgatgctagtgactagtgagtcctctaaaagaagtttggcaggtccggctgttgcaaacgtttctttaggccttctgtagagccagatgtttcagagtgtgcgcaagttctcttcgttatcttttggagaaatatggtaggtaagctggtttctttctcgaagaacttttttttccttcgtattttattgtgtcactggccagctatgggctctggcatgttcgtccagtgcaacctgtgcttcgtgcatggggaagtggttgtctttagattctgatggctagccatgtgtccctggatacttctgtacgtggcatctcttcctggagctctctctgtgtgtatatatatacgtgcagcaatctcttttcgccaaaacaagaagacttggagaagtgaagttggaaagttctatactgaggttttagaatggcgagtgcacaggcgatggggcaaggagagcaggatcacttcgttctgaagagcgggcacaccatcccggctgttgggctaggcacttggagagccggctcagatagcgctcactctgttaagacagccatcaccgaggctggatataggcatgtagacacagctgctcagtacggagtagaaaaggaggtcggtaaaggacttaaagctgcaatggaagctgggatcaacaggaaagatttgtttgtaacatcgaaactatggtgcacagacttggctcctaacaaggttcggccagcgctacagaacacgctcaaggatttgcagttggattatcttgatctctaccttatccattggccattccgactaaaagatggagcgcatatgcctccagaagctggggaagtgcttgagttcgacttggaaggagtgtggagggaaatggaaagccttgtgaaagatggactagttaaagacataggtgtttgcaattacacagttaccaagctcaaccgtctgatgcgttcagcaactattccgccagcagtatgccagatggaaatgcaccctggttggaagaacgacaagattttcgaggcctgcaagaagcatgggattcatgttactgcttactctccactgggttcttcagagaagaacctagcacatgaccctgctgtcgaaaaggtagccaacaaattgaacaagaccccaggtcaggtgctcatcaagtgggccctccaaaggggaacaagtgttattcccaaatcaaccaaagacgaaaggatcaaggagaacattcaggtgtttggatgggagatccctgaggaggacttcaaggtcttgtgcagcatcaaagatgagaagcgagtcctgaccggggaggagctcttcgtgaacaagacccacgggccgtacaagagcgcatctgagctctgggaccacgaggactgagctgagctgccgtgccgccggatccgattccggaaccgaaaataaaggacgttgcatgcttttgtcaaaaccggcttctgatgagatggaaagagtgtgtgcaaaagcaaaacccgtcatgcactgtacctaaactgaataaagatggcaccagtggttcgccttcgcctttcgtacgtgcttcctctgctcgcattatttgcctcaccagcg

SEQ ID NO: 2409 - DNA, 2068 bp, Sorghum bicolor
ccggctgttccccttgcttacgcataaggcataaccgcggcggggacacgcgacagcatccacctcgccgccgccgcctccttccttccgcccatcgagtcgaccgatcgattgttcgcggcctccccctagtcagatcccactcaatcccaagcccaaaccctacccacccttctcaaccagcgatgatggcagcggagccctcgccgtcggttccctccaccgccgctgacgacctcgaaaccctcgccctcgactcatcctcgtcgtccgccgccgctaccgcctccgcctctaccgaccccctcctccggccacctacctccccgaccgccgcgagcgacgaccacttcgtcatcgacgacttcctcgacgaggacgacttctccaccacaccgtcgcccagcgtcgtccgcccgccgcgcgcagcgcgcggcgatgcggcgtctccagtgttcgccaaaatcaccgtatccgatcccaagaagcacgcggagcccagcggcgggggtgccgccggtgtgatcccggggtccggcagctacttttcttacctcatcaccacccgttttgctggcggcggcggggaggtccgcgtgcggcggcgcttccgcgacgtggtggccctcgcggaccgccttgccgcagcccaccgcggcctcttcgtcccggcccggcccgacaagagcgtcctcgaggggcaggtgatacagcgccacgacttcgtcagccagcggtgcgctgcgctccagcgctacctctgccgccttgccgcgcaccctattgttggtcagagccctgatctccgtacgttcctcacggagcctggtgccatccctgccttccaaggtgaggcgccgcggtactggacttccacggtgaatgctgctgctccgctggtgccaacgaaagctgggagggacttgtttgggatgtttaagggtctcaagcagacgttggtgaatgggctggttgcaacaaagcctccacctgtggagcaggagacagacacagagttcctggcacacaaggccaggttcgaggacttacagcagcagctcaccacaacatcgcagcaggcagaagcgcttgttaaagcccaagatgatcttagagaaactacaggtcacttgggaatgacattgattaagctggcaaaatttgaaagagagcaggcaacatgtaattccctaagaagacgggctggtgaaatccatagttttgcaaattctgttttgaagatgagcaggtcacagataaaattaaactctgaaattgtgaaacacctgggtagtatccatgaatacttggagatgatgatatcagttcatcatgcgtttacagatcgctctaatgctttacattacgtgcaaagcttgtcagcagatttgttttccttgcacaccagagcagggagacttgaatcttcatcagcaagagatatggggcatgagtggtcaacatatcagaaggtagaggggttgaaagaaacaataagatcagcggaagcagccaaaagtgatgcacttagagaatatgaaagcattaaggaaaacaacaagattgaaataaaaagatttgacaaggaaagacgccatgatctcatcgagatgctgaaaggttttgtggtaactcaggtgtcttattcagaccattttgctaatatgtggacaaaggtaacagaggaaacagaagtatatgcaaacaggagcaactgatatacgtatagggagtgtagagtagttgattttgatctacatttaatttgctccaacatccagcgactacaaccattcttattctaccccagttttgccacattgggttggttgtagtgccacatgagttatgtgcggtcgtttatgtgcagtcgtgaaattgggtcccgacagatgagcttctttaatcctgttagcttgactgataatccagggctaaaagtactttatgttgatttgttgtaagagaaaaacactgttgaatgacagattcggcagataagccccaacaaacaagaattttacacaagatttttttgatgataacttacagttaatgtccatgagca

SEQ ID NO: 2410 - DNA, 2022 bp, Sorghum bicolor
ccggctgttccccttgcttacgcataaggcataaccgcggcggggacacgcgacagcatccacctcgccgccgccgcctccttccttccgcccatcgagtcgaccgatcgattgttcgcggcctccccctagtcagatcccactcaatcccaagcccaaaccctacccacccttctcaaccagcgatgatggcagcggagccctcgccgtcggttccctccaccgccgctgacgacctcgaaaccctcgccctcgactcatcctcgtcgtccgccgccgctaccgcctccgcctctaccgaccccctcctccggccacctacctccccgaccgccgcgagcgacgaccacttcgtcatcgacgacttcctcgacgaggacgacttctccaccacaccgtcgcccagcgtcgtccgcccgccgcgcgcagcgcgcggcgatgcggcgtctccagtgttcgccaaaatcaccgtatccgatcccaagaagcacgcggagcccagcggcgggggtgccgccggtgtgatcccggggtccggcagctacttttcttacctcatcaccacccgttttgctggcggcggcggggaggtccgcgtgcggcggcgcttccgcgacgtggtggccctcgcggaccgccttgccgcagcccaccgcggcctcttcgtcccggcccggcccgacaagagcgtcctcgaggggcaggtgatacagcgccacgacttcgtcagccagcggtgcgctgcgctccagcgctacctctgccgccttgccgcgcaccctattgttggtcagagccctgatctccgtacgttcctcacggagcctggtgccatccctgccttccaaggtgaggcgccgcggtactggacttccacggtgaatgctgctgctccgctggtgccaacgaaagctgggagggacttgtttgggatgtttaagggtctcaagcagacgttggtgaatgggctggttgcaacaaagcctccacctgtggagcaggagacagacacagagttcctggcacacaaggccaggttcgaggacttacagcagcagctcaccacaacatcgcagcaggcagaagcgcttgttaaagcccaagatgatcttagagaaactacaggtcacttgggaatgacattgattaagctggcaaaatttgaaagagagcaggcaacatgtaattccctaagaagacgggctggtgaaatccatagttttgcaaattctgttttgaagatgagcaggtcacagataaaattaaactctgaaattgtgaaacacctgggtagtatccatgaatacttggagatgatgatatcagttcatcatgcgtttacagatcgctctaatgctttacattacgtgcaaagcttgtcagcagatttgttttccttgcacaccagagcagggagacttgaatcttcatcagcaagagatatggggcatgagtggtcaacatatcagaaggtagaggggttgaaagaaacaataagatcagcggaagcagccaaaagtgatgcacttagagaatatgaaagcattaaggaaaacaacaagattgaaataaaaagatttgacaaggaaagacgccatgatctcatcgagatgctgaaaggttttgtggtaactcaggtgtcttattcagaccattttgctaatatgtggacaaaggtaacagaggaaacagaagtatatgcaaacaggagcaactgatatacgtatagggagtgtagagtagttgattttgatctacatttaatttgctccaacatccagcgactacaaccattcttattctaccccagttttgccacattgggttggttgtagtgccacatgagttatgtgcggtcgtttatgtgcagtcgtgaaattgggtcccgacagatgagcttctttaatcctgttagcttgactgataatccagggctaaaagtactttatgttgatttgttgtaagagaaaaacactgttgaatgacagattcggcagataagccccaacaaacaagaatttt

SEQ ID NO: 2411 - DNA, 1899 bp, Zea mays
ccccacttgcttacgcgagacgcgacaccaatacgccatccactgatccacctcgccttctgcttccttcagcggttccgcccatcgactcgacagatccttgttcacgacctcaccctattcagatcccaagcggccacgcccaagcccaaaccctacccacccatctcaagttctcaaccagcgatgatggcagcggagccctcgccgtcggttccctccaccgccgctgaagacatggaaaccctcgccctcgactcatcctcgtcgtccgccgccgctacggcctccgcctccgaccccctccttcggccacctacctccccgaccgccgccgcgagcgacgaccccttcgtcatcgacgacttcctcgacgaggacgacttcaccgccccgccgcccagcgtcgccggcccgccgcccgccgtgcttggcgatgcggcgtccccagtgttccccaagatcaccgtatccgatcccaagaagcacgccgagcctagcggcgggggtgctgccggtgtgatcccagggtccggcagctacttttcttacctcatcaccacacgttttgcgggcggcggtggggaagtccgcgtgcggcggcgcttccgcgacgtggtggccctcgcggacggccttgccgcagctcaccgcggcctatttgtcccggcccggcccgacaaaagcgtcctcgaggggcaggtcttgcaacgccacaacttcgtgagccagcggtgcgctgcgctccagcgttacctctgccgccttgccgcgcaccccatcgtcggccagagccctggtctccgcacgttcctcacggagcctggtgccatccccgccttccagagtgaggcaccgcggtactggacaaccacggtgaatgctgctgctccgatggttcagatgaaagctgggagggacttgtttgggatgtttaagggtctcaagcagacgatggtgaatgggatggttgcaacaaagcctccacctgtggagcaggagacagatacagagttcctggcgcacaaggccaggttcgaggacttacaacagcagcttaccacaacatcacagcaggctgaagcgctcgttaaagcccaagatggttatagagaaactacaggtcacttgggaatgacattgattaagctggcaaaatttgaaagagagcaggcaacatgtaactccctaagaagacggtctggtgaaatccataactttgcaaattctgttttgaagatgagcaggtcacagataaaattgaactctgaaattgtgaaacacctgggtagtatccatgaatatttggagatgatgatatcagttcatcatgcatttacagatcgctctaatgctttacattacgtgcaaattctgtcagcagatttgttttccttgcatatcagggcaaggagacttgaatcgtcgtcagcaagagatatggggcacgagtggtcaacatatcagaaagtagaggggttgaaagaaacaataagatcagcggaagcagccaaaagtgatgcagttagagaatatgaaagtattaaggaaaacaacaagattgaaataaaaagatttgacaaggaaagacgccacgatttcatcgagatgctgaaaggttttgtgataactcaggtgtcttattcagaccattttgctaacatgtggacaaaggtaacggaggaaacagaagtatatgcaaacaggagcagctgatgtacgtatagggagtgtagaatagttgattttgatctatttaatttgctccaacatccaacgacaacaatcattcttattcttccccagttttgtcaccttgagttggttgtaaacttgtaatgccacatgagtcatgtgcagtcgtgaaattgggtcccggcagatgagcttctgtgctac

SEQ ID NO: 2412 - DNA, 2355 bp, Zea mays
actgccccatggcccattgcttacgcataactgcggcggggacacgcgacgctaccgacttcgccgccgcctccttccttccgcccgtcgagtcgaccgaccgattgttcgcgggtcgcggcctccctcctagtcagatccactcaatcccaagaggccaagtccaaaccctacccaccacccttctcaaccagcgatgatggcagcggagccctcgccgtcggttccctccaccgccgctgacgccctggaaaccctcgccctcgactcatcctcgtcgtccgccgccgctaccgcctccacttccaccgaccccctcctccggccacctacctccccgaccgccgccgcgagcgacgacccattcgtcatcgacgacttcgacgaggacgacttctccaccgccccggcgcccaacgtcgcccgccagccgcgcgctgcgcgtggtgatgcggcgtccccagtgttcgccaaaatcaccgtatcggatcccaagaagcacgcggagcccagcggcgggggtgccgccggtgtgatcccggggtccggtagctacttctcttacctcatcaccacccgtcttgcgggcggcggcggggaggtccgcgtgcggcggcgcttccgcgacgtggtgaccctcgcggaccgccttgccgcagcccaccgtggcctcttcgtcccggcccgacccgacaagagcgtcctcgaggggcaggtcatgcagcgccacgacttcgtgagccagcggtgcgctgcgctccagcgctacctccgccgccttgccgtgcaccccatcgtcggccacagccctgacctccgcacgttcctcacggagcctggtgccgtccctgcctttcagggtgagcccccgcggtactggactaccacgctgaatgctgctgctccgctggtgccaacgaaagctaggagggacttgtttgggatgtttaagggtctcaagcagacggtggtgaatggactggttgcaacaaagcctccacctgtggagcaggagacagacacagagttcctggcgcacaaggccaggtttgatgacttacagcagcagcttaccataacatcacagcaggcggaagcgcttgttaaagcccaagatgatcttagagaaactacaggtcacttgggaatgacattgattaagctggcaaaatttgaaagagagcaggcaacatgtaattccctaagaagacgtgctggtgaaatccataattttgcaaattctgttttaaagatgagcaggtcacagataaaattaaactctgaaatggtgaaacacctgggcagtatccatgaatacttggagatgatgatatcagttcatcatgcattcacagatcgctctaatgctttatattacgtgcaaagtctgtcagcagatttgttttccttgcacaccagggcagggggacttgaatcttcatcagcaagagatatggggcatgagtggtcaacatatcagaaggtagaggggttgaaagaagcaataagatctgcggaagcagccaaaagtgatgccgttagagaatatgaaagcattaaggaaaacaacatgattgaaataaaaagatttgacaaggaaagacgtcatgatttcattgagatgctgaaaggttttgtggtaactcaggtgtcttattcagaccattttgctaatatgtggacaaagtttgattatctttgtaggagggtattgttcaacaatctgctcaagttacatgagtacactgtctatacccgtactgcgttgcatcgccttctcgaactccggagagggagagagggcggagaaagcataggattcgaggttgtcacgctcgacggtagaactggacccctttcctcacgcaaggtttctaggtgagcgacaacatgaaccccagtgacttggtgaagctgattgagattctggacccttcaaacaaacctggaaggatcaccataattacaaggatgggggaagagaacatgagagtgaagttgcctcatctcatccgtgttgttcgcaatgctggattgattgtcacatggattactgatcctatgcatggaaacaccatcaaggccccttgtggcctgaagactcgtccattcgactcaattctggctgaagtgcgcgcattcttcgacgtgcatgatcaagaaggaagtcacccaggaggcatccaccttgaaatgactgggcagaacgtgaccgagtgcattggtggatcaaggactgtgaccttcgatgacctgagcgaccgctaccacacccactgtgacccaaggctgaacgcctcccagtccctggagctcgcctttgaagcgtcccggtcctctaggactcaaatgtga

SEQ ID NO: 2413 - DNA, 473 bp, Elaeis guineensis
cgcctctccagcctccactttccccatccttctccgccgtcgcggtcgcctcgcagtccgaagagcctccgactccgatggccagccgctgggtccgacccgaggtgtaccctctgttcgcggcgacgggcgtggccgtcggcatctgtggatttcagctcttcaggaacatcaccggcaacccggaagtcagggtaaacaaggcagggagggcagctggtgtccttgaaaatcatgaggaggggaggcgttacgcaatgcacggcctcaggagctttgtgcatgacaagacccctgaaatcatgccagcgattaacaagttcttcactgagccaaagtgaagcattttgcttggctgttgactgctctgcttaaatggctattgtcgattgtacccatgtcatccataaattgaagcacagccgatacctcttattgaaagtaccgtatgagtgcgattaggtacaaaaaaa

SEQ ID NO: 2414 - DNA, 697 bp, Saccharum officinarum
cgcctctccgctttcccccatccttctccgccgtcgccgtcgccgtcggccgcgtcccagtccgaagagcctccgactctgatggccagccgctgggtccgacccgaggtgtacccgctgttcgcggcgatgggcgtcgccgtcggcatctgcgggtttcagctcttccggaacatcaccggcaacccggaagtcagggtaaacaaggcaggaagggcagctggggtgcttgagaatcatgaggaggggagacgttacgcgatgcatggcctaagaagctttgtgcatgacaagacccctgaaattatgcctgctatcaacaagttcttcactgagccgaagtgaagcatgttgattggctgttgatggttctgctactagttgctattggggattgtacccttttctggcaattcaatatgttgtgccgtccataaattggaggacatctcttactcttataaagtaccgtatgaatgcttggtgatgacttgctatatgtatgatggtgaatgagtttgatcgtccctgtttgatgttcatgctcttctgtcatgtggatttgctgcacttcaatgataaaactggcagccaacgttcatttggatactgctaatggtatgtcgattttgtgtacctagggatgaaaatggatcggatacggatggatatcactgatattatatttgtttttatc

SEQ ID NO: 2415 - DNA, 601 bp, Zea mays
aaccgtcacttcggacgagaagctctaagcgaccacgcgccgataaaaaccgctcccacccactcgctccgctgccctgcccctcctccgccttttcgcctctctccactttccccgtccttcgccgtcgcggccgcgtcctagtctagtctgatggccagccgctgggtccgacccgaggtgtacccgctgttcgcggcgatgggagttgccgttggcatctgcgggtttcagctcttccggaacatcaccggcaacccggaagtcagggtaaacaaggcagggagggcagccggcgtgcttgagaaccatgaggaggggaggcgttacgccatgcatggcctcagaagctttgtgcacgacaagacccccgagatcatgccagctatcaacaagttctttactgaccccaagtgaagcaaagcagctttggttggccgctgatgacgatggttctgctactagttgcccttggggattgtgtaccctttttatggcaattcgatatgtgaatgagttcgacggtccctgtttgttcctcgtactcacctgtcatgtggatttgatgcacttaagtgataaaactgtcagccaacgttca

SEQ ID NO: 2416 - DNA, 1058 bp, Zea mays
ggggtggaggatgagaaatgattttatgtattagtagaattcgtttctactctgtaacttacatgacacactttgtctcactcctctgtagtaaaatgtagcacataaatatctctggcatcttactaataataatatacaaatatattttacataaaacataattaacttaattgatatatatctaaattactattattaagaaattagtttattttcctttagaaaaataggaattgcacggaaaatagagttcctaaactagtttatttttttagaaaaataaaaattacatgaaaaaatggaattttcaaactagcccttaaaataattccggcgtactcctatgaaaccaagtgggcaaccggaaggaaacaaaaagtgagagaaacgcgagggtagaaccgtcatttcgggcgagaagctccaaacgaccacaccgcacacgccgataaaaccgctccacccactccgcccactccccctctgccgtcgcctgtccactttccccgtgcttctccgccgtcgaggccgcgtcccagtgcgaagagaccacgactcagatggccagccgctgggtccggcccgaggtgtacccgctgttcgcggcgacgggcgtggccgtcggcatctgcggatttcagctcttccggaacatcaccggcaacccggaagtcagggtaaacaaggcagggagggcagctggtgtgcttgagaaccatgaggaggggaggcgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccctgacctctaaaagtactttgagtgcttggtgatgacttgctatatgtatgatggtggatgagtttgatcgtccatgcttgatgttcatattcatctgtcatctggatttgccgcacttcagtgataaaattgtcatttggatactg

SEQ ID NO: 2417 - DNA, 710 bp, Pennisetum glaucum
ccgccgtcgccactccagcatccactttccccatccttctccgccgtcgcggtcgcctcgcagtccgaagagccgccgactccgatggccagccgctgggtccgacccgaggtgtacccgctgttcgcggcgatgggcgtggccgtcggcatctgcgggtttcagctcttcaggaacatcaccggcaacccggaagtcagggtgaacaaggcagggagggcagctggggtgttagaaaatcacgaggaggggaggcgttacgcaatgcatggactcagaagctttgtgcatgacaagacccccgaaatcatgccatcgatcaacaagttcttcactgagccaaagtgaagcattttgcttggctgttgaatcgctattgtcgattgtacccatgtcatccataaattgaagcacagcagatacctcttattaatagtaccatatgtgatgacttcttatgtgtgtgatggttgatgagtgatgtgattggtatgactttgtgtgcgagggttgataagtgttgtgttacccatggttgattttcttgcttattgctgtgcctcacagccaggcaaaatgtccatttggttactgctactgatagcttggtgatgtgtgaaactgcaagcttgattgtacatcatcatgacttacatctacttggaaactgcaagcttgattgtacatcatcatgacttacatctacttgg

SEQ ID NO: 2418 - DNA, 710 bp, Panicum virgatum
tcgcctctccactttccccatccttctccgccgtcgcctctccactttccccatccttcgccgccgtcgcggtcgcctcgcagtccgaagagccgcccccgactccgatggccagccgctgggtccgacccgaggtgtacccgctgttcgcggcgatgggcgtggccgtcggcatctgcggatttcagctcttccggaacatcaccgggaacccggaagtcagggtaaacaaggcagggagggcagctggtgtgcttgagaaccatgaggaggggaggcgttacgcaatgcacagcctcagaagctttgtgcatgacaagaccccagaaatcatgccggccatcaacaagttcttcactgagccaaagtgaagcgatttgctcgggtgctgctgctggagtcgctattgtcgagtgtacccatttaaggcattcaatatgtaatgtcatccataaattggaggacagcggatacctcttattaaaagtaccgtgtgagtgattggtgatggcttgctatgtgtatgatggtttatgagtgctgcatcacccctgtttgatgttcatgctcatctgtcatgtggatttgctgtgcctcagtgataaattgccagccaacgttcatttggttactgctactgatgttatgtgatgtgcatcccatatgcagtctgttaaactgcgggcttgactatgcatcatcattacttc

SEQ ID NO: 2419 - DNA, 604 bp, Panicum virgatum
cctcctccgccgtcgcctctccactttccccatccttcgccgacgtcgcggtcgcctcgcagtccgaagagcccccgactccgatggccagccgctgggtccgacccgaggtgtacccgctgttcgcggcgatgggcgtggccgtcggcatctgcggatttcagctcttccggaacatcaccggcaacccggaagtcagggtaaacaaggcagggagggcagctggtgtgcttgagaatcatgaggaggggaggcgttacgcaatgcacagcctcagaagctttgtgcatgacaagacccctgaaataatgccatccatcaacaagttcttcactgagccgaagtgaagcgatttgctcgggtgctgctgctggagtcactattgtctagttcctattaaggcattcaatgtcatgtcatccataaattggaggacagcagatacctcttattaaaagtaccttatgagtgattggtgatggcttggtatgtgtatggtttatgagtgttgcatcacccctgtttgatgttcatgctcatctgtcatgtggatttgctgtgcctcagtgataaattgtcagccaacgctcatttggttactgct

SEQ ID NO: 2420 - DNA, 603 bp, Panicum virgatum
gccgtcgcctctccactttccccatccttcgccgccatcgcggtcgcctcgcagtccgaagagccgcccccgactccgatggccagccgctgggtccgacccgaggtgtacccgctgttcgtggcgatgggcgtggccgtcggcatctgcggatttcagctcttccggaacatcaccgggaacccggaagtcagggtaaacaaggcagggagggcagctggtgtgcttgagaaccatgaggaggggaggcgttacgcaatgcacagcctcagaagctttgtgcatgacaagaccccagaaatcatgccggccatcaacaagttcttcactgagccaaagtgaagcgatttgctcgggtgctgctgctggagtcgttattgtcgagtgtacccatttaaggcattcaatatgtaatgtcatccataaattggaagacagcggatacctcttattaaaagtaccgtgtgagtgattggtgatggcttgctatgtgtatgatggtttatgagtgctgtatcacccctgtttgctgttcatgctcatctgtcatgtggatttgctgtgccccagtgataaattgccagccaacgttcatttggttac

SEQ ID NO: 2421 - DNA, 591 bp, Triticum aestivum
ctccgccgtttcgcctctctccactttccccgtccttcgccgtcgcggccgcgtcctagtctagtctgatggccagccgctgggtccgacccgaggtgtacccgctgttcgcggcgatgggagttgccgttggcatctgcgggtttcagctcttccggaacatcaccggcaacccggaagtcagggtaaacaaggcagggagggcagctggtgtgcttgagaaccatgaggaggggaggcgttacgccatgcatggcctaagaagctttgtgcatgaaaagacccctgagatcatgcctgctattaacaagttcttcactgaccccaagtgaagcatgttgatggttctactgctacttgccattggggattgtacccttttctggcagttcgatgtgttgtgccgtccataaattggaagacatctcttactcttattaaaagtaccgtatgagtgcttggtaatggcttgctatatgtatgatggtgaatgagtttggtcgtccctctttgatgttcatactccagtcatctgtcatgtggatttgctgtgcttcaatgataaaactgtcagccaacgttcatttggat

SEQ ID NO: 2422 - DNA, 573 bp, Cynodon dactylon
cgccgcgctttcactttcccctcttcctcgcccgtcgccgtctcgtctcccggcgcgaagagccgctcagactctgatggccagccgttgggtcagacccgaggtgtacccgctgttcgcggcgatgggcgtggctgtcggcatctgcgggtttcaactcgtccgcaacatcaccggcaacccggaagtcagggttaacaaggcaggaagggcagcaggtgttcttgagaaccacgaggagggccggcggtacgcgatgcacagcctcagaagctttgtgcatgacaagactcctgagattatgcctgcgataaacaagttcttcacagaccccaagtgaatcataatgagtgggctatagactgttctactatatcatttgctgttgtgggttgtgtacccattccaggcatgctgtatgttgtgtcgtccataaactgggggacatctgagacctcttattcaaagtaccgtgctaccattgtgtgatgcaataatggtttgctatgtgtctgatgggcgtcacataatcctgttctgttaaatgttcatactcatgtgagttgctgtgca

SEQ ID NO: 2423 - DNA, 862 bp, Sorghum bicolor
cgtacgaaagcttaattcctgtgtactgcaaacagtgggcaaccggaagagaacaaaaagtgaacgaaaacgcgagggcagaaccgtcatttcggacgataagctccaagcggccactcgccgataaaaccgtcccacccactccgcccactccccctcctccgccgtcgcctctccactttcccccatccttctccgccgtcgccgtcgcggtcgcgtcccagtccgaagagcctccgactccgatggccaaccgctgggtccgacccgaggtgtacccgctgttcgcggcgatgggcgtggccgtcggcatctgcgggtttcagctcttccggaacatcaccggcaacccggaagtcagggtaaacaaggcagggagggcagctggtgtgcttgagaaccatgaggaggggaggcgttacgccatgcatggcctaagaagctttgtgcatgaaaagacccctgagatcatgcctgctattaacaagttcttcactgaccccaagtgaagcatgttgatggttctactgctacttgccattggggattgtacccttttctggcagttcgatgtgttgtgccgtccataaattggaagacatctcttactcttattaaaagtaccgtatgagtgcttggtaatggcttgctatatgtatgatggtgaatgagtttggtcgtccctctttgatgttcatactccagtcatctgtcatgtggatttgctgtgcttcaatgataaaactgtcagccaacgttcatttggatactcctggtatatcctgcgaagtgtgctccttatgcagtttgtgaagtttgaccaggcatctgcatgtcttgcatctccttgatgagatgttat

SEQ ID NO: 2424 - DNA, 827 bp, Sorghum bicolor
taattcctgtgtactgcaaacagtgggcaaccggaagagaacaaaaagtgaacgaaaacgcgagggcagaaccgtcatttcggacgataagctccaagcggccactcgccgataaaaccgtcccacccactccgcccactccccctcctccgccgtcgcctctccactttcccccatccttctccgccgtcgccgtcgcggtcgcgtcccagtccgaagagcctccgactccgatggccaaccgctgggtccgacccgaggtgtacccgctgttcgcggcgatgggcgtggccgtcggcatctgcgggtttcagctcttccggaacatcaccggcaacccggaagtcagggtaaacaaggcagggagggcagctggtgtgcttgagaaccatgaggaggggaggcgttacgccatgcatggcctaagaagctttgtgcatgaaaagacccctgagatcatgcctgctattaacaagttcttcactgaccccaagtgaagcatgttgatggttctactgctacttgccattggggattgtacccttttctggcagttcgatgtgttgtgccgtccataaattggaagacatctcttactcttattaaaagtaccgtatgagtgcttggtaatggcttgctatatgtatgatggtgaatgagtttggtcgtccctctttgatgttcatactccagtcatctgtcatgtggatttgctgtgcttcaatgataaaactgtcagccaacgttcatttggatactcctggtatatcctgcgaagtgtgctccttatgcagtttgtgaagtttgaccaggcatctgcatgtctt

SEQ ID NO: 2425 - DNA, 777 bp, Pennisetum glaucum
ctcaggcccttgcgaagaaggatcctgttccgccgtcgccactccagcatccactttccccatccttctccgccgtcgcggtcgcctcgcagtccgaagagccgccgactccgatggccagccgctgggtccgacccgaggtgtacccgctgttcgcggcgatgggcgtggccgtcggcatctgcgggtttcagctcttcaggaacatcaccggcaacccggaaggaacaaggcagggagggcagctggggtgttagaaaatcacgaggaggggaggcgttacgcaatgcatggactcagaagctttgtgcatgacaagacccccgaaatcatgccatcgatcaacaagttcttcactgagccaaagtgaagcattttgcttggctgttgaatcgctattgtcgattgtacccatgtcatccataaattgaagcacagcagatacctcttattaatagtaccatatgtgatgacttcttatgtgtgcgatggttgatgagtgatgtgagttgataagtgttgcgttacccatggttgattttcttgcttattgctgtgcctcacagccaggcaaaatgtccatttggttactgctactgatagcttggtgatgtgtgaaactgcaagcttgattgtacatcatcatgacttacatctacttggaaactgcaagcttgattgtacatcatcatgacttgcatctacttggtaaattcctacctcaaatgctagtatgtctggtcgatgttattggttgtgattttatagtgattcctg

SEQ ID NO: 2426 - DNA, 850 bp, Oryza sativa
ggaaaacagtgggcagcaccgcagcagcaaaggaagaaagcccccaaacgaaacgggtgaggggcattttcgtcattccatacaggtcacctccaaactcgccaagcgaaccacactgcgtcactgtgataaaagccgctctgcacccactccgtccacttcctctctctctctcctaccgtcgccttccactttcccctctctctctctctccgccgccgccgacgccgacgatggcctccagccgctgggtccgaccggaggtgtacccgctgttcgcggcgatgggcgtggccgtcggcatctgcggcttccagctcttccgcaacatcaccggcaaccccgaagtcagggttaacaaggtagggagggcagctggagtgctcgagaaccatgaggagggaaggcgctacgcagagcatgggctaagaaactatgtgcgcgacaagacccctgagatcatgccagctatcaacaagttcttcactgagccaacaaaatgatgaaggaatttagttggttgttgattgctctgctattagttactattgcggattgatttaatggattttacccatttcaagcattacatatgttgtctcatccataaatcggaggacatcaaatgcctcttgttggaagttaccatatgtgtttgtggtcaatgactagtcaaatgttctaatactatttgtctgatgattgatgagtgttacattaccctgcttgattctctatactcattgtctatatcatgtgaaattactgtacctacatgatggtatagtcaggaacaaggggaatgaactgcctttgcactgctgatgccgattggttgcaccgaattttg

SEQ ID NO: 2427 - DNA, 285 bp, Momordica charantia
accctctgttcgcggcgacgggcgtggccgtcggcatctgtggatttcagctcttcaggaacatcaccggcaacccggaagtcagggtaaacaaggcagggagggcagctggtgtccttgaaaatcatgaggaggggaggcgttacgcaatgcacggcctcaggagctttgtgcatgacaagacccctgaaatcatgccagcgattaacaagttcttcactgagccaaagtgaagcattttgcttggctgttgactgctctgcttaaatggctattgtcgattgt

SEQ ID NO: 2428 - DNA, 1022 bp, Brachypodium distachyon
aaaaggcccaatgctgttggcaaaaacaacaggcggaaaggtgaggacaagctcgtcatttcagcgaaggaagtcccaagtgtagaagcgagtgaggcgagcgaccacaccccggtaataaagccggctcacgcactccgcccactccctctcatccgccgtcgcctctcagctctcctctctctctttctccgccgccgcagtctccgaggaaacccccgcaacgccgatggccgccagcaaatgggtccggcccgaggtgtacccgctgttcgctgcgacgggcgtggccgtcggcatctgcgcgttccagctgctccgcaacatcactggcaacccggaagtcagggttagcaaggtagggagggcagcaggagtgcttgataatcatgaggaggggaggcgctacgctgagcatggtctcagaagctttgtgcgtgacaagacccccgagatcatgccaggtatcaacaagttcttcaccgacccaaagtgaagggtttggattcggctatgactcgccagtgcacaatgttgttctgctactattagttatgattgtgggtaaatgtaaacccgtgtgaagcattcagcaatgtttgactcgcccataatttggaggatatctgacagtgattacctcttattgaatgtgccatgtattggctgatggcttcctatataccgcaacaaatatcttatggtcgatggcttgaacatatatgttccaatgaagttgttcaatgtttgtgttcagtttagggctttttcatcggtggttggtactaattttcttttctccccttttaaaaatatgcttcctctctttttatttctttttcttgatggactcacatgtcattctcttttttttttctcggtaccccatgttgttacttcttcaattaactactaattccttgttactcatctgtcctctacattggcaactacctttttggtacccatgtaaaggtacccatgtagtaaccattgtcgaggatgttcttactgtcacgtgg

SEQ ID NO: 2429 - DNA, 720 bp, Brachypodium distachyon
aagctcgtcatttcagcgaaggaagtcccaagtgtagaagcgagtgaggcgagcgaccacaccccggtaataaagccggctcacgcactccgcccactccctctcatccgccgtcgcctctcagctctcctctctctctttctccgccgccgcagtctccgaggaaacccccgcaacgccgatggccgccagcaaatgggtccggcccgaggtgtacccgctgttcgctgcgacgggcgtggccgtcggcatctgcgcgttccagctgctccgcaacatcactggcaacccggaagtcagggttagcaaggtagggagggcagcaggagtgcttgataatcatgaggaggggaggcgctacgctgagcatggtctcagaagctttgtgcgtgacaagacccccgagatcatgccaggtatcaacaagttcttcaccgacccaaagtgaagggtttggattcggctatgactcgccagtgcacaatgttgttctgctactattagttatgattgtgggtaaatgtaaacccgtgtgaagcattcagcaatgtttgactcgcccataatttggaggatatctgacagtgattacctcttattgaatgtgccatgtattggctgatggcttcctatataccgcaacaaatatcttatggtcgatggcttgaacatatatgttccaatgaagttgttcaatgtttgtgttcagtttagggcttt

SEQ ID NO: 2430 - DNA, 699 bp, Secale cereale
tcacccgcaaccgccgtctccactctcccctctcccactcttcctccgccgccggcgcagcgtcctccccgcgacttcgatggccagcaagtgggtcaggcccgaggtgtacccgctgttcgcggcgacgggcgtcgccatcggcatctgcgccttcagcctcctccgcaacatcaccggcaaccccgaagtgagggtcaacaagatggggagggcagccggagtgcttgagaaccatgaggaagggaggcgctacgccgagcacggcctcagagcctatgtgcaggacaagacccccgagatcatgccaggaatcaacaagttcttcaccagcccgaaatgaagcgctttcgtctgtctgtgactcgctattagtaactgttgtggtcaagtgcaaacctatttcaagcattcagtaatgttgtcgcgtccataattcagaggatatcatcaagtacctcttattgaaagaaccatgtgatgtttgatgcttgctatatatgtggtcggtggcttcaaaatatccgtttcattgagattgccaatgttccatgcttgtgttgtggagatctgactggtagcttgtcaattactgcacacgtttggatattattacctccgtcctggtttataagtcctctttgtattttgtgccaaattttgactagagatttaactaataaaatatgaatacttgtc

SEQ ID NO: 2431 - DNA, 725 bp, Secale cereale
tctcacccgcaaccgccgtctccactctcccctctcccactcttcctccgccgccggcgcagcgtcctccccgcgacttcgatggccagcaagtgggtcaggcccgaggtgtacccgctgttcgcggcgacgggcgtcgccataggcatctgcgccttcagcctcctccggaacatcaccggcaacccagaagtcagggtcaacaagatggggagggcagctggagtgcttgagaaccatgaggaagggaggcgctacgccgagcacggcctcagagcctatgtgcaggacaagacccctgagatcatgccaggaatcaacaagttcttcaccagcccgaaatgaagcgctttagtctgtctgtgactcgctattagtaactgttgtggtcaagtgcaaacctatttcaagcattcagtaatgttgtcgcgtccataattcagaggatatcatcaagtacctcttattgaaagaaccatgtgatgtttgatggcttgctatatatgtgatggccgttggcttcaaaatatctgtttccatgcttgcgtttagttgctgtgttgtcgagatctgactggtagctcgtcgattattgcacacgtttggatattattactactgctggtattttcaagtgtgttcaagtcatgacagtagcttgtacacaactcctttggaatctgtaatttttgtgaagaatgtgtgcacagacccaaaaaaaaaaa

SEQ ID NO: 2432 - DNA, 461 bp, Secale cereale
agcgtcctcaccgcgactccgatggccagcaagtgggtcaggcccgaggtgtacccgctgttcgcggcgacgggcgtcgccataggcatctgcgccttcagcctcctccggaacatcaccggcaacccagaagtcagggtcaacaagatggggagggcagctggagtgcttgagaaccatgaggaagggaggcgctacgccgagcacggcctcagagcctatgtgcaggacaagacccctgagatcatgccaggaatcaacaagttcttcaccagcccgaaatgaagcgctttagtctgtctgtgactcgctattagtaactgttgtggtcaagtgcaaacctatttcaagcattcagtaatgttgtcgcgtccataattcagaggatatcatcaagtacctcttattgaaagaaccatgtgatgtttgatggcttgctatatatgtgatggccgttggct

SEQ ID NO: 2433 - DNA, 515 bp, Secale cereale
ctctcacccgcaaccgccgtctccactctcccctctcccactcttcctccgccgccggcgcagcgtcctccccgcgactccgatggccagcaagtgggtcaggcccgaggtgtacccgctgtttgcggcgacgggcgtcgccatcggcatctgcgccttcagcctcctccgcaacatcaccggcaacccagaagtcagggtcaacaagatggggagggcagctggagtgcttgagaaccatgaggaagggaggcgctacgccgagcacggcctcagagcctatgtgcaggacaagacccctgagatcatgccaggaatcaacaagttcttcaccagcccgaaatgaagcgctttagtctgtctgtgactcgctattagtaactgttgtggtcaagtgcaaacctatttcaagcattcagtaatgttgtcgcgtccataattcagaggatatcatcaagtacctcttattgaaagaaccatgtgatgtttgatggcttgctatatatgtgatggcc

SEQ ID NO: 2434 - DNA, 589 bp, Secale cereale
actccctctcacccgcaaccgccgtctccactctcccctctcccactcttcctccgccgccggcgcagcgtcctccccgcgacttcgatggccagcaagtgggtcaggcccgaggtgtacccgctgttcgcggcgacgggcgtcgccatcggcatctgcgccttcagcctcctccgcaacatcaccggcaaccccgaagtgagggtcaacaagatggggagggcagctggagtgcttgagaaccatgaggaagggaggcgctacgccgagcacggcctcagagcctatgtgcaggacaagacccctgagatcatgccaggaatcaacaagttcttcaccagcccgaaatgaagcgctttagtctgtctgtgactcgctattagtaactgttgtggtcaagtgcaaacctatttcaagcattcagtaatgttgtcgcgtccataattcagaggatatcatcaagtacctcttattgaaagaaccatgtgatgtttgatggcttgctatatatgtgatggccgttggcttcaaaatatctgtttccatgcttgcgtttagttgctgtgttgtcgagatctgactggtagct

SEQ ID NO: 2435 - DNA, 568 bp, Secale cereale
ccctctcacccgcaaccgccgtctccactctcccctctcccactcttcctccgccgccggcgcagcgtcctccccgcgacttcgatggccagcaagtgggtcaggcccgaggtgtacccgctgttcgcggcgacgggcgtcgccatcggcatctgcgccttcagcctcctccgcaacatcaccggcaaccccgaagtgagggtcaacaagatggggagggcagccggagtgcttgagaaccatgaggaagggaggcgctacgccgagcacggcctcagagcctatgtgcaggacaagacccctgagatcatgccaggaatcaacaagttcttcaccagcccgaaatgaagcgctttcgtctgtctgtgactcgctattagtaactgtgtggtcagtgcaaactatttcaagcattcagtaatgttgtcgcgtccataattcagaggatatcatcaagtacctcttattgaaagaaccatgtgatgtttgatgcttgctatatatgtggtcgtggcttcaaaatacccgtttcattgagattgccaatgttccatgcttgtgttgtgga

SEQ ID NO: 2436 - DNA, 660 bp, Secale cereale
tcctccgccgccggcgcagcgtcctccccgcgactccgatggccagcaagtgggtcaggcccgaggtgtacccgctgttcgcggcgacgggcgtcgccatcggcatctgcgccttcagcctcctccgcaacatcaccggcaacccagaagtcagggtcaacaagatggggagggcagccggagtgcttgagaaccatgaggaagggaggcgctacgccgagcacggcctcagagcctatgtgcaggacaagacccccgagatcatgccaggaatcaacaagttcttcaccagcccgaaatgaagcgctttcgtctgtctgtgactcgctattagtaactgttgtggtcaagtgcaaacctatttcaagcattcagtaatgttgtcgcgtccataattgagaggatatcatcaagtacctcttattgaaagaaccatgtgatgtttgatgcttgctatatatgtggtcggtggcttcaaaatatccgtttcattgagattgccaatgttccatgcttgtgttgtggagatctgactggtagcttgtcgattactgcacacgtttggatattactacctccgtcctggttcataagtcctctttgtattttgtgccaaattttgactagagatttaactaataaaatatgaatacttgtcac

SEQ ID NO: 2437 - DNA, 522 bp, Secale cereale
tccgccgccggcgcagcgtctccccgcgactccgatggccagcaagtgggtcaggcccgaggtgtacccgctgttcgcggcgacgggcgtcgccatcggcatctgcgccttcagcctcctccgcaacatcaccggcaacccagaagtcagggtcaacaagatggggagggcagccggagtgcttgagaaccatgaggaagggaggcgctacgccgagcacggcctcagagcctatgtgcaggacaagacccccgagatcatgccaggaatcaacaagttcttcaccagcccgaaatgaagcgctttcgtctgtctgtgactcgctattagtaactgttgtggtcaagtgcaaacctatttcaagcattcagtaatgttgtcgcgtccataattgagaggatatcatcaagtacctcttattgaaagaaccatgtgatgtttgatgcttgctatatatgtggtcggtggcttcaaaatatccgtttcattgagattgccaatgttccatgcttgtgttgtgga

SEQ ID NO: 2438 - DNA, 468 bp, Secale cereale
ccgccggcgcagcgtcctccccgcgactccgatggccagcaagtgggtcaggcccgaggtgtacccgctgttcgcggcgacgggcgtcgccatcggcatctgcgccttcagcctcctccgcaacatcaccggcaacccagaagtcagggtcaacaagatggggagggcagccggagtgcttgagaaccatgaggaagggaggcgctacgccgagcacggcctcagagcctatgtgcaggacaagacccccgagatcatgccaggaatcaacaagttcttcaccagcccgaaatgaagcgctttcgtctgtctgtgactcgctattagtaactgttgtggtcaagtgcaaacctatttcaagcattcagtaatgttgtcgcgtccataattgagaggatatcatcaagtacctcttattgaaagaaccatgtgatgtttgatgcttgctatatatgtggtcggtggctt

SEQ ID NO: 2439 - DNA, 475 bp, Secale cereale
ccgccgtcgcagcgtcctccccgcgactcggatggccagcaagtgggtcaggcccgaggtgtacccgctgttcgcggcgacgggcgtcgccatcggcatctgcgccttcagcctcctccgcaacatcaccggcaacccagaagtcagggtcaacaagatggggagggcagccggagtgcttgagaaccatgaggaagggagacgctatgccgagcacggcctcagagcctatgtgcaggacaagacccccgaaatcatgccaggaatcaacaagttcttcaccagcccgaaatgaagcgctttagtctgtctgtgactcgctattagtaactgtctgtttgtggtcaagtgcaaacctatttcaagcattcagtaatgttgtcgcgtccataattcagaggatatcatcaagtacctcttattgaagaaccatgtgatgtttgatggcttgctatatatgtgatggtcgatggct

SEQ ID NO: 2440 - DNA, 452 bp, Secale cereale
gccggcgcagcgtcctccccgcgactccgatggccagcaagtgggtcaggcccgaggtgtacccgctgttcgcggcgacgggcgtcgccatcggcatctgcgccttcagcctcctccgcaacatcaccggcaacccagaagtcagggtcaacaagatggggagggcagcgggagtgcttgagaaccatgaggagggcaggcgctacgccgagcatggcctcagagcctatgtgcaggacaagacccccgagatcatgccaggaatcaacaagttcttcaccagcccgaaatgaagcactttagcctgtcagtggctcgctattagtaactgttgtggtcaagtgcaaacctatttcaagcattcagtaatgttgtcgcgtccataattcagaggatatcatcaagtgcctcttattgaaagaaccatgtgatgtttgatggcttgctatata

SEQ ID NO: 2441 - DNA, 631 bp, Triticum aestivum
cgccgccggcgcagcgtcctccccgcgactccgatggccagcaagtgggtcaggcccgaggtgtacccgctgttcgcggcgacgggcgtggccatcggcatctgcgccttcagcctcctccgcaacatcaccggcaacccagaagtcagggtcaacaagatggggagggcagcaggagtgcttgagaaccatgaggagggcaggcgctacgccgagcacggtctcagagcctatgtgcaggacaagacccccgagatcatgccaggaatcaacaagttcttcaccagcccgaaatgaagcactttagtctctctgtgactcgctattagcaactgttgtggtcaagtgcaaacctatttcaagcattcagtaatgttgtcgcgtccataattcagaggatatcataaagtacctcttattgaaagaaccatgtgatgtttgatggcttgctatatatgtgatggttgatggcttcaaaatatctgtttcattgagattgtggatattccatgcttccgtttagttgctgtgttgtggttgtggagacctcagtggtagctcggcgattactgcagacatttggatattgctattgctggtattttgaagtgtgttcctgtcttaacagtag

SEQ ID NO: 2442 - DNA, 544 bp, Pseudoroegneria spicata
ccgccgtcgcctctccactttcctttcctctccctcactcactctccccctccgccgccggcgcagcgtcctccccgcgactccgatggccagcaagtgggtcaggcccgaggtgtacccgctgttcgcggcgacgggcgtggccatcggcatctgcgccttcagcctcctgcgcaacatcaccggcaacccagaagtcagggtcaacaagatggggagggcagccggagtgcttgagaaccatgaggagggcaggcgctacgccgagcacggcctcagagcctatgtgcaggacaagacccccgagatcatgccaggaatcaacaagttcttcaccagcccgaaatgaagcactttagtctgtctgtgactcgctattagtaactgttgtggtcaagtgcaaacctatttcaagcattcagtaatgttgtcgcgtccataattcagaggatatcatcaagtacctcttattgaaagaaccatgtgatgtttgatggcttgctatatatgtgatggttggtggctataaaatatccgtttcata

SEQ ID NO: 2443 - DNA, 706 bp, Triticum aestivum
ggagtagaaactcaaccgccgtcgcgtctccactttcctctccatctcactcactctctccctccgccgccggcgcagcgtcctccccgcgactccgatggccagcaagtgggtcaggcccgaggtgtacccgctgttcgcggcgacgggcgtggccatcggcatctgcgcctttagcctccttcgcaacatcaccggcaacccagaagtcagggtcaacaagatggggagggcagcgggagtgcttgagaaccatgaggagggcaggcgctacgccgagcacggcctcagagcctatgtgcaggacaagacccccgagatcatgccaggaatcaacaagttcttcaccagcccaaaatgaagcactttagtctgtctgtgactcgcaattagtaactgttgtggtcaagtgcaaacctatttcaagcattcagtaatgttgttgcgtccataattcagaggacatcgtcaattacctcttattgaaagaaccatgtgatgtttgatggcttgctatatatgtgatggttgatggcttctaaatatctgcttcattgagattgtggatattccatgcttccgtgtagttgctgtgttgtggttgtggagacctcagtggtagctcagcgattactgcagacatttggatattgctactgctggtattttgaagtgtgttcctgtcttagcagtatctttcacacaa

SEQ ID NO: 2444 - DNA, 524 bp, Triticum aestivum
caaccgccgtcgcctctccactttcgtctctctcactcactctccccctccgccgccggcgcagcgtcctccccgcgactccgatggccagcaagtgggtcaggcccgaggtgtacccgctgttcgcggcgacgggcgtcgccatcggcatctgcgccttcagcctcctccgcaacatcaccggcaacccagaagtcagggtcaacaagatggggagggcagcgggagtgcttgagaaccatgaggagggcaggcgctacgccgagcatggcctcagagcctatgtgcaggacaagacccccgagatcatgccaggaatcaacaagttcttcaccagcccgaaatgaagcactttagcctgtcagtggctcgctattagtaactgttgtggtcaagtgcaaacctatttcaagcattcagtaatgttgtcgcgtccataattcagaggatatcatcaagtgcctcttattgaaagaaccatgtgatgtttgatggcttgctatatatgtgatggttgatggctt

SEQ ID NO: 2445 - DNA, 578 bp, Triticum aestivum
gcgactggagcacgaggacactgacatggactgaaagagtagaaactcacccgcaaccgccgtcgcctctccactttcgtctctctcactcactctccccctccgccgccggcgcagcgtcctccccgcgactccgatggccagcaagtgggtcaggcccgaggtgtacccgctgttcgcggcgacgggcgtggccatcggcatctgcgccttcagcctcctccgcaacatcaccggcaacccagaagtcagggtcaacaagatggggagggcagcaggagtgcttgagaaccatgaggagggcaggcgctacgccgagcacggtctcagagcctatgtgcaggacaagacccccgagatcatgccaggaatcaacaagttcttcaccagcccgaaatgaagcactttagtctgtctgtgactcgctattagcaactgttgtggtcaagtgcaaacctatttcaagcattcagtaatgttgtcgcgtccataattcagaggatatcataaagtacctcttattgaaagaaccatgtgatgtttgatggcttgctatatatgtgatggttgatggcttc

SEQ ID NO: 2446 - DNA, 844 bp, Triticum aestivum
catttcagccaagcaactccgagcgactgagcaaccacacccgcacaataaagccggctcacgcactccgcccactccctctcaaccgccgtcgcgtctccactttcctctccatctcactcactctccccctccgccgccggcgcagcgtcctccccgcgactccgatggccagcaagtgggtcaggcccgaggtgtacccgctgttcgcggcgacgggcgtggccatcggcatctgcgcctttagcctccttcgcaacatcaccggcaacccagaagtcagggtcaacaagatggggagggcagcgggagtgcttgagaaccatgaggagggcaggcgctacgccgagcacggcctcagagcctatgtgcaggacaagacccccgagatcatgccaggaatcaacaagttcttcaccagcccaaaatgaagcactttagtctgtctgtgactcgcaattagtaactgttgtggtcaagtgcaaacctatttcaagcattcagtaatgttgttgcgtccataattcagaggacatcgtcaattacctcttattgaaagaaccatgtgatgtttgatggcttgctatatatgtgatggttgatggcttctaaatctgcttcattgagattgtggatattccatgcttccgtgtagttgctgtgttgtggttgtggagacctcagtggtagctcagcgattactgcagacatttggatattgctactgctggtattttgaagtgtgttcctgtcttagcagtatctttcacacaactcctttggaatttgtcaattctgtgagcatgtatgcgctgtggtatttgtgggtatggaaaatgactgt

SEQ ID NO: 2447 - DNA, 651 bp, Triticum aestivum
agcgactgagcaaccacacccgcacaataaagccggctcacgcactccgcccactccctctcacccgcaaccgccgtcgcctctccactttcgtctctctcactcactctccccctccgccgccggcgcagcgtcctccccgcgactccgatggccagcaagtgggtcaggcccgaggtgtacccgctgttcgcggcgacgggcgtggccatcggcatctgcgccttcagcctcctccgcaacatcaccggcaacccagaagtcagggtcaacaagatggggagggcagcaggagtgcttgagaaccatgaggagggcaggcgctacgccgagcacggtctcagagcctatgtgcaggacaagacccccgagatcatgccaggaatcaacaagttcttcaccagcccgaaatgaagcactttagcctctctgtgactcgctattagcaactgttgtggtcaagtgcaaacctatttcaagcattcagtaatgttgtcgcgtccataattcagaggatatcataaagtacctcttattgaaagaaccatgtgatgtttgatggcttgctatatatgtgatggttgatggcttcaaaaaaaaaaaaaaaaactcgagacctcggccgcgaccacgctaatcactagtgaattc

SEQ ID NO: 2448 - DNA, 538 bp, Lolium multiflorum
gactcacctcacccgccgtcgcctctcctccactttcctctcgcatcgtccgccgccgccgccgctgccgactccgatggccgccagcaagtgggtccggcccgaggtgtacccgctgttcgcggcgaccggcgtggccgtgggaatctgcttcttcagcctgttccgcaacatcaccggcaaccccgaagtgagggtcagcaaggttgggagggcagctggagtgctggagaaccacgaggaggggaggcgctacgccgagcacggtctcagggcctttgtgcagaacaagacccccgagatcatgccaggaatcaacaagttcttcaccgacccgaaatgaagcatcctactctggctatgagctggctggtcgaaatgtggcaccactattagtaactgttgtggtcaaatgtaaaacccaattcgagtaatttggagatgtcaaagtaactcttattgaaagtagaaccatgaattgcttgatggcttttctatgtatgtgagatggctgatggcttgaaatatgcgttctgtt

SEQ ID NO: 2449 - DNA, 512 bp, Avena sativa
ccgtcgcagcctcctccccgcgactccgatggccgccagcaagtgggtccggcccgaggtgtacccgctgttcgcggcgacgggcgtggccgtcggcatctgcgtgttcagcctcttccgcaacatcaccggcaaccccgaagtgagggtcagcaaggtggggagggcagctggagtcctagagaaccatgaggagggaagacgctatgccgagcatggtctccgagcctttgtgcagaacaagacccccgagatcatgccaggaatcaacaagttcttcaccggcccgaaatgaagcacatcctagtttggctatggtttggctggtcaaaatgtcactctgctataagtaacccgatgtggtcaagcgtaaacccagttcaagcattctgtgatatgtaattgcgtccataatttgaagatgtcaagtactacctcttattgaaagtaccatgtactgcttgatggcttgctgtatgtcaagatggttgatggtttgaaatatgtgctct

SEQ ID NO: 2450 - DNA, 773 bp, Avena sativa
ctcctccactttcctctctctctcttagtttccgccgccgcagtctccgtcgcagcgtcctccccgcgactccgatggccgccagcaagtgggtccggcccgaggtgtacccgctgttcgcggcgacgggcgtggccgtcggcatctgcgtgttcagcctcttccgcaacatcaccggcaaccccgaagtgagggtcagcaaggtggggagggcagctggagtcctagagaaccatgaggaggggaggcgctatgccgagcatggtctccgagcttttgtgcagaacaagacccccgagatcatgccaggaatcaacaagttcttcaccgacccgaaataaagcacctcctagtttggctatgattcggctggtcaaatgtcgctatgctataagtaaccgttgtggtcaagcgtaaacccagttcatgcattctgtgatgtgtaattgcgtccataatttgaagatgtcaagtacctcttattgaaagtaccatgtactgcttgatggcttgctatatgtcaagatggttgatggcttgaaatatgtgctctgttgaaatccctgaatgtttgcacttggttactgtcgtgcagaaaccttgatggtgggagcttgtcaataactgccaacatttggatattgctgatggtaatttgaactgtgctgccgtctttcagtatcactaacacaaattcttttgtaaatagttggtttggtttttttaggtctttggttatgtgctgtcatgatgagttgtggtatttgtgatgt

SEQ ID NO: 2451 - DNA, 751 bp, Hordeum vulgare
ctctctccccctccgccgccggcgcagcgtcatccccgcgcgcgactccgatggccagcaagtgggtccgtcccgaggtgtacccgctcttcgcggcgacgggcgtcgccatcggcatctgcgccttcagcctcctccgcaacatcaccggcaacccagaagtcagggtcagcaagatggggagggcagcaggagtgcttgagaaccatgaggagggcaggcgctacgccgagcacggcctcagagcctacgtgcaggacaagacccccgagatcatgccaggaatcaacaagttcttcaccagcccgaaatgaagcactttagactgtctgtctgtgactcgctattagcaactgttgtggtcaagtgcaaacctatttcaagcattcagtaatgttgttgcgtccataattcagaggatatcatccagtacctcttaatgaaagaaccatgtgatgtttgttggcttgctatatatgtgatggttggtggctataaaatacctgtatcatagagatcgttcaatgtttaaaaaaaaaaaaaaaaaattaaaaaaaaaaaaaaaaaaaaaaaattttgggggggccccgggccccaaatcccccttttgggggcgctttattcccccgttatattgggcccttttttaaaaatccctctatctcctatttctcacttcttccctcatctcttctctcttccaccttaccggtccgctctggttggcctacccctcgctggattttcacca

SEQ ID NO: 2452 - DNA, 738 bp, Hordeum vulgare
ccactcccccctctctccccctccgccgccggcgcagcgtcatccccgcgcgcgactccgatggccagcaagtgggtccgtcccgaggtgtacccgctcttcgcggcgacgggcgtcgccatcggcatctgcgccttcagcctcctccgcaacatcaccggcaacccagaagtcagggtcagcaagatggggagggcagcaggagtgcttgagaaccatgaggagggcaggcgctacgccgagcacggcctcagagcctacgtgcaggacaagacccccgagatcatgccaggaatcaacaagttcttcaccagcccgaaatgaagcactttagactgtctgtctgtgactcgctattagcaactgttgtggtcaagtgcaaacctatttcaagcattcagtaatgttgttgcgtccataattcagaggatatcatccagtacctcttaatgaaagaaccatgtgatgtttgttggcttgctatatatgtgatggttggtggctataaaatacctgtatcatagagatcgttcaatgtttcatgtttgtgcttagttgttttgttgcgcaggcctcagtggtagctcgttgatgtgtgtgcacatttgggtgttgctgcttgtattttgaagcatgttcctgtcttaacagtatcttggacataactcctttggaatttgtgaattttgtgagcatgtatgcgctgtgagcatggaaaatgactgtcctgtaagttaa

SEQ ID NO: 2453 - DNA, 574 bp, Leymus cinereus x Leymus triticoides
gccgctccactttcctctctcactctctctctcccctccgccgccggcgcagcgtcctccccgcgactccgatggccagcaagtgggtcaggcccgaggtgtacccgctgttcgcggcgacgggcgtggccatcggcatctgcgccttcagcctcctccggaacatcaccggcaacccagaagtcagggtcagcaagatagggagggcagcgggagtgcttgagaaccatgaggaaggcaggcgctacgccgagcacggcctcagagcctatgtgcaggacaagacccctgagatcatgccaggaatcaacaagttcttcaccagcccgaaatgaagcacttcagtttgtctgtggctcgctattagtaactgctgtggtcaagtacaaacctatttcaagcattcagtaatgttgtcgcgtccataattcagaggatataatcaagtactagtacctcttattgaaagaaccatgtgatgtttgatggcttgctatatatgtgatggttggtggcctcaaaatacccgtttcattgagaatgcttaatgtttcatgtttgtgcctaaaaaaaa

SEQ ID NO: 2454 - DNA, 523 bp, Secale cereale
tctcacccgcaaccgccgtctccactctcccctctcccactcttcctccgccgccggcgcagcgtcctccccgcgactccgatggccagcaagtgggtcaggcccgaggtgtacccgctgtttgcggcgacgggcgtcgccatcggcatctgcgccttcagcctcctccgcaacatcaccggcaacccagaagtcagggtcaacaagatggggaggcagctggagtgcttgagaaccatgaggaagggaggcgctacgccgagcacggcctcagagcctatgtgcaggacaagacccctgagatcatgccaggaatcaacaagttcttcaccagcccgaaatgaagcgctttagtctgtctgtgactcgctattagtaactgttgtggtcagtgaaaacctattcaagcattcagtaatgttgtcgcgtccataattgagaggatatacaaataaaacaaaagtacctcttattagaaagaaccatgtgattgtttgatgcttgcttatatatgtggtcggtg

SEQ ID NO: 2455 - DNA, 520 bp, Festuca arundinacea
  misc_feature (11)..(11): n is a, c, g, or t
  misc_feature (13)..(13): n is a, c, g, or t
  misc_feature (18)..(19): n is a, c, g, or t
  misc_feature (21)..(21): n is a, c, g, or t
  misc_feature (33)..(34): n is a, c, g, or t
  misc_feature (36)..(37): n is a, c, g, or t
  misc_feature (45)..(45): n is a, c, g, or t
  misc_feature (55)..(55): n is a, c, g, or t
  misc_feature (60)..(60): n is a, c, g, or t
  misc_feature (128)..(128): n is a, c, g, or t
  misc_feature (134)..(134): n is a, c, g, or t
  misc_feature (140)..(140): n is a, c, g, or t
  misc_feature (143)..(143): n is a, c, g, or t
  misc_feature (161)..(161): n is a, c, g, or t
  misc_feature (255)..(255): n is a, c, g, or t
  misc_feature (275)..(275): n is a, c, g, or t
  misc_feature (282)..(282): n is a, c, g, or t
  misc_feature (353)..(353): n is a, c, g, or t
  misc_feature (358)..(358): n is a, c, g, or t
  misc_feature (365)..(365): n is a, c, g, or t
  misc_feature (375)..(375): n is a, c, g, or t
  misc_feature (380)..(380): n is a, c, g, or t
  misc_feature (392)..(392): n is a, c, g, or t
  misc_feature (408)..(408): n is a, c, g, or t
  misc_feature (443)..(443): n is a, c, g, or t
ggcacgagggncnccctnncnctttcctctccnncnnccgccgcngccgtcgcancgtcntccccgcgactccgatggccgccagcaagtgggtccggcccgaggtgtacccgctgttcgcggcgacnggcgtngccgtnggnatctgcttcttcagcctntttcgcaacatcaccggcaaccccgaagtgagggtcagcaaggttgggagggcagctggagtgctggagaaccacgaggaggggaggcgctacnccgagcacggtctcagggcntttgtgnagaacaagacccccgagatcatgccaggaatcaacaagttcttcaccgacccgaaatgaagcatcctagtntggcnatgagtnggctggtcanaatgncgcgctgctatnagtaactgttgtggtnaaatgtaaaacccaattcgagtaatttggagatgncaaaataactcttattgaaagtagaaccatgaattgcttgatggcttttctatatatgtgagatggttgatggcttg

SEQ ID NO: 2456 - DNA, 570 bp, Triticum aestivum
gcgactggagcacgaggacactgacatggactgaaggagtagaaactctcaaccgccgtcgcgtctccactttcctctccatctcactcactctctccctccgccgccggcgcagcgtcctccccgcgactccgatggccagcaagtgggtcaggcccgaggtgtacccgctgttcgcggcgacgggcgtggccatcggcatctgcgcctttagcctccttcgcaacatcaccggcaacccagaagtcagggtcaacaagatggggagggcagcgggagtgcttgagaaccatgaggagggcaggcgctacgccgagcacggcctcagagcctatgtgcaggacaagaccccgaagatcatgccaggaatcaacaattcttcaccagcccaaaatgaacactttatctgtctgtgactcgcaattagtaactgttgtgggcaaagtgcaaacctatttcaagcattcaataatgttgttgcgtccataattcagaggacatcgtcaattacctcttattgaaaagaacatgtgatgtttgatggcttgctatatatgtgatggctgatgg

SEQ ID NO: 2457 - DNA, 623 bp, Secale cereale
agcaagtgggtcaggcccgaggtgtacccgctgttcgcggcgacgggcgtcgccatcggcatctgcgccttcagcctcctccgcaacatcaccggcaacccagaagtcagggtcaacaagatggggagggcagctggagtgcttgagaaccatgaggaagggaggcgctacgccgagcacggcctcagagcctatgtgcaggacaagacccctgagatcatgccaggaatcaacaagttcttcaccagcccgaaatgaagtgctttagtctgtctgtgactcgctattagtaactgttgtggtcaagtgcaaacctatttcaagcattcagtaatgttgtcgcgtccataattcagaggatatcatcaagtacctcttattgaaagaaccatgtgatgtttgatggcttgctatatatgtgatggccgttggcttcaagatatctgtttccatgcttgcgtttagttgctgtgttgtcgagatctgactggtagctcgttgattattgcacacgtttggatattattactactgctggtattttcaagtgtgttcatgtcatgacagtagcttgtacacaactcctttggaatctgaattttgtgagaatgtgtgcacagccc

SEQ ID NO: 2458 - DNA, 544 bp, Saccharum officinarum
ccgaagagcctccgactctgatggccagccggtgggttcgacccgaggtgtacccgctgttcgcggcgatgggcgtctgcgtctgcatctgccggtttcagctcttccggaacatcaccggcaacccggatgtcagggtaaacacggcaggaagggcagctggggtgctggagaatcatgaggaggggagacgtgacgcgatgcatggcctaaaaggcttcgtgcatgacaagacctgtgacagtatgcctgctatcagcaagttcttctctgagtcgaagtgaagcatgttgatcggatgctgacggtactgctactaatggctattgaggattgcaccctcatctggctatactatatagcgggccgtacataaattggaggacatgtcttactctgataaagtaccggctgaatgctcggcgatgatgtctgatggtgaatgagatctgaaccgtcctgcgggatgacgatgctgttgtgtcatgtcgatgtgcggctcttgcctgatataactgaatatctgcgtttatctggattctgg

SEQ ID NO: 2459 - DNA, 1065 bp, Triticum aestivum
tttcaataagaggtaattgacgatgtcctctgaattatggacgcaacaacattactgaatgcttgaaataggtttgcacttgaccacaacagttactaattgcgagtcacagacagactaaagtgcttcattttgggctggtgaagaacttgttgattcctggcatgatctcgggggtcttgtcctgcacataggctctgaggccgtgctcggcgtagcgcctgccctcctcatggttctcaagcactcccgctgccctccccatcttgttgaccctgacttctgggttgccggtgatgttgcgaaggaggctaaaggcgcagatgccgatggccacgcccgtcgccgcgaacagcgggtacacctcgggcctgcacgcaccaagaaacgagacagattaagaaaacacgcggaggcagagagaatcaaatggcgttcagcgaggcgcaggaggagctggtcctgcgctcatggaaagccatgaagccggactccgaatccatcgctctcaagttcttcctcaggatcttcgagatcgcgccggcggccaagccgatgttcccgttcctgcgcgacgccggcgaggacgcgccgctcgagagccacccgaagctcaaggcgcacgccgtgaccgtcttcgtcatggcctgcgagtcggccacgcagctgcgcaagaccggcgacgtcaaggtgagggaggccacgctgaggcgcctcggcgccacccacgtcagggccggcgtcgccgacgcgcacttcgaggtggtgaagacggcgctgctggacaccatcgagggcgccgtccccgagatgtggacgccggagatgaaggccgcctgggaggaggcctacgaccagctcgccgccgccatcaaggaggagatgaagcttgctgcggcggcttgatggcacgcatggactctgctttcatgagctctctgttgtgatatgtcatgtgtgtgctgtaccgtaagcgctgccataacgacaagtgaggcagccaaaaaaatcactgttttatataatcccgattatcaatatattaattccttcggttaaaaaaaa

SEQ ID NO: 2460 - DNA, 2025 bp, Panicum virgatum
gttcgagacacgccatacgacacggatagagacgacaacgccgcagcgcgaggacgacgacgaccacctcctctgaggccatggcgcagctgccgtctgggagcgtcgaggcggagctcgtcccgacgctctcctcgctggagccggtctacggcgagggctcccagctcgacgaggcgcggctccgcttcgcgcgcctcggggaccgcttccaggccgtccacggcgcccgcccagcgctcttcgcccgctccccagggagggtgaatctgatcggggagcacatcgactacgagggctactcggtgctgcccatggccatccgccaggacatgatcgtcgcgatccggaaggcagacggcggccaggtgcgggtcgccaatgtcgacgacaagtaccccgtctgcgtctacccggccgaccccgacaaggaaattgacataaaaaaccacaaatgggggcactatttcatgtgtggatacaagggcgtatatgaatattgtagatcaaaagggatagatctgggcaaacctgttgcgcttgatgttgttgttgacggcacagtacctcaaggatctggtctgtcaagctctgcagcatttgtctgttcagcaacaattgctatcatgggggtccttgagaaaaacttcccaaagaaagaagttgctcaattcacgtgtctgtccgagcgccacattggaacacagtctggaggtatggatcaggctatatcaatcatggccaaacctggattcgctgagttgatagacttcaacccaatccatgcaactgatgtccaactacctcgaggtggtacatttgttattgcccattgtttggcagagtccaagaaagcagagacagccgcaacaaactacaacaaccgtgttgtggagtgtcgcttagcagcaattgttcttgccatcaaactagggatggatgccaaaaaagctgtctcttctgttacaacgctctcagatgttgaggggctatgtgtttcttttgctgggaatgaaggttcatctgaccctggagtagctgtgaagaaacttctgcttgaggagccatatacagcagaagaaatagagaaaattacaggtgaaagcctgacatctatcttcaagagctcccaaacttccttggatgttataaaagctgcaaagcactacaagctatttcagcgtgctagtcatgtctactcggaagcaaggcgggtgtatgccttcagggatactgtctcgtcaaagctcagtgaggaagataagcttaagaaactcggtgatcttatgaacgaaagccattatagctgcagcgtgctatatgaatgcagctgccctgagctggaggagcttgtgaaaatatgtagagaccatggagccctgggagcgcgtctcacgggagctggctggggcggctgtgcagtcgctctagtcaaagaacccatcgtcccgcagttcatcctcaatctaaaggaaatgttctacaaatcaaggatcgaccggggagtgatcaagcagacggatctggggctgtacgtgttcgcgtccaagccgtcgagcggcgcggccatattcaagttgtagggggccgttccccgttgtacatgcatgaaccaaaagcagcagccagggacgagacgcggaattaaattaaattcttcttgtgtgtagtctagctccagagttgtgttcgtccccggtggacacccggcgacgcctaggcgggctaaggcgaggccttaagcaaggcgagccgccaccgccttgtcgcctaggcgacgccttgaaaacagaggaatggactgggatagcaatagcatgcatcctcgtactccgatcctctccgtgtctccttcagctcgtgtctgtcactggggctggcagccatacatctccatccttcccttcaagtcatcccaagtcgattatttatatatatgatgtcgcaccaatgcaaataatgaatggactttggtggcgcgcacgagattgaataaaagccctgggcacggtgagatcatcagcc

SEQ ID NO: 2461 - DNA, 2214 bp, Sorghum bicolor
aaggggtaggacagtaaaagcccgtagcccagaaagagagaaggttctccaagtcaatcacaatcacgaggagtcatcagttcatcacgccatacaacacggacagcgacgagacgacgacgccggagagtaacggcgagtcggccgcgagagtgaaggcgagtcggcgaccatcaaggaaggacatggccacgttgcccggcagcgcccccgccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtgaatctgatcggggagcacatcgactacgagggctactcggtgctgcccatggccatccgccaggacatgatcgtcgccatccggagggccgacggcggccaggtgcgggtcgccaatgtcgacgacaagtaccccctgtgcgtctaccccgccgacccagataaggaaattgacataaaaaatcacaaatgggggcactatttcatgtgtggatacaagggagtttacgaatactgtagatcaaacgggatagatctgggcaaacctgttgcacttgatgttgttgttgatggcacagttcctcaaggctctggattgtcaagctcagcagcttttgtctgttcagcaacaattgctatcatgggagtccttgagaaaaactttccaaagaaagaagttgctcaattcacttgtctgtctgagcgccacattggaacacagtctggaggcatggatcaggctatatctatcatggccaaacctggattcgctgagttgatagattttaatccaattcatgcaactgatgtccaactacctccaggtggtacatttgtgatcgcccattgtttggcagagtccaagaaagcagagacagctgcaacaaattataataaccgtgttgtggagtgtcgcttagcagcgattgttcttgccatcaaactagggatggataggaaaaaagctgtctcctctgttacaaccctctccgatgttgagggtctatgcgtttcttttgctgggaaagaaggttcatctgatcctgcaatagctgtgaagaaacttttgcatgagaatccatatacagctgaagaaatagagaaaattacaggtgaaagcctgacatctgtcttccagagctctcaaacttccttggatgttataaaagctgcaaagcactacaagctatttcagcgtgcgactcatgtctactctgaagcaaggagggtttacgctttcagggatactgtctcctcaaaactcagtgaggaagataagcttaagaaacttggtgatcttatgaacgaaagccattacagctgcagcgtgctatatgagtgcagttgccctgagctggaggagcttgtgaaagtctgtagagacaatggagcactgggagcacgtctcacaggagctgggtggggtggctgtgcggttgctctggtcaaggagcccatcgtccctcagttcattctgaatctaaaggaaatgtactacaaatcaaggattgagaggggagtaatccagcagggtgatctgggcctgtatgttttcgcgtcgaagccatcgagcggcgcagccatattgacgttgtaggcgggcagaggcagcctccattcttttacgagcccgctgtaaattcgtagagtccgtaccctggtcccagatgtggccctgtaaaacatggaataagttacttgcatctcgatgaacaccgaactgttgtaaaacatggagtattaaattatctcaggcaacacacgcattaggcatgttgctccagatttgagagacgagttcgtggctggctgccatggatgaatgaagttaaaagaaaagaggaataatccgaatcttatccagagggcgtatctatctatgccccgttgtgtagctcgtctccctttggatcataattcaatatgtcgagctaactctggaggaggatattgtgcaaagaaagagagccagctcctgtgagaggggttaaagcccatttgttgattatggggtcttaactatgttttttttttgccctagagggttatttttcttgtgtacataaaactctcttttctccatcttatttgaaggccaaagcttctgtcgttacgtt

SEQ ID NO: 2462 - DNA, 2400 bp, Sorghum bicolor
atccataggagacaagagagctcatcagcacgggatctcccgacggatacaagaaaggggtaggacagtaaaagcccgtagcccagaaagagagaaggttctccaagtcaatcacaatcacgaggagtcatcagttcatcacgccatacaacacggacagcgacgagacgacgacgccggagagtaacggcgagtcggccgcgagagtgaaggcgagtcggcgaccatcaaggaaggacatggccacgttgcccggcagcgcccccgccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtgaatctgatcggggagcacatcgactacgagggctactcggtgctgcccatggccatccgccaggacatgatcgtcgccatccggagggccgacggcggccaggtgcgggtcgccaatgtcgacgacaagtaccccctgtgcgtctaccccgccgacccagataaggaaattgacataaaaaatcacaaatgggggcactatttcatgtgtggatacaagggagtttacgaatactgtagatcaaacgggatagatctgggcaaacctgttgcacttgatgttgttgttgatggcacagttcctcaaggctctggattgtcaagctcagcagcttttgtctgttcagcaacaattgctatcatgggagtccttgagaaaaactttccaaagaaagaagttgctcaattcacttgtctgtctgagcgccacattggaacacagtctggaggcatggatcaggctatatctatcatggccaaacctggattcgctgagttgatagattttaatccaattcatgcaactgatgtccaactacctccaggtggtacatttgtgatcgcccattgtttggcagagtccaagaaagcagagacagctgcaacaaattataataaccgtgttgtggagtgtcgcttagcagcgattgttcttgccatcaaactagggatggataggaaaaaagctgtctcctctgttacaaccctctccgatgttgagggtctatgcgtttcttttgctgggaaagaaggttcatctgatcctgcaatagctgtgaagaaacttttgcatgagaatccatatacagctgaagaaatagagaaaattacaggtgaaagcctgacatctgtcttccagagctctcaaacttccttggatgttataaaagctgcaaagcactacaagctatttcagcgtgcgactcatgtctactctgaagcaaggagggtttacgctttcagggatactgtctcctcaaaactcagtgaggaagataagcttaagaaacttggtgatcttatgaacgaaagccattacagctgcagcgtgctatatgagtgcagttgccctgagctggaggagcttgtgaaagtctgtagagacaatggagcactgggagcacgtctcacaggagctgggtggggtggctgtgcggttgctctggtcaaggagcccatcgtccctcagttcattctgaatctaaaggaaatgtactacaaatcaaggattgagaggggagtaatccagcagggtgatctgggcctgtatgttttcgcgtcgaagccatcgagcggcgcagccatattgacgttgtaggcgggcagaggcagcctccattcttttacgagcccgctgtaaattcgtagagtccgtaccctggtcccagatgtggccctgtaaaacatggaataagttacttgcatctcgatgaacaccgaactgttgtaaaacatggagtattaaattatctcaggcaacacacgcattaggcatgttgctccagatttgagagacgagttcgtggctggctgccatggatgaatgaagttaaaagaaaagaggaataatccgaatcttatccagagggcgtatctatctatgccccgttgtgtagctcgtctccctttggatcataattcaatatgtcgagctaactctggaggaggatattgtgcaaagaaagagagccagctcctgtgagaggggttaaagcccatttgttgattatggggtcttaactatgttttttttttgccctagagggttatttttcttgtgtacataaaactctcttttctccatcttatttgaaggccaaagcttctgtcgttacgttaaaaaaatcggaatctatatacggatgcaacttggacttgatatccgtaaataggcacattgtcatagacagtggtcagtaggtactccctctggtccgtatttcaatttacacgccacaacgttgacatgg

SEQ ID NO: 2463 - DNA, 2193 bp, Zea mays
atggtgaggctgaccggtgggcccaactgtacaggagacaaaagactacaggtcatcatcacgggatctcccgacggaacggaacggatatataacaagcctagggctaggggtagccaggcccaggaagagagagaaggttctccaagtcaatcgcaatcacgaagagtcatcacgccatacgacacggaggacaccgagccggaggcgaagccggtgcgcagcgcgagagtagcggcgagtcggcgaccatcaagcaactgcatggccgcgttacccgccagcgcccccgccgcccgccccctccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtcaatctgatcggggagcacatcgactacgagggctactcggtgttgccgatggccatccgccaggacatgatcgtcgccatccgaagggccaacggcgcccaggtgagggtcgccaacgtcgacgacaagtaccccctctgcgtttaccccgccgacccagacaaggaaattgacgtaaaaaatcacaaatgggggcactatttcatgtgtggatacaagggagtttatgaatactgtagatcaaaagggatagatctgggcaaacctgttgcgcttgacgtcgttgttgatggcacagttcctcaaggctctggactgtcaagctcagcagcatttgtctgttcagcaacaattgctatcatgggaatccttgacaaaaactttccaaagaaagaagttgctcaattcacttgtctgtctgagcgccacattggaacgcaatctggcggcatggatcaggctatatctatcatggcgaaacctggattcgctgagttgatagattttaatccaatccatgcaactgacgtccaactaccttcaggtggtacatttgtgatcgcccattgtttggccgagtccaagaaagcagagacagctgcaacaaattataataaccgtgttgtggagtgtcgcttagcagcgattgttcttgccatcaaacttgggatggataggaaaaaggctatctcctccgttacaaccctctccgatgttgaggggctatgtgtttcttttgctgggagagaaggttcatctgatcctgcagtagctgtgaagaaacttctgcatgaggacccatatacagctggagaaatagagaaaattacaggagaaggcctgacatctgtcttccagggctctcagacgtcattggatgttataaaagcggcaaagcactacaagctatttcagcgtgcgacccatgtctactctgaagcaaggagggtttatgctttcagggatactgtctcttcaaaactcagtgaggaaggcaagcttaagaaacttggtgatcttatgaacgagagccattacagctgcagcgtgctatacgaatgcagttgccctgagctggaggagcttgtgaaggtctgcagagacaacggagcactgggagcacgtctgacaggagctgggtggggtggctgcgcggttgctctggtcaaggagcccatcgtccctcagttcattctgaaactaaaggaaatgtactacaaatcaaggattgacaggggagtaatcaagcagggcgatgtgggcctatacgtgttcgcatccaagccgtcgagcggcgcggccatactgaggttgtaggcaggcaggaaggcagaggcagccgctattcttttcacgagtgtggtggccctgtaaaacatggaataaagttgccatgaacaccgaacccttgtagtagcgttgaattatctcagacaacacacgcattaaattgatatctatctacaggagtaacacacgagcgaaccatgctgttttaaatcctctttcttgctattctcgtttttcgttggttcaccggccatttcgtggagttgtttccagtaacgtaaaatataacgatacgtagataaaactatcaccctcgaagtataattttcttttcttagatatttaagtaatcctgtcactcatcttgagttggtaatcgatccatgcattgtcctataaaattcggtctcagtgagaattacacataagtttta

SEQ ID NO: 2464 - DNA, 1782 bp, Avena sativa
ccatcatcggcggattgcaagtcaaaagacaagcagagcgtccaaattttctggaagcagagggaggcgatggcgcaggttgtggtggcagttggcggcgaggacgtcctgggcgccggcgagctcgtgccggcgctgacctcgctcgagccggtctacggcgagggctcgccgctcgacgaggcgcgcctccgcttcgaccgcctcggcgaccgcgtcggggaactctacggcgcacgccccgccctcttcgcccgctccccagggagggtgaatctgatcggggagcacatcgactacgagggctactcggtgctgcccatggccatccgccaggacatgatcgtcgccatccggaaggccgacggcggccaggtgcgcgtcgccaatgtcgacgacaagtaccccacctgcgtctacccggccgaccccaacaaggaaattgacataaaaaatcacaagtggggccactactttatgtgtggatataagggggtatacgagtacgctaggtcaaaagggatagatatgggtgaacctgttgctcttgatgttgttgttgatggcacagttcctcaaggatctggactttcaagctcagcagcatttgtttgttctgcaacaattgctatcatgggaattctcgagaaaaacttcccaaagaaagaagttgctcaattcacttgtcagtctgagcgccatatcgggacacagtcagggggtatggatcaggcgatatctatcatggccaaacctggatttgctgagctgatagatttcaatccaatcaaagcaaccgatgttcaactacctccaggaggtacatttgtgattgcccactgtctggcagagtcgaagaaagcagagacagctgctacaaactacaacaatcgtgttgtggagtgtcgcttggctgcgattgttcttgccatcaaactagggatggccacaactaaagctctgtcctctgttaccaccctctctgatgttgaggggttatgtgtctcttttgccggcaaagaatgttcttctgatcctggagttgccgtgaagaacctattgcatgaggaaccatatacaacagaggaaatagagaaaattacaggtgaaagcctgtcttctgtcttccagggctctcaaacttcttggatgtcttgagagctgcaaagcattttaagttatttcagcgtgcctttcatgtgtactccgaagcaaggcgggtgtacgcttttagagatacagtgttatcaaaactcagtgaggaagatatgctcaaaaagcttggtgatcttatgaacgatagccattatagctgcagtgtgctatatgagtgcagctgtcctgagttggaagagcttgtaaaaatatgccgggacaacggggcactgggagcgcgcctaacaggagctggatggggcggctgtgcagttgccctggttaaggagggcattgtccctcagttcattctcaatttgaaggagaagtactacaaatcaaggatcgaccggggagtgatcaagcagagcgatcttgggctgtatgtgttcgcgtcgaagccgtcgagcggcgcagccatattgaagctgtagattgaccaccgccgccgtgcttccttcacttgtacatggatatatactctcggctacgacttattgatatcgatcgaataaagaggtgctcggaggcgagcacactcccctagttaatttagtccagccatgcgtgcctgaatgtacaatacacaatgtgtacctatcgttacttatgggcaaactgactatc

SEQ ID NO: 2465 - DNA, 2213 bp, Oryza sativa
agtcaatcgaagttgccaccccgcaatcacatagagtgtgatacgacttgtaacggatagagacgaggcgtgaggaagaagacgacgactgattcgctagacagcgcgagaagcggaagaggaggaggcgagagagcaccagcgatggcggctcgggtgcccggaggaggaggcgccgccgcggcggcggaggcggaggttgtcccgacgttctcctccctggagccgatctacggcgacggctctccgctcgacgaggcgcgcctccgcttggcccgcctcgccgacaagttccacgccgtctacgccgcgcgccccgcgctcttcgcccgctctccggggcgggtgaatctgataggggagcacatcgactacgaggggtactcggtgttgcccatggccatccggcaggacatgatcgtcgccatcaggagggcagaggggaaggaggtgcgcgtcgccaatgtcgacgacaagtaccccatctgtgtctacccggccgaccccgacaaggaaattgacataaaaaaccacaaatggggccactatttcatgtgtggatacaagggagtttatgagtattgtaggtcaaaagggatagatatgggtggacctgttggccttgatgtagttgttgatggcacagttcctacaggatctggactttcaagctcagcagcatttgtctgttcagcaacaattgctatcatgggagttcttgagaaaaatttcccaaagaaagaagttgcacaattcacctgtcaatctgagcgccacattggaacacaatctgggggcatggatcaggctatatctatcatggccaaacctggatttgctgagttgatagatttcaatccaatccatgccactgatgtgcaactacctccaggcggtacatttgtgattgcccattgcctggcagagtccaagaaagcagagacagctgcaacaaactataacaaccgtgttgttgaatgtcgcctggctgcaattgttcttgccatcaaactagggatggaaacaaaaaaggctgtctcctctgttaccaccctctctgatgttgaggggttatgtgtctcttttgctggaaaagagggttcttctgatcctggagttgccgtgaagaaactattacatgaagaatcatatacaacagaagaaatagagaaaattacaggtcaaagcctgacatctatcttccagagctctcaaacttccttggatgttctaagagcagcaaagcatttcaagttatttcagcgtgcctttcatgtgtactcggaagcaaggcgggtttatgccttcagagatactgtattgtcaaaactcagtgcggaagatatgcttcaaaaactgggcgatcttatgaatgaaagtcactatagctgcagtgtgttatatgaatgcagctgtcccgagttggaagagcttgtaaaagtatgtagagacaacggagcactcggagcacgtcttactggagcagggtggggtggctgtgcagtcgctttggttaaggaaggcattgtcccgcagtttattctcaatttaaaggaaacgtactataaatcaaggatcgaccggggagtgatcaaccagaaggatcttgggttgtacgtgttcgcgtccaagccgtcgagtggagcagccatattcaagctgtaggccaccaatccaccattctttcgccacctgtaaatcgattcagaccagaagcgccacgacgcaagcacgcaggttcctacatgacctaagtccacccacacgtcaatgtatctttatacaagtacttattagaaacaataaatcatgtctattaatctattactatgccgggacacaaccaatagagacttcaaaacaatgatgcatcagtggttagtagggtgtcgatggaggttgcttttttttttttttcttatacagtgatacgatgatacttctagtacttgcagtggacctttggactttggtcaagttattcaggtgtcatcttcgtgtgtactgttgattttgctgtgcctagagaccgtcatgttcttccaggcgtctcgtgcaccataaggctatggttatgttttaactaacatcagttatgccattgcagcgtgtttgttagtacaggcactgttcaccataagcaaactaactctcctgtttaatttgcataaatgaaaggaaactaactaactgtagtttgacattgatttccc

SEQ ID NO: 2466 - DNA, 1802 bp, Pseudoroegneria spicata
  misc_feature (517)..(517): n is a, c, g, or t
tgcagagcaggggagagtccaacttcttctcgaaccacccgagagagagagacagaggcgatggcgaccaaggaggcgaaggtggttcccgccgacggcgtcgacgaggacctaatcccggcgctgtcctcgctggagccggtctacggcgcggggtcggcgctcgacgaggcccgcctccgcttcgcccgcctcggcgaccgcttccgggccctctacgccgccggccccgccctcttcgcccgctccccagggagggtgaatctcatcggggagcacatcgactacgagggctactcggtgctgcccatggccatccgccaggacatgatcgtcgccatccgcagggccgacggcggcctcgtccgcgtcgccaatgtcgacgacaagtacgccacctgcgtctaccccgccgacccagacaaggaaattgacatcaagaaccacaagtggggccactactttatgtgtggatataagggagtatacgaatatgctaggtcaaaagggatagatntgggtgaacctgttgctcttgatgttgtagttgatggcacagtccctcaaggatccggactttcaagctcagcagcatttgtctgttcagcaacaattgctatcatgggaattctcgggaaaaacttcccaaagaaagatgttgctcaatttacctgtcaatctgagcaccatattgggacacagtcagggggtatggatcaggctatatctatcatggccaaacctggatttgctgagttgatagatttcaatccaatcaaagcaaccgacgtgcaactaccctctggtggtacatttgtgattgcccactgcctggcagagtccaagaaagcagaaacagctgctacaaactacaacaaccgcgttgtagagtgtcgcttggccgcgattgttctcgccatcaaactagggatggatataaaaaaagccatcacatctgttactaccctctctgatgttgaggggctatgcgtttcctttgctggcaaagaaggttcttctgatcctggagttgctgtcaagaagctattgcatgaggagccatatacgttggaggaaatagagaaaattacaggtcaaagcctagcaactgtcttccagagctctcaaacttccttggatgttttgagagcagcaaagcatttcaagttatttcagcgtgcctctcatgtgtactctgaagcaaggcgggtgtacgcatttagggatactgtattatcgaaagtcagcgaagaaggtatgcttaagaagctcggtgatctaatgaacgatagccatcatagctgcagtgtgctatatgaatgcagctgtcccgagttggaagagcttgtaaaagtgtgccgggacaacggggcacttggagcgcggctcacaggagccgggtggggcggctgtgcagtcgccctggtcaaggagggcatcgtcccacagttcatcctcaatttgaaggagaagtactacaaatcaaggatcgacaggggagtgatcaagcagagcgaccttggcctgtatgtgtttgcgtcgaagccgtcgagcggcgcggccatactgaagctgtagatggaccaccgccggccgtggccggtcacttgtacatgcacatactcgcccacaacctatattgatcgaataaagagcacgctgccattagctaatttagtccccacccatgcgtgtctgaatgtacaatactacaatgtgtagtatttatcgttgtttattatgggcgatctgactgccaggttatctacatatgctgctgttggtcctctccaaaaaaaaaa

SEQ ID NO: 2467 - DNA, 1945 bp, Triticum aestivum
gagatcgccgcctgtcacggttgcaacttgcttcgggggtcaaaccgcagacagagcaggggagagtccaaacttcttttttttttttgagggagagagtccaaacttcttccttctcgaaccacccgagagagacagagagagatagcggcgatggcgaccaaggaggccaaggtggttcccgccggcgacgtcgacgccgccgtcgacggcgaggatctggtcccggtgctggcgtcgctggagccggtgtacggcgcggggtcggcgctcgacgaggcgcgcctccgcttcgcccgcctcgccgaccgcttccgcgccctctacgccgccggccccgccctcttcgcccgctccccagggagggtgaatctcatcggggagcacatcgactacgagggctactcggtgctgcccatggccatccgccaggacatgatcgtcgccatccgcagggccgacggcggcctcgtccgcgtcgccaatgtcgacgacaagtacgccacctgcgtctaccccgccgaccccgacaaggaaattgacatcaagaaccacaaatggggccactactttatgtgtggatacaagggagtgtatgaatatgctaggtctaaagggatagatatgggtgaacctgttgctcttgatgtcgtagttgatggcacagtccctcaaggatctggactttcaagctcagcagcatttgtctgttcggcaacaattgctatcatgggaattcttggtaaaaacttcccaaagaaagaagttgcccaatttacttgtaaatctgagcgccatattgggacacagtcagggggcatggatcaggctatatctatcatggccaaacctggatttgctgagttgatagatttcaatccaattaaagcaacagatgtgcaactaccttctggtggtacatttgtgattgcccactgtctggcagagtccaagaaagcagagacagctgctacaaactacaacaaccgcgttgtagagtgtcgcttggcagcgattgttctcgccatcaaactagggatggatacaaaaaaagccgtcacatctgttacgaccctctctgatgttgagggactatgcgtctcctttgctggcaaagaaggttcttctgatcctggagttgctgtgaagaagctattgcatgaggagccatatacgttggtggaaatagagaaaattacaggtcaaagcctagcaactgtcttccagagctctcaaacttccttggatgttttgagagctgcaaagcatttcaagttatttcagcgtgcctctcatgtgtactctgaagcaaggcgggtgtatgcgtttagggatactgtattatccaaactcagcgatgaaggtatgcttaagaagctcggtgatctaatgaacgatagccatcatagctgcagtgtgctatatgaatgcagctgtcccgagttggaagagcttgtaaaagtgtgccgggacaatggggcactcggagcgcggctcacaggagccgggtggggcggctgcgcagtcgccctggtcaaggagggcatcgtcccacagttcatcctcaatttgaaggagaagtactacaaatcaaggatcgacaggggagtgatcaagcagagcgaccttggcctgtatgtgtttgcgtcgaagccgtcgagcggcgcggccatactgaggctgtagatcgacgaccgccgtccgtggccggtcacttgtacatgcacacatactcgcccacaacctattgctcgaataaacgcgtgctcgcctcgaggcgagcacgctgccgttagctaatttagcccccgcccatgcgtgtctgaatgtacaatgctacaatgtgtcgtgtttatcgttgtttattatgggcgatctgactgccaggttatctacatatgctgctgttggccctctccaagaggcacggagtccaaaaaaaaaa

SEQ ID NO: 2468 - DNA, 1933 bp, Triticum aestivum
gagatcgccgcctgtcacggttgcaacttgcttcgggggtcaaaccgcagacagagcaggggagagtccaaacttcttttttttttttgagggagagagtccaaacttcttccttctcgaaccacccgagagagacagagagagatagcggcgatggcgaccaaggaggccaaggtggttcccgccggcgacgtcgacgccgccgtcgacggcgaggatctggtcccggtgctggcgtcgctggagccggtgtacggcgcggggtcggcgctcgacgaggcgcgcctccgcttcgcccgcctcgccgaccgcttccgcgccctctacgccgccggccccgccctcttcgcccgctccccagggagggtgaatctcatcggggagcacatcgactacgagggctactcggtgctgcccatggccatccgccaggacatgatcgtcgccatccgcagggccgacggcggcctcgtccgcgtcgccaatgtcgacgacaagtacgccacctgcgtctaccccgccgaccccgacaaggaaattgacatcaagaaccacaaatggggccactactttatgtgtggatacaagggagtgtatgaatatgctaggtctaaagggatagatatgggtgaacctgttgctcttgatgtcgtagttgatggcacagtccctcaaggatctggactttcaagctcagcagcatttgtctgttcggcaacaattgctatcatgggaattcttggtaaaaacttcccaaagaaagaagttgcccaatttacttgtaaatctgagcgccatattgggacacagtcagggggcatggatcaggctatatctatcatggccaaacctggatttgctgagttgatagatttcaatccaattaaagcaacagatgtgcaactaccttctggtggtacatttgtgattgcccactgtctggcagagtccaagaaagcagagacagctgctacaaactacaacaaccgcgttgtagagtgtcgcttggcagcgattgttctcgccatcaaactagggatggatacaaaaaaagccgtcacatctgttacgaccctctctgatgttgagggactatgcgtctcctttgctggcaaagaaggttcttctgatcctggagttgctgtgaagaagctattgcatgaggagccatatacgttggtggaaatagagaaaattacaggtcaaagcctagcaactgtcttccagagctctcaaacttccttggatgttttgagagctgcaaagcatttcaagttatttcagcgtgcctctcatgtgtactctgaagcaaggcgggtgtatgcgtttagggatactgtattatccaaactcagcgatgaaggtatgcttaagaagctcggtgatctaatgaacgatagccatcatagctgcagtgtgctatatgaatgcagctgtcccgagttggaagagcttgtaaaagtgtgccgggacaatggggcactcggagcgcggctcacaggagccgggtggggcggctgcgcagtcgccctggtcaaggagggcatcgtcccacagttcatcctcaatttgaaggagaagtactacaaatcaaggatcgacaggggagtgatcaagcagagcgaccttggcctgtatgtgtttgcgtcgaagccgtcgagcggcgcggccatactgaggctgtagatcgacgaccgccgtccgtggccggtcacttgtacatgcacacatactcgcccacaacctattgctcgaataaacgcgtgctcgcctcgaggcgagcacgctgccgttagctaatttagcccccgcccatgcgtgtctgaatgtacaatgctacaatgtgtcgtgtttatcgttgtttattatgggcgatctgactgccaggttatctacatatgctgctgttggccctctccaagaggcacggagt

SEQ ID NO: 2469 - DNA, 2034 bp, Triticum aestivum
cacggttgcgacttgtttcgagggtcagagcgccgaagagtaggggagagtccaaacttcttctcgaaccaccatagagacggagagagagatagcggcgatggcgaccaaggaggccaaggtggttcccgccggcgacgtcgacgccgccgtcgacggcgaggatctggtcccggtgctggcgtcgctggagccggtgtacggcgcggggtcggcgctcgacgaggcgcgcctccgcttcgcccgcctcgccgaccgcttccgcgccctctacgccgccggccccgccctcttcgcccgctccccagggagggtgaatctcatcggggagcacatcgactacgagggctactcggtgctgcccatggccatccgccaggacatgatcgtcgccatccgcagggccgacggcggcctcgtccgcgtcgccaatgtcgacgacaagtacgccacctgcgtctaccccgccgaccccgacaaggaaattgacatcaagaaccacaaatggggccactactttatgtgtggatacaagggagtatatgaatatgctaggtcaaaagagatagatatgggtgaacctgttgctcttgatgttgttgttgatggcacagtccctcaaggatctggactttcaagctcagccgcatttgtctgttcagcaacaattgctatcatgggaattctcgggaaaaacttcccaaagaaagaagttgctcaatttacttgtcaatctgagcgtcatattgggacacagtcaggtggtatggatcaggctatatctatcatggccaaacctggatttgctgagttgatagatttcaatccaattaaagcaacagatgtgcaactaccttctggtggtacatttgtgattgcccactgtctggcagagtccaagaaagcagagacagctgctacaaactacaacaaccgcgttgtagagtgtcgcttggcagcgattgttctcgccatcaaactagggatggatacaaaaaaggccgtcacgtctgttacaaccctctctgatgttgaggggctatgcgtctcctttgctggcaaagaaggttcttctgatcctggagttgctgtgaagaagctattgcatgaggagccatatacgttggtggaaatagagaaaattacaggtcaaagcctagcaactgtcttccagagctctcaaacttccttggatgttttgagagctgcaaagcatttcaagttatttcagcgtgcctctcatgtgtactctgaagcaaggtgggtgtacgcatttagggatactgtattatcgaaactcagcgacgaaggtatgcttaagaagctcggtgatctaatgaacgatagccatcatagctgcagtgtgctatatgaatgcagctgtcccgagttggaagagcttgtaaaagtgtgccgggacaacggggcactcggagcgcggctcacaggagccgggtggggcggctgcgcagtcgccctggtcaaggagggcatcgtcccacagttcatcctcaatttgaaggagaagtactacaaatcaaggatcgacaggggagtgatcaagcagagcgaccttggcctgtatgtgtttgcgtcgaagccgtcgagcggcgcggccatactgaggctgtagatcgaccaccgccgtccgtggccggtcacttgtacatgcacacatactcgcccacaacctattgctcgaataaacgcgtgctcgcctcgaggcgagcacgctgccgttagctaatttagcccccgcccatgcgtgtctgaatgtacaatgctacaatgtgtcgtgtttatcgttgtttattatgggcgatctgactgccaggttatctacatatgctgctgttggccctctccaagaggcacggagtcccgatggttgatgcatcgcttatctttttcttctcttttttgaggtgtggttacattacctgacactcacgtcgactagctatgaacaacgggagaggtgtgctgtcctgggaactttgcagaaaggaccacaacggaaaccccaagcaccac

SEQ ID NO: 2470 - DNA, 1778 bp, Secale cereale
cttccggggtcaagccgcagagcaggggagagtccaaacttcttccttctcgaaccacccgagagagacagagagagaggcgatggcgaccaaggaggccaaggtggttcccgccggcgacgtcgacgaggagatgatcccggcgctggccgcgctggagccggtgtacggcgcggggccggcgctcgaggaggcgcgccgccgcttcgcccgcctcgacgaccgcttccgcgccctctacgccgccggccccgccctcttcgcccgctccccagggagggtgaatctcatcggggagcacatcgactacgagggctactcggtgctgcccatggccatccgccaggacatgatcgtcgccatccggagggccgacggcggcctcgtccgcgtcgccaatgtcgacgacaagtacgccacctgcgcctaccccgccgaccccgacaaggaaattgacatcaagaaccacaagtggggccactactttatgttgcggatacaagggagtatacgaatatgctaggtcgaaagggatagatatgggtgaacctgttggtcttgatgttgttgttgatggcacagtccctcaaggatctgggctttcaagctcagcagcatttgtctgttcagcaacaattgctatcatgggaattctcgggaaaaacttcccaaagaaagaagttgctcaatttacttgtcaatctgagcgtcatattgggacacagtcaggtggtatggatcaggctatatctatcatggccaaacctggatttgctgagttgatagatttcaatcctatcaaagcaaccgatgtgcaattaccctctggtggtacatttgtgattgctcactgcctggcagagtccaagaaagcagaaacagctgctacaaactacaacaatcgcgttgtagagtgtcgcttggcagcgattgttctcgccatcaaactagggatggatacaaaaaaagctgtcacatctgttacgaccctctctgatgttgaggggctatgcgtctcctttgctggcaaagaaggttctgctgatcccggagttgctgtgaagaagctgttgcatgaggagccatatacgttggaggaaatagagaaaattacaggtcaaagcctagcaactgtcttccagagctctcaaacttccttggatgttttgagggctgcgaagcatttcaagttatttcagcgtgcctctcatgtgtactctgaagccaggcgggtgtacgcatttagggacacagtattatcgaaactcagcgacgaaggtatgcttaagaagctaggcgatctaatgaacgatagccatcatagctgcagtgtgctatatgaatgcagctgtcccgagttggaagagcttgtaaaagtgtgccgggacaacggggcgctgggagcacggctcacaggagccgggtggggcggctgcgtggttgccctggtcaaggagggcatcgtcccacagttcatcctcaatttgaaggagaagtactacaaatcgaggatcgacaggggggtgatcaagcagagcgaccttggcctgtatgtgtttgcgtcgaagccgtcgagcggcgcggccatactgaggctgtagatggaccaccgccggccttcttggtcggtcacttgtacatggaacacacactcccctaccagctagtgatcgaataaacacgcgtgctcgctgctactattagctaatttagtccacccatatgcgtgcctgaatgtacattactggtacaatgtgtacctttatcgttggttgttt

SEQ ID NO: 2471 - DNA, 1951 bp, Brachypodium distachyon
cgaggcgctcaactgctatataatcggaaacggatcacggttgcgttcccccgtctgtcatccctcggtcgcaagtcaaaccgcgaagtccaaaactcggaaccaaccagaccaccggaggcgatcgatcgatggcgcacttggccggcggcggcggggacgagctcgtcccgacgctctcctcgctggagacggtgtacggcgccggcgaggaggaggaggaggaggcgcgcgtccgcttcggccgcctcggcgaccgcttccgggccctctactcggccagccccgccctcttcgcccgctccccagggagggtgaatctgatcggggagcacatcgactacgagggctactcggtgctgcccatggccatccgccaggacatgatcgtcgccatcagcaaggccgcccacggccaggtgcgcgtcgccaatgtcgaagacaagtacgccgcctgcgtctacccggccgaccctgacaaggaaattgacataaaaaaccacaaatggggccactactttatgtgtgggtacaagggagtatatgagtacggcaggtcaaaagggatagatatgggtgaacctgttggccttgatgtcgttgttgatggcacagttcctctaggatctggactttcaagctcagcagcatttgtctgctcagcaacaattgctatcatgggaattctcgagaaaaatttcccaaagaaagaagttgctcaattcacttgtcaatctgagcgtcatattgggacacagtcggggggtatggatcaggctatatctatcatggccaaacctggatttgctgagttgatagatttcaatccaatcaaagcaaccgatgtgcaactaccacaaggtggtacatttgttattgcccattgtctggcagagtccaagaaagcagagacagctgctacaaattacaacaaccgtgttgtcgagtgtcgcttggcagcgattgttcttgccattaaactagggatggatacaaacaaagctatatcttctgttaccaccctctctgatgttgaggggttatgcgtctcttttgctggcaaagaaggttcttctgatcctgtagttgctgtgaagaagttactgcatgaggaaccatatacaacagaggaaatagagaaaattgtaggcaaaagcttggcatctgccttcgagagttcgccaacttccttggacgttttaagagctgcgaagcaattcaagttatttcagcgtgccgctcacgtatactctgaagcaagacgggtatatgcattcagagatactgtatcatcaaaactcagtgaggaagatatgcttaagaagcttggcaaccttatgaatgatagccattacagctgcagtgtgctatacgaatgcagctgccctgagttggaagagcttgtaaaagtatgccgggacaacggggcacttggagcgcgtctcacaggagccggatggggtggctgcgcagtggccttggtcaaggagtccattgtcccgcagttcatcctcagtttgaaggagaagtactacaaatcgaggatcgaccggggagtggtcaagcagagcgagcttggcctgtatgtgttcgcatcaaagccgtcgagcggtgcggccatattgaagctgtagatcgaccgccgccgcccctgtaaatgatcaaataaaggaagtgcctgggaggcaagccgcgccccggttccctcccttaatttagttttatgtatgaatgactgaaatgtacaatgtgtatacatatataattagttggagtattgtttatggaattatgggcgtctggctatcaaaattatatgtactctgttcgtcgaaggctgatatgcacgactgctttgttatagtgcatctgtacgtacttgctttcagatgctgacagtcttggtcgatggttcccaactactgggcatgagagttcacgcattgtccgt

SEQ ID NO: 2472 - DNA, 1777 bp, Brachypodium distachyon
gcgatcgatcgatggcgcacttggccggcggcggcggggacgagctcgtcccgacgctctcctcgctggagacggtgtacggcgccggcgaggaggaggaggaggaggcgcgcgtccgcttcggccgcctcggcgaccgcttccgggccctctactcggccagccccgccctcttcgcccgctccccagggagggtgaatctgatcggggagcacatcgactacgagggctactcggtgctgcccatggccatccgccaggacatgatcgtcgccatcagcaaggccgcccacggccaggtgcgcgtcgccaatgtcgaagacaagtacgccgcctgcgtctacccggccgaccctgacaaggaaattgacataaaaaaccacaaatggggccactactttatgtgtgggtacaagggagtatatgagtacggcaggtcaaaagggatagatatgggtgaacctgttggccttgatgtcgttgttgatggcacagttcctctaggatctggactttcaagctcagcagcatttgtctgctcagcaacaattgctatcatgggaattctcgagaaaaatttcccaaagaaagaagttgctcaattcacttgtcaatctgagcgtcatattgggacacagtcggggggtatggatcaggctatatctatcatggccaaacctggatttgctgagttgatagatttcaatccaatcaaagcaaccgatgtgcaactaccacaaggtggtacatttgttattgcccattgtctggcagagtccaagaaagcagagacagctgctacaaattacaacaaccgtgttgtcgagtgtcgcttggcagcgattgttcttgccattaaactagggatggatacaaacaaagctatatcttctgttaccaccctctctgatgttgaggggttatgcgtctcttttgctggcaaagaaggttcttctgatcctgtagttgctgtgaagaagttactgcatgaggaaccatatacaacagaggaaatagagaaaattgtaggcaaaagcttggcatctgccttcgagagttcgccaacttccttggacgttttaagagctgcgaagcaattcaagttatttcagcgtgccgctcacgtatactctgaagcaagacgggtatatgcattcagagatactgtatcatcaaaactcagtgaggaagatatgcttaagaagcttggcaaccttatgaatgatagccattacagctgcagtgtgctatacgaatgcagctgccctgagttggaagagcttgtaaaagtatgccgggacaacggggcacttggagcgcgtctcacaggagccggatggggtggctgcgcagtggccttggtcaaggagtccattgtcccgcagttcatcctcagtttgaaggagaagtactacaaatcgaggatcgaccggggagtggtcaagcagagcgagcttggcctgtatgtgttcgcatcaaagccgtcgagcggtgcggccatattgaagctgtagatcgaccgccgccgcccctgtaaatgatcaaataaaggaagtgcctgggaggcaagccgcgccccggttccctcccttaatttagttttatgtatgaatgactgaaatgtacaatgtgtatacatatataattagttggagtattgtttatggaattatgggcgtctggctatcaaaattatatgtactctgttcgtcgaaggctgatatgcacgactgctttgttatagtgcatctgtacgtacttgctttcagatgctgac

SEQ ID NO: 2473 - DNA, 1985 bp, Triticum aestivum
cgagggtcagagcgccgaagagtaggggagagtccaaacttcttctcgaaccaccatagagacggagagagagatagcggcgatggcgaccagggaggcgaaggcgaccaaggaggcgaaggtggttcccgccggcgacgccgacgccgacggcgaggagctggtcccggcgctggcctcgctcgagccggtgtacggcgcggggccggcgctcgacgaggcccgcctccgcttcgcccgcctcgccgaccgcttccgcgccctctactccgccggccccgccctcttcgcccgctccccagggagggtgaatctcatcggggagcacatcgactacgagggctactcggtgctgcccatggccatccgccaggacatgatcgtcgccatccgcagggccgacgccggcctcgtccgcgtcgccaatgtcgacgacaagtacgccacctgcgtctaccccgccgacccggacaaggaaattgacatcaagaaccacaaatggggccactactttatgtgtggatacaagggagtatacgaatatgctaggtcgaaagggatagatatgggtgaacctgttgctcttgatgttgttgttgatggcacagtccctcaaggatctggactttcaagctcagccgcatttgtctgttcagcaacaattgctatcatgggaattctcgggaaaaacttcccaaagaaagaagtcgctcaatttacttgtcaatctgagcgtcatattgggacacagtcaggtggtatggatcaggctatatctatcatggccaaacctggatttgctgagttgatagatttcaatccaatcaaagcaaccgatgtgcaactaccctctggtggtacatttgtgattgctcactgcttggcagagtccaagaaagcagaaacagctgctacaaactacaacaaccgtgttgtagagtgtcgcttggcagcgattgttctcgccatcaaactagggatggatacaaaaaaggccgtcacgtctgttacaaccctctctgatgttgaggggctatgcgtctcctttgctggcaaagaaggttcttctgatcccggagttgctgtgaagaagctattgcatgaggagccatatacgttggaggaaatagagaaaattacaggtcaaagcctagcaactgtcttccaaagctctcaaacttccttggatgttttgagagctgcgaagcatttcaagttatttcagcgtgcctctcatgtgtactctgaagcaaggtgggtgtacgcatttagggatactgtattatcgaaactcagcgacgaaggtatgcttaagaagctcggtgatctaatgaacgatagccatcatagctgcagtgtgctgtatgaatgcagctgtcccgagttggaagagcttgtgaaagtgtgccgggacaacggggcactcggagcgcggctcacaggagccgggtggggcggctgcgcagtcgccctggtcaaggagggcatcgtcccacagttcatcctcaatttgaaggagaagtactacaaatcaagggtcgacaggggagtgatcaagcagagcgaccttggcctgtatgtgtttgcgtcgaagccgtcgagcggcgcagccatactgaggctgtagatcgaccaccgccggccgtggtcggtcgcttgtacatgcacacatacctattgctcgaataaacgcgtgctcgaggcgagcacgctgccattagctaatttagtgcccgcgtgtctgaatgtacaatactagtacaatgtgtagtatttatctctgtttattatgggcgatctgactgccaggttatctacatatgctgctgttggtcctctctaagaggcacggagtcccgatggttgatgcatcgtttttgttgttgttgaggtgtggttacatgacctgacactcacgtcgactagctgagaacgacgggagagctgcagagaggacaacaacaggaacaacaaagcaccaccag

SEQ ID NO: 2474 - DNA, 1831 bp, Triticum aestivum
cacggttgcgacttgtttcgagggtcagagcgccgaagagtaggggagagtccaaacttcttctcgaaccaccatagagacggagagagagatagcggcgatggcgaccagggaggcgaaggcgaccaaggaggcgaaggtggttcccgccggcgacgccgacgccgacggcgaggagctggtcccggcgctggcctcgctcgagccggtgtacggcgcggggccggcgctcgacgaggcccgcctccgcttcgcccgcctcgccgaccgcttccgcgccctctactccgccggccccgccctcttcgcccgctccccagggagggtgaatctcatcggggagcacatcgactacgagggctactcggtgctgcccatggccatccgccaggacatgatcgtcgccatccgcagggccgacgccggcctcgtccgcgtcgccaatgtcgacgacaagtacgccacctgcgtctaccccgccgacccggacaaggaaattgacatcaagaaccacaaatggggccactactttatgtgtggatacaagggagtatacgaatatgctaggtcgaaagggatagatatgggtgaacctgttgctcttgatgttgttgttgatggcacagtccctcaaggatctggactttcaagctcagccgcatttgtctgttcagcaacaattgctatcatgggaattctcgggaaaaacttcccaaagaaagaagtcgctcaatttacttgtcaatctgagcgtcatattgggacacagtcaggtggtatggatcaggctatatctatcatggccaaacctggatttgctgagttgatagatttcaatccaatcaaagcaaccgatgtgcaactaccctctggtggtacatttgtgattgctcactgcttggcagagtccaagaaagcagaaacagctgctacaaactacaacaaccgtgttgtagagtgtcgcttggcagcgattgttctcgccatcaaactagggatggatacaaaaaaggccgtcacgtctgttacaaccctctctgatgttgaggggctatgcgtctcctttgctggcaaagaaggttcttctgatcccggagttgctgtgaagaagctattgcatgaggagccatatacgttggaggaaatagagaaaattacaggtcaaagcctagcaactgtcttccaaagctctcaaacttccttggatgttttgagagctgcgaagcatttcaagttatttcagcgtgcctctcatgtgtactctgaagcaaggtgggtgtacgcatttagggatactgtattatcgaaactcagcgacgaaggtatgcttaagaagctcggtgatctaatgaacgatagccatcatagctgcagtgtgctgtatgaatgcagctgtcccgagttggaagagcttgtgaaagtgtgccgggacaacggggcactcggagcgcggctcacaggagccgggtggggcggctgcgcagtcgccctggtcaaggagggcatcgtcccacagttcatcctcaatttgaaggagaagtactacaaatcaagggtcgacaggggagtgatcaagcagagcgaccttggcctgtatgtgtttgcgtcgaagccgtcgagcggcgcagccatactgaggctgtagatcgaccaccgccggccgtggtcggtcgcttgtacatgcacacatacctattgctcgaataaacgcgtgctcgaggcgagcacgctgccattagctaatttagtgcccgcgtgtctgaatgtacaatactagtacaatgtgtagtatttatctctgtttattatgggcgatctgactgccaggtta

SEQ ID NO: 2475 - DNA, 1942 bp, Secale cereale
agagagaggcgatggcgaccaaggaggccaaggtggttcccgccggcgacgtcgacgaggagatgatcccggcgctggccgcgctggagccggtgtacggcgcggggccggcgctcgaggaggcgcgccgccgcttcgcccgcctcgccgaccgcttccgcgccctctactccgccgaccccgccctcttcgcccgctccccagggagggtgaatctcatcggggagcacatcgactacgagggctactcggtgctgcccatggccatccgccaggacatgatcgtcgccatccggagggccgacggcggcctcgtccgcgtcgccaatgtcgacgacaagtacgccacctgcctctaccccgccgaccccgacaaggaaattgacatcaagaaccacaagtggggccactactttatgtgcggatacaagggagtatacgaatatgctaggtcgaaagggatagatatgggtgaacctgttggtcttgatgttgttgttgatggcacagtccctcaaggatctgggctttcaagctcagcagcatttgtctgttcagcaacaattgctatcatgggaattctcgggaaaaacttcccaaagaaagaagttgctcaatttacttgtcaatctgagcgtcatattgggacacagtcaggtggtatggatcaggctatatctatcatggccaaacctggatttgctgagttgattgatttcaatccaatcaaagcaaccgatgtgcaactaccctctggtggtacatttgtgattgctcactgcctggcagagtccaagaaagcagaaacagctgctacaaactacaacaaccgcgtcgtagagtgtcgcttggcagcgattgttctcgccatcaaactagggatggatacaaaaaaggctgtcacatctgttacgaccctctctgacgttgaggggctatgcgtctcctttgctggcaaagaaggttctgctgatcccggagttgctgtgaagaagctgttgcatgaggagccatatacgttggaggaaatagagaaaattacaggtcaaagcctagcaactgtcttccagagctctcaaacttccttggatgttttgagggctgcgaagcatttcaagttatttcagcgtgcctctcatgtgtactctgaagcaaggcgggtgtacgcatttagggatactgtattatcgaaactcagcgaggaaggtatgctcaagaagctcggtgatctaatgaatgatagccatcacagctgcagtgtgctatatgaatgcagctgtcccgagttggaagagcttgtaaaagtgtgccgggacaacggggcgctcggagcgcggctcacaggagccgggtggggcggctgcgtggtggccctggtcaaggagggcatcgtcccacagttcatcctcaatttgaaggagaagtactacaaatcgaggatcgacaggggagtgatcaagcagagcgaccttggcctgtatgtctttgcgtcgaagccgtcaagcggcgcggccatactgaggctgtagatggaccgccgccggccgtggtcggtcacttgtacatgaaacacatactcccccaccagctagtgatcgaataaacacgcgtgctcgctgctactattagctaatttagtccacccatatatgcgtgcctgaatgtacattactagtacaatgtgtaccttatcgttggttgtttatgagcgatgcgggttatcaattggcatgctgctgtttgtcgtctccaagaggcacgttgtcccaatggctcatacatggctagtcttgtccttttttcatgaggtgtggtacgggagaggtccgtcgttgacggaagagaagaatgtcctttctcgttgtcaaaaccagggaagcatcaacataaaagaaaagagggaagcatcagcgctttttgaaccgaaaaaaaaaagtacgta

SEQ ID NO: 2476 - DNA, 1721 bp, Secale cereale
gggcgatggcgaccaaggaggccaaggtggttcccgccggcgacgtcgacgaggagatgatcccggcgttggccgcgctggagccggtgtacggcgcggggccggcgctcgaggaggcccgccgccgcttcgcccgcctcgacgaccgcttccgcgccctctacgccgccggccccgccctcttcgcccgctccccagggagggtgaatctcatcggggagcacatcgactacgagggctactcggtgctgcccatggccatccgccaggacatgatcgtcgccatccggagggccgacggcggcctcgtccgcgtcgccaatgtcgacgacaagtacgccacctgcctctaccccgccgacccagacaaggaaattgacatcaagaaccacaagtggggccactactttatgtgtggttacaagggagtatacgaatatgctaggtccaaagggatagatatgggtgaacctgttgctcttgatgtcgtagttgatggcacagtccctcaaggatctggactttcaagctcagcagcatttgtctgttcagcaacaattgctatcatgggaattctcgggaaaaacttcccaaagaaagaagttgctcaatttacttgtcaatctgagcgtcatattgggacacagtcaggtggtatggatcaggctatatctatcatggccaaacctggatttgctgagttgatagatttcaatcctatcaaagcaaccgatgtgcaattaccctctggtggtacatttgtgattgctcactgcctggcagagtccaagaaagcagaaacagctgctacaaactacaacaatcgcgttgtagagtgtcgcttggcagcgattgttctcgccatcaaactagggatggatacaaaaaaggctgtcacatctgttacgaccctctctgatgttgaggggctatgcgtctcctttgctggcaaagaaggttctgctgatcccggagttgctgtgaagaagctgttgcatgaggagccatatacgttggaggaaatagagaaaattacaggtcaaagcctagcaactgtcttccagagctctcaaacttccttggatgttttgagggctgcgaagcatttcaagttatttcagcgtgcctctcatgtgtactctgaagccaggcgggtgtacgcatttagggacacagtattatcgaaactcagcgaggaaggtatgctcaagaagctcggtgatctaatgaacgatagccatcacagctgcagtgtgctatatgaatgcagctgtcccgagttggaagagcttgtaaaggtgtgccgggacaacggggcgctcggagcgcggctcacaggagccgggtggggcggctgcgtggtggccctggtcaaggagggcatggtcccacagttcatcctcagtctgaaggagaagtactacaaatcgaggatcgacaggggagtgatcaagcagagcgaccttggcctgtatgtgttcgcgtcgaagccgtcgagcggcgcggccatactgaggctgtagatggaccgccgccggccttcttggtcggtcacttgtacatggaacacacactcccctaccagctagtgatcgaataaacacgcgtgctcgctgctactattagctaatttagtccacccatatgcgtgcctgaatgtacattactggtacaatgtgtaccttatcgttggttgtttatgagcgatctgaccggcgtgc

SEQ ID NO: 2477 - DNA, 1901 bp, Secale cereale
caacttgcttccggggtcgagccgcagagcaggggagagtccaaacttcttccttctcgaaccaccagagagacagagagagatagagagaggcgatggcgaccaaggaggccaaggtggttcccgccggcgacgtcgacgaggagatgatcccggcgctggccgcgctggagccggtgtacggcgcggggccggcgctcgaggaggcgcgccgccgcttcgcccgcctcgacgaccgcttccgcgccctctacgccgccggccccgccctcttcgcccgctccccagggagggtgaatctcatcggggagcacatcgactacgagggctactcggtgctgcccatggccatccgccaggacatgatcgtcgccatccggagggccgacggcggcctcgtccgcgtcgccaatgtcgacgacaagtacgccacctgcgcctaccccgccgaccccaacaaggaaattgacatcaagaaccacaaatggggccactactttatgtgtggttacaagggagtatacgaatatgctaggtccaaagggatagatatgggtgaacctgttgctcttgatgtcgtggttgatggcacagtccctcaaggatctggactttcaagctcagcagcatttgtctgttcagcaacaattgctatcatgggaattctcgggaaaaacttcccaaagaaagaagttgctcaatttacttgtcaatctgagcgtcatattgggacacagtcaggtggtatggatcaggctatatctatcatggccaaacctggatttgctgagttgatagatttcaatccaatcaaagcaaccgatgtgcaactaccctctggtggtacatttgtgattgctcactgcctggcagagtccaagaaagcagaaacagctgctacaaactacaacaaccgcgtcgtagagtgtcgcttggcagcgattgttctcgccatcaaactagggatggatacaaaaaaggctgtcacatctgttacgaccctctctgacgttgaggggctatgcgtctcctttgctggcaaagaaggttctgctgatcccggagttgctgtgaagaagctgttgcatgaggagccatatacgttggaggaaatagagaaaattacaggtcaaagcctagcaactgtcttccagagctctcaaacttccttggatgttttgagggctgcgaagcatttcaagttatttcagcgtgcctctcatgtgtactctgaagcaaggcgggtgtacgcatttagggacacagtattatcgaaactcagtgaggaaggtatgctcaagaagctcggcgatctaatgaacgatagccatcacagctgcagtgtgctatatgaatgcagctgtcccgagctggaagagcttgtaaaagtgtgcagggacaacggggcgctcggagcgcggctcacaggagctgggtggggcggctgcgtggttgccctggtcaaggagggcatcgtcccacagttcatcctcagtctgaaggagaagtactacaagtcgaggatcgacaggggggtgatcaagcagagcgaccttggcctgtatgtgtttgcgtcgaagccgtcgagcggcgcggccatactgaggctgtagatggagaaggccggtcacttgtacatgaacacattctccccccacaacctattatcgatcgaataaacacgcgtgctcgctgccattagctaatttagtccacccatatatgcgtgtcagaatgtacattactagtacaatgtgtacactggcgtgctgctgtttgttgtctccatggcgttcctttttttcacgaggtgtggtacgggagaggtccgtcgttggcggaacagaagaatgtcctttgtcgttgtcaaaaccagggaagcatcaacataaaaaaaaaaa

SEQ ID NO: 2478 - DNA, 1804 bp, Hordeum vulgare
ggcgatggagatggcgacggcgaccaaggaggggaaggcggccaaggtggtccccgccggcggcgaggacgaggagctgatcccggcgctggcctcgctggagccggtgtacggcgcggggccggcgctcgacgaggcccgcctccgcttcgcccgcctcgccgaccgcttccgctccctctacgccgccggccccgccctcttcgcccgctccccagggagggtgaatctcatcggggagcacatcgactacgagggctactcggtgctgcccatggccatccgccaggacatgatcgtcgccatccgcagggccgacggcggcctcgtccgcgtcgccagtgtcgacgacaagtacgccacctgcgcctaccccgccgacccagacaaggaaattgacataaagaaccacaaatggggccactactttatgtgtggatacaagggcgtatacgagtatgctaggtcaaaagggatagatatgggcgaacctgttgctcttgatgttgtagttgatggcacagtccctcaaggatctggactttcaagctcagcagcatttgtctgttcagcaacaatcgctatcatggggattctcgggaaaaacttcccaaagaaagaagttgctcaatttacatgtaaatctgagcgtcatattgggacccagtcagggggtatggatcaggctatatctatcatggcgaaacctggatttgctgagttgatagatttcaacccaatcaaagcaaccgacgtgcaactaccctctggtggtacatttgtgattgcccactgcctggcagagtccaagaaagcagaaacagctgctacaaactacaacaaccgtgttgtagagtgtcgcttggcagcgattgttctcgccatcaaactagggatggatgcaaaaaaagccatcacatcagttacaaccctctctgatgttgaggggctatgtgtctcctttgctggcaaagaaggttcttcggatcctggagttgctgtgaagaagctattgcatgaggatccatatacgttggaggaaatagagaaaattacaggtcaaagcctggcaactgtctttcagagctctcaaacttcattggatgttttgagagctgcgaagcatttcaagttatttcagcgcgcctctcatgtgtactctgaagcaaggcgggtgtacgcatttaaggatactgtattatcaaaactcagcgatgaaggcatgcttaagaagctcggtgatctaatgaacgatagccatcatagctgcagtgtgttatatgaatgcagctgtcccgagttggaagagcttgtaaaagtgtgccgggacaatggggcgctcggagctcggctcacaggagccgggtggggcggctgtgcagtcgccctcgtcaaggagggcatcgtcccacagttcatcctcaatttgaaggagaagtactacaaatcaaggatcgacaggggagtgatcaagcagagcgacattggcctgtacgtgtttgcttcgaagccgtcgagtggcgcggccatactgaggctgtagatcggccacttccggccgtggtcggtcacttgtacatgcatgcacacatactcgcccgcaacctattgatcgaataaacgcgtgctcggaggtccgagcacgctgccattagctgaattagtccccacccatgcgtgtctgaatgtacaatactacaatgtgtagcctctatttatcgttgtttacgggcgttctgagtgccaggttatctacatgccgatcttggtcctctcctagaggcacggagacggagtccgatgg

SEQ ID NO: 2479 - DNA, 1770 bp, Secale cereale
gactgtccaaacttcttccttctcgaaccacccgagagagacagagagagaggcgatggcgaccaaggaggccaaggtggttcccgccggcgacgtcgacgaggagatgatcccggcgctggccgcgctggagccggtgtacggcgcggggccggcgctcgaggaggcgcgccgccgcttcgcccgcctcgccgaccgcttccgcgccctctactccgccgaccccgccctcttcgcccgctccccagggagggtgaatctcatcggggagcacatcgactacgagggctactcggtgctgcccatggccatccgccaggacatgatcgtcgccatccggagggccgacggcggcctcgtccgcgtcgccaatgtcgacgacaagtacgccacctgcctctaccccgccgaccccgacaaggaaattgacatcaagaaccacaaatggggccactactttatgtgtggttacaagggagtatacgaatatgctaggtccaaagggatagatatgggtgaacctgttgctcttgatgtcgtagttgatggcacagtccctcaaggatctggactttcaagctcagcagcatttgccagttcagcaacaattgctatcatgggaattctcgggaaaaacttcccaaagaaagaagttgctcaatttacttgtcaatctgagcgtcatattgggacacagtcaggtggtatggatcaggctatatctatcatggccaaacctggatttgctgagttgatagatttcaatccaatcaaagcaaccgatgtgcaactaccctctggtggtacatttgtgattgctcactgcctggcagagtccaagaaagcagaaacagctgctacaaactacaacaaccgcgtcgtagagtgtcgcttggcagcgattgttctcgccatcaaactagggatggataacaaaaaaggctgtcacatctgttacgaccctctctgacgttggagggctatgcgtctcctttgctggcaaagaaggttctgctgactcccggagttgctgtgaagaagctattgcatgaggagccatatacgttggaaggaaatagaagaaaattacagatacaaagcctagctactgtcttccagagctctactaacttccttggattgttttgagagctgcgaagctatttcaagttatttcagcgtgcctctcatgtgtactctgaagccaggcgggtgtacgcatttagggacacagtattatcgaaactcagcgaggaaggtatgctcaagaagctcggcgatctaatgaatgatagccatcacagctgcagtgtgctatatgaatgcagctgtcccgagctggaagagcttgtaaaagtgtgccgggacaacggggcgctcggagcgcggctcacaggagccgggtggggcggctgcgtggtggccctggtcaaggagggcatcgtcccacagttcatcctcaatttgaaggagaagtactacaaatcgaggatcgacaggggagtgatcaagcagagcgaccttggcctgtatgtgtttgcgtcgaagccgtcgagcggcgcggccatactgaggctgtagatggaccgctgccggcttctggcgtcacttgacatggaacacacactcccctaccagctagtgatcgaataaacacgcgtgctcgctgctactattagctaatttagtccacccatatatgcgtgcctgaatgtacattactagtacaatgtgtaccttatcattgtttgtttatgagcgaaaaaagtc

SEQ ID NO: 2480 - DNA, 1836 bp, Hordeum vulgare
cggggccggcgctcgacgaggcccgcctccgcttcgcccgcctcgccgaccgcttccgctccctctacgccgccggccccgccctcttcgcccgctccccagggagggtgaatctcatcggggagcacatcgactacgagggctactcggtgctgcccatggccatccgccaggacatgatcgtcgccatccgcagggccgacggcggcctcgtccgcgtcgccagtgtcgacgacaagtacgccacctgcgcctaccccgccgacccagacaaggaaattgacataaagaaccacaaatggggccactactttatgtgtggatacaagggcgtatacgagtatgctaggtcaaaagggatagatatgggcgaacctgttgctcttgatgttgtagttgatggcacagtccctcaaggatctggactttcaagctcagcagcatttgtctgttcagcaacaatcgctatcatggggattctcgggaaaaacttcccaaagaaagaagttgctcaatttacatgtaaatctgagcgtcatattgggacccagtcagggggtatggatcaggctatatctatcatggcgaaacctggatttgctgagttgatagatttcaacccaatcaaagcaaccgacgtgcaactaccctctggtggtacatttgtgattgcccactgcctggcagagtccaagaaagcagaaacagctgctacaaactacaacaaccgtgttgtagagtgtcgcttggcagcgattgttctcgccatcaaactagggatggatgcaaaaaaagccatcacatcagttacaaccctctctgatgttgaggggctatgtgtctcctttgctggcaaagaaggttcttcggatcctggagttgctgtgaagaagctattgcatgaggatccatatacgttggaggaaatagagaaaattacaggtcaaagcctggcaactgtctttcagagctctcaaacttcattggatgttttgagagctgcgaagcatttcaagttatttcagcgcgcctctcatgtgtactctgaagcaaggcgggtgtacgcatttaaggatactgtattatcaaaactcagcgatgaaggcatgcttaagaagctcggtgatctaatgaacgatagccatcatagctgcagtgtgttatatgaatgcagctgtcccgagttggaagagcttgtaaaagtgtgccgggacaatggggcgctcggagctcggctcacaggagccgggtggggcggctgtgcagtcgccctcgtcaaggagggcatcgtcccacagttcatcctcaatttgaaggagaagtactacaaatcaaggatcgacaggggagtgatcaagcagagcgacattggcctgtacgtgtttgcttcgaagccgtcgagtggcgcggccatactgaggctgtagatcggccacttccggccgtggtcggtcacttgtacatgcatgcacacatactcgcccgcaacctattgatcgaataaacgcgtgctcggaggtccgagcacgctgccattagctgaattagtccccacccatgcgtgtctgaatgtacaatactacaatgtgtagcctctatttatcgttgtttccgggcgttctgagtgccaggttatctacatgccgatcttggtcctctcctagaggcacggagacggagtccgatggttgatggatcgctgatgtttttcttttcgtttttgaggtgtggttacatgaccagacactcacgtcgactggctgagaacagcgggagagctctgctgtcctggaaactttggagaaacgacaacagcagaaaaccaaagctccacca

SEQ ID NO: 2481 - DNA, 1789 bp, Secale cereale
cgcagagcaggggagagtccaaacttcttcctctcgaaccacccgagagagacagagagagaggcgatggcgaccaaggaggccaaggtggttcccgccggcgacgtcgacgaggagatgatcccggcgctggccgcgctggagccggtgtacggcgcggggccgcgctcgaggaggcgcgccgccgcttcgcccgcctcgacgaccgcttccgcgccctctacgccgccggccccgccctcttcgcccgctccccagggagggtgaatctcatcggggagcacatcgactacgagggctactcggtgctgcccatggccatccgccaggacatgatcgtcgccatccgcagggccgacggcggcctcgtccgcgtcgccaatgtcgacgataagtacgccacctgcgcctaccccgccgaccccaacaaggaaattgacatcaagaaccacaagtggggccactactttatgtgcggatacaagggagtatacgaatatgctaggtcgaaagggatagatatgggtgaacctgttgctcttgatgttgttgttgatggcacagtccctcaaggatctggactttcaagctcagcagcatttgtctgttcagcaacaattgctatcatgggaattctcgggaaaaacttcccaaagaaagaagttgctcaatttacttgtcaatctgagcgtcatattgggacacagtcaggtggtatggatcaggctatatctatcatggccaaacctggatttgctgagttgatagatttcaatccaatcaaagcaaccgatgtgcaattaccctctggtggtacatttgtgattgctcactgcctggcagagtccaagaaagcagaaacagctgctacaaactacaacaatcgtgttgtagagtgtcgcttggcagcgattgttctcgccatcaaactagggatggatacaaaaaaggctgtcacatctgttacgaccctctctgatgttgaggggctatgcgtctcctttgctggcaaagaaggttctgctgatcccggagttgctgtgaagaagctgttgcatgaggagccatatacgttggaggaaatagagaaaattacaggtcaaagcctagcaactgtcttccagagctctcaaacttccttggatgttttgagggctgcgaagcatttcaagttatttcagcgtgcctctcatgtgtactctgaagcgaggcgggtgtacgcatttagggacacagtattatcgaaactcagtgaggaaggtatgctcaagaagctcggtgatctaatgaacgatagccatcacagctgcagtgtgctatatgaatgcagctgtcccgagttggaagagcttgtaaaagtgtgccgggacaacggggcgctcggagcgcggctcacaggagccgggtggggcggctgcgtggttgccctggtcaaggagggcatcgtcccacagttcatcctcaatttgaaggagaagtactacaaatcgaggatcgacaggggggtgatcaagcagagcgaccttggcctgtatgtgtttgcgtcgaagccgtcgagcggcgcggccatactgaggctgtagatggaccgccgccggccttgttggtcggtcacttgtacatgaagcacatactccccccacaacctattattgatcgaataaacacgcgtgctcgctgccattagctaatttattagtccacctatgcgtgcctgaatgtacattactagtacaacaatgtgtaccttatcgttggttgtttatgagcgatgcgggttatcgattgg

SEQ ID NO: 2482 - DNA, 1501 bp, Triticum aestivum
gagggtgaatctcatcggggagcacatcgactacgagggctactcggtgctgcccatggccatccgccaggacatgatcgtcgccatccgcagggccgacggcggcctcgtccgcgtcgccaatgtcgacgacaagtacgccacctgcgtctaccccgccgacccagacaaggaaattgacatcaagaaccacaaatggggccactactttatgtgcggatacaagggagtatatgaatatgctaggtcaaaagggatagatatgggtgaacctgttgctcttgatgttgttgttgatggcacagtccctcaaggatctggactttcaagctcagccgcatttgtctgttcagcaacaattgctatcatgggaattctcgggaaaaacttcccaaagaaagaagttgctcaatttacttgtcaatctgagcgtcatattgggacacagtcaggtggtatggatcaggctatatctatcatggccaaacctggatttgctgagttgatagatttcaatccaatcaaagcaaccgatgtgcaactaccttctggtggtacatttgtgattgctcactgcctggcagaatccaagaaagcagaaacagctgctacaaactacaacaaccgcgttgtagagtgtcgcttggcagcgattgttctcgccatcaaactagggatggatacaaaaaaagccgtcacgtctgttacgactctctctgatgttgaggggctatgcgtctcctttgctggcaaagaaggttcttctgatcccggagttgctgtgaagaagctattgcatgaggagccatatactttggaagaaatagagaaaattacaggtcaaagcctagcaactgtcttccagagctctcaaacttccttggatgttttgagagcagcgaagcatttcaagttatttcagcgtgcctctcatgtgtactctgaagcaaggcgggtgtacgcatttagggatactgtattatcgaaactcagcgatgaaggtatgcttaagaagctcggtgatctaatgaacgatagccatcatagctgcagtgtgctatatgaatgcagctgtcccgagttggaagagcttgtaaaagtgtgccgggacaacggggcgctcggagcacggctcacaggagccgggtggggcggctgcgcagtcgccctggtcaaggagggcatcgtcccacagttcatcctcaatttgaaggagaagtactacaaatcaaggatcgacaggggagtgatcaagcagagcgaccttggcctctatgtgtttgcgtcgaagccgtcgagcggcgcggccatactgaggctgtagatcgaccaccgccggccgtggccggtcacttgtacatgcacacatactctcgaataaacgcgtgctcgaggcgagcacgctgccattagctaatttagtccccgcccatgcgtgtctgaatgtacaataccagtacaatgtgtagtatttatcgttgtttattatgggcgatctgac

SEQ ID NO: 2483 - DNA, 1093 bp, Pennisetum glaucum
cacgagcggcggaggtcgtcgtcgccgtggttgccgcagtccttgccgcccatggctgctgcgtggtgctggtggtgaggtgaggtgggcagcagcggcagggggtgaggacgggagaaggagaacaacaaggggggagggagaagaggaggcgaaggcgagggcgcgaggagcaccagccatggtgcacgtcaacttctaccgcaactatggtaagacattcaagaagccaaggcgtccttatgagaaggagcgtcttgatgctgaactgaagctcgtcggtgagtatgggctgaggtgcaagcgtgagctgtggagggtccagtatgctctgagcaggatccgtaacgctgcaaggcacttgctcacacttgacgagaagaacccccgccgtatctttgagggtgaggcgctgctccgccgcatgaaccgctatgggctgcttgctgagggtcagaacaagcttgattacgtccttgccctcactgctgagaacttcctcgcaaggcgccttcagactcttgtcttcaaggctggcatggccaagtccatccaccatgctcgtgtcttgatcaagcaacgtcacatcagggttggcaggcaaatcgtcaatgtcccatctttcatggtgagggtggagtctgagaagcacattgacttttcgctgtcaagcccgtttggtggaggccccccagggagggtgaagaggaagaaccagaagaaggcaactggtggtggtggtgatggtggtgatgaggatgaggagtgaagagatccagtagcaattgtctgataatattatctagttgtcataaacatatcagtatcttgagcacttagctgtgtggcccggtgcgcagacccatgtgctgttgcggtgtcacatatgttatcgttttatctggattctggaggagtttttagcccatacttagttgctatgtttggagatgttcaattatgttgaggttttatgtggtttcaacttctgtttgccatcaagctgtacctttctttcccttcctatgatttgccaatttcgtttgcattatctgctgagttgcctttctagtgacgttgatgagatggtggt

SEQ ID NO: 2484 - DNA, 941 bp, Saccharum officinarum
actccccccacagaagcggcggcggcggagcaagaggaggcgagggcgagggcgagggcgcgagggagggagaggagcaccaaccatggtgcacgtgagcttctaccgcaactatggtaaaacattcaagaaaccaaggcgtccttatgagaaggagcgtcttgacgctgaactgaagctggtcggtgagtatgggctgaggtgcaagcgtgagctctggagggtccagtatgcactgagcaggatccgtaatgctgcaaggcacttgctcacccttgatgagaagaacccccgccgtatctttgagggtgaggcgcttctccgtcgcatgaaccgctatgggctgctcgctgagggtcagaacaagcttgattatgtccttgcccttactgctgagaacttccttgcaaggcgccttcaaacacttgtcttcaaggctggcatggccaagtccattcaccatgctcgtgtcttgatcaagcagcgtcacatcagggttggcaggcaaattgtcaatgtcccatcattcatggtgagggtggagtctgagaagcacattgacttttcactgtcaagcccgttcggtggaggtccaccaggcagggtgaagagaaagaaccagaagaaggcaagtggtggtggcggcgatggtggtgatgaggatgaggagtgaggatgcacaagtagcattacccaatatgatattatctagttttcataaacatgttcgtatcatgagtacttagctgcgtgacctgatgctcagtctcctgcgctgactctgtgtcatggtggttatcattttatcttgtgttattagcctatacttagctgctatgtttggagatgtttaatcctgtggttggtttttgacttaagctctgttgctattatgctgttcctgttttctttcggccaatgatttgctgaaacaatggttt

SEQ ID NO: 2485 - DNA, 985 bp, Panicum virgatum
ccagcgactccaccacagaagcggcggcgcggcggagggagaagagggggcgaaggcgagggcgcggggaagggagaggagcaccagcaatggtgcacgtcagcttctaccgtaactatggtaagacattcaagaagccaaggcgtccttatgagaaggagcgtcttgatgctgagctgaagctcgtcggtgagtacgggctgaggtgcaagcgtgagctgtggagggtccagtatgctctgagcaggatccgtaatgctgcaaggcacttgctcacacttgatgagaagaacccccgccgtatctttgagggtgaggcgctgctccgccgcatgaaccgctatgggctgcttgctgagggtcagaacaagcttgattacgtccttgccctcactgctgagaacttcctggcaaggcgccttcagactcttgtcttcaaggctggcatggccaagtccatccaccatgctcgtgtcttgatcaagcaacgccacatcagggttggcaggcaaattgtcaatgtcccgtcattcatggtgagggtggagtctgagaagcacattgacttttcactgtcaagcccattcggcggaggtcccccaggcagggtgaagaggaagaaccagaagaaggcaagcggtggtggcggcgacggcggcgatgaggacgaggagtgaggatgaaccagtagccgttacctgatttaatattatctagttgtcataaacatgttggtatcttgagctcttagctgtgtggcctgatgctcagtcccttgtgttgactgggcatcacggatgtttatcgttttgccttgcagtgttattagcctatacttagctgctatgtttgaagatgtttaatcatgttgcgtttcaacttctgttgtcatcaaagctgtacctgttttctctgcacctatgatttgccaagtcagttcacataatctgcttgagttgcctttctatatataatggatgatggt

SEQ ID NO: 2486 - DNA, 943 bp, Panicum virgatum
gcggcggcggcggaggagggagaagaggaggcgacggccagggcgcgaggaagggagcggagcaccagccatggtgcacgtcagcttctaccgcaactatggtaagacattcaagaagccaaggcgtccttatgagaaggagcgtcttgatgctgagctgaagctcgtcggtgagtacgggctgaggtgcaagcgtgagctgtggagggtccagtatgctctgagcaggatccgtaatgctgcaaggcacttgctcacacttgatgagaagaacccccgccgtatctttgagggtgaggcactgctccgccgcatgaaccgctatgggctgcttgctgagggtcagaacaagcttgattacgtccttgccctcactgctgagaacttcctggcaaggcgccttcagactcttgtcttcaaggctggcatggccaagtccatccaccatgctcgtgtcttgatcaagcaacgccacatcagggttggcaggcaaattgtcaatgtcccatcattcatggtgagggtggagtctgagaagcacattgacttttcactgtcaagcccgttcggcggaggccccccaggcagggtgaagaggaagaaccagaagaaggcaagtggtggtggcggcgacggcggtgatgaggatgaggagtgaggatgaaccagtagccgttacctgatataatattatctagttgtcataaacatgttggtatcttgagctcttagctgtgtggcctgatgctcagccccttgtgctgactgggcatcacggatggttatcgttttatcttgcagtgttattagcctatacctagctgctatgttttgagatgtttattcaagttgcgtttcaacttctgttgtcatcaaagctgtacctgttttctctgcaccaatgatttgccaagtcgtttgcataatttgcttgagttgcctt

SEQ ID NO: 2487 - DNA, 964 bp, Panicum virgatum
accacagaagcggcggcggcggcggagggagaagaggaggcgaaggcgagggcgcgagggagggagcggagcaccagccatggtgcacgtcagcttctaccgcaactatggtaagacattcaagaaaccaaggcgtccttatgagaaggagcgtcttgatgctgagctgaagctcgtcggtgagtacgggctgaggtgcaagcgtgagctgtggagggtccagtatgctctgagcaggatccgtaatgctgcaaggcacttgctcacacttgatgagaagaacccccgccgtatctttgagggtgaggcgctgctccgccgcatgaaccgctatgggctgcttgctgagggtcagaacaagcttgattacgtccttgccctcactgctgagaacttcctggcaaggcgccttcagactcttgtcttcaaggctggcatggccaagtccatccaccatgctcgtgtcttgatcaagcaacgccacatcagggttggcaggcaaattgtcaatgtcccatcattcatggtgagggtggagtctgagaagcacattgacttttcactgtcaagcccgttcggcggaggccccccaggcagggtgaagaggaagaaccagaagaaggcaagtggtggtggcggcgacggtggcgatgaggatgaggagtgagaatgaaccagtagccgtttcctgatataatattatctagttgtcatgaacatgttggtatcttgagctcttagctgtgtggcctgatgctcagtcccctgtgctgactgggcgtcacagatggttatcattttatcttgcagtgttattagcctatacctagctgctatgtttggagatgtttaatcaagttgcgtttcaacttctgttgtcatcaaagctgtacctgttttctctgcacctatgatttgccaagtcgttcgcataatctgcttgactaccctttctatagatgat

SEQ ID NO: 2488 - DNA, 1083 bp, Sorghum bicolor
atataaacgcgaccctcgcgacctagcaccactaccagcgacccctcacagaagcggcggcggcggagcaagaggaggcgaaggcgagggcgagggcgcgagggagggacaggagcaccagccatggtgcacgtgagcttctaccgcaactatggtaaaacattcaagaaaccaaggcgtccttatgagaaggagcgtcttgatgctgaactgaagctggttggtgagtatggtctgaggtgcaagcgtgagctctggagggtccagtatgcactgagcaggatccgtaatgctgcaaggcacttgctcacccttgatgagaagaacccccgccgtatctttgagggtgaggcgcttctccgccgcatgaaccgctatgggctgcttgctgagggtcagaacaagcttgattatgtccttgcccttactgctgagaacttccttgcaaggcgccttcagacacttgtcttcaaggctggcatggccaagtctattcaccatgctcgtgtcttgatcaagcagcgtcacatcagggttggcaggcaaatcgttaatgtcccatcgttcatggtgagggtggagtctgagaagcacattgacttttcactgtcaagcccgttcggtggaggccccccaggcagggtgaagaggaagaacctgaagaaggcaagtggcggtggcggcgatggtggtgatgaggatgaggagtgaggatgaacaagtagcatggccccaatataatattatctagttttcataaacatgttcctatcatgagtacttagctgggtgaccagatgctcagtcccctgtgctgactctgcgtcatggatggttatcattttatcttgtgttactagcctatacttagctgctatgtttggagatgtttaatcctgtggttggtttttgacttatgctctgttgctattaagctgttcctgttttcttttggccaatgatttgctgaagcatcattcataatctgcctcagttgcctttggttgtattgatcggggcatgtgctgaaattttgttgctgtgagagtattaacgaatggtttgtggatattttatgtgacc

SEQ ID NO: 2489 - DNA, 1135 bp, Sorghum bicolor
ttgctcggcccactagggtttttggtagtatataaacgcgaccctcgcgacctagcaccactaccagcgacccctcacagaagcggcggcggcggagcaagaggaggcgaaggcgagggcgagggcgcgagggagggacaggagcaccagccatggtgcacgtgagcttctaccgcaactatggtaaaacattcaagaaaccaaggcgtccttatgagaaggagcgtcttgatgctgaactgaagctggttggtgagtatggtctgaggtgcaagcgtgagctctggagggtccagtatgcactgagcaggatccgtaatgctgcaaggcacttgctcacccttgatgagaagaacccccgccgtatctttgagggtgaggcgcttctccgccgcatgaaccgctatgggctgcttgctgagggtcagaacaagcttgattatgtccttgcccttactgctgagaacttccttgcaaggcgccttcagacacttgtcttcaaggctggcatggccaagtctattcaccatgctcgtgtcttgatcaagcagcgtcacatcagggttggcaggcaaatcgttaatgtcccatcgttcatggtgagggtggagtctgagaagcacattgacttttcactgtcaagcccgttcggtggaggccccccaggcagggtgaagaggaagaacctgaagaaggcaagtggcggtggcggcgatggtggtgatgaggatgaggagtgaggatgaacaagtagcatggccccaatataatattatctagttttcataaacatgttcctatcatgagtacttagctgggtgaccagatgctcagtcccctgtgctgactctgcgtcatggatggttatcattttatcttgtgttactagcctatacttagctgctatgtttggagatgtttaatcctgtggttggtttttgacttatgctctgttgctattaagctgttcctgttttcttttggccaatgatttgctgaagcatcattcataatctgcctcagttgcctttggttgtattgatcggggcatgtgctgaaattttgttgctgtgagagtattaacgaatggtttgtggatattttatgtgaccataattatgcgacgttgtagcat

SEQ ID NO: 2490 - DNA, 862 bp, Pennisetum glaucum
actcccagcgattccaccacagaagcggcggcggcggcggaagaggagggagaagaggaggcgaaggcgagggcgcgaggagcaccagccatggtgcacgtcaacttctaccgcaactatggtaagacattcaagaagccaaggcgtccttatgagaaggagcgtcttgatgctgaactgaagctcgtcggtgagtatgggctgaggtgcaagcgtgagctgtggagggtccagtatgctctgagcaggatccgtaacgctgcaaggcacttgctcacacttgacgagaagaacccccgccgtatctttgagggtgaggcgctgctccgccgcatgaaccgctatgggctgcttgctgagggtcagacaagcttgattacgtccttgccctcactgctgagaacttcctcgcaaggcgccttcagactcttgtcttcaaggctggcatggccaagtccatccaccatgctcgtgtcttgatcaagcaacgtcacatcagggttggcaggcaaatcgtcaatgtcccatctttcatggtgagggtggagtctgagaagcacattgacttttcgctgtcaagcccgtttggtggaggccccccagggagggtgaagaggaagaaccagaagaaggcaactggtggtggtggtgatggtggtgatgaggatgaggagtgaagagatccagtagcaattgtctgataatattatctagttgtcataaacatatcagtatcttgagcacttagctgtgtggcccggtgcgcagacccatgtgctgttgcggtgtcacatatgttatcgttttatctggattctggaggagtttttagcccatacttagttgctatgtttggagatgt

SEQ ID NO: 2491 - DNA, 883 bp, Triticum aestivum
cagaagcggcggcggcggacaaacgcaggcgaaggcgagggtgtgagggaaggagcaccagccatggtgcacgtgagcttctaccgcaactatggtaaaacattcaagaaaccaaggcgtccttatgagaaggagcgtcttgatgctgaactgaagctggttggtgagtatggtctgaggtgcaagcgtgagctctggagggtccagtatgccctgagcaggatccgtaatgctgcaaggcacttgctcacccttgatgagaagaacccccgccgtatctttgagggtgaggcgcttctccgccgcatgaaccgctatgggctgcttgctgagggtcagaacaagcttgattatgtccttgcccttactgctgagaacttccttgcaaggcgccttcagacacttgtcttcaaggctggcatggccaattccattcaccatgctcgtgtcttgatcaagcagcgtcacatcagggttggcaggcaaatcgttaatgtcccatcgttcatggtgagggtggagtctgagaagcacattgacttttcactgtcaagcccgttcggtggaggccccccaggcagggtgaagaggaagaacctgaagaaggcaagtggcggtggcggcgatggtggtgatgaggatgaggagtgaggatgaacaagtagcatggccccaatataatattatctagttttcataaacatgttcctatcatgagtacttagctgggtgaccagatgctcagtcccctgtgctgactctgcgtcatggatggttatcattttatcttgtgttactagcctatacttagctgctatgtttggagatgtttaatcctgtggttgtttttgacttatgctctgttgctattaagctgttcctg

SEQ ID NO: 2492 - DNA, 890 bp, Triticum aestivum
agaggagcgaaggcgagggcgagggtgagggcgcgagggagggacaggagcaccagccatggtgcacgtgagcttctaccgcaactatggtaaaacattcaagaaaccaaggcgtccttatgagaaggagcgtcttgatgctgaactgaagctggttggtgagtatggtctgaggtgcaagcgtgagctctggagggtccagtatgccctgagcaggatccgtaatgctgcaaggcacttgctcacccttgatgagaagaacccccgccgtatctttgagggtgaggcgcttctccgccgcatgaaccgctatgggctgcttgctgagggtcagaacaagcttgattatgtccttgcccttactgctgagaacttccttgcaaggcgccttcagacacttgtcttcaaggctggcatggccaattccattcaccatgctcgtgtcttgatcaagcagcgtcacatcagggttggcaggcaaatcgttaatgtcccatcgttcatggtgagggtggagtctgagaagcacattgacttttcactgtcaagcccgttcggtggaggccccccaggcagggtgaagaggaagaacctgaagaaggcaagtggcggtggcggcgatggtggtgatgaggatgaggagtgaggatgaacaagtagcatggccccaatataatattatctagttttcataaacatgttcctatcatgagtacttagctgggtgaccagatgctcagtcccctgtgctgactctgcgtcatggatggttatcattttatcttgtgttactagcctatacttagctgctatgtttggagatgtttaatcctgtggttgtttttgacttatgctctgttgctattaagctgttcctgtttcttttggcc

SEQ ID NO: 2493 - DNA, 854 bp, Eragrostis curvula
  misc_feature (23)..(23): n is a, c, g, or t
  misc_feature (770)..(770): n is a, c, g, or t
  misc_feature (801)..(801): n is a, c, g, or t
  misc_feature (819)..(819): n is a, c, g, or t
gtagggggaccgtcagcgactcncctctagaagcggcggcggcggaagagaaggcgagggcgcgagggagaaaggagaggagcaccagccatggtgcacgtcaacttctatcgcaactatggcaagactttcaagaagcccaggcgtccttatgagaaggagcgtcttgacgcagagctgaagctggtcggtgagtacggcctgaggtgcaagcgtgagctgtggagggtccagtacgccctgagcaggatccgtaatgctgccaggcacttgctcactctggatgagaagaacccccgccgtatctttgagggtgaggcgctgctccgccgcatgaaccgctatggactgctcgctgagggccagaacaagcttgattatgtcctggctcttaccgctgagaacttccttgcgaggcgtcttcagacccttgtcttcaaggctggtatggccaagtccattcaccatgcccgtgtcttaatcaggcagcgccacatcagggttggcaggcagattgtcaatgtcccatcgttcatggtgagggttgagtctgagaagcacgttgacttctcactgaccagcccattcggtggaggccccccaggcagggtgaagagaaagaaccagaagaaggcaagtggtggcggcggtgacggtggtgatgaagatgaggagtgaagaacgagccagtagcagttacctaatatattatgtagtcatcataaaaaatgtttgtgctatgagtacttgctgggtggtctgatactcanccccgttctgtatggcgtaatcggttttccnccagacaggatggttacngctttatcttgtgttccttagcctatatacttagc

SEQ ID NO: 2494 - DNA, 1082 bp, Zea mays
atataaaagctgccctcgcgacctagcaccagcccagccactccactcctaccccacacagaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtggagtctgagaagcacattgacttttcactgtcaagcccattcggtggaggccccgcaggaagggtgaagagaaagaatcagaagaaggcaagcggtggcggcgatgctggcgatgaggatgaggagtgaggatggacaagtagcgttacccaatataataatattatctagttttcttgaacttgttcgaatgatgagtgcttagctgtgtgatctgacgcagagttccctgtgctgactctgtgtcatggatggtccattttatcttgtggtattatcagcctttacataactgctatgtttggatatgttcaattctgttgcaattttatgtggttgtttttttgcgttttgttgctattaagctgttctttcaatcggctaatgatttgcttaaatgttatttataatctgcttcagcttgttgtactgattgggtatatgatacgcttaaaattttgttgctgtgacagtattgacaactggtctgtgaacatttgatat

SEQ ID NO: 2495 - DNA, 962 bp, Brachypodium distachyon
cagcccactagggttttgcttccaggtataaaacacccttcttctcctaccgcaccccttcctcctatcaactccaccacagagcggcggcggcgcaggcgcaggcgagagagctccagccatggtgcacgtcaacttctaccgcaactatgggaagacattcaagaaaccaaggcgtccctatgagaaggagcggcttgatgcagaactcaagctggtgggtgagtatggactgaggtgcaagcgtgagctgtggagggttcagtatgctttgagcaggatccgtaatgctgcaaggcacttgctcaccttggatgagaagaacccccgccgtatctttgagggcgaggctcttctccgccgcatgaaccgctatggacttcttgctgagggtcagaacaagcttgattacgtccttgcccttactgctgagaacttccttgcaaggcgtcttcagacccttgtcttcaaggctggcatggcaaagtctatccaccatgctcgtgtcttgatcaggcaacgtcacatcagggttggcaggcagattgtgaacgtcccatcgttcatggtgagggttgaatctgagaagcacatcgacttttcactgaccagtccattcggtggaggccagccaggcagggtgaagcggaagaaccagaagaaggctagcggtggtggtgacgctggtggcgacgaggatgaggaatgagaaggaagtagtagctgttccctaatattttatcaaatataatcatgagaatgttgctgtcatgagtacttagctggctgagaggcctaagacttgtcatcggttttcctctaggcaggacgttttgtcacttcatctctgtgttgttagcctgtacttctgctatgtttggagctatttaatcgtgatgcagtttctttatatgttttttaccatgctctgagattctggtcacatagcctatcttgcgtta

SEQ ID NO: 2496 - DNA, 879 bp, Brachypodium distachyon
cttcctcctatcaactccaccacagagcggcggcggcgcaggcgcaggcgagagagctccagccatggtgcacgtcaacttctaccgcaactatgggaagacattcaagaaaccaaggcgtccctatgagaaggagcggcttgatgcagaactcaagctggtgggtgagtatggactgaggtgcaagcgtgagctgtggagggttcagtatgctttgagcaggatccgtaatgctgcaaggcacttgctcaccttggatgagaagaacccccgccgtatctttgagggcgaggctcttctccgccgcatgaaccgctatggacttcttgctgagggtcagaacaagcttgattacgtccttgcccttactgctgagaacttccttgcaaggcgtcttcagacccttgtcttcaaggctggcatggcaaagtctatccaccatgctcgtgtcttgatcaggcaacgtcacatcagggttggcaggcagattgtgaacgtcccatcgttcatggtgagggttgaatctgagaagcacatcgacttttcactgaccagtccattcggtggaggccagccaggcagggtgaagcggaagaaccagaagaaggctagcggtggtggtgacgctggtggcgacgaggatgaggaatgagaaggaagtagtagctgttccctaatattttatcaaatataatcatgagaatgttgctgtcatgagtacttagctggctgagaggcctaagacttgtcatcggttttcctctaggcaggacgttttgtcacttcatctctgtgttgttagcctgtacttctgctatgtttggagctatttaatcgtgatgcagtttctttatatgttttttaccatgctctgagatt

SEQ ID NO: 2497 - DNA, 841 bp, Pennisetum glaucum
agaagcggcggcggcggcggaagaggagggagaagaggaggcgaaggcgagggcgcgaggagcaccagccatggtgcacgtcaacttctaccgcaactatggtaagacattcaagaagccaaggcgtccttatgagaaggagcgtcttgatgctgaactgaagctcgtcggtgagtatgggctgaggtgcaagcgtgagctgtggagggtccagtatgctctgagcaggatccgtaacgctgcaaggcactgcggtcacgacttgacgagaagaacccccgccgtatctttgagggtgaggcgctgctccgccgcatgaaccgctatgggctgcttgctgagggtcagaacagcttgattacgtccttgccctcactgctgagaacttcctcgcaaggcgccttcagactcttgtcttcaaggctggcatggccaagtccatccaccatgctcgtgtcttgatcaagcaacgtcacatcagggttggcaggcaaatcgtcaatgtcccatctttcatggtgagggtggagtctgagaagcacattgacttttcgctgtcaagcccgtttggtggaggccccccagggagggtgaagaggaagaaccagaggaaggcaaactggtggtgggtgggtgaataggtagggtgaatgaggatgaggagtgaagagatccagtagcaattgtctgataatattatctagttgtcataaacatatcagtatcttgagcacttagctgtgtggcccggtgcgcagacccatgtgctgttgcggtgtcacatatgttatcgttttatcagtatcttgagcactcagctgtgtggcccgatgcgcagacc

SEQ ID NO: 2498 - DNA, 877 bp, Lolium multiflorum
gccaccacacagcggcggcggcggcggcagcacagcgggagcgagagagagagaggagagagctccagccatggtgcacgtcaacttctaccgcaactatggcaagacattcaagaagccaaggcgtccttatgagaaggagcgtcttgacgcagaactgaagctggtcggtgagtatggactgaggtgcaagcgtgagctgtggagggttcagtatgcattgagcaggatccgcaatgctgcaaggcacttgctcacactggatgagaagaacccccgccgtatcttcgagggtgctgcgcttctccgccgcatgaaccgctatgggctcctcgctgagggtcaggacaagcttgattacgtccttgccctgactgctgagaacttccttgcaaggcgcctgcagactcttgtcttcaaggctggcatggcaaagtcaatccaccatgcccgtgtcttgatcaggcagcgccacatcagggttggcaggcaaatcgtcaatgtcccatccttcatggtgagggttgagtctgagaagcacattgacttttcgctgacaagcccattcggtggaggcccagcaggcagggtgaagaggaagaaccagaagaaggcaagtggtggcggtgatgctggtggtgacgaggatgaggagtgataaggaactactagtagctatcacctaatatttatcaaaatacaatcatcctgagaatgttggtgtgtcatgagtactttagctgagaggcctggcctgagacttgtcatgggtttttccctctaggcaggacgttttgttgctttatcttgtgttgttagcatgcactttcgtatgtttgactttggagctgttatatcttgatgcagttattttcga

SEQ ID NO: 2499 - DNA, 1101 bp, Oryza sativa
ctctcgccgctgccatataaaagctctctcctcttcactcctcgccgccgcgctcctcctcccctcgagaaacccaagctccagcaatcggcggcggcggcgacgcgggagaggcggtccggcgacgatggttcacgtcagcttctaccgcaactatggtaagacattcaagaagccacgtcgcccttacgagaaggagcgtcttgatgcagagctgaagctagtgggtgagtatggactgaggtgcaagcgtgagctgtggcgtgttcagtatgctttgagccgtatccgtaacaatgcaaggcacctgctcacacttgatgagaagaatccacgccgcatcttcgagggtgaggcactgcttcgccgcatgaaccgttatgggctccttgctgatgggcagaacaagcttgattatgtccttgccctcactgttgagaactttctcgcaaggcgtcttcagactcttgtcttcaaggctggcatggccaagtccatccaccatgctcgtgtcctgatcaggcaacgccacatcagggtcggcaggcaaattgtcaacatcccatcattcatggtgagggttgagtctgagaagcacattgacttctcactgacaagcccattcggtggaggcccccctggtagggtgaagcggaagaaccagaagaaggcaagcggcggtggtggtgacggtgaggaagaagatgaggaatgagaagaagtttgcagctagttgtttccgtaacgatcataaaactttctgtgctgagtaactgggcccaaattctgtagcttgcctatctgggtttcagaattcaagcaggttgtgtccttaatatgttggtttatgttagcactttttggcattatgttagatagctcgaattaaagatatatctggagatgtttttgcattcggcatagacttgtggttaatgctgttttatggattcgtttcatggtaattctcactcgtaccagtgtgcttgaactagtgatactcgtaccgatgctgtttttagtgtttttatggattggaagttgcaacatggattatggagttgttaagattaatttagtagcgtgtcaggtaatatttac

SEQ ID NO: 2500 - DNA, 1104 bp, Oryza sativa
aaaagctctctcctcttcactcctcgccgccgcgctcctcctcccctcgggaaaccatagctccagcaatcggcggcggcggcgacgcgggagaggcggtccggcgacgatggtccacgtcagcttctaccgcaactatggtaagacattcaagaagccacgtcgcccttacgagaaggagcgtcttgatgcagagctgaagctagtgggtgagtatggactgaggtgcaagcgtgagctgtggcgtgttcagtatgctttgagccgtatccgtaacaatgcaaggcacctgctcacacttgatgagaagaatccacgccgcatcttcgagggtgaggcactgcttcgccgcatgaaccgttatgggctccttgctgatgggcagaacaagcttgattatgtccttgccctcactgttgagaacttcctcgcaaggcgtcttcagactcttgtcttcaaggctggcatggccaagtccatccaccatgctcgtgtcctgatcaggcaacgccacatcagggtcggcaggcaaattgtcaacatcccgtcgttcatggtgagggttgagtctgagaaacacattgacttctcactgacaagcccattcggtggaggcccccctggtagggtgaagaggaagaaccagaagaaggcaagcggcggtggcggtgatggtgaggaggaagatgaggaatgagaagaagtttgcaactagttgtttccgtaatgatcataaaactttctgtgctgagtaactgggcccaaattctgtagcttgcctatctgggtttcagaattcaagcaggttggccttcagatgttggtttatgttagctctttttggcaccatgttaggtagctcgaattaaagatatgcctggagatgtttaattttggtgttttatatgtttttgcattcggcattgtggtcaatgctgttttatggattcgtttcatggtaatcctcactcgtaccagtgtgcttgaactagtttatactcactcgtaccaatgctgtttttagtgtttttatggattggaagttgcaacatggattatgtagttaagattaatttagtagcgtgtcaggtaatatttacatgt

SEQ ID NO: 2501 - DNA, 1046 bp, Oryza sativa
ataaacgcgctctcctcctcactcctcctcccctcgagaaaccaaagctccagcaatcggcggcggcggcggcggcccgtgagaggcggtccggcgacgatggttcacgtcagcttctaccgcaactatggtaagacattcaagaagccacgtcgcccttacgagaaggagcgtcttgatgcagagctgaagctagtgggtgagtatggactgaggtgcaagcgtgagctgtggcgtgttcagtatgctttgagccgtatccgtaacaatgcaaggcatctgctcacacttgatgagaagaatccacgccgcatctttgagggtgaggcactgcttcgccgcatgaaccgttatgggctccttgctgatgggcagaacaagcttgattatgtccttgccctcactgttgagaacttcctcgcaaggcgtcttcagactcttgtcttcaaggctggcatggccaagtccatccaccatgctcgtgtcctgatcaggcaacgccacatcagggtcggcaggcaaattgtcaacatcccgtcgttcatggtgagggttgagtctgagaagcacattgacttctcactgacaagcccattcggtggaggcccccctggtagggtgaagaggaagaaccagaagaaggcaagtggcggtggcggtgacggtgaggaggaagatgaggaatgagaacagaagtttgcaactagttgtttccgtaatgatcataaaactctgtgctgagtaactaggcccaaattctgtagcttgcctatctgggattcagaattcaagcaggttgtgcttcaggtgttggtttatgttaaccctttttggcattatgttaggtatagacttgtggttaatgctgttttatggattcgtttcatggtaatcctcatcgtaccagtgcgcttgaactagtgatactcactcgtaccaatgctgtttttaatgtttttatggattcgaagttgcaacatggattatggagttgttaagattaatttagtagcgtctcaggtaatatttacatgttcagaccaaaa

SEQ ID NO: 2502 - DNA, 797 bp, Secale cereale
agcgggagagagagaggagagagctccagccatggtgcacgtcaacttctaccgcaattatggcaagacattcaagaaaccaaggcgtccttatgagaaggagcgtcttgatgcagaactaaagctggttggtgagtatggactgaggtgcaagcgtgagctctggagggttcagtatgcattgagcaggatccgtaatgctgcaaggcacttgctcacactggatgagaagaatccccgccgtatctttgagggcgctgctcttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttaatcaggcaacgccacatcagggttggcaggcagattgtcaatgtcccctcattcatggtgagggtggaatcggagaagcacatcgatttctcactgacaagtccattcggtggaggccctgcaggcagggtgaagagaaagaaccagaagaaggcaagtggtggcggtgacgctggtggtgatgaggaagaggaatgaggaactatcaccttatatttatcaaatgctggtgttatgagtactttagctgagaggcctgagacttacatgggttatcctcttgtcgtttttgtcacattatctctgttgttagcatgtatgcactttatgtttggatctatttggccgtgatgaaagttatctaaaaatgttttta

SEQ ID NO: 2503 - DNA, 852 bp, Triticum aestivum
ggcggcggcagcgggggagagaggagagagctccagccatggtgcacgtcaacttctaccgcaactatggtaagacattcaagaaaccaaggcgtccttatgagaaggagcgtcttgatgcagaactgaagctggttggtgagtatggattgaggtgcaagcgtgagctctggagggttcagtatgcattgagcaggatccgtaatgctgcaagacacttgctcacactggatgagaagaatccccgccgtatctttgagggtgcggctcttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccgtcgttcatggtgagggttgaatctgagaagcacatcgacttctcactgacaagtccattcggcggaggccctgcaggcagggtgaagagaaagaaccagaagaaggcaagtggtggcggcgacgccggtggtgatgaggaagaggaatgaggaactagtagctatcaccttatatttatcaaatgttggtgttatgagtactttagctgagaggcctgagactttcatgggttatcctcttgtcattttgtcactttatcactgttgttagcatgtatgcacttctttatgtttggagctatttggtcgtgatgttttcgactatgacctggaattattcttcaattgcttctgttggggtggttgtctgatagtt

SEQ ID NO: 2504 - DNA, 903 bp, Triticum aestivum
atcaagcttatcctggccctcctatcaactcgaccacagagcggcggcggcggcggcggcagcggaagaaagaggagagagctccagccatggtgcacgtcaacttctaccgcaactatggtaagacattcaagaaaccaaggcgtccttatgagaaggagcgtcttgatgcagaactaaagctggtcggtgaatatggactgaggtgcaagcgtgagctctggagggttcagtatgcactgagcaggattcgtaatgctgcaagacacttgctcacactggatgagaaaaatccccgccgtatctttgagggcgcggcccttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccctcgttcatggtgagggttgaatctgagaagcacatcgacttctcactgacaagtccattcggcggaggccctgcaggcagggtgaagagaaagaaccagaagaaggcaagtggtggcggcgacgccggtggtgatgaggaagaggaatgaggaactagtagctatcaccttatatttatcaaatgttggtgttatgagtactttagctgagaggcctgagactttcatgggttatcctcttgtcattttgtcactttatcactgttgttagcatgtatgcacttctttatgtttggagctatttggtcgtgatgttttcgactatgacctggaattattcttcaattgcttctgttggggtggttgtctgatagtt

SEQ ID NO: 2505 - DNA, 908 bp, Hordeum vulgare
ctctagagctgccgttcggagaactggctcccccgggctgcaggctcgaccacagagcggcggcggcggcggcggcagcgggagagagaggagagagctccagcaatggtgcacgtcaacttctaccgcaactatggtaagacattcaagaaaccaaggcgtccctatgagaaggagcgtctggatgcagaactaaagctggtgggtgagtatggactgaggtgcaagcgtgagctctggagggtccagtatgcattgagcaggatccgtaatgctgcaaggcacttgctcacactggatgagaagaatccccgccgtatctttgagggtgcagctcttcttcgtcgcatgaaccgctatgggctccttgctgagggccaggacaagcttgattacgtccttgccctgactgctgagaacttccttgcaaggcgccttcagactcttgtcttcaaggctggcatggcaaagtccatccaccatgcccgtgtcttgatcaggcaacgccacatcagggttggcaggcagatcgtcaatgtcccctcattcatggtgagggttgaatctgagaagcacattgacttttcactgacaagtccattcggtggaggccctgcaggcagggtgaagaggaagaaccagaagaaggcaagtggtggcggcgacgctggtggtgatgaggaagaggaatgaggaactagtagggatcaccttatatttatcaaatgttggtgttgtgagtgctttagctgagaggcctgagactttcatggattatcctcttgtcgtttcgttgcattatctctgttgttagcatgcatgcacttcgttatgtttggagctatttgttcgtgatgcagttatctgaaaatgtttttgactatgacctggaattctacatcaattgc

SEQ ID NO: 2506 - DNA, 1021 bp, Hordeum vulgare
cgaacgacccatactcgataccccacagcccgctagggtttctctggcaggtataaaatacccgttcttctcctctcccattcctccccctatcaactcgaccacagagcggcggcggcggcggcggcagcgggagagagaggagagagctccagcaatggtgcacgtcaacttctaccgcaactatggtaagacattcaagaaaccaaggcgtccctatgagaaggagcgtctggatgcagaactaaagctggtgggtgagtatggactgaggtgcaagcgtgagctctggagggtccagtatgcattgagcaggatccgtaatgctgcaaggcacttgctcacactggatgagaagaatccccgccgtatctttgagggtgcagctcttcttcgtcgcatgaaccgctatgggctccttgctgagggccaggacaagcttgattacgtccttgccctgactgctgagaacttccttgcaaggcgccttcagactcttgtcttcaaggctggcatggcaaagtccatccaccatgcccgtgtcttgatcaggcaacgccacatcagggttggcaggcagatcgtcaatgtcccctcattcatggtgagggttgaatctgagaagcacattgacttttcactgacaagtccattcggtggaggccctgcaggcagggtgaagaggaagaaccagaagaaggcaagtggtggcggcgacgctggtggtgatgaggaagaggaatgaggaactagtagggatcaccttatatttatcaaatgttggtgttgtgagtgctttagctgagaggcctgagactttcatggattatcctcttgtcgtttcgttgcattatctctgttgttagcatgcatgcacttcgttatgtttggagctatttgttcgtgatgcagttatctgaaaatgtttttgactatgacctggaattctacatcaattgcttctgtttgcgtgcttgtctgactaactctgtcccaaaataattagaattgtactccctct

SEQ ID NO: 2507 - DNA, 846 bp, Leymus cinereus x Leymus triticoides
gcggcggcggcggcggcagcgggagagagaggagagagctccagccatggtgcacgtcaacttctaccgcaactatggtaagacattcaagaagccaaggcgtccttatgagaaggagcgtcttgatgcagaactaaagctggtgggtgagtatgggctgaggtgcaagcgtgagctctggagggttcagtatgcattgagcaggatccgtaatgctgcaaggcacttgctcacactggatgagaagaatccccgccgtatctttgagggcgcagctcttcttcgtcgcatgaaccgctatgggctccttgctgtgggccaggataagcttgattacgtccttgccctgactgctgagaacttccttgcaaggcgccttcagactcttgtcttcaaggctggcatggcaaagtccatccaccatgcccgtgtcttgatcaggcaacgccacatcagggttggcaggcagatcgtcaatgtcccgtcattcatggtgagggttgaatctgagaagcacatcgacttctcactgacaagtccattcggtggaggccctgcaggcagggtcaagagaaagaaccagaagaaggcaagtggtggcggcgacgctggtggtgatgaggatgaggaatgaggaactagtagcttatcaccttatatttatcaaatgttggtgtcacgagtactttagatgagaggcctgagactttcatgggttaccctcttgtccttttgtcgctttatctctgttgttagcatgcatgcacttcgttatgtttggtgctatttggtcgtgatgcagttatctaaaaatgtttttgactattgacctgttattctccatca

SEQ ID NO: 2508 - DNA, 909 bp, Avena sativa
gaccatcaatttccaccacagagcggcggcggcggcatcacagccggagagagagagagaggagagctacagccatggtgcacgtcaacttctaccgcaactatggtaagacattcaagaagccaaggcgtccttatgagaaggagcgtcttgatgcagaactgaagctggttggtgagtatggactgaggtgcaagcgtgagctgtggagggttcagtatgcgctgagcagaatccgtaatgcggcaaggcacttgctcacactggatgagaagaatccccgccgtatctttgagggtgcggctcttctccgccgcatgaaccgctatgggctccttgctgagggtcaggacaagctggattacgtccttgctctcactgctgagaacttccttgcaaggcgccttcagactcttgtcttcaaggctggcatggcaaagtcaatccaccatgcccgtgtcttgatcaggcagcgccacatcagggttggcaggcaaattgtcaatgtcccttccttcatggtgagggttgaatctgagaagcacattgacttttctctgacaagcccatttggtggaggcctccctggcagggtgaagaggaagaacctgaagaaggcaagtggtggcggtgacgccggtggtgacgaggatgaggagtgataaggaactactagtagctatcacctaatattttatcaaaatacaatcatcatgagaatgttggtgtcatgagtactttagctgagaggcctgggacttgtcatgggttattcctctaggaggaccttgtcacttttatctggtgttgttagcttgcacttgctatgttctggagcaatttgatctgaagcagttgttttaagtatgttttcaaccatgacctgaaatcaatgcatctgttttgttg

SEQ ID NO: 2509 - DNA, 776 bp, Pseudoroegneria spicata
  misc_feature (297)..(297): n is a, c, g, or t
gctcccttcatggtgcacgtaaacttctaccgcaactatggtaagacattcaagaaaccaaggcgtccttatgagaaggagcgacttgacgcagaactaaagctggtgggtgagtatggactgaggtgcaagcgtgagctctggcgggttcagtatgcattgagcaggatccgtaatgctgcaaggcacttgctcacactggatgagaagaatccccgccgtatctttgagggcgcagctcttcttcgtcgcatgaaccgctatgggctccttgctgagggccaggataagcttgantacgtccttgccctgactgctgagaacttccttgcaaggcgccttcagactcttgtcttcaaggctggcatggcgaagtccatccaccatgcccgtgtcttgatcaggcaacgccacatcagggttggcaggcagatcgtcaatgtcccgtcgttcatggtgagggttgaatctgagaagcacattgacttctcgctgacaagtccattcggtggaggccctgcaggcagggtgaagagaaagaaccagaagaaggcaagtggtggcggcgacgctggtggtgatgaggaagaggaatgaggaactagtagctatcaccttatatttatcaaatgttggtgttatgagtactttagctgagaggcctgagactttcatgggttatcctcttgtcgttttgtcgcattatctctgttgttagcatgcatgcactttgttatgtttggagctatttggtcgtgatgcagttatctaaaaat

SEQ ID NO: 2510 - DNA, 806 bp, Triticum aestivum
agaaagaggagagagctccagccatggtgcacgtcaacttctaccgcaactatggtaagacattcaagaaaccaaggcgtccttatgagaaggagcgtcttgatgcagaactaaagctggtcggtgaatatggactgaggtgcaagcgtgagctctggagggttcagtatgcactgagcaggattcgtaatgctgcaagacacttgctcacactggatgagaaaaatccccgccgtatctttgagggcgcggcccttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccctcgttcatggtgagggttgaatctgagaagcacatcgacttctcactgacaagtccattcggtggaggccctgcaggcagggtgaagagaaagaaccagaagaaggcaagtggtggcggtgacgccggtggtgacgaggaagaggaatgaggaactagtagctatcaccttatatttatcaaatgttggtgttatgagtactttagctgagaggcctgagactttcatgggttatcctcttgtcattttgtcactttatcactgttgttagcatgtatgcactgctttatgtttggagctatttggtcgtgatgaaagttatctaaaaatgttcttgactaaaaa

SEQ ID NO: 2511 - DNA, 829 bp, Triticum aestivum
gagagagctccagccatggtgcacgtcaacttctaccgcaactatggtaagacattcaagaaaccaaggcgtccttatgagaaggagcgtcttgatgcagaactaaagctggtcggtgaatatggactgaggtgcaagcgtgagctctggagggttcagtatgcactgagcaggattcgtaatgctgcaagacacttgctcacactggatgagaaaaatccccgccgtatctttgagggcgcggcccttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccctcgttcatggtgagggttgaatctgagaagcacatcgacttctcactgacaagtccattcggtggaggccctgcaggcagggtgaagagaaagaaccagaagaaggcaagtggtggcggtgacgccggtggtgacgaggaagaggaatgaggaactagtagctatcaccttatatttatcaaatgttggtgttatgagtactttagctgagaggcctgagactttcatgggttatcctcttgtcattttgtcactttatcactgttgttagcatgtatgcactgctttatgtttggagctatttggtcgtgatgaaagttatctaaaaatgttcttgactatgacctggaatcctccttcaattgcttctgttggg

SEQ ID NO: 2512 - DNA, 900 bp, Secale cereale
gcaggtataaaataccccttcttctcctctcgcattcctccctcctatcaactcgaccacagagcggcggcggcggcgggcggcagcgggagagagagaggagagagctccagccatggtgcacgtcaacttctaccgcaattatggcaagacattcaagaaaccaaggcgtccttatgagaaggagcgtcttgatgcagaactaaagctggttggtgagtatggactgaggtgcaagcgtgagctctggagggttcagtatgcattgagcaggatccgtaatgctgcaaggcacttgcgtcacactggatgagaagaatccccgcgtatctttgagggcgctgctcttctccgtcgcatgaaccgctatggtctccttgctgagggccaggataagcttgattacgtccttgccctgactgctgagaacttccttgcaaggcgccttcagactcttgtcttcaaggctggcatggcaaaatccatccaccatgcccgtgtcttaatcaggcaacgccacatcagggttggcaggcagattgtcaatgtcccctcattcatggtgagggtggaatcggagaagcacatcgatttctcactgacaagtccattcggtggaggccctgcaggcagggtgaagagaaagaaccagaagaaggcaagtggtggcggtgacgctggtggtgatgaggaagaggaatgaggaactatcaccttatatttatcaaatgctggtgttatgagtactttagctgagaggcctgagacttacatgggttatcctcttgtcgtttttgtcacattatctctgttgttagcatgtatgcactttatgtttgaatctatttggccgtgatgaaagttatctaaaaatgttttttacaaaaaaaaaaaaaaaaa

SEQ ID NO: 2513 - DNA, 900 bp, Secale cereale
ctcccagcccgctagggttttgctggcaggtataaaatacccttcttctcctctcgcattcctccctcctatcaactcgaccacagagcggcggcggcggcgggcggcagcgggagagagagaggagagagctccagccatggtgcacgtcaacttctaccgcaattatggcaagacattcaagaaaccaaggcgtccttatgagaaggagcgtcttgatgcagaactaaagctggttggtgagtatggactgaggtgcaagcgtgagctctggagggttcagtatgcattgagcaggatccgtaatgctgcaaggcacttgcgtcacactggatgagaagaatccccgcgtatctttgagggcgctgctcttctccgtcgcatgaaccgctatggtctccttgctgagggccaggataagcttgattacgtccttgccctgactgctgagtacttccttgcaaggcgccttcagtactcttgtcttcaaggctggcatggacaaaatccatccaccatgcccgtgtcttaatcaggcaacgccacatcagggttggcaggcagattgtcaatgtcccctcattcatggtgagggtggaatcggagaagcacatcgatttctcactgacaagtccattcggtggaggccctgcaggcagggtgaagagaaagaaccagaagaaggcaagtggtggcggtgacgctggtggtgatgaggaagaggaatgaggaactatcaccttatatttatcaaatgctggtgttatgagtactttagctgagaggcctgagacttacatgggttatcctcttgtcgtttttgtcacattatctctgttgttagcatgtatgcactttatgtttgaatctatttggccgtgatgaaagttatctaaaaat

SEQ ID NO: 2514 - DNA, 1523 bp, Brachypodium distachyon
ccccggtgtacatcaagggtgggaatttagggtttccccgagccgccgccgtataggagccttctccttcctcctcgcgaacgacagcttcagcaaccagcgtcggggcacgggcggagctccgaccatggtccacgtcaacttctaccgcaactatggtaagacattcaagaaaccaaggcgcccgtatgagaaggagcgtcttgatgcagagctgaagctggtgggtgagtatggactgaggtgcaagagggaactgtggagggttcagtatgctttgagccgtatccgcaacaatgcaaggcacctgcttacacttgatgagaagaaccctcgccgtatctttgaaggggaggcattgctccgccgcatgaaccgctatgggctccttgctgatgggcagaacaagcttgattatgtcctggcccttactgtggagaacttccttgcaaggcgtcttcagactcttgtcttcaaggctggtatggcgaagtccatccaccatgcccgtgtcctgatcaggcaacgccacatcagggttggcaagcaaattgtgaacatcccgtcgttcatggtgagggtcgattctgagaagcacattgacttttcactgacaagcccatttggtggaggtaatcctggcagggtgaagcgaaagaaccaaaagaaggcaagtgggggtggtggcggcggtgaggaagaagatgaggaatgagtgactagctggttcctataagaaaaatagaaatctgttggtatgagtacttaaacctgagctccaaagctttttggctcgagttgtagggtactagggtttcagaatttcggcaggttgacattcttatgtgttgttatgtcaagtagtgcaagataagatatgttcggagatgtttgattctggtgcagagttatatggcggagtatatgttgtgttttttatgcatggtttggttgatgtattttggtggatcctgagttgcatcgtttttcgtagttggtgttgctcgcttgcttacctacagtggatgcaatcctgtttatcgtttgctcatctctttttttacagctcgtttactcatgtattagttgggttttcttactttgaaattagatcaatgtatctcttatgaatatgtcaagtcattgtactctgtttggctatataggaacgagtattcatagatcatcaatttgaccgacaaaatatgagttatatgcccttgaaatatgtaattacaagcatgtaatgatatatttttggtggcatataacaggcatttcgttagttaaattatttatctagtaacacacacaggtcttgtatacccgaagcgaacgcaaccggagataattacagagtagaggaaaatgctaaaaagggactgcaagaaaagaaatgtcatcaaacgtgtgctctgtttcaggtactgaaccacatgcagcagcaaggtatttttactctgctttccaaatattcggtaacaacaacaaaaatatataatggttcttttgaacgtcataac

SEQ ID NO: 2515 - DNA, 1045 bp, Brachypodium distachyon
ccggtgtacatcaagggtgggaatttagggtttccccgagccgccgccgtataggagccttctccttcctcctcgcgaacgacagcttcagcaaccagcgtcggggcacgggcggagctccgaccatggtccacgtcaacttctaccgcaactatggtaagacattcaagaaaccaaggcgcccgtatgagaaggagcgtcttgatgcagagctgaagctggtgggtgagtatggactgaggtgcaagagggaactgtggagggttcagtatgctttgagccgtatccgcaacaatgcaaggcacctgcttacacttgatgagaagaaccctcgccgtatctttgaaggggaggcattgctccgccgcatgaaccgctatgggctccttgctgatgggcagaacaagcttgattatgtcctggcccttactgtggagaacttccttgcaaggcgtcttcagactcttgtcttcaaggctggtatggcgaagtccatccaccatgcccgtgtcctgatcaggcaacgccacatcagggttggcaagcaaattgtgaacatcccgtcgttcatggtgagggtcgattctgagaagcacattgacttttcactgacaagcccatttggtggaggtaatcctggcagggtgaagcgaaagaaccaaaagaaggcaagtgggggtggtggcggcggtgaggaagaagatgaggaatgagtgactagctggttcctataagaaaaatagaaatctgttggtatgagtacttaaacctgagctccaaagctttttggctcgagttgtagggtactagggtttcagaatttcggcaggttgacattcttatgtgttgttatgtcaagtagtgcaagataagatatgttcggagatgtttgattctggtgcagagttatatggcggagtatatgttgtgttttttatgcatggtttggttgatgtattttggtggatcctgagttgcatcgtttttcgtagttggtgttgctcgcttgcttacctacagtggatgcaatcctgtttatcgtttg

SEQ ID NO: 2516 - DNA, 1081 bp, Setaria italica
ccggcccacctaatcaaagctagggtttacctcccttataagatctcgtctcccacccccgcgcctccatctctccccacacctcctccggcggcggcgagctcgacgaccaaccgcgcctacctgccgcggcagccatggtgcacgtcagcttctaccgcaactatgggaagaccttcaagaagccaaggcgtccgtacgagaaggagcgccttgatgctgagctgaagctggtgggtgagtacggcctgaggtgcaagcgtgagctgtggcgtgtgcagtatgccctgagccgtatcagaaatgcagccagggagctgctcaccctggatgagaagaacccccgccgtatctttgagggtgaggcgctcctccgccgcatgaaccgctatggtctccttggtgagggtcagaacaagctcgattacgtgcttgccctcactgttgagaacttcctccagcgccgcctccagaccattgtcttcaagaatggcatggccaagtccatccaccacgcccgtgtcctgatcaggcagcgccacatcagggtggggaggcagctcgtcaacattccgtcattcatggtcagggttgaatccgagaagcacatcgacttctccctcaccagccctctgggtggtggccctgctggaagagtgaagagaaagaaccagaataaggccactggcggtggcggtgacgccgaggaggatgaagagtaagagctgcataggattttgcgacagcaattggttgaaatgtgaaatgaaccttgttggaatccttaggtgttattcctgagttttggtggtcttgaattcagaatccggctatggtagacaattttgtgatccactgacgctttaatttcaagccttgcatgtttcggacctcatcaaatgtatgttatgcgtggctattttctcgtttggcctctgggggagtctaggccagccgactcgctggttgaagttctggatcatttcggttgccaatgccaattgtacatttttttaaatacatgaacgtaaaagcctttttgtttcacgagtacccgaatttgttgccgtgttgagcacta

SEQ ID NO: 2517 - DNA, 876 bp, Pennisetum glaucum
agcttgattatgtgcttgcgctcactgttgagaacttcctgcagcgtcagccatggtgcacgtcagcttctaccgcaactatgggaagacattcaagaagccaaggcgtccttatgagaaggagcgtcttgatgctgagctgaagttggtaggtgagtatggcctgaggtgcaagcgcgagctgtggcgtgtgcagtatgccctcagccgcatccgaaatgcagcaagggaactgctcaccctcgatgagaagaacccccgccgtatcttcgagggcgaggcacttctgcgccgcatgaaccgctacggactccttggcgagggccagaacaagcttgattatgtgcttgcgctcactgttgagaacttcctgcagcgtcgcctccagaccattgtcttcaagaatggcatggcaaagtccattcatcatgcccgtgtgctcatcaggcaacgccacattagagttgggaggcagcttgtcaacattccctcattcatggttagagttgactctgagaagcacatcgacttctcccttaccagcccgcttggtggtggtgagcctggaagagtgaagagaaagaaccagaagaaggctactggtggaggtggtgatggtgatgaggatgaagagtgatcctgcaatgctagctcccagttttgttgttagggcctaattttgctggcttttttaggacctaaaatcttgttacatgaactgatgcaaaagttggtcaccatgggctatctaaaattgctgtttaaattatcgaaaatcaccattgctgagactcagtttcattgactagttttttatctgatgaattcagagacttcagaaattgtttcccctgttacttgaatggagcacataat

SEQ ID NO: 2518 - DNA, 967 bp, Setaria italica
gtgcgccgcctccacaccctcattcgccttcccacctccccctcgcaagtcacagcagacctcgcggcggcggcggcggcggcgctcgagaccggcggcgggcggcggaggcatcatcagccatggtgcacgtcagcttctaccgcaactatgggaagactttcaagaagccaaggcgtccgtatgagaaggagcgtcttgatgctgagctgaagctggtaggtgagtatggcctgaggtgcaagcgcgagctgtggcgtgtgcagtatgccctcagccgcatccgaaatgcagcaagggagttgctcaccctcgatgagaagaacccccgccgtatctttgagggcgaggcactcctgcgccgcatgaaccgctacggacttcttggcgagggccagaacaagcttgattacgtgcttgcgctcactgttgagaacttcctgcagcgtcgcctccagaccattgttttcaagaatggcatggcaaagtccattcatcatgctcgtgtgctcatcaggcaacgccacattagagttgggaggcagcttgtcaacattccctcattcatggttagagttgactctgagaagcacgtcgacttctcccttaccagcccgcttggtggtggtgagcctggaagagtgaagagaaagaaccagaacaaggcttctggtggaggtggtgatggtgatgaggatgaagagtgatcatgcaatgctagctcccggttttgttgttaggacctaattttgctggctttgttaggacctaatcttgttacatgaacggaagcaaaagttggtcaccatgggttgtctaaaattgctatttaaattattgaaaaccgtcattgctgagactcagtttcattgttgagtttttatctgatgaatatgcatgtgaattaagagagacttcagaaaattgtttctcctgttacttgaatgagcacataatcttttctgtc

SEQ ID NO: 2519 - DNA, 805 bp, Panicum virgatum
ccccttgcgagtcatagcacacctcgcggcggcggggcccgagaccggcggcggaggcagcatcagccatggtgcacgtcagtttctaccgcaactatggtaaaactttcaagaagccaaggcgtccgtatgagaaggagcgccttgatgctgagctgaagctggtaggtgagtatggcctgaggtgcaagcgcgagctgtggcgtgtgcagtatgccctcagccgcatccggaatgccgctagggagcttctcacccttgatgaaaagaatccccgccgtatcttcgagggtgaggcactcctgcgccgcatgaaccgctacggtctcctcggtgagggccagaacaagcttgattacgttcttgcgctcactgttgagaacttccttcagcgtcgccttcagacaattgtcttcaagaatggcatggcaaagtccatccatcatgctcgtgtgctcatcaggcaacgccacattagagttgggaggcagctcgtcaacattccctcattcatggtcagagttgattctgagaagcacattgacttctcccttaccagcccgctcggtggtggtgagcctggaagagtgaagagaaagaaccaaaagaaggcttctggtggaggcggtgatggtgatgaggatgaagagtgatcatgtgatgattgctcctggttttgttgttaggacctaattttgcgggccctgttaggacctaaacatgttacatgaactgacacaaagagttggccaccgccagttgtcaaaattgtgatttaaattatcgaaaaccatcattgctgaga

SEQ ID NO: 2520 - DNA, 906 bp, Panicum virgatum
gttcccacctcgccccttgcaagttcatagcacacctcgcggcggcggcgcccgagaccggcggcgggcggcggaggcagcatcagccatggtgcatgtcagcttctaccgcaactatggtaaaactttcaagaagccaaggcgtccgtatgagaaggagcgccttgatgctgagctgaagctggtaggtgagtatggcctgaggtgcaagcgtgagctgtggcgtgtgcagtatgccctcagccgcatccggaatgctgcgagggagctcctcacccttgatgagaagaacccccgccgtatcttcgagggtgaagcactcctgcgccgcatgaaccgctatggtctcctcggtgagggccagaacaagcttgattacgttcttgcgctcactgttgagaacttccttcagcgtcgccttcagaccattgtcttcaagaatggcatggcaaagtccatccatcatgctcgtgtgctcatcaggcaacgccacattagagttgggaggcagcttgtcaacattccctcattcatggtcagagttgactctgagaagcacattgacttctcccttaccagcccgcttggtggtggtgagcctggaagagtcaagagaaagaaccagaagaaggcttctggtggaggcggtgatggtgatgaggatgaagagtgatcatgtgatgattgctcccggttttgttcttaggacctaattttgctggccctgttaggacctaaacttgttacatgaactgaagcaaagagttggccaccaccagctgtctaaaattgcaatttaattatcgaaaaccatcattgctgagactatgtttcattggggcttttgtctgatgaatatgcatgtgaattcagtgacacctcagaaaattgtttcaccagttactt

SEQ ID NO: 2521 - DNA, 979 bp, Pennisetum glaucum
gcggcgagctcgacgaccaaccgcgcctccctgacgcggcagccatggtgcacgtcaacttctaccgcaactatgggaagaccttcaagaagccaaggcgtccgtacgagaaggagcgccttgacgctgagctgaagttggtgggcgagtacggcctcaggtgcaagcgtgagctgtggcgtgtgcagtatgccctgagccgtatcagaaatgcagccagggagctgctcaccttggatgagaagaacccccgccgtatctttgagggtgaggcactcctccgtcgcatgaaccgctatggtctccttggtgagggtcagaacaagctcgattacgtgcttgccctcaccgttgagaacttcctacagcgccgcctccagaccattgtcttcaagaatggcatggccaagtctatccaccatgcccgtgtcctgatcaggcagcgccacatcagggtagggaggcagcttgtcaacattccgtcattcatggtcagggttgaatccgagaagcacattgacttctccctcaccagccctctgggtggcggccctgctggaagagtgaagagaaagaaccagaagaaggcctcgggtggtggcggtgatggtgaggaggatgaagagtaagagccagtaggattttgcaacagcaattggttgaaatgcgaagtgaaacttgttggattacttgggtgctgttccaatttttgtggtcttgaattcagattcctgtctatggtagacaattatgtgatcagctgacgctttaatttcaagccttgcctgtctcggaccctcatcaaatgtatgtctcgttggcctcttgggggagttaggttgccaatgccaattgtactttgcattttttgtaaatgcaagaacgcaaaagcctttttgcttcacagctaccagaaatgttgtccccgttgagacaaaaaaaaaaaaaaagaaaagtacttacgtagtacgttagacta

SEQ ID NO: 2522 - DNA, 882 bp, Sorghum bicolor
ccatggtgcatgttagcttctaccgcaactatgggaagactttcaagaagccaaggcgtccgtatgagaaggagcgactagatgctgagctgaagctggttggtgagtatggcctgcgctgcaagcgtgagctgtggcgcgtgcagtatgccctgagccgtatcagaaatgcagccagggagcttctcactctggatgagaagaacccacgccgtatctttgagggtgaggcgctcctccgccgcatgaaccgatatggtctccttggtgagggacagaacaagctcgattacgtgcttgcccttactgttgagaacttcctccagcgccgcctccagaccattgtcttcaagaatggcatggccaagtccatccaccatgctcgtgtcctgatcaggcagcgccacatcagggtgggaaggcagctcgtcaacatcccctcgttcatggtcagggtcgaatcagagaagcacattgacttctccctcaccagccctctgggtggcggtccagctggaagggtgaagcggaagaaccagaagaaggcctcaggcggtggcgatgatggtgaggacgacgatgagtaatgccatgtaggatcctgcgacagcaattggttgaaatgtgagatggacactttaggtgtcgtggctaaatttttgtggtcttgaattcagaaatcctactatggtagacaattttgcaccgcactactgacactcttaatttcaagcattggcatcgtatctggacaccatgaattgtgtattctagtttcggtggctatttgctcgtttggcatcctatgtttaaaactgaatgtctgaatcaaattggtattccaacttttcgttctcaggtgctgttcggttcataaatgat

SEQ ID NO: 2523 - DNA, 1106 bp, Sorghum bicolor
aaatccggcccatctaatcaaagctagggtttacatcccttataagatctcgtcttccatccacgcctccgtccctcgcacttcctccggcggcggcaacccgacgaccaaccgcgccaccctgccgcggcagccatggtgcatgttagcttctaccgcaactatgggaagactttcaagaagccaaggcgtccgtatgagaaggagcgactagatgctgagctgaagctggttggtgagtatggcctgcgctgcaagcgtgagctgtggcgcgtgcagtatgccctgagccgtatcagaaatgcagccagggagcttctcactctggatgagaagaacccacgccgtatctttgagggtgaggcgctcctccgccgcatgaaccgatatggtctccttggtgagggacagaacaagctcgattacgtgcttgcccttactgttgagaacttcctccagcgccgcctccagaccattgtcttcaagaatggcatggccaagtccatccaccatgctcgtgtcctgatcaggcagcgccacatcagggtgggaaggcagctcgtcaacatcccctcgttcatggtcagggtcgaatcagagaagcacattgacttctccctcaccagccctctgggtggcggtccagctggaagggtgaagcggaagaaccagaagaaggcctcaggcggtggcgatgatggtgaggacgacgatgagtaatgccatgtaggatcctgcgacagcaattggttgaaatgtgagatggacactttaggtgtcgtggctaaatttttgtggtcttgaattcagaaatcctactatggtagacaattttgcaccgcactactgacactcttaatttcaagcattggcatcgtatctggacaccatgaattgtgtattctagtttcggtggctatttgctcgtttggcatcctatgtttaaaactgaatgtctgaatcaaattggtattccaacttttcgttctcaggtgctgttcggttcataaatgatactgtagacataaatggtactccatccgtctcaaattataagatgtttgacttttttatcccaagacatgacaaaagaaatgatattttgc

SEQ ID NO: 2524 - DNA, 937 bp, Saccharum officinarum
gcaactcgacgaccaaccgcgccaccctgccgcggcagccatggtgcatgttagcttctaccgcaactatgggaagactttcaagaagccaaggcgtccgtatgagaaggagcgcctagatgctgagctgaagctggttggtgagtatggcctgcgctgcaagcgtgaactgtggcgcgtgcagtatgccctgagccgtatcagaaatgcggccagggagctgctcaccctggatgagaagaacccacgccgtatctttgagggtgaggcgctcctccgccgcatgaaccgatatggtctccttggcgagggtcagaacaagcttgattatgtgcttgccctcactgttgagaacttcctccagcgccgcctccagaccatcgtcttcaagaatggcatggccaagtccatccaccatgctcgtgtcctcatcaggcaacgccacatcagggtgggaaggcagctcgtcaacattccctcgttcatggtcagggtcgaatcagagaagcacatcgacttctccctcaccagccctctgggtggcggtcctgctggaagggtgaagcggaagaaccagaagaaggcctcaggcgggggtggtgatggtgaggaggacgatgagtagtgccacgtaggattctgcgacggcaattggttgaaatgtgagatggacactttaggtgttgtgcctgagtttttgtggtcttgaattcagaaatcctaagatggtagacaattttgcatcccactactgacagtcttgtttaatttcaagcattggcatcgtgtctggacgccatgaattgtattatgatttgcgtggctatttgctcgttcggcgtcctatgtttaagactgtcaaattggtattccaacttttcgttatcaggtgctgattggttcataaattatactgccaacgtaaatggcatatgag

SEQ ID NO: 2525 - DNA, 830 bp, Panicum virgatum
ctccacacctcctccggcggcgtccagctcgacgaccaaccgcgcctccctgccgcggcactgcggcagccatggtgcacgtcagcttctaccgcaactatgggaagactttcaagaagccaaggcgtccttatgagaaggaacgtcttgatgctgagctgaagctggttggtgagtatggcctgaggtgcaagcgtgagctgtggcgtgtgcagtatgccctgagccgtatcagaaatgcagccagggagctgctcaccctggatgagaagaaccctcgccgtatctttgagggtgaggcactcctccgccgcatgaaccgctatggtctccttggtgagggtcagaacaagctggattacgtgcttgccctcactgttgagaacttcctccagcgccgcctccagaccatcgtcttcaagaatggcatggccaagtccatccaccatgctcgcgtcctgatcaggcagcgccacatcagggtgggaaggcagcttgtcaacatcccgtcattcatggtcagggttgaatctgagaagcacatcgacttctccctcaccagccctctgggtggcggccctgctggaagagtgaagagaaagaaccagaagaaggcctcaggtggtggtggcgatggggaggatgatgaagagtaagggcctgtaggattttgcaacagcaattggttgaaatgcgaaatgaaccttgttggaattaggtgttgttcctgagtttttgtggtaattgaattcagaatcgggggatggtagacaattttgtggtccactgacactcatgtttaatttaagccttggcatgtttcggacctc

SEQ ID NO: 2526 - DNA, 1239 bp, Zea mays
atataagaacgccacgtctacgatctccttgccacacccctcacaaaccacaaacacatctcgcggcggcggcggcggcagagacaggcggcggccgccgagcggcgtgggcagcgtcatccatggtgcacgtgaacttctatcgcaactatggtaagactttcaagaagccaaggcggccttatgagaaggagcgccttgatgctgagttgaaattagtgggtgaatatggcctgaggtgcaagcgtgagctgtggcgtgtgcagtatgccctcagccgcatccgaaatgctgcaagggagctgctcacccttgatgagaagaacccccgtcgtatctttgagggcgaggcactcctgcgccgcatgaaccgctatggtcttctcggtgagggccagaacaagcttgactatgtgcttgcactcaccgttgagaactttctgcagcgccgccttcagaccattgtcttcaagaatggcatggcgaagtccattcatcatgctcgtgtgctcatcaggcaacgccacattagagttgggaggcaacttgtcaacattccctcattcatggtgagagttgactcagagaagcacatcgacttctctcttaccagcccacttggtggtggagaacctggaagggtgaagagaaagaaccaaaagaaggcttctggtggaggcggtgacgacgaagaggaagagtgatcatgtgatgctagctccttcgttttgttagggacctaattttgttacatgaaaacaaaaagttggctgccgaggtttctgaaaaattgcaatttaaaattttgagaactgtaattgctaagactcttcattgccgaagttgtttatccgatgaacacatgttaattcagtgagcttgcactgctgcttacatgagatcactttctgtcaggaagatattagtgtgtactccgatatatagatctgggatatgttgtttcgaagtattttatttatatatagctacgcactcgacatgttgtattcttaatctgtgttaaaattctaaagacaggtggagtattcgttgcaaattgtaagctaacatcttagttgattggcctgatttccttctgaataaataacacggtttttaaatttgtacccttagttttgccaactttctaatttttatcttttttttctcagttttgctcttatgatctatagcactagaagagcaaaattgagaaaaaaacacgaataagggtaaaaa

SEQ ID NO: 2527 - DNA, 1015 bp, Zea mays
ctagggtttacatcccttataaaatctcgtcttccacccccgcctcgctcagtcgcacttcctccggcggcggcaactcgacggccaaccgcgccaccctgccgcggcagccatggtgcatgttaacttctaccgcaactatgggaagactttcaagaagccaaggcggccgtatgagaaggagcgcctagatgctgagctgaagctggttggtgagtatggcctgcggtgcaagcgtgagctgtggcgcgtgcagtatgccctgagccgtatcaggaatgcagccagggagttgctcaccctggatgagaagaacccacgccgtatctttgagggcgaggcgctcctccgtcgcatgaacagatatggtcttcttggcgagggacagaacaagcttgattacgtgcttgccctcactgttgagaacttcctccagcgccgcctccagaccatcgtcttcaagaatggcatggccaagtccatccaccatgctcgtgtcctgatcaggcagcgccacatcagggtgggaaggcagctcgtcaacatcccctcgttcatggtcagggtcgaatcagagaagcacatcgacttctccctcaccagccctctgggtggtggtcctgccggaagggtgaagcggaagaaccagaagaaggcctcagggggcggcgacgctgaggaggacgaggagtagagggccacgtagggattctgcgaccgcaattggttgaaatgtgaggtggacactttagttgttgtgcctgagtgtgtttgttcattgtaatgaattcagaaattctactgtggtagacaattttgcacccccactactgacactcctgtttaaatttaaacattggcatcgtgtctagacaggatgaattgtattctggtttggccgtttgggtggctatttgctagtttggtctttaggccaatgtttaagactgaaacaaattggtagccaactttactttattatgctctgctggtctgtttggtgatttttttttac

SEQ ID NO: 2528 - DNA, 1004 bp, Sorghum bicolor
ctagggtttacatcccttataagatctcgtcttccatccccgcctcccgtctctcgcacttcctccggcggcggcaactcgacgaccaaccgcgccaccctgccgcggcagccatggtgcatgttagcttctaccgcaactatgggaagactttcaagaagccaaggcgtccgtatgagaaggagcgactagatgctgagctgaagctggttggtgagtatggcctgcgctgcaagcgtgagctgtggcgcgtgcagtatgccctgagccgtatcagaaatgcagccagggagcttctcactctggatgagaagaacccacgccgtatctttgagggtgaggcgctcctccgccgcatgaaccgatatggtctcctgggtgagggacagaacaagctcgattacgtgcttgcccttactgttgagaacttcctccagcgccgcctccagaccattgtcttcaagaatggcatggccaagtccatccaccatgctcgtgtcctgatcaggcagcgccacatcagggtgggaaggcagctcgtcaacatcccctcgttcatggtcagggtcgaatcagagaagcacattgacttctccctcaccagccctctaggtggcggtccagctggaagggtgaagcggaagaaccagaagaaggcctcaggcggtggcgatgatggtgaggaggacgatgagtagtgccgtgtaggatcctgcgacagcaattggttgaaatgtgagatggacactttaggtgtcgtggctaaatttttgtggtcttgaattcagaaatcctacgatggtagacatttttgcaccgcactactgacactcttaatttcaagcattggcatcgtatctggacaccatgaattgtgtattctagtttctgtggctgttgctcgtttggcatcctatgtttcaaactgaatgtccaaattggtattccaatttttcgttctcaggtgctgttcggttcataaatgatactgtagacataaatgg

SEQ ID NO: 2529 - DNA, 1204 bp, Sorghum bicolor
ctagggtttacatcccttataagatctcgtcttccatccccgcctcccgtctctcgcacttcctccggcggcggcaactcgacgaccaaccgcgccaccctgccgcggcagccatggtgcatgttagcttctaccgcaactatgggaagactttcaagaagccaaggcgtccgtatgagaaggagcgactagatgctgagctgaagctggttggtgagtatggcctgcgctgcaagcgtgagctgtggcgcgtgcagtatgccctgagccgtatcagaaatgcagccagggagcttctcactctggatgagaagaacccacgccgtatctttgagggtgaggcgctcctccgccgcatgaaccgatatggtctcctgggtgagggacagaacaagctcgattacgtgcttgcccttactgttgagaacttcctccagcgccgcctccagaccattgtcttcaagaatggcatggccaagtccatccaccatgctcgtgtcctgatcaggcagcgccacatcagggtgggaaggcagctcgtcaacatcccctcgttcatggtcagggtcgaatcagagaagcacattgacttctccctcaccagccctctaggtggcggtccagctggaagggtgaagcggaagaaccagaagaaggcctcaggcggtggcgatgatggtgaggaggacgatgagtagtgccgtgtaggatcctgcgacagcaattggttgaaatgtgagatggacactttaggtgtcgtggctaaatttttgtggtcttgaattcagaaatcctacgatggtagacatttttgcaccgcactactgacactcttaatttcaagcattggcatcgtatctggacaccatgaattgtgtattctagtttctgtggctgttgctcgtttggcatcctatgtttcaaactgaatgtccaaattggtattccaatttttcgttctcaggtgctgttcggttcataaatgatactgtagacataaatggtactccatccgtctcaaattataagatgtttgacttttttatcccaagacatgacaaaagaaatgatattttgcacacatttttgaataagacaggtgattaaacttggtgataaaagttaaacttcttataatttaggatggattgagtatatgagatgcttggggtgatgattacaggataacaagttttgcattttg

SEQ ID NO: 2530 - DNA, 892 bp, Saccharum officinarum
cacccgcccggacttcccgggtgcacacctcgcggcggcggcggcggcggcggcggcgactgagaccgtcggcgggcggcggaggcagcgtcagccatggtgcacgtgagcttctatcgcaactatggtaagactttcaagaagccaaggcgtccgtatgagaaggagcgccttgatgctgagctgaaattggtgggtgagtatggcttgaggtgcaagcgtgagctgtggcgtgtgcagtatgccctcagccgcatccgaaatgctgcaagggagctgctcaccctcgatgagaagaatccccgccgtatctttgagggcgaggcactcctgcgccgcatgaaccgctatggtcttcttggtgagggccagaacaagcttgattatgtgcttgcgctcactgttgagaacttcctgcagcgccgccttcagaccattgtcttcaagaatggcatggcgaagtccattcatcatgctcgtgtgctcatcaggcaacgccacattagagttgggaggcaacttgtcaacattccctcattcatggtgagagttgactcagagaagcacattgacttctcccttaccagcccacttggtggtggtgaacctggaagggtgaagagaaagaactcaaagaaggcttctggtggaggcggtgatgatgaggaggaagagtgattatagctccctgttttgttagggcctaattttcctggctttgttaggacctaattttgttacatgaaaacaaaagttggctgccgagggttgtctgaaattgcaatttaaattcgtgagaactgtaattgctgagactcaacattgccgaagttgtttatcgatgaacatgttaattcagtgagaattcaaaggaatgttcgcactcttgctt

SEQ ID NO: 2531 - DNA, 875 bp, Panicum virgatum
tcccttataagatctcgtctcctaccccccgcgcctccacctccacacctcctccggcggcggccacctcgacgaacagccgcgcctccctgccgcggcagccatggtgcacgtcagcttctaccgcaactatggtaagactttcaagaagccaaggcgtccttatgagaaggagcgtcttgatgctgagctgaagctggttggtgagtatggcctgaggtgcaagcgtgagctgtggcgcgtgcagtatgccctgagccgtatcagaaatgcagccagggagctgctcaccttggatgagaagaaccctcgccgtatctttgagggtgaggcgctcctccgccgcatgaaccgctatggtctccttggtgagggtcagaacaagctggattacgtgcttgccctcactgttgagaactttctccagcgccgcctccagaccatcgtcttcaagaatggcatggccaagtccatccaccatgctcgtgtcctgatcaggcagcgccacatcagggtgggaaggcagctcgtcaacattccgtcattcatggtcagggttgaatctgagaagcacatcgacttctcgctcaccagccctctgggtggcggccctgctggaagagtgaagagaaagaaccagaagaaggcctcaggcggtggtgatgacggcgaggacgatgaagagtaagggcctgtaggattttgcaacaggaattggttgagatgcgaaatgaacctggttggaattaggtgttgttcctgagtttttgtggtgattgaattcagaatcgggcaatggtagacaattttgtgatccactgactatcatgtttaatttcaagccatggcatgtttcggacctcgaaaaaaaaaga

SEQ ID NO: 2532 - DNA, 840 bp, Eragrostis curvula
  misc_feature (5)..(5): n is a, c, g, or t
  misc_feature (7)..(7): n is a, c, g, or t
  misc_feature (12)..(14): n is a, c, g, or t
  misc_feature (16)..(16): n is a, c, g, or t
  misc_feature (18)..(21): n is a, c, g, or t
  misc_feature (23)..(24): n is a, c, g, or t
  misc_feature (26)..(26): n is a, c, g, or t
  misc_feature (31)..(31): n is a, c, g, or t
  misc_feature (34)..(34): n is a, c, g, or t
  misc_feature (36)..(37): n is a, c, g, or t
  misc_feature (42)..(43): n is a, c, g, or t
  misc_feature (45)..(46): n is a, c, g, or t
  misc_feature (49)..(49): n is a, c, g, or t
  misc_feature (68)..(69): n is a, c, g, or t
  misc_feature (155)..(155): n is a, c, g, or t
  misc_feature (633)..(633): n is a, c, g, or t
  misc_feature (689)..(689): n is a, c, g, or t
  misc_feature (708)..(708): n is a, c, g, or t
  misc_feature (736)..(736): n is a, c, g, or t
  misc_feature (750)..(750): n is a, c, g, or t
  misc_feature (754)..(754): n is a, c, g, or t
agaananagagnnnanannnnanngnaaganggnanntggtnntnnaantcgcggcggcggggtgccnnagacggcggcgggcggcggaggcagcgtcagccatggtgcacgttaacttctaccgcaactatggtaagaccttcaagaagccaangcgtccttatgagaaggagcgtcttgacgcagagctgaagctggtgggcgagtatggcctcaggtgcaagcgtgagctgtggcgtgtgcagtatgcccttggccgcatccgtaatgctgcaagggagctgctcaccctcgatgagaagaacccccgccgtatctttgagggcgaggcactcctgcgtcgcatgaaccgtatggtctccttggtgagggccagaacaagcttgattatgtccttgcgctcactgtgagaacttcctgcagcgtcgcctccagacatcgtcttcaagaatggcatggcaaaatccattcatcatgctcgtgtcctcatcaggcaacgccacatcagagttgggaggcagcttgttaacattccctcgttcatggtgagagttgactcagaaaagcacattgacttctccctgaccagcccacttggtggtggcgagcctggaagggtcaagagaaagaancagaagaaggctaccggaggaggtggtgatggtgatgaggatgaagagtaatcatncgacactagctcctctttngttaggacctaattttgctggctttgtnaggacctgatttgntacntgaccaaagttggcgggcaagggtttctaaaattggtgtttcagattgatgaatctttcttggtgaaatcgtctcattgaattggt

SEQ ID NO: 2533 - DNA, 767 bp, Curcuma longa
gcccgtagcttccgcggcggcggctcttgatctcctccgtcgtgattcttgaggcgaagcttgcgaacaagacatggtgcatgtcagcttctaccgcaactatgggaagaccttcaagaagccccgccggccctacgagaaggagcggctggacgcggagctgaagctggtgggtgagtatggcctccggtgcaagcgcgaactgtggagagtccagtacgccctgagccgtatccggaacgctgccagggagcttctcacgctcgacgagaagaaccctcgccggatcttcgagggcgaggccctgcttcggaggatgaaccgttacggactcctggaggagggtcagaacaagctcgattacgttcttgcgctcactgtggagaactttctggagcgccgccttcagacgctcgtgttcaagtcagggatggccaagtcgatccaccacgctcgtgtactgatcaggcagcgccacatcagggtcggaaggcaagttgtcaacatcccttcgtttatggttagagtcgattctgcgaagcacatcgatttctcattgactagtccattcggaggtggccgtcccggaagagttaagagaaagaaccagaaggccgccgcaaagaaggcagctggaggtgatggtgacgatgatgatgaggaatgagcattttgtttaagcattaaagtgaattagtagctctctattttccattttcctgttgaatttcatatctatttatttccatttccaattcagtagtttt

SEQ ID NO: 2534 - DNA, 961 bp, Solanum melongena
tcacagacaaaatctataagcagcctcacaatctcttcaaaccctagtgtctctttaaccctagcagtttctccgttcatttcagctggtctccgatctgagctcggtgctgtcaacaggtaaccatggtgcacgtctccttttatcgcaactatgggaagacctttaagaaaccccgacgtccttatgagaaggagaggttggatgcagagttgaagcttgtgggagagtatgggctgaggtgcaagagggagctctggagagttcagtatgctttgagccgtatcaggaatgctgcaagaatgcttctgacccttgatgagaaagatcctcgtcggatttttgaaggtgaagctctcttgaggaggatgaacaggtatggattgttggatgagagccagaacaagcttgattatgtcttggcactcactgttgagaacttccttgagcgtcgcctgcaaacccttgttttcaagactggcatggctaagtcaatccaccatgcaagagtgctcatcaggcaaaggcatatcagggttggaaggcaagtggtgaatgttccttcgtttatggtgagagtggactctcaaaagcacatcgacttctctctaaccagtccttttggtggcgggcgtccaggaagagtgaagagaaagaaccaaaagtctgctgccaagaaggctgctggcggtgatggtgatgatgaggatgaagaatgagcttttgcgtaaagcctaagaaagctgtctggcgatggagctgttcagttttaagtttttagttacccttgtagtacttcctcaccttcctttcttggatgttgtgatatcttcatatattagaaagaaaatattgggagaaatattttgatggttggattttgctttaatctttagagtttcaacaatttgttttgaaccagattgcatctcttattaagtgatagaagtgaatctacact

SEQ ID NO: 2535 - DNA, 902 bp, Solanum melongena
aaccctagtgtctctttaaccctagctgtttctccgttcatttcagctggtctccgatctgagctcggctgtcaaccggtaaccatggtgcacgtctccttttatcgtaactatgggaagacctttaaaaaaccgcgacgtccttatgagaaggagaggttggatgcagagttgaagcttgtgggagagtatgggctgaggtgcaagagggagctctggagagttcagtatgctttgagccgtatcaggaatgctgcaagaatgcttctgacccttgatgagaaagatcctcgtcggatttttgaaggtgaagctctcttgaggaggatgaacaggtatgggttgttggatgagagccagaacaagcttgattatgtcttggcactcactgttgagaacttccttgagcgtcgcctgcaaacccttgttttcaagactggcatggctaagtcaatccaccatgctagagtgctcatcaggcaaaggcatatcagggttggaaggcaagtggtgaatgttccttcgtttatggtgagagtggactctcagaagcacatcgacttctctctaaccagtccttttggtggcgggcgtccaggaagagtgaagagaaagaaccaaaagtctgctgccaagaaggctgctggcggtgatggtgatgatgaggatgaagaatgagcttttgtgtaaaccccaagaatgctgtttggcgatggagttcagttttaagtttttagttacccatgtagtacttcctcaccttcctttcttgggatgttgtcatatcttcatatattagaaagaaatggttcttagcagagattgggagaatattttgatgtttggattttgctttagagtttcaacaatttgttttgaaccagattgcatcttattaagtg

SEQ ID NO: 2536 - DNA, 901 bp, Fraxinus spp
ggttcttcttccggccgacgtagcttacagccatggttcacgtcagtttttaccgcaattatggtaagacatttaagaagcctcgccgtccgtacgagaaggagcgtttggatgcagagctgaaacttgttggtgaatacgggctccgatgcaagagagagctctggagggtgcagtatgcattgagtcgcattcgtaatgctgctagaaatcttctcacccttgatgagaaagacccccgtcgtatctttgagggtgaagcccttttacgcaggatgaacaggtacgggcttttggatgagagccagaataagctcgattatgtcttggcacttactgtggagaacttccttgaacgccgcctccaaactcttgtgttcaaggctggtatggccaagtcaattcatcatgctcgagtgctgatcaggcagaggcatatcagggttgggaggcaggtggttaatgttccatccttcatggtgagagtcgactcacagaagcacatcgacttctccctcactagtccttttggtggtggtcgacctggaagagtgaagcgaaagaaccagaaagctgctgccaagaaggcatctggtggtgatggtgatgaagaagacgaggaataaacattttcaacaattagaaaactgaagcaccatgttccttgacatgtggttttcattctaaactgaaactctttaaattttgtcttgacaaatggtagcgtgttttgcttgtgtttcactaatggactgttttctcttctattttttggttgggattatatgaaagatcaatttatataatttcatttcatccactttttcatcatttagtactttcttatcgtctttgtttggattatgttttcgaatgtcaactatgttaaatgctttgatat

SEQ ID NO: 2537 - DNA, 988 bp, Brachypodium distachyon
gagggcggctccccaggtcaccctctttccctctccacacctccaccggcggcggccagcttgagctcgacgaaccgcggcatctgcggcggcggcggcggccatggtgcacgtcaacttctaccgcaactatgggaagactttcaagaagccgaggcgtccatatgagaaggagcgacttgatgctgagctgaagctggttggggagtacggtctgcggtgcaagcgtgagctgtggcgcgtgcagtacgccctaagccgtatccggaatgctgcaagggagctgcttaccctggatgagaagagccctcgccgtatttttgagggtgaagcgctactccgccgcatgaaccgatatggtctccttgctgaggaccagaacaagctcgattacgtgcttgcgctcactgttgagaacttccttcagcgccgtctccagaccattgtcttcaagaatggcatggccaagtcaatccatcatgcccgtgtccttatcaggcagcgacacatcagggtcggaaggcagctcgtcaacattccttctttcatggtgagggttgccaccgagaagcacatcgacttctcactcaccagccccctgggtggtggccctgctggaagggtgaaacggaagaaccagaagaaggcctctggcggcggcggtggtgatggagacgaggaggaagagtaggagctcagcattgcaatacatacctttgttggagaaattgtcgaaacttaatttgagacggccttgtatgacttccgcaacaggaaattgatgaaacttggatttgagcttagaaacttggtgacttctgggttttatagtttgaaacggaccatgtgcatatctttgaatatcaaatcagaacaaggttgagataaggactgtcaaatgggctgataataatataaaaaaatgaaagaaaacaggggactagtaaatactagtggagtgcccgtgcattgctacggatcaacaaaa

SEQ ID NO: 2538 - DNA, 1073 bp, Brachypodium distachyon
caaacgatctgtcgcctccattaccttcccgacctcacgacccttcttgcggcggcgccggcgtccgataccggcgttgagcgggggaggcaccgtcagccatggtgcacgttaacttctaccgcaactatggtaagactttcaagaagccaaggcgtccatatgagaaggaacgtcttgacgcagagctgaaactggtgggtgagtatggcctgaggtgcaagcgtgagttgtggcgcgtgcaatatgctctcagccgcatccgtaatgctgcgagggagctgctcacccttgatgagaagagcccccgtcgtatcttcgagggtgaagctctactgcgccgcatgaaccgctatggtctccttgctgaggaccagaacaagcttgattacgtgcttgcgctcactgttgagaacttccttcagcgtcgcctccagacaattgtcttcaagaatggcatggcaaaatccatccatcatgctcgtgttctcatcaggcaacgccatatcagagttggaaggcagcttgtcaacattccctcattcatggtgagagttgacactgagaagcacattgatttctctctcaccagcccacttggtggtggagagcctggaagggtcaagcgaaagaaccagaagaaggcttctggtggtggaggcggtgatggtgatgaggaggaagagtgaacatgtgatgtaggaccctgattttgttgcattagtcggaagaaattttgtccgccaactgttgtctagaattgttcccaattcttgaatccatccttgcagtagacttggtttgatatttcaagttttgtcgtacaatgaacatgtgaaatgggatttcagttgcacaatgcttacctgtttgcctatattgcttctgtgctttgaatgtagtttttccaggcgtgtgctgctggtttagtttaataacatttcaaagtttgacagtccaggagtgtgcctctatagcttctgaatttgtaattttttgttggtgatgctggtggaacaaagtgccaaaatttgacagttgaaagctttcagttttcacctgtttgttctgaa

SEQ ID NO: 2539 - DNA, 903 bp, Brachypodium distachyon
gagggcggctccccaggtcaccctctttccctctccacacctccaccggcggcggccagcttgagctcgacgaaccgcggcatctgcggcggcggcggcggccatggtgcacgtcaacttctaccgcaactatgggaagactttcaagaagccgaggcgtccatatgagaaggagcgacttgatgctgagctgaagctggttggggagtacggtctgcggtgcaagcgtgagctgtggcgcgtgcagtacgccctaagccgtatccggaatgctgcaagggagctgcttaccctggatgagaagagccctcgccgtatttttgagggtgaagcgctactccgccgcatgaaccgatatggtctccttgctgaggaccagaacaagctcgattacgtgcttgcgctcactgttgagaacttccttcagcgccgtctccagaccattgtcttcaagaatggcatggccaagtcaatccatcatgcccgtgtccttatcaggcagcgacacatcagggtcggaaggcagctcgtcaacattccttctttcatggtgagggttgccaccgagaagcacatcgacttctcactcaccagccccctgggtggtggccctgctggaagggtgaaacggaagaaccagaagaaggcctctggcggcggcggtggtgatggagacgaggaggaagagtaggagctcagcattgcaatacatacctttgttggagaaattgtcgaaacttaatttgagacggccttgtatgacttccgcaacaggaaattgatgaaacttggatttgagcttagaaacttggtgacttctgggttttatagtttgaaacggaccatgtgcatatctttgaatatcaaatcagaacaaggttgagataaggactgtcaaatggg

SEQ ID NO: 2540 - DNA, 844 bp, Brachypodium distachyon
gcctccattaccttcccgacctcacgacccttcttgcggcggcgccggcgtccgataccggcgttgagcgggggaggcaccgtcagccatggtgcacgttaacttctaccgcaactatggtaagactttcaagaagccaaggcgtccatatgagaaggaacgtcttgacgcagagctgaaactggtgggtgagtatggcctgaggtgcaagcgtgagttgtggcgcgtgcaatatgctctcagccgcatccgtaatgctgcgagggagctgctcacccttgatgagaagagcccccgtcgtatcttcgagggtgaagctctactgcgccgcatgaaccgctatggtctccttgctgaggaccagaacaagcttgattacgtgcttgcgctcactgttgagaacttccttcagcgtcgcctccagacaattgtcttcaagaatggcatggcaaaatccatccatcatgctcgtgttctcatcaggcaacgccatatcagagttggaaggcagcttgtcaacattccctcattcatggtgagagttgacactgagaagcacattgatttctctctcaccagcccacttggtggtggagagcctggaagggtcaagcgaaagaaccagaagaaggcttctggtggtggaggcggtgatggtgatgaggaggaagagtgaacatgtgatgtaggaccctgattttgttgcattagtcggaagaaattttgtccgccaactgttgtctagaattgttcccaattcttgaatccatccttgcagtagacttggtttgatatttcaagttttgtcgtacaatgaacatgtgaaatgggatttcagttgcac

SEQ ID NO: 2541 - DNA, 900 bp, Musa acuminata
cggcgacagagaagaacgcgaaccggccatggttcacgtcagtttctaccgcaactatggcaagacgttcaagaaacctcgccgcccgtacgagaaggagcggctggacgcggaactcaaactggtcggggagtacgggctgcggtgcaagcgcgagctatggagggtccagtacgctctcagccggatccggaacgcggccagggatctcctcacgctcgatgagaagaatccccgacggatctttgagggagaggccctgctccgccgtatgaaccgctacgggctccttgaggagggccagaacaagctcgactacgtccttgccctcaccgtggagaactttctggagcgccgcctccagactctcgtgttcaagtctggaatggccaagtccatccaccatgctcgggtcctgataaggcagcggcacatcagagtcggaaggcaagttgtgaacatcccctcgttcatggtcagagttgattccgcaaagcacatagatttctcacttaccagtccattcgggggaggccgacctggtagggtgaagagaaaaaatcagaaagctgctgcaaagaagcaactggaggcgacggcaacgaggatgatgaggaatgagcaatatgctctagatatctcttttccatgcgatcatcatcacatggatgattttgatgtttctgcattttgggatattggagctatctttatattttgatatgctgccttgataggagtatttcgagtttgtgtgatgatcatgcacattagtattgtctggtcattgtatttcatccgagatttgatcatatgctcctgacttgtctggtatagaaactatgctgtggatgttaacgtgatatttgaacgtaaatgttacatcgcgttctatggttt

SEQ ID NO: 2542 - DNA, 1223 bp, Musa acuminata
gtttgctggttcgtggggagcccagaaggcctaacccaaaaactggcatgaagagttgcggaccctcaacccgacccggttcgacccgatgtcgtttccacgctcagggctagggtttttggaattctatatataaaggaatctgcgtgctcgttcgcggcctctcgcgcacctccttggatcgggatccgtaggcgagcgccggaggcgtcggtggaggagaagcagccatggttcacgtcagtttttataggaactacgggaagacctttaagaagccccgtcgtccctatgagaaggagcggcttgatgctgagctgaagcttgtcggtgagtatgggctccgctgcaaacgagaactctggagagtccagtatgcgctgagccgaatccgtaatgctgcgagggatcttctcacgcttgatgagaaaaaccctcgtcggattttcgagggagaggccctcctccgccggatgaaccgttatgggctcctcgaggaaggccagaacaagctagattatgtcctggccctcacagtggagaacttcttggagcgccgtctgcagactctcgtcttcaagtcgggaatggcaaagtctatccaccatgctagggttctcatcaggcagcgccacatcagagttgggaggcaagtggttaacatcccatcattcatggtgagggtggattcagcaaagcacatcgacttctccctgacgagtccatttggtggtggccgtcctgggagagtgaagagaaggaaccagaaggcagcagcaaagaaggcagctgggggtgatggtgatgaggaggatgaggaatgaggaataaggaatatgcaactatcctagtcgaattctggtcttctatttcttttgcactttgagttattagttatctgaacattttgcacaagtgttattgcaggaagttaccttagtgttttctaatgttgaaatcatggagtagacacgtattcatctattttggcttaaaaggttagtgtctcgatcaacctcaggtggcataagcgcatgctttgtggtgcaatgaacttggtccaagtggtcaatattttccttgtgtttattgaccatgctattagttcaaattggtcgacatagttttctttatgtttaatcaaattgttcaaagatgttatgttagtcaacttgtatgcttttatctatatttactgtccacagacccacattaatatttct

SEQ ID NO: 2543 - DNA, 849 bp, Musa acuminata
cggatatctttgaatcgatcgagcgccagaggcggctctggaggggaaccaaccatggttcacgtcagtttctacaggaattatgggaagacttttaagaagccccgtcgtccctacgagaaggagcggctcgatgcggagctgaagctggtgggtgagtatgggctccgctgcaagcgggagctctggagggtccagtacgcgctgagccgaattcgtaatgctgcaagggatcttctcacgctcgacgagaagaaccctcgtcggatttttgagggagaggccctcctccgccggatgaaccgctatgggctgctcgaggaaggccagaacaagctcgattacgtcctggctctcacagtagagaacttcctggagcgccgtctgcagactcttgtcttcaagtcggggatggcgaagtccatccaccatgccagagtcctgatcaggcagcgccacatcagagtcgggaggcaagtggttaacatcccgtcgttcatggtgagggtggactctgcaaagcacatcgacttctctctcacaagtccatttggtggtgggcgccccgggagggtgaagagaaagaatcaaaaggctgcagcaaagaaggcagccggtggcgacggtgatgaggatgacgaggaatgagcaatatgcatttgcggtattccaattctaggagcctttatttgtttcagacttgagtttgttatccgctatctgatcattttgtagaagtattagctcataaaatttgccacattattgttaaaaatgcttctaaattttaatatcgtggattttgacatttgtttatggatttattttggcttcactaatttatgagtc

SEQ ID NO: 2544 - DNA, 1001 bp, Musa acuminata
gttgcactcttaatcgtttgaggcgagaaccggagacggcggcggcagaccagccatggttcatgtcagtttctaccgcaactatgggaagaccttcaagaagccccgccgcccgtacgagaaggagcggctggacgcggagctgaagctggtgggggagtacgggctccggtgcaagcgcgagctgtggagggtgcaatacgcgctcagccgtatccggaacgccgccagggatctgctgacgctcgacgagaagaacccccgccggatctttgagggcgaggccctgctccgccggatgaaccggtacggcctcctcgaggagggccagaacaagctcgactacgttctcgcgctcaccgtcgagaacttcctggaacgccgccttcaaacgctcgtcttcaagtccgggatggccaagtccatccaccacgctcgcgtcctgatcaggcagcgtcacatcagagtgggaaggcaagtggtcaacatcccatcattcatggtcagagtggattctgcaaagcacattgatttctcactgacaagtccatttggcggaggccgcccgggaagggtgaagagaaagaaccagaaggctgctgcaaagaaggcagctggaggtgacggcgacgaggacgacgaggaatgagcattgtgctttggttgtgcctcacctaataatttttctacacttcattagacttggagtttctatctatttgctcaagattttcctgttttaaggtaagaaactcccatctttcagttttccttgtcatttccatgttaccatctgcagatggattttgctggattttgacatgatgaagtattttcttttcattgctgattcggctagatatgaattgggtgaatgaggtatcattatttattatgtttcgatctttatggtttagtcttcatgtaaacaatgaggttgatgaatatgccatatttgctgcttcgataaatgctgttaagttatcattagtttcatctgg

SEQ ID NO: 2545 - DNA, 727 bp, Capsicum annuum
gcacgagggacgaacaaacatggtgcacgtcaatttttatcgcaactatgggaagacctttaagaagcctcgaaggccctacgagaaggagcgattggatgcagaattgaagcttgtaggagagtatggactaaggtgcaagagggaactttggagagttcagtatgctttgagccgtatcaggaatgctgctagaatgcttctcacactggacgagaaggacccacgccgtatctttgaaggtgaagctctcttgaggaggatgaaccggtacgggttattggatgagagccaaaacaagcttgattatgtcttggcactcaccgtggagaactttcttgagcgtcgtctccaaacacttgtgttcaagactggcatggctaagtcaatccatcatgctagagtgctcatcaggcaaaggcatatcagagtcgggaggcaggtggtgaatgttccttcctttatggtgcgagtggactcccagaagcacatcgacttctctctcactagtccattcggtggtgggcgtcctggaagagtcaagcgaaagaaccaaacggctgccactaagaaggcttctggtggtgatggagatgaagaggatgaagaataagcagctatattagtgtttggagtatttggctatagtactggcctatgttattttctgagattgtggttacctgcatgtagtagtagaaagaaacgtattaagcaaaagttttta

SEQ ID NO: 2546 - DNA, 794 bp, Musa acuminata
cttggatcgggatccgtaggcgagcgccggaggcgtcggtggaggagaagcagccatggttcacgtcagtttttataggaactacgggaagacctttaagaagccccgtcgtccctatgagaaggagcggcttgatgctgagctgaagcttgtcggtgagtatgggctccgctgcaaacgggaactctggagagtccagtatgcgctgagccgaatccgtaatgctgcgagggatcttctcacgcttgatgagaaaaaccctcgtcggattttcgagggagaggccctcctccgccggatgaaccgttatgggctcctcgaggaaggccagaacaagctagattatgtcctggccctcacagtggagaacttcttggagcgccgtctgcagactctcgtcttcaagtcgggaatggcaaagtctatccaccatgctagggttctcatcaggcagcgccacatcagagttgggaggcaagtggttaacatcccatcattcatggtgagggtggattcagcaaagcacatcgacttctccctgacgagtccatttggtggtggccgtcctgggagagtgaagagaaggaaccagaaggcagcagcaaagaaggcagctgggggtgatggtgatgaggaggatgaggaatgaggaataaggaaactatcctagtggaattctggtcttctatttcgtttgcacttgagttattagttatctgaacattttgcagaagtgttattgcaggaagttacctcagtgttttctattgttgaaatcatggagtagacacgta

SEQ ID NO: 2547 - DNA, 637 bp, Musa acuminata
tttggaggggaaccaaccatggttcacgtcagtttctacaggaattatgggaagacttttaagaagccccgtcgtccctacgagaaggagcggctcgatgcggagctgaagctggtgggtgagtatgggctccgctgcaagcgggagctctggagggtccagtacgcactgagccgaattcgtaatgctgcaagggatcttctcacgctcgacgagaagaaccctcgtcggatttttgagggagaggccctcctccgccggatgaaccgctatgggctgctcgaggaaggccagaacaagctcgattacgtcctggctctcacagtagagaacttcctggagcgccgtctgcagactcttgtcttcaagtcggggatggcgaagtccatccaccatgccagggtcctgatcaggcagcgccacatcagagtcgggaggcaagtggttaacatcccgtcgttcatggtgagggtggactctgcaaagcacatcgacttctctctcacaagtccatttggtggtgggcgccccgggagggtgaagagaaagaatcaaaaggccgcagcaaagaaggcagctggtggcgacggcgatgaggatgacgaggaatgagcaatatgcatttgcggtattccaa

SEQ ID NO: 2548 - DNA, 789 bp, Manihot esculenta
catggtgcacgtctctttttaccgcaactatgggaaaaccttcaagaaaccaagacgtccctatgagaaggagcgtttggatgctgagttgaagcttgttggagagtatgggctccgttgtaagagagagctttggagggttcagtatgcattgagccgcattcgtaatgcagcaagaatgcttctcacccttgatgaaaaaaacccacgacgtatttttgagggtgaagcccttctcaggaggatgaataggtatggacttttagatgagagtcagaacaaacttgattatgtgttggccttgactgtggagaactttcttgagcgccgtctccaaactctcgtgttcaagtcagggatggccaagtcaatccatcatgccagagtgcttatcaggcaaaggcacattagggtagggagacaggtggttaacattccctcttttatggtgagggtggactcacaaaagcacattgatttctcacttacaagtccctttggtggtggacgccctggcagagtgaagagaaagaatcaaagggctgctaacaagaagagttctggtggtgatggggatgaagaagatgaagagtgagctgtgacgtcctgcaatagcaactaatggttttgttagggagcattcctaaagagtttttcttattgacctttcctttcattttctgtcattatatgatggctttttgaggagctttaatgttagcaagcaattctgattctttttttgttctttttttgccagttaattagttgctttgttattgttgatgg

SEQ ID NO: 2549 - DNA, 832 bp, Curcuma longa
gcactagaaccagccatggttcacgtcagtttctacagaaactatgggaagacatttaagaagccccgtcgtccctatgagaaggagcggcttgatgcggaattgaagttggttggtgagtatgggctgcgctgcaagcgggaactctggagggtgcagtatgcactgagcaggattcgaaatgctgcaagggagcttttgacgcttgatgaaaagaaccctcgtcgtattttcgaaggagaggccctccttcgccggatgaaccgctatggcctccttgaggaaggacagaacaagcttgattatgtcctcgccctcactgttgaaaacttcttggagcgtcgtcttcagactcttgtcttcaagtcagggatggccaagtctattcaccatgcaagggtactcatcagacagcgccatataagagttggtaggcaggtggtcaacatcccatcattcatggtgagggttgattcagcaaagcacatcgacttttccttgacgagtccatttggtggtggccgacctggaagggtgaagagaaagaaccaaaaggcagcagcaaagaaggctgctggaggtgacgatgaagaggatgaagaatgagcaatatgcattgcaatagtgatggttgagttttactagtcccctgtttaacaggtttatgctgattttattgtcagttgcttttgaatctttttgagttagcaccatctcattccctctctggaactctgggagttttacttgaatcttggatttttttttatgaatattatatatattattttcatatttttaatcttagattgctgcttaatgctaaaaaaaa

SEQ ID NO: 2550 - DNA, 886 bp, Solanum melongena
atccatcgacattgaaggagacgaacaaacatggtgcacgtctctttctatcgcaactatgggaagacctttaagaagcctcgaaggccctacgagaaggagcgattggatgcagaattgaagcttgttggagagtatggtcttaggtgcaagagggagctttggagagttcagtatgctttgagccgtatcaggaatgctgctagaatgcttctgacacttgatgagaaggatccacgccgtatttttgaaggtgaagctctcttgaggaggatgaacaggtatggattattggatgagagccaaaacaagcttgattatgttttggcactcaccgtggagaactttcttgagcgtcgtctccaaacacttgtgttcaagactggcatggctaagtcaattcatcatgctagagtgctcatcaggcaaaggcatatcagagtcgggaggcaggtggtgaatgttccttcctttatggtgagagtggactcccagaagcacattgacttctctctcactagtccattcggtggtgggcgtcctggaagagtcaagcgaaagaaccaaaaggccgcagccaagaaggctggtggtggtgatggagatgaagatgatgaagaatgagcaacttaccttagtgtttggagtatttggctagtagttctggactatcttatttttctgcaatttgtggttgccttcatgtaggagtaaaaagaaatgtattaaacaagagtttctaaatttggattttttgctgcttaagagttcaattagtggcggattctgaaaccttccattttcatttggtaagaaaataatttttgccttctttatggtggaacgagtggtggttatggtggtgcaataattgaatattgtgtgc

SEQ ID NO: 2551 - DNA, 781 bp, Hevea brasiliensis
acggcctcgtcggagcagaactatggtgcacgtctcattctatcgcaactatgggaagacatttaagaagcctcgtcgtccctatgagaaggagcgattggatgcagagctgaagttggtgggtgagtatggtttgcggtgcaagagagagctgtggagggtccaatatgcactgagccgcatccgtaatgctgctaggatgcttttgactcttgatgagaagaaccctcgccggatctttgagggcgaggctcttctccgcaggatgaaccgctatggtctattggatgagagtcagaacaagcttgattacgtgttggccttgactgtggagaacttccttgagcgccgcttgcaaacacttgtgttcaagtctggtatggcaaagtccatccaccatgctcgagtgcttattagacagaggcatatcagggttggaaggcaggtggtgaacatcccatctttcatggttagggttgactcacaaaagcacattgatttctcgttgacaagtccatttggtggtgggcgtcctggaagagtgaagagaaagaaccaaagagcagctagcaagaaggcttcgggtggagatggagatgaggaggatgaggagtgagtaatgagtttaggaccatcctattataacttgtgttactgtcaaagctagttttgttgctacctttacggggctattttttaatttaaattaccgctttattgttttggtttccaacttccatattgggtttgatctgtgatgcattatatgtgcccatgatct

SEQ ID NO: 2552 - DNA, 722 bp, Hevea brasiliensis
gcttctccattcgtttttgtatgtttccattgctacgcaataacatcgcagaggaaatcaccggaaactaaccatcatggtgcacgtctctttttaccgcaactatgggaaaaccttcaagaaaccaagacgtccctatgagaaggagcgtttggatgctgagttgaagcttgttggagagtatgggctccgttgtaagagagagctttggagagttcagtatgcattgagccgtattcgtaatgcagcaagaatgcttctcacccttgatgagaaaaacccacgtcgtatttttgagggtgaagcccttctgaggaggatgaataggtatggacttttggatgagagccagaacaagcttgattatgtgttggccctgactgtggagaactttcttgagcgccgtctccaaactctcgtgttcaagtcgggtatggctaagtcaatccatcatgctagagtgctcatcaggcaaaggcacattagggttgggagacaagtggttaatattccctcatttatggtgagggtggactcgcaaaagcatattgatttctcacttacaagtccatttggtggtgggcggcctggtagagtgaagagaaagaatcaaagggctgctaacaagaagagttctggtggcgatggggatgaagaagatgaagagtgagcttttcccgttctgaaatagtgattaatgtttctttttggaagtatgccta

SEQ ID NO: 2553 - DNA, 850 bp, Actinidia deliciosa
  misc_feature (681)..(681): n is a, c, g, or t
  misc_feature (683)..(683): n is a, c, g, or t
  misc_feature (687)..(687): n is a, c, g, or t
  misc_feature (692)..(693): n is a, c, g, or t
  misc_feature (704)..(704): n is a, c, g, or t
  misc_feature (712)..(712): n is a, c, g, or t
  misc_feature (731)..(732): n is a, c, g, or t
  misc_feature (751)..(751): n is a, c, g, or t
  misc_feature (761)..(761): n is a, c, g, or t
  misc_feature (793)..(793): n is a, c, g, or t
  misc_feature (796)..(796): n is a, c, g, or t
  misc_feature (799)..(799): n is a, c, g, or t
  misc_feature (830)..(831): n is a, c, g, or t
cggagacggagagctgaagaacagccatggtgcacgtctccttctaccgaaactatgggaagacatttaagaaacctcgtcgtccgtatgaaaaggagcgtttggatgctgagctgaagcttgtgggagagtatgggcttcggtgcaagagggaactatggagggttcagtatgccctgagccgtatccgtaatgctgcgagaatgcttcttacccttgatgagaagaatccccgccgaatctttgagggcgaggctcttctccgaaggatgaaccgttatgggcttttggaggagagtcagaacaagctcgattacgtcttggcactgactgtggagaactttctcgagcgccgcctccaaacacttgtgtttaagactggtatggcaaagtccatccatcatgccagagtgctcatcaagcagaggcatatcagggttggaaggcaggtggtgaacatcccgtctttcatggtgcgagtagactctcagaagcacattgatttctcgctgaccagtccacttggaggtgggcgcccgggtagggtgaagagaaagaaccagaaggccgccgccaagaaggctgcaggtggagacggagatgaccaggacgaggaatgaggtgctgctaatacaacttccttttgtagcaatagtaaggtttgtgtctgaacttgtattngncacnacccnncattaggattntttggttncatgactgcagtcatgttnnagtttctggacctttatgntttttggatntggaagaagtttgctttcattttgttgcatgnganggntagtattttgacatatactctttttgagaanntggtttttgtttttgtgtt

SEQ ID NO: 2554 - DNA, 874 bp, Capsicum annuum
gcacgagggacgaacaaacatggtgcacgtcaatttttatcgcaactatgggaagacctttaagaagcctcgaaggccctacgagaaggagcgattggatgcagaattgaagcttgtaggagagtatggactaaggtgcaagagggaactttggagagttcagtatgctttgagccgtatcaggaatgctgctagaatgcttctcacactggacgagaaggacccacgccgtatctttgaaggtgaagctctcttgaggaggatgaaccggtacgggttattggatgagagccaaaacaagcttgattatgtcttggcactcaccgtggagaactttcttgagcgtcgtctccaaacacttgtgttcaagactggcatggctaagtcaatccatcatgctagagtgctcatcaggcaaaggcatatcagagtcgggaggcaggtggtgaatgttccttcctttatggtgcgagtggactcccagaagcacatcgacttctctctcactagtccattcggtggtgggcgtcctggaagagtcaagcgaaagaaccaaacggctgccactaagaaggcttctggtggtgatggagatgaagaggatgaagaataagcagctatattagtgtttggagtatttggctatagtactggcctatgttattttctgagattgtggttacctgcatgtagtagtagaaagaaacgtattaagcaaaagtttttatttttggatttttcgctgttttaagagtttggcgaactctgtccttcaaaatccctccgagaaaattgagtagagaacacattctagttttttttttaacttcaaaggcatccttccaaattcgttgccagagtccacaaactcttt

SEQ ID NO: 2555 - DNA, 797 bp, Petunia hybrida
gcggggctccccggaaggtccccttttctccatttgagcaacgcaatcatggtgcacgtctccttttatcgcaactatgggaagacatttaagaagccccggcgtccctatgagaaggagcgattggatgcagagttgaagcttgttggagagtatggactaaggtgcaagagagaactttggagagttcagtatgctttgagccgtatcaggaatgcggctagaatgcttttgacccttgatgagaaagacccacgtcgtatttttgaaggtgaagctctcttgaggaggatgaacaggtatggtttattggatgagagccagaacaagcttgattacgtcttggcactcactgtggagaactttcttgagcgtcgtctccaaacccttgtgttcaagactgggatggcaaagtcaatccatcacgctagagtgctcattaggcaaaggcatatcagagttggaaggcaggtggtgaatgttccttcctttatggtgagagtggactctcagaagcacattgacttctctctcactagtcctttcggtggtggacgtcctggaagagtcaagagaaagaaccagaagtctgctgctaagaaggctgctggtggtgatggagatgaagaggatgaagaataagcagtatgttcattcggaatatatgggcttagtgttatcttaattttctgcaattgtgttaccttcatgttgtagaacgggtgtattgaccagcattggacaagttttttttgttttgcatttgctctgtttaagagttctgactaaatgtgctg

SEQ ID NO: 2556 - DNA, 769 bp, Populus trichocarpa
gattttcttttagacggggagaaatcttgtaactataaatacaacaattatagttcctcaccgcctccctagaccctaactgagttcgacagcgagcagaatggttcacgtctccttttataggaactatgggaaaacttttaagaagccaaggcgtccttatgagaaggaacgtttggatgccgagctgaagcttgtcggagagtatgggcttcgtgccaagagggaactctggagggttcagtatgctttgagtcgcattcgtaatgctgccagaatgcttctcacccttgacgagaagaaccagcgccgtatttttgagggtgaggcgcttttgaggaggatgaataggtatgggcttttggaagagagccagaacaagctcgattatgtgttggctctcaccgtggaaaactttctcgagcgccgcctccagactcttgttttcaaggctggtatggctaagtccatccaccatgccagagtgctcatcaaacagaggcacattagggttgggaggcaggtggtcaatattccatccttcatggtgagagttgactcgcagaagcacattgatttctcactgacaagcccctttggtggtggacgccctggtagagtgaagcgaaagaaccagaaggctgcttccaagaaggctgctggtggagatggagatgaagaggatgaagaatgagctgtaatgttcagtgatagtgattttcatttaaagttataaatttggttaataaaaaggaaaaggaagcaacaa

SEQ ID NO: 2557 - DNA, 971 bp, Populus trichocarpa
ggttggcccaatattgttcgggcttgtaaaacatgagcagtcccaaatccttaaaagctgttgctagggtttccatttaactttcaaaatataaaactatcgctttcgctgttttccattgcctctgcaacgctgtaactaagatctcaggaaggaggcactgaacaagcaagcatggtgcacgtctccttctaccgcaactatgggaaaacttttaagaagccaaggcgtccttatgagaaggaacgtttggatgctgagctgaagcttgtcggagagtatgggctccgtgccaagagggaactctggagggtgcaatatgctttgagtcgcattcgtaatgctgccagaatgcttctcacccttgatgagaagaaccaacgccgtatttttgagggtgaggcgcttttgaggaggatgaataggtatgggcttttggaagagagccagaacaagctcgattatgtgttggctctcaccgtggaaaactttctcgagcgccgcctccagactcttgttttcaaggctggtatggctaagtccatccaccatgccagagtgctcatcaaacagaggcacattagggttgggaggcaggtggtcaatattccatccttcatggtgagagttgactcgcagaagcacattgatttctcactcacaagcccctttggtggtggacgccctggtagagtgaagcgaaagaatcagaaggctgcttccaagaaggctgctggtggagatggagatgaagaggatgaagaatgagctgtaatgttcagtgatggtgattttcatttaatgttataaattttggtcaagagtttgtattgttgatctttcaagctgtttcatatcgtaagataagatgtttctgtggattttaacgtcatggagttctctttgggatatgttgttagctgtcctggttttatgccttgaagtaaatttatagtttttatccgctccca

SEQ ID NO: 2558 - DNA, 1401 bp, Eragrostis curvula
  misc_feature (40)..(40): n is a, c, g, or t
  misc_feature (62)..(62): n is a, c, g, or t
  misc_feature (65)..(65): n is a, c, g, or t
  misc_feature (129)..(131): n is a, c, g, or t
  misc_feature (504)..(504): n is a, c, g, or t
  misc_feature (528)..(528): n is a, c, g, or t
  misc_feature (544)..(544): n is a, c, g, or t
  misc_feature (547)..(547): n is a, c, g, or t
tggagaaggagaaagggaaaaagggggaagaggaaggatngcggggtttctgcgcacacggnggngggagccggcgacgaaccgcaccacctgccgcggcagccatggtgcacgtcaacttctaccgcnnntatgggaagactttcaagaagccaaggcgtccatatgagaaggagcgccttgatgctgagctgaagctcgtgggtgagtacggcctgcggtgcaagcgtgagctgtggcgtgtgcagtatgccctgagccgcatcagaaacgcagcaagggagttgctcaccttggatgagaagaaccctcgccgtatctttgagggtgaggcgctgctccgccgcatgaaccgctatggtctccttggtgagggtcagaacaagctcgattacgtgcttgctctcactattgagaacttcctccagcgccgcctccagaccattgttttcaagaatggcatggccaagtccatccaccatgcccgtgtcctgatcaggcagngccacatcagggtgggaaggcagntcgtcaacattccctngtncatggtcaggcttgaatcagagaagcacattgacttctcactcaccagcccgcttggtggtggccctgctggaagagtgaagagaaagaaccagaagaaggcctctggtggtggcggtgatggcgaggaggatgaggagtaagggaccggacatgccttgtaggtctttgcaagatgagttcgttcagaaatgaatcattgtagacttgagggtgaacctagttcctagtggtgcagttggctgtccctgggagttttgttgtcatgaattttgtatccaacggttttgctctgttgcatgtcccacccttgaattcgaaaacttgtgatatgttctcgtttgctgccgccagaatcaattttatccccagtccctataagaaaaattttcactacctccggtgctttgttgccaaaaaaaaaaaaaaaaaaaaaaaaaaataatcttgctttaatccactggcttaatacctaatgaattcccgccccccggccggtcacccttatgggaaaacttcccaaccccttgcaagctaatccttgggtctacaaaaagggccccctaaaaaccagaaccaaatactagggtcaaactcgtttcccgggtagaaaatttgttcccctcccactttccctcccaccaacccacccccggaaacccaaaaatgaaaaaaccagggggggccgccccgcgtgggggcgcacacccaattattttaccgtgttggccacccgcgcccccctttttccactgacagaaaacaagctcgggttccccgcatccaatcataaagttattctccctcacactctcagcgatgtaaagggccgatgtcttttttcttcttcttatt

SEQ ID NO: 2559 - DNA, 883 bp, Gossypium hirsutum
gacggagaattagggttcgattccggagagggagcctgagaaacggctaccacatccaaggaaagcagcaaagtcactgtgttaaagagaaacggcgcctccgccctacaacaatggttcacgtctccttttaccgcaactatgggaagacatttaagaagcctcgtcgtccttatgaaaaggaacgattggatgctgagttgaggctggtgggagagtacgggctgcgatgcaagagggaactctggagagttcagtatgctttaagccgaatcagaaatgctgctagggatctattgaccctcgatgagaagaacccgcgtcggatctttgagggtgaagcccttcttcgcaggatgaatcgatacggactattggatgagagccagaacaagcttgattatgtcttggcgttgacagtggagaacttcctcgaacgtcgccttcaaactctcgtgttcaagactggtatggctaaatctatccaccatgcccgagttctcatcaggcagaggcatatcagggttggaaggcaggtagtcaacattccatcattcatggtgagggttgattcacaaaagcacattgatttctcgctgactagtccgtttggcggtggacgtcccggaagagtgaagagaaagaaccaaagggcagctgccaagaaggctgctggtggagatggagatgaagaagatgaagagtaaggtgattggggttcttgatctttttttacttttacatgatttagaaaaatgatgtcttggtgtttattttggattgataatatttttggacattgttagaattttgtttagtttccaagaaaatgagtttacttttctttattatttttttcctgatatgaaattaccttcagttt

SEQ ID NO: 2560 - DNA, 807 bp, Musa acuminata
tcgccgcccacttcgcgcacctcttttgatctccgcaggcgagcgccggaggcggctgaggagacgaaccagccatggtgcacgttagtttctacaggaactatgggaagacctttaagaagccccgtcgtccctacgagaaggagcggctcgatgctgagctgaagctggtgggcgagtatgggctccgctgcaagcgggaactctggagggtccagtacgccctgagccgaattcgtaacgctgccagggatcttctcacgctcgacgagaagaaccctcgtcggatttttgagggagaggccctccttcgccggatgaaccgttatgggctcctcgaggaaggccagaacaagctcgattacgtcctggccctcaccgtggagaacttcttggagcgccgcctgcagactctcgtcttcaagtccggcatggcgaagtccatccaccacgctagggtactcatcaggcagcgtcacatcagagttgggaggcaagtggttaacatcccatcgttcatggtgagggtggattcagcaaagcacattgatttctcccttactagtccatttggtggtggacgccccggaagggtgaagagaaggaatcagaaggcagcagcaaagaaggcagcaggaggcgatggtgatgaggatgatgaagaatgagcaacatgcatttgtggtaatggaattgtgatagcatttttttcttttggatgaatttagtttcagttatctgaaggtttcgtagaagtgagaacacataaatttacccctgaatgacttttaatgcttttagagtttg

SEQ ID NO: 2561 - DNA, 1000 bp, Musa acuminata
ccaccgcctgtcttttagggttcttcttcccatctcttccgtgagagacccgcgcttgcgccggcgacagagaagaacgcgaaccagccatggttcacgtcagtttctaccgcaactatggcaagacgttcaagaaacctcgccgcccgtacgagaaggagcggctggacgcggaactcaaactggtcggggagtacgggctgcggtgcaagcgcgagctatggagggtccagtacgctctcagccggatccggaacgcggccagggatctcctcacgctcgatgagaagaacccccgacggatctttgagggagaggccctgctccgccgtatgaaccgctacgggctccttgaggagggccagaacaagctcgactacgtccttgccctcaccgtggagaactttctggagcgccgcctccagacgctcgtgttcaagtctggaatggccaagtccatccaccatgctcgggtcctgataaggcagcggcacatcagagttggaaggcaagttgtgaacatcgcatcattcatggtcagagttgattccgcaaagcacatagatttctcacttaccagtccattcggtggaggccgacccggtagagtgaagagaaaaaatcagaaagccgccgcaaagaaggcaaccggaggagacggtgacgaggatgatgaggaatgagcaatatgctctagttatctcgtttccatgtgttcatcatcacatggatgatttttatgtttctgcattttgggatattggaactatctttatattttgatatgctgccttgataggagtatttcgagtttgtgtgatgatctttcacattagtattgtctggtcattgtatttcatccgagttttgatcatgctcctgacttgtctggcatagaaactatgctgtggatgttaacgtgatatttgaacgtaaatgttacatcttgttctatggtttaaaatttcggattatataaatcttcgagctatttggatta

SEQ ID NO: 2562 - DNA, 1122 bp, Beta vulgaris
tggttgtggttgtggttgtggggtctattgtttcgatgttgttctctaattcccaggtttgtttcgccattgctgcggaagaggagagagcttttgggtccattgtagcctgcctgtgtgtgtgagagagaaagagaggaagagagagagagggagctccgccgtagtacagcagaggacaaccatggtgcacgtttgcttctaccgcaactacggtaagacatttaagaaaccccgtcgtccttatgagaaggaacgtttggatgctgagttgaagcttgttggagagtatgggcttcgtaacaagagggagttgtggagggttcaatatgttttgagtcgtattcgtaatgcggctcgtcatcttctcacacttgatgagaagaaccctcgtcgtatctttgagggtgaggctttgcttcgtaggatgcatcgtcatgggctattagatgagggtcagaacaagcttgattatgtcttggctcttactgttgagaacttccttgagcgtcgtcttcaaacacttgtattcaagtccggtatggccaagtctatccaccatgcccgtgttcttatcaagcaaaggcacatcagggttggaagacaagttgtgaacatcccatcattcatggttagagtcgactcacaaaagcacattgacttctctctctcaagtccattcggtggtggtcgtcctggaagagtgaagcgaaagaaccagaaagcagctgctaagaaggctgctggcggcgacggagacgaggaagatgaggagtgagcgttcagaatctagtaacttgtagtagtgcacaatcaaaacccctttttttgttgttaatgcaaattccgttgcatggtgaccattattatccttttgttttgaactttcaagttagattttgctgaaagtttttgtcattgctggttttatatggaatcgcatgaccgtggattatgagtaattagaaccgcagagcttcaaccagttccttttatttcaagttacattgtagttcttggtctagccacaatatagttgcctttttgcttacatgtgtatcttgtttgctgtgattagactttgacaaacatgtcttaacttaacttcatgatctgttgtca

SEQ ID NO: 2563 - DNA, 1110 bp, Gossypium raimondii
agcgtcggagacaatatcttttaaaaaaattcacatatttttaataaaaattttcaatatattctcatttttatcgtgaagatgatttaaacacaaactttgggctttttaactctttagtctttatttgggcctaagtagctcatatccctttgtttagcaacagcaaattttcagttctaaggctttatcatattttttagggtttgctttataaaacccatttgcaaccctaccgttggttgatgaaagcagcaaagtcactgtgttaaagagaaacggcgcctccgccctacaacaatggttcacgtctccttttaccgcaactatgggaagacatttaagaagcctcgtcgtccttatgaaaaggaacgattggatgctgagttgaggctggtgggagagtacgggctgcgatgcaagagggaactctggagagttcagtatgctttaagccgaatcagaaatgctgctagggatctattgaccctcgatgagaagaacccgcgtcggatctttgagggtgaagcccttcttcgcaggatgaatcgatacggactattggatgagagccagaacaagcttgattatgtcttggcgttgacggtggagaacttcctcgaacgtcgccttcaaactctcgtgttcaagactggtatggctaaatctatccaccatgcccgagttctcatcaggcagaggcatatcagggttggaaggcaggtagtcaacattccatcattcatggtgagggttgattcacaaaagcacattgatttctcgctgactagtccgtttggcggtggacgtcccggaagagtgaagagaaagaaccaaagggcagctgccaagaaggctgctggtggagatggagatgaagaagatgaagagtaaggtgattggggttcttgatctttttttacttttacatgatttagaaaaatgatgtcttggtgtttattttggattgataatatttttggacattgttagaattttgtttagtttccaagaaaatgagtttacttttctttattatttttttcctgatatgaaattaccttcagtttaataaaagcttatattacaatttaagggatgattataatt

SEQ ID NO: 2564 - DNA, 922 bp, Amaranthus tuberculatus
tggtccattacggcggagtagagaaacagagccatggttcacgtttccttttatcgcaactatggtaagacttttaagaagcctcgtcgtccctatgagaaggaacgattggatgctgagttgaagcttgttggagaatatgggcttcgtaacaagagggagttatggagggttcagtatgttctgagccgcattcgtaatgcagctcgtcatcttctaactcttgatgagaagaaccctcgtcgtatttttgagggtgaggctttgcttcgtaggatgaatcgttatgggcttttggacgagggtcaaaacaagctcgattatgtgttggctcttactgtcgagaacttccttgagcgtcgccttcaaacacttgttttcaagtctgggatggccaagtctatccaccatgctcgtgttcttatcaggcaaaggcacattagagtcggaaggcaagtagtgaacataccatccttcatggttaggcttgactcacagaagcacatcgacttctctcttacaagtccatttggtggtggtcgtcctggaagagtgaagagaaagaatcagaaagctgcagcaaagaaggctgccggtggagatggagatgaggaagatgaagagtaagcagtactcgatatgcattagtggtgcacaccaaagttcaactttttttgttgctaaatgcacattttgttggatgagtgacttaatttgtgatcctattgtttcaaaactttaacctgtagattttgctaaaatctgtctgttggttctattatactggatcacacatcaacgtggattatagccatttatcggcaattagaacaacagaattttgttagcagctgttggacaagtctcgaatgaaatctctatttatccctctttaaaacacatctataagaaggatgttgcc

SEQ ID NO: 2565 - DNA, 865 bp, Beta vulgaris
  misc_feature (767)..(767): n is a, c, g, or t
ggccgggggttttgatctgtgtgtgtgtgaaagacattgagaggaagagagagagagggagctccgccgtagtacagcagaggacaaccatggtgcacgtttgcttctaccgcaactacggtaagacatttaagaaaccccgtcgtccttatgagaaggaacgtttggatgctgagttgaagcttgttggagagtatgggcttcgtaacaagagggagttatggagggttcaatatgttttgagtcgtattcgtaatgcggctcgtcatcttctcacacttgatgagaagaaccctcgtcgtatctttgagggtgaggctttgcttcgtaggatgcatcgtcatgggctattagatgagggtcagaacaagcttgattatgtcttggctcttactgttgagaactttcttgagcgtcgtcttcaaacacttgtattcaagtccggtatggccaagtctatccaccatgcccgtgttcttatcaagcaaaggcacatcagggttggaagacaagttgtgaacatcccatcattcatggttagagtcgactcacaaaagcacattgacttctctctctcaagtccattcggtggtggtcgtcctggaagagtgaagcgaaagaaccagaaagcagctgctaagaaggctgctggcggcgacggagacgaggaagatgaggagtgagcgttcagaatctagtaacttgtagtagtgcacaatcaaaacccctttttttgttgttaatgcaaattccgttgcatggtgacnattattatccttttgttttgaactttcaagttagattttgctgaaagtttttgtcattgctggttttatatggaatcgcatgaccgtggattatgagt

SEQ ID NO: 2566 - DNA, 924 bp, Manihot esculenta
agggtttcgttcctttacaaaggtcccttttgaagactgcaaactttgtaagagacgaagctctgtgagaggaaaggccaccgaggagcagagccatggtgcacgtctccttctatcgcaactatgggaagacttttaagaagccccgtcgtccctatgagaaggagcgattggatgcagaactaaagttggttggggagtatggattgcggtgcaagagagagctatggagggttcaatatgctttgagccgcattcgaaatgctgctagaatgcttttgactcttgatgagaagaatcctcgcaggatctttgagggtgaggcacttctccgcaggatgaaccgctatggtttattggatgagagtcagaacaagcttgattatgtgttggccttgactgtggagaacttccttgagcgccgcctgcaaacacttgttttcaagtctggtatggcaaagtccatccaccatgcccgagtgcttatcaggcagaggcatatcagggttggaaggcaggtggttaacatcccatctttcatggtgagggttgattcacagaagcacatcgatttctcattgacaagtccatttggcggtgggcgtcctggaagagtgaagagaaagaaccagagagctgctagcaagaaggcttctggtggagatggagatgaagacgatgaggagtgagttatgagttcagccatggccaggctagtagaacataggctattgcctcagcatttgttatcttttacaaggacagttttgttaagaatatttactgcattaatgttttggtttctgaactttgatattgggtttgttttgagaggaattaaaattatgtatcaatgagctatgctgagctcctccaatttaaacggaatctggctggttattgaatgcttgtcttcttaggtct

SEQ ID NO: 2567 - DNA, 968 bp, Manihot esculenta
ggttttagggttaccttcctttataaactctcattttgaagactggaaaaacctagtgtaacacgcagagagagagagcaaaatctctgtgagaggaacggccccgtcggagcagagccatggtgcacgtctctttctatcgaaactatgggaagacctttaagaagccccgtcgtccctatgagaaggagcgattggatgcagagttgaagttggtgggtgagtatggtttgcgatgcaagagagagctgtggagggtccaatatgccttgagccgcattcgtaatgctgctagaatgcttttgactcttgatgagaagaacccacgccggatctttgaaggtgaggctcttcttcgcaggatgaaccgctatggtctattggatgagagtcagaacaagcttgattatgtgctggccttaactgtggagaacttccttgagcgccgcttgcagacactcgtattcaagtctggaatggcaaaatccatccaccatgctcgagtgcttatcagacagaggcatatcagggttggaaggcaggtggtgaacatcccatctttcatggttagggttgattcacagaatcacattgatttctccttgacaagtccatttggtggtgggcgtcctggaagagtgaagagaaagaaccaaagagcagccagcaagaaggcttctggtggagatggagacgaggaggatgaggagtgagtcaggagtttaggaccatccgataagaacttgttttaccgtctaagctagttttattgttacgtttatggccctctttttttttttttatttgaaaaaaacaaaaaaagaatgttaccgcattaatgttttgatttctgaacattgatctttgatattgggtttgctcttttgatgcatcacattatatgtatccatgacctgttctgaggattactttttccacccaatgacaacacagctggctgcttattt

SEQ ID NO: 2568 - DNA, 1280 bp, Ricinus communis
attgtttttatttttaaaaaaagtatgggctgatatttgagcccacctaaaatacagaagtaagctttgctggtataagaatcgagatcaaacgtctagagggctagggttttgtaccaagacttcatatattaaaagaaaaataacagaaatatataagcgctcttgaaccagaaaatctcattcctttcttccacttctccattgggttaaatcgtcactccacaataggatcggagaggaagcaaaggcagctaacaaagcatggtgcacgtttctttttaccgcaactatgggaaaacctttaagaaaccaagacgcccctatgagaaggagcggttggacgctgagctgaagctcgttggagaatatggtctccgttgtaagagagagctttggagggttcaatatgcattgagccgtatccgtaatgctgcaagaatgctccttacgcttgatgaaaaaaaccagcgtcgtatttttgaaggtgaagcacttctgaggaggatgaataggtatggacttttggatgagagccaaaacaagcttgattacgtgttggccttgactgttgagaacttccttgagcgccgtcttcaaacacttgtgttcaagtctggtatggctaagtctatccaccatgctagagtgctcatcaggcagagacacattagggttgggagacaagtggttaacattccctctttcatggtgagggtcgactcacaaaagcacattgatttctcccttacaagtcctttcggtggtgggcgccctggtagagtgaagagaaagaatcaaagagctgctagtaagaagaattctggcgacggggaagaagaagatgaagagtgagctctcggagatggtgactaatgattttgttaggaagtttgcttaatagtgtttcacattgaccaccttctacatcattttgaatcctcgtgaaattttgagagaatatttagtgctaccaagtacttctgttctgtgttcttttttaccatctaaaggcttatgctgttgttggaatatataatcgcttgtccaactattggcaaattgtctgcttatagaattagtgcccaaatttggtgaaggttccaggtggcttttcagtgctgctttaaaagcagcgtggttggtcgttctgtttctaccctctcttgaattgttcattattgggccttctctcctataggatgaaagtatgtgtcatctctcctgtgaagcaaactcttagccagcaatttccaaattcatttttttctttctacaaa

SEQ ID NO: 2569 - DNA, 894 bp, Gossypium hirsutum
cttttatgaaacccatttgcaaccctaccgttggttgatggaagcagcaaagtcactgtgttaaagagaaacggcgcctccgcccaacaacaatggttcacgtctccttttaccgcaactatgggaagacatttaagaagcctcgtcgtccttatgaaaaggaacgattggatgctgagttgaggctggtgggagagtacgggctgcgatgcaagagggaactctggagagttcagtatgctttaagccgaatcagaaatgctgctagggatctattgaccctcgatgagaagaacccgcgtcggatctttgagggtgaagctcttcttcgcaggatgaatcgatacggactcttggatgagagccagaacaagcttgattatgtattggcgttgacggtggagaacttcctcgaacgtcgtcttcaaactcttgtgttcaagactggtatggctaaatctatccaccatgcccgagttctcatcaggcagaggcatatcagggttggaaggcaggtagtcaacattccatcattcatggtgagggttgattcacaaaagcacattgatttctcgctgactagtccgtttggcggtggacgtcctggaagagtgaagagaaagaaccaaagggcagctgccaagaaggctgctggtggagatggagatgaagaagatgaagagtaaggtgattggggtttttgatctttttttacttttacatgatttagaaaaatgatatcttggtgtttattttggattgataatatttttggacattgttagaattttgtttagtttccaagaaaatgagtttacttttctttattatttttttcctgatgaaattaccttcagtttaataaaagcttatattacattttaaaaaaaaaaa

SEQ ID NO: 2570 - DNA, 763 bp, Fraxinus spp
acaacaatggtgcacgtctctttttaccgcaactatgggaagacttttaagaagccccgtcgtccctatgagaaggagcgactagatgctgagctgaagcttgttggagaatatggacttaggtgcaagagggaactctggagggttcagtacgcactgagccgcatcagaaatgctgcaagaaatcttctgactcttgacgagaaggatcctcgtcgtattttcgagggtgaagcccttctgaggaggatgaacaggtatgggctgctggatgagagccagaacaagctcgattatgtattggctctaacagtagagaatttccttgagcgccgcctgcagactcttgtgtttaaggcaggtatggccaagtcaatccaccatgccagagtgctcatcaggcaaaggcatatcagggttggtcgacaagttgtcaacgtgccctcttttatggtgagagtggattctcagaagcacattgatttctctctgacaagtccatttggtggtggccgccctggtagagtgaagagaaggaaccagaaggcagctgcaaagaaggcttccggtggtgatggggatgaagatgatgaagagtgaaagctcggtagtttatgcggttaatggttataccaggaagttgcatccttagtttgtctttgctcttgtagcagtgtcttaaataaactaaactgttagtgatttctgtcttgagatattaaagattaggatgtttaaccttcttggcaatggtcttcatatc

SEQ ID NO: 2571 - DNA, 810 bp, Fraxinus spp
gaggtgaaaccctaatctgttgccttcagcaggaagggataaccggattgaagatcgaaacagtgggggccaacaacaatggtgcacgtctctttttaccgaaactatggtaagacgtttaagaagccccgtcgtccctatgagaaggagcgactagatgctgagttgaagcttgttggagagtatggacttaggtgcaagagggaactctggagggttcagtatgcactgagccgcatcagaaatgctgcaagaaatcttctgactcttgacgagaaggaccctcgccgtatttttgagggtgaagcccttctgaggaggatgaacaggtatgggttgctggatgagagccagaataagctcgattatgtcttggccctcacagtagagaatttccttgagcgccgcctgcaaacttgtgtgtttaaggcaggtatggccaagtcaatccaccatgccagagtgctcatcaggcaaaggcatatcagagttggtcgacaagttgtcaacgtgccctcatttatggtgagagtggattcccagaagcacattgatttctctctcacaagtccatttggtggtggccgccccggtagagtgaagcgaaagaaccagaaggcagctgcaaagaaggcttctggtggtgatggggatgaagatgatgaagagtgaaagctcggtagttaatgcggttaaaggtaataccaggcagttgcatcattagtttttctttgctcttgtagcagtgtcttaaatgaaatactggtggttctgtccaagatattaagattagtctgttttaagcttgac

SEQ ID NO: 2572 - DNA, 826 bp, Zingiber officinale
  misc_feature (214)..(214): n is a, c, g, or t
  misc_feature (720)..(720): n is a, c, g, or t
  misc_feature (784)..(784): n is a, c, g, or t
  misc_feature (812)..(812): n is a, c, g, or t
tcttgatctcctccgtcttgaggcaaagcttgcgaacgagacatggtgcatgtcagcttctaccgcaactatgggaagaccttcaagaagccccgccggccctacgagaaggagcggctggacgcggagctgaagctggtgggtgagtatggcctccggtgcaagcgcgaactgtggagagtccaatacgcattgagccgtatccggaacgctnccagggagcttctcaccctcgacgagaagaacccccgccggatctttgagggcgaggccctgctccggaggatgaaccgttacgggctcctgggggagggtcagaacaagctcgattacgttcttgcgctcactgtggagaactttctggagcgacgccttcagacgctcgtgttcaagtcagggatggccaagtcgatccaccacgctcgtgtactgatcaggcagcgacacatcagagtcggaaggcaagttgtcaacattccttcatttatggttagagtcgattctgccaagcatatcgatttctcattgactagtccatttggaggtggccgtcccggaagagttaagagaaagaaccagaaggctgctgcaaagaaggcagccggaggcgacggtgatgaggatgatgaggaatgagcattatgtttaagcatttacttgaattagtagctctctattttttattttcccattgattttctatctatttattttcatttncaattcagtagcttaacttatcaacacccgtcattttctcattttactaaacatggattttgangatcattctctgagattatgaagctccntgtttatttgcttc

SEQ ID NO: 2573 - DNA, 906 bp, Ipomoea batatas
tacggccgggggctgaaccctagtccctcagagctgcagaatttagattccattgccgaactgaggttctttcctccggcggcccagcatggtgcacgtttccttttaccgaaactatggaaagacattcaagaagcctcgccgtccatatgagaaagagcgtttggatgctgagttgaagcttgtgggtgaatatgggcttaggtgcaagagggagctttggagagttcagtatgctttgagccgtatccgaaataatgcaagaatgcttctaacccttgatgagaaggacccacgccgtatttttgagggtgatgcactcctgaggaggatgaataggtatggcctgctggacgagagccaaaacaagcttgattatgtccttgccctcacagtggagaattttcttgagcgccgtctacaaactctggtgtttaaggctggcatggcaaagtcaatccatcatgcaagagttctcattaggcaaaagcacatcagggttggaaggcaggttgtcaatgtcccgtccttcatggtcagggttgactctcagaagcacatcgatttctcactgtccagcccattcggtggtggccgacctggtagagtgaagagaaagaaccagaaggccgctgcgaagaaggctgctggtggtgatggagatgaagaggatgaagaatgagcttgtttcttctgtgtagtagggtgtaccctttttccacaatttgctggaggttattacaccttactacccttttgccaaaagcccaaaactctctgtggtcttacaagctttgacattttctgttgactaatcttttgattgcccttttgtaccttttgtggttctagagttggttacatctattataatttaagttaagagatgttctagtaaaaaaaaaa

SEQ ID NO: 2574 - DNA, 777 bp, Lactuca sativa
cctaagagcagcgcagagggaggaggccgccggaagtgaggtgaatatcagccaattagccgccgtatcgacgttgaacaaccatggttcacgtctctttctaccgcaactatggaaaaaccttcaagaagccacgtcgtccttatgagaaggaacgattagatgctgagcttaagttagtcggagagtatgggttgagatgcaaaagggagctatggagagtgcaatacgcacttagcagaatccgaaatgctgcaagaatgcttctaacccttgaagaaaaagacccacgtaggatctttgaaggtgaagccctaatgagaaggatgaacagatatggactcttggatgaaagtcaaaacaagctcgattacgttcttgccctaactgttgaaaactttcttgaacgtcgccttcagacacttgtgttcaaaactggtatggctaagtcaatccaccatgccagagtcctcatcaagcaaagacacatcagggtgggaaggcaagttgtgaatgtgccttctttcatggtgagagttgactcacagaagcatattgacttttcattgacgagtccatttggaggtgggagacctggaagagtgaagaggaagaaccagaaggctgctgcaaagaaggcttctggtggagatggggatgaggaggatgaagaatgaaaagcttgaaaacttgagaggtgttatgaggtttattatatgagtacttttgttatcttgataataactcttttgtaggaagttttgaatgcttttggaa

SEQ ID NO: 2575 - DNA, 817 bp, Olea europaea
agctttcagccatggttcacgtcagtttttaccgcaactatgggaagacgtttaagaagcctcgtcgtccatatgagaaggagcgtttggatgcagagctgaagcttgttggtgaatacgggctccgatgcaagagagagctctggagggtacagtatgcattgagtcgtattcgtaatgctgcaagaaatcttctcacccttgatgagaaagaccctcgtcgtatctttgagggtgaagcccttcttcgcaggatgaacaggtatgggcttttggatgagagccagaataagctcgattatgtcttggcacttactgtggagaacttccttgaacgccgcctccaaacacttgtgttcaaggctggtatggcaaagtcaattcatcatgcccgtgtgctcatcaggcagaggcatatcagggttgggagacaagttgttaatgtgccatccttcatggtgcgagtcgactcacagaagcacatcgacttctccctcactagtcctttcggtggtggtcgacctggaagagtgaagcgaaagaaccagaaagctgctgcaaagaaggcgtctggtggtgatggtgatgaagaagacaaaaaataaacatttaagaaactgaagtagcatgttcttaaaatgcagtttttgttctaaactggaaaactctaaaatcttttgtctcgacagatactttgtgttttggcatgttttttcagtattagactttttctgttttatttttttttggtttggatattacgtaggaaatttaattatatgatagttcatcaagttttacttataatttttagttt

SEQ ID NO: 2576 - DNA, 849 bp, Capsicum annuum
gtaggccgccgatctaagggcgccgccatctaccgataaaaatggtgcacgtctccttctaccgcaactatgggaagacctttaagaagcctagacgtccctatgagaaggagagattggatgccgagttgaagctcgttggagagtatggactgaggtgcaagagggagttgtggagagttcagtacgccttgagccgtatcaggaatgctgcaagaatgcttctgacccttgacgacaaagacccacgtcgtatttttgaaggtgaagctctcttgaggaggatgaacaggtatgggttgttggatgaaagccagaacaagctcgattatgtcttggcactcactgtggagaacttccttgaacgccgtctgcaaacccttgttttcaagactggcatggccaagtcaatccaccatgcaagagtgctcatcaggcaaaggcatatcagggttggaaggcaagtggtgaatgttccttcatttatggtgaaagtggactctcagaagcacattgacttctctctatccagtcctttcggtggcgggcgtccaggaagagtgaagcgaaagaaccaaaaggctgctgccaagaaggctgctggcggtgatggtgatgaggaggacgaagaataagcttttgcgcaagaacccaaagaaagatgttggtgatggagccggttcatttttgaagtttttaagtacccatgtagtgcttccttacattcctttcttcgatatttgtgatatcttcatatgaaagtaatgttcttagcagagactgggagaatgttttgatgtttggattttgctctaaatagactttgaattttgtttaattttttccttg

SEQ ID NO: 2577 - DNA, 899 bp, Capsicum annuum
gcagtaaagtaggccgccgatctaagggcgccgccatctaccgataaaaatggtgcacgtctccttctaccgcaactatgggaagacctttaagaagcctagacgtccctatgagaaggagagattggatgccgagttgaagctcgttggagagtatggactgaggtgcaagagggagttgtggagagttcagtacgccttgagccgtatcaggaatgctgcaagaatgcttctgacccttgacgacaaagacccacgtcgtatttttgaaggtgaagctctcttgaggaggatgaacaggtatgggttgttggatgaaagccagaacaagctcgattatgtcttggcactcactgtggagaacttccttgaacgccgtctgcaaacccttgttttcaagactggcatggccaagtcaatccaccatgcaagagtgctcatcaggcaaaggcatatcagggttggaaggcaagtggtgaatgttccttcatttatggtgaaagtggactctcagaagcacattgacttctctctatccagtcctttcggtggcgggcgtccaggaagagtgaagcgaaagaaccaaaaggctgctgccaagaaggctgctggcggtgatggtgatgaggaggacgaagaataagcttttgcgcaagaacccaaagaaagatgttggtgatggagccggttcatttttgaagtttttaagtacccatgtagtgcttccttacattcctttcttcgatatttgtgatatcttcatatgaaagtaatgttcttagcagagactgggagaatgttttgatgtttggattttgctctaaatagactttgaattttgtttaattttttccttgaaccaaacaaagtgattgccaaattatcttgtcccctcgtgc

SEQ ID NO: 2578 - DNA, 860 bp, Ananas comosus
acgatctcggtttctcctctccaaacgcgagagccgcgagggggaagagcaccagccatggttcacgtcagtttctaccgcaattatgggaagacgttcaagaagccacgccgcccctacgagaaggagcggctcgatgccgagctcaagctggtgggggagtacggtctccgatgcaagagggagctgtggagagttcagtacgctttgagccggatccggaacgcggcgagggagctcctcacgctggatgagaagaaccctcgccggatcttcgagggagaggctcttcttcgccggatgaatcgatacggcctgctcggcgagaatcagaacaagctcgattacgtcctcgcccttacggtcgagaacttcctcgagcggcggcttcagaccatcgtcttcaagaccgggatggccaagtccatccaccatgccagggtcctaatcaggcaacgccacatcagagttgggcggcagttggttaacattccctcattcatggtgagggtagattctgagaagcacatcgacttctccctcacgagtccgtttggcggaggtcgccctggaagagtgaagagaaagaacatgaagaatgcagcaaagaaggcagctggcggtgacggtgatgaggaggatgaagaatgagcaaatcatgccttagtaggttctgctgtgtcttttttgccttgtaagttaaatttgctagctaagaatgtggtatgttatcctcccaaatctataagagtcatttcacattgcgcttactggagctatataagtgaggcagggttttttgttttattactatataaaatatgactgtatatggagactgatttctatgcctttttttt

SEQ ID NO: 2579 - DNA, 876 bp, Populus trichocarpa
atgttccatccttgttcatcgccaccctaaaccctaagtttgcaggcggcagtcaacaagcatggtgcatgtgtccttctatcgcaactacgggaaaacttttaagaaacctaggcgtccctatgagaaggaacgtttggatgctgagctgaagctcgtcggagagtatgggctccgtgccaagagggaactctggagggtccagtatgcattgagtcgcattcgtaatgctgccagaatgcttctaacccttgatgagaagaactcacgccgtatctttgagggtgaggcgcttttgaggaggatgaataggtatgggcttttggaggagagtcagaacaagctggattacgtgttggctcttacggtggaaaactttcttgagcgccgcctccagacacttgttttcaaggctggtatggctaagtcgatccaccatgcccgagttctcattaaacagaagcacattagggttgggaggcaggtggtcaatattccatctttcatggtgagggtggactcgcagaagcacattgatttctctctcacaagtccctttggtggtggacgtcctggtagagtgaagcgaaagaaccagaagtctgcagccaagaaagcatctggtggagatggagatgaagaagatgaagaatgagcagtcatgttctttgacagtgaatttcttgttaatcttataaagtttgtttaagactttcaatctctttggtatcctaagataaaagaggtttatgcgcggatctttaagttattagggtgtgttaccattttgagattacctttgtcgttgtctttgtctttgcctttggaatttattgttttcttgataaatctagctagcccttgttttacgcctta

SEQ ID NO: 2580 - DNA, 970 bp, Populus trichocarpa
gtgaagcccatgcggacatgccactccattcctaaaagcttgcaagggtttagggtttgcaaatataagtcacacgatcctccattgctgcggtcgtccttgctggtctccgctcactctgctctcttgaggacacggcatccgaaccatggttcacgtcagtttttacagaaactatgggaagactttcaagaagccgaggcgcccatatgagaaggaacggttggacgcagagctgaaacttgttggagagtatgggctccgtgctaagagggagctatggagggttcaatatgccctgagccgcattcgtaatgctgcaagaatgcttctcaccctggacgagaagaacccacgccgaatttttgaaggtgaagcccttctccgcaggatgaacaggtatggtcttctagaggagaaccagaacaagcttgattatgtcctggccctcactgttgagaacttccttgagcgtcggctccagaccctcgtgttcaaggctggcatggcaaagtctattcaccatgctcgtgtgctcatcaagcagaggcacactagggttggaaggcaggttgttaacattccatcttttatggtgagggttgactcccagaaacacattgatttttctctcacaagtccacttggaggtggccgtcctggaagagtgaagagaaagaatcagaaggctgctgccaagaaggctactggtggagatggtgatgaagaggatgaggaatgaaacactcgaacagtaggctagtaaaaattcttgtgaactgaattttcttaagcatctttcttggtgtcactcacactagtgggtgcttggtatgtgttttttttgcaattgttgtatccgaactagaacaagattttgcttactaacgtaagagctaacttttggtgttgctttagatgaatggatgttttatacttgtcccctatagatgtgtatttttctgtcaaa

SEQ ID NO: 2581 - DNA, 816 bp, Solanum lycopersicum
atagcagtatcctttaccttctcagagatctctgtacattgaaggagacgaacaaacatggtgcacgtctctttttatcgcaactatgggaagacctttaagaagccacgaaggccttatgagaaggagcgattggatgcagaattgaagcttgtaggagagtatggactaaggtgcaagagggagctttggagagttcagtatgctttgagccgtatcaggaatgctgctagaatgcttctgacattggatgagaaggatccacgtcgtatttttgaaggtgaagctctcttgaggaggatgaacaggtatgggttgttggatgagagccaaaacaagctcgattatgtcttggcactcaccgtggagaactttcttgagcgtcgtctccaaacactagtgttcaagaccggcatggctaagtcaattcatcatgccagagtgctcatcaggcaaaggcatatcagagttggtaggcaggtggtgaatgttgcttcttttatggtgagagtagactcccagaagcacattgacttctctctcactagtccatttggcggtgggcgtcctggaagagtgaagcgaaagaaccaaaagtctgctgccaagaaggctgctggtggtgatggtgatgaagaggatgaagaatgatcaactatcttagtgtttggtctatttggcttgtagttctggcctatcttatttttctgctatttgtggtttaccttcatgtagtagtaaagaaatattaaacagaagtttctaaatcttggattttgcactgttttaagagttttgactaaatctgtcttacca

SEQ ID NO: 2582 - DNA, 827 bp, Solanum lycopersicum
acccttgtgtaatttacccttcgccatttctgttctcttcagcagatcggcgacgacggtgccggtgaccggaaagtatggtgcatgtttccttttaccgcaactatgggaagacctttaagaagcctcgacgcccttatgagaaggagcgattggatgcagagttgaagcttgttggagaatatgggctgaggtgcaagagagagctttggagagttcagtatgccttgagccgtatcagaaatgctgcaagaatgcttctgaccttggatgagaaagatccacgccgtatttttgaaggtgaagcactcttaagaagaatgaacagatacggattattggatgagagccagaacaagcttgattatgtcttagccctcactgttgagaactttcttgagcgtcgtctccaaaccctcgtcttcaagactggcatggccaagtcaatccaccatgctagagtgctcattcgacaaaggcatatcagagttggtaggcaggtggtgaacgttgcttctttcatggtgagagtggactcccagaagcacattgacttctctctcaccagtcctttcggtggtggtcgccctggaagagtgaagcgaaagaaccagaaatctgctgcaaagaaagcagctggtggtgatggtgacgaggaagatgaagaataaactcttgtgtttatttgcgtttggatgtttcacttctgcctatgttgtgtactttcttgttttatgtttttttttttgcaatttaatctacctttaatatattagaaatggttttgacagaggtggagaagaaattgagtttggatttagcacttg

SEQ ID NO: 2583 - DNA, 778 bp, Utricularia gibba
ggcacggcggtgagcagaagcgatggtccacgtttcgttttaccgcaactatgggaagacatttaagaagccgcgacgtccttatgaaaaggagcgtcttgacgcggaattgaagcttgttggagagtatggtttgaggtgcaagcgtgagctgtggagggttcagtatgcgctgagccgcattagaaacaatgctagagatctgcttactctcgatgagaaggaccctcgtcgtatttttgagggagaagcacttttgcggcggatgaataggtatgggctactggatgagagtcagaacaagcttgattatgtgctggccctcacagtcgaaaatttcctcgaacgccgactgcagactctcgtctttaaagccggtatggctaagtcaattcatcatgccagagtcctgatccggcagaggcatatcagggtggggaggcaagttgtgaatgttccttctttcatggtgagagtggactcccagaagcacattgatttctctctaactagtcctttcggcggtggccggcccggccgtgtgaagagaaggaaccagaaggctgctgctaagaaagcttctggcggtgatggagatgaggaagacgaggagtaaggcgtattgcttcatctggtttctgtgattgtagtctcaaaactccatgttttcctggtccttatctgtctttaagtagtggacttggctctcgctgagccatcagctttttttcaagctcttctcccatttctcaaactgtgttttgaaccatcctctgaa

SEQ ID NO: 2584 - DNA, 769 bp, Utricularia gibba
ctggccatggtgcacgtctctttctaccggaactatgggaagacgtttaagaaacctcgtcgtccctatgaaaaggagcgccttgatgcggagttgaagcttgttggagagtatggcttgagatgcaaaagggagctgtggagggttcagtacgcactcagccgcattaggaacaatgccagggatctcttgactcttgatgagaaggatccacggcgtatttttgagggagaagcccttttgcggaggatgaatcggtacggtttgctggatgagagccagaacaagctggattatgtgttggccttgactgttgaaaacttccttgagcgtcgactccaaactctcgtcttcaaggctggcatggctaagtccattcatcatgctagagtcctcatcaggcagaggcacatcagggttggaaggcaggttgtgaatgttccctcgttcatggtgagagtggactcccagaagcacatcgacttctctctcacgagtccattcggtggaggccgtcctggtagagtgaagagaaggaaccagaaggcggccgcaaagaaggcctctggtggtgatggtgacgaggaagatgaagagtgaggtgaactgcaagcaagatttaggcctgatttctgcactctattgcgtttaatctcatgttcttccaatatcccttgttttttcagtttcagttggagtatgtttggttcacataatcattacgaaacccacagatgctcttccatgtgcttcatatactaaattcaag

SEQ ID NO: 2585 - DNA, 822 bp, Gerbera hybrid cultivar
agcagcgcaggaggaggccgccggagagagcaatcaattaaccgccggatcgacgtcgaacaacaatggttcacgtcaacttctaccgcaactatgggaagacttttaagaagccccgtcgtccttatgagaaggagcgattggacgctgagttgaagcttgttggagagtacggtctccgatgcaaaagggagctatggagggtgcaatatgctcttagccgcattcgtaatgctgcaagaatgcttttgacccttgaagagaaggacccacgtaggatttttgagggtgaagcccttatgaggaggatgaaccggtacggtcttttggatgagagtcagaacaagctcgattatgtcttggccctcactgtggagaactttcttgaacgtcgactccagacactcgtgttcaagactggaatggccaagtccattcaccatgctagggttcttatcaagcagaggcacatccagggtgggaaggcaagtggtgaatgtaccatcgttcatggtgagagttgactcgcagaagcacattgacttttcgctgacgagtccgtttggaggtgggcgacctggcagagtaaagcgaaagaaccagaaggcggctgcaaagaaggcagatggtggggatgcggatgaagacgacgaaaaatgagtatttcttttagagttgttcttggcttaaaccttataataacctatgtaggaagttttggatgccttttcctaacctcctaaggtttttgttatggatttaattaagtgtaggttatttgtttttttttttggtaatgaacttgaaatcataggtggatgg

SEQ ID NO: 2586 - DNA, 790 bp, Festuca arundinacea
  misc_feature (789)..(789): n is a, c, g, or t
ggcacgagggacccatcctgcggcggcgccggcgtacgagaccggcgttgagttggggaggcatcgtcagccatggtgcacgtcaacttctaccgcaactacggtaagactttcaagaagccaaggcgtccttatgagaaggagcgtcttgatgctgagctgaaactggtgggggagtatggcctcaggtgcaagcgtgagctgtggcgtgtgcagtatgcccttagccggatccgcaacgctgcaagggagctgctcacccttgatgagaagaatccccgtcgtatctttgagggcgcggctcttctgcgacgcatgaaccgctatggtctcctttctgaggaccagaacaagcttgattatgtgcttgcgctcactgtcgagaacttccttcagcgccgcctccagaccattgtcttcaagaatggcatggcaaaatccatccatcatgctcgcgtgctcatcagacaacgccacatcagagttgggaggcagcttgtcaacattccgtcgttcatggtgagagttgacaccgagaagcacgtcgacttctccctgaccagcccacttggtggtggtgagcctggaagggtgaagaggaagaaccaaaagaaggctgcaggtggtggcggtggtgatggtgatgaggaggaagagtgatcatatgattcagctctattttttggtagaacctaatcttgcagtcacctgttagaacctgattttgttacatgcctctgaacaaaggttggtcactgtgggtgtctagaattgctcttttcagttctng

SEQ ID NO: 2587 - DNA, 816 bp, Lolium multiflorum
cctgacgacccatcctgcggcggcgccggcgtacgagaccggcgttgaggaggggaggcaccgtcagccatggtgcacgtcaacttctaccgcaactacggtaagactttcaagaagccaaggcgtccttatgagaaggagcgtcttgatgctgagctgaaactggtgggggagtatggcctcagatgcaagcgtgagctgtggcgtgtgcaatatgcccttagccggatccgcaacgctgcaagggagctgctcaccctggatgagaagaacccccgtcgtatctttgaaggcgcggctctcctgcgtcgcatgaaccgctatggtctcctttctgaggaccagaacaagcttgattacgtgcttgcgctcactgtcgagaacttccttcagcgccgcctccagaccattgtcttcaagaacggcatggcaaaatccatccatcatgctcgtgtgctcatcagacaacgccacatcagagttgggaggcagcttgtcaacattccgtcgttcatggtgagagttgacactgagaagcacgtcgacttctccctgaccagcccacttggtggtggtgagcctggaagggtcaagaggaagaaccaaaagaaggctgcaggtggtggcggtggtgatggtgatgaggaagaagagtgatcaaatgattcagctctgtttttttggtagaacctaatttgctgtcacctggtagaacctgattttgttaaatgcctctgaacaaaggttggtcaccgtgggtgtctagaattgctctttccagttctcgaatccatcattgcaaagatttggtttgat

SEQ ID NO: 2588 - DNA, 871 bp, Avena sativa
gctccattacctccccgacctcactactcatcttgcggcggcgccggcgtccgcgaccggcgttgagaggcgggggcatcgtcaaccatggtgcacgtcaacttctaccgcaactacggtaagactttcaagaaaccaaggcgtccatatgagaaggagcgtcttgatgctgaactgaaactggtgggtgagtatggcctgaggtgcaagcgtgagctgtggcgtgtgcaatatgcccttagccgcatccgtaatgctgcaagggagctgctcacccttgatgagaagaacccccgccgtatctttgagggcgcggctctcctgcgacgcatgaaccgctatggtctcctttctgaggaccagaacaagcttgattacgtgcttgcactcactgttgagaacttccttcagcgccgcctccagaccattgtcttcaagaatggcatggcaaaatccatccatcatgctcgtgttctcatcaggcaacgccacatcagagttgggaggcagcttgtcaacattccgtcgttcatggtgagagtcgacactgagaagcacgtggacttctccctcactagcccacttggtggtggtgagcctggaagggtcaagaggaagaaccagaagaaggctgcaggtggcggcggtggtgatggtgatgaggaggaagagtgaacatgtgattcagctctgttttttggtagaacctaattatgatgtctcctgttagaacctgattttgttacatgtctttggacaaaaggttggccaccgtgggtgtctagagtttgctctttccagttcttcaatccatcattgcaaagatttcgtttgatacttgtttgttcatccgatgagctaattgacatgt

SEQ ID NO: 2589 - DNA, 854 bp, Cirsium arvense
atttagggctattttattatcctatatagcctaagaactaaatcaggcgtatttttctctctagttcggcttcattttgcttttctctcgaaggcagccatggttcacgtcaatttctaccgcaattatggaaaaactttcaagaagcctcgccgtccgtatgagaaggagcgtttggatgctgagttgaagctcgtaggagagtatgggcttcgttgtaaaagagagctatggagggttcagtacgcattgagtcgcattcgtaatgctgcacgtatgcttctcactcttgacgagaaagacccacgtcgaatctttgaaggtgaagcccttcttcgcaggatgaatagatacgggcttttggatgagagccaaaacaagctcgattatgtcttggctttgactgttgagaactttcttgaacgtcggcttcaaacacttgtattcaaaactggaatggcaaagtcaattcatcatgctcgtgtgctgattaggcagaggcatatcagggttgggaggcaagtggttaatgttgcatcattcatggtgagggttgactctcagaaacacattgacttctcgctcactagtccgtttggaggtggccgtcctggaagagtgaaacgaaagaaccaaaaagccgctgctaaaaaggcttccggtggaggtggagatggagacgaagaggacgaagattgagccaatctttatcgtaagtcttttacatttgtacttttcacttttttcgatcaatgttgttagttgttacttaacagtaaacaccgaccttttatgatttagtttttcttatagtatttgttgtttgtggaactctaagtgtctatttatacaac

SEQ ID NO: 2590 - DNA, 840 bp, Flaveria ramosissima
gcagcgcagagggtggccgccggaggcagaagagattaatcaagtagccgccggagtatcgacgtcgaacaacaatggttcacgtctccttctaccgcaactatggtaagacttttaagaagccgcgtcgtccttatgagaaggaacgattggatgctgagttgaagcttgttggtgagtacggtcttcgatgcaaaagggagctttggagggtgcaatatgctttgagccgcattcgtaatgcagcaagaatgcttttgacccttgaggagaaggacccacgtcgtatctttgaaggtgaggctcttatgaggagaatgaacaggtacggactgttggatgagagtcagaacaagctcgattatgtgttggccctcactgtggagaactttctcgaacgccgtctccagacgcttgtgttcaaaactggtatggctaagtcgatccaccatgctagagttcttatcaagcagagacacatcagggttggaaggcaggttgtgaatgtgccttctttcatggtgagagtggactcacagaagcacattgacttctcactcacgagtccatttggaggtggccgaccaggaagagtgaagcgaaagaaccagaaggcagctgcaaagaaggctgctggtggagatgctgatgaggatgaagaagaatgagctcactcttttggctcttagtcttaatatcttttgcactggtgacgtgtacgagtaattgttatcatccataattactgttggtaggaagttttggatgctttgtcatgtgtctgttgctttttatgtcttttcatggatttagttaatgacaagtttatgctttggattg

SEQ ID NO: 2591 - DNA, 895 bp, Tabernaemontana elegans
aaactgcccagacgacgggtttctgcttcgtcttcctcggtttactgacggcgagcaaccctacgttaggcagtcatggtgcacgtcagtttctatcgcaactatgggaagactttcaaaaagcctcgccggccatatgagaaggaacgattggatgcagagttgaagcttgttggagagtatgggctccgctgcaagagggaactctggagggtgcagtatgcacttagccgaattcgtaataatgcaagaatgcttctcactcttgatgagaaagaccctcgtcgtatttttgagggtgaagcccttcttcgtaggatgaacagatatgggcttttggatgaaggtcagaacaagcttgattatgtgttagctctgactgtcgagaacttccttgaacgtcgccttcaaacacttgtattcaagactggaatggccaaatcaattcaccatgcccgtgtactcattagacagaggcatatcagggttggaaggcaggtggtgaatgtgccatccttcttggtgagggttgactctcagaaacacattgacttttcacttacaagtccatttggtggtggccgtcctggaagagtcaagcgaaggaaccagaaggctgctgcaaagaaagctgctggtggtggtgatggagatgaagaggatgaggagtgagcagttcatgtttaatatatgctttgtaactctcagctatcttatgtgactgctagttaaaattttgttatgatagatgtgctacttttgcttgtttgaagatacggatagttattttggttgtgatgtttgaggataataatttagatttgcttctagttgtcatgtcagctgcacatcttgttccctttattttgatatttaatattgctttgttaaagca

SEQ ID NO: 2592 - DNA, 1126 bp, Triphysaria pusilla
tactacaacactgctaacaagatacctagaggcaaatgcggatattgcaaaggagaactgcacagttttaccgaagatataatcatcaaatccacatgagaaaatgaccaggctcataactgggcttgtctgaataaaatgagttttgatcgtggctgtggttttgtaataacttaatggacagtttttcttgctcgtaaccaatattctcccgatttgactaataattaacttgtacctgcccgggcgaccgcccgggcaggtgcaaaaccagatcggcggattgagtgagtgacgatcgctttgacggcggcggagaaaaatcatggtgcacgtctcgttttaccgcaactatggaaaaacgtttaagaagcctcgtcgtccctacgagaaggagcggcttgatgctgagctaaagctcgttggagaatatggtcttaggtgcaaaagggagctctggagggttcagtttgcactgagccgtatcaggaacaatgcaagggatcttttgacccttgatgagaaggatccacgtcgtattttcgagggtgaagcccttttgaggaggatgaataggtatgggctgctggacgagagccagaacaagctcgattatgttttggcactaactgttgagaactttctggaacgtcgcctacaaactcttgtgttcaaggcgggtatggctaagtccattcaccatgccagagtgctcattaggcaaaggcatatcagggttgggaggcaagttgtgaatgtgccatctttcatggtgagggttgactcgcagaagcatattgatttctcactcaccagcccgttcggcggtggcaggcccggtagagtgaagcgaaagaaccagaaggcagctgcaaagaaggcttcgggtggcggtgatggagatgaggatgatgaagagtaagtggcttcagctgcaaagaaggcttcaggtagtgtaatagatttttattaagttattgttatttgtactttcgaaaagcagtgttttgagttcatctttgctgcttgtgtagtgtttagactgttattgttatctgtggtttttttgttgaagatgtcatgatttaggataatgaaactcttaaaagattttgcttattattat

SEQ ID NO: 2593 - DNA, 1096 bp, Beta vulgaris
ttttgcacttgccgcctccgcaacttcacccactacaattttaagctcgccgacggtgagcaaccatggtccacgtctgttactatcgcaactatgggaagacgtttaagaagccacgtcgtccttatgagaaggagcgattagatgctgagttgaagctagtaggcgagtacggtcttcgtaacaagagggaattgtggagggttcagtatgtattgagtcgtattcgtaatgctgcaaggcatcttcttactttggatgagaagaaccctcgtcgtatctttgaaggggaagctcttttgaggagaatgaacaagcacgggcttttggatgaaggccagaacaagctcgattacgtgttggcattgactgttgagaactttttggagaggcgtcttcagacactcgtcttcaagtctggtatggccaagtctattcaccatgctagagtgctcatcaggcagaggcatattagggttgggagacaggttgtgaatgttccttctttcatggtgagggtggactcccaaaagcacattgacttctctctcaccagtcccttcggaggaggccgccctggtagagtgaagcgaaagaaccagaaggcagcagcaaagaaggcagctggtggagatggtgatgatgaagatgaggagtgagctatactaccaggcccttgtaggcgtaggcttgatgagatatttgttagtacctctaccgaatcttgaaatatggccctattctcttaagagatcaaccaattttcttgtttcagttgattggtttttggttcctcttatatcttaggaagttttgagtgcttgcttttgttatgtgttcaatctttagaatatgacaatatgttcaccgtatgttactgtattgtgttcttacggattcaatagagattatttacctttgtttacaaggctttccataactcttgtggcattatttcaatcatattttgtcgtgccgctacaattcgagtgatcagaagaattgtactagcttgcctgtatcactcttattcagaaggcctagctagaatggtgttatatgtatgcagtcttttactcgatgtcttagatggttc

SEQ ID NO: 2594 - DNA, 840 bp, Vaccinium corymbosum
cgctccgcggcaaaggagccatggtgcacgtcaacttctaccgaaactatgggaagacatttaagaaaccccgtcgtccctatgagaaggaacgattggatgctgagctgaagcttgtgggtgagtacgggcttcggtgcaagagagaactgtggagggttcagtatgctctgagccgtatccgtaatgccgcaaggatgcttcttacactagatgagaagaatcagcgtcgtatctttgagggtgaagctcttctcagaaggatgaaccgctatgggcttttgaatgagaatcagaataagcttgattacgtcttggccttgacagtggagaactttcttgagcgccgtctccagacacttgtgttcaaggctggtatggcaaagtctatccatcatgccagggtgctcatcagacaaaggcatatcagagttggaaggcaggtggtgaacgtaccgtctttcatggtgagactagactctcagaagcacattgatttctcgctcacaagtccattgggaggtggacgccctggtagggtgaagcgaaagaaccagaaggcagcggccaagaaggcctcgggtggcgatggagatgaagaggacgaggaataagtgctcatatggaatgccattagcagtaataatagggttcgtttcttatccgggtgttagataccatccctgctttaggataagctcaatcactggactgcagtaatgttctggtttctggaccttcgaaactggtttttggatttggatcaagttttgcttgcattttatttgtatgtgatgacagagtgttttgccaaatttttctttgagaaaaggggtttgt

SEQ ID NO: 2595 - DNA, 905 bp, Vaccinium corymbosum
gcaaaggagccatggtgcacgtcaacttctaccgaaactatgggaagacatttaagaaaccccgtcgtccctatgagaaggaacgattggatgctgagctgaagcttgtgggtgagtacgggcttcggtgcaagagagaactgtggagggttcagtatgctctgagccgtatccgtaatgctgcaaggatgcttcttacactagatgagaagaatcagcgtcgtatctttgagggtgaagctcttctcagaaggatgaaccgctatgggcttttgaatgagaatcagaataagctcgattacgtcttggccttgacagtggagaactttcttgagcgccgtctccagacacttgtgttcaaggctggtatggcaaagtctatccatcatgccagggtgctcatcagacagaggcatatcagagttggaaggcaggtggtgaacgtaccgtctttcatggtgagactagactctcagaagcacattgatttctcgctcacaagtccattgggaggtggacgccccggtagggtgaagcgaaagaaccagaaggcagcagccaagaaggcctcgggtggcgatggagatgaagaggatgaagaataagtgctcatatggaacgccattagcagtaataatagggtttgtttctcatccgggtgtcagataccatccctgctttaggatagctcaatcactggactgcagtaatgttctggtttctggaccttcgaaactggtttttggatttggatgaagttttgcttgcattttgtttgcatgcgaggacagtattttgccaaatttttctttgagaaaaggggtttgttcaatgagcaactttattgttatgatttttctttgtttggcgaattgatctttgctaggaatatcgtttgcttattc

SEQ ID NO: 2596 - DNA, 1336 bp, Gossypium raimondii
ccaaaatggaagaggatggaaacattagggtttagggtttccctagtatataatgatctcgcttcgcctcctttcccttccttacctcggcttcttcccttccttctatctttattttctcgcctgtgacgagaagccgacgctaccatggttcacgtcagtttctaccgcaactatgggaagacctttaagaagccacgacgtccgtatgagaaggaacgattggatgctgagttgaggcttgtaggagagtatgggctccgatgtaagagggagctgtggagggttcagtatgctttgagccgcatccgtaatgctgctagggaccttctcactcttgatgagaagaaccctcgtcgtatttttgaaggtgaagcccttcttcgtaggatgaacagatatggacttttggatgagagccagaacaagctcgattatgtgttggctttgactgttgaaaacttccttgaacgtcgtttgcaaacgctcgtgttcaagactggtatggccaagtcaattcaccatgcacgtgtgttgatcaggcaacgacacataagggtcgggagacaggttgtgaacatcccgtccttcatggtgagggtcgactcccaaaagcatattgatttctctcttactagtccgtttggaggtggccgccccggaagagtgaagagaaagaaccagagagcagctgccaagaaggctgctggtggagatggtgatgaagatgatgaagagtaaaccttaggctactatcaaccaccagtaggaaccctttaaaagcctttgtttggaacatacaatatcctccattggtagacatggttttgagttttgtttccagaactttgttgtagtggatcttgatatatgttttgcatttactattgctgttttggtcggatttgaagttaattaagtgtgctgttttaagattaaaaaaaaaaaaatctttattattgtgttctctatactagcaagctccaccattttgattgataatagatatgtattttgtataatcaacatgcagaagatatatttaataaatacaaaagaaaaattaacataataaatataagatgtcatagctaacatcaaatccctttcctctccacctgtgtctcttccaaaataaattaaagcgaaaactgttcttttccagctgctgcttaaaggcatctctctcctttcttctctttgttgcgtccttaagtctttaccatctcccttttcccctctcattgttgggaccataggcaggcagcagtccgacggctcttcttattgttgatcactcccgtctcatttgcttcattgtttcatcttttcattt

SEQ ID NO: 2597 - DNA, 1002 bp, Gossypium raimondii
gggaaattttagggttttgggtttccgtaatataaattatcacgcttcggctcttctttctttttaacttcggcttcttccttttgcacccaccctgtttctatctcggctctgacgagaagccggcgccgacatggttcacgtcagtttctaccgcaactatgggaagacctttaagaagcctaggcgtccttatgaaaaggaacgattggatgcagagttgagacttgtaggagagtatggactccgatgtaagagggagttgtggagggttcagtatgctttgagccgtatccgtaatgctgctagggatcttctcactcttgatgagaagaaccctcggcgtatttttgaaggtgaagcacttcttcgtaggatgaataggtatggacttttggatgagagccaaaacaagcttgattacgtcttggctttgactgttgagaactttcttgagcgtcgtttgcaaacactagtattcaagactgggatggccaagtcgattcaccatgctcgtgtgttgattaggcaaaggcacattagggttggtaggcaagtggtcaacatcccatctttcatggtgagggttgactctcaaaaacatattgacttctctctcacaagtcccttcggaggtggccgccctggaagagtgaagagaaagaaccagagagcagctgccaagaaggctgctgggggagatggcgatgatgaggaagatgagtaaacgttaaggccattaccctgcaactaggaacccttgaaagcatatgtttgaaactttgccatcacctccattgttagacatggtttgagttttgtttccagatctctactgtagcggatattggtatatgtcttgcatttagtaatctgtgtttttttatccctgatttaaagctatttaagtaattatgctgtttaaggattgaagtattttaatggatgacgtattctattaaacctaaaaccttatttaagggccagactgtgcttttgtgt

SEQ ID NO: 2598 - DNA, 663 bp, Acacia harpophylla
agccatggttcacgtttcattctaccgcaactatgggaaaaccttcaagaagcctcgtcgtccgtatgagaaggagcgtttggatgctgagttgaagcttgtgggagagtatggacttcgctgcaaaagagagctgtggagagttcagtacgctctgagtcgtatccgtaataacgcaagggagcttttgacccttgatgagaagaacccacgtcggatcttcgagggtgaagctcttctgcgtaggatgtttcgatatgggcttttagatgagagtcagaacaagctcgattacgtgttggctttgaccgtggagaacttccttgagcgtcgtctccaaacacttgtgttcaaatcagggatggccaagtcaattcatcatgctagggtcctcattaggcagaggcatatcagggttgggagacaggttgtgaacatcccatcattcatggtgcgagttgattcccagaagcacattgacttctcacttacaagtccgtttggaggtgggcgtcctggaagagtgaagagaaagaatcaaagggctgctgccaagaaggctgctggtggagatggagatgaggaggatgaggagtaaattatggatttatctttttgtaatactcttaaatcttgtttcagatttttgccggtagtattttt

SEQ ID NO: 2599 - DNA, 911 bp, Amsonia hubrichtii
aaatggtgcacgtctcgttttatcgcaactatggtaagaccttcaagaagcctcgtcgtccctatgaaaaggagcgtttggatgctgaactgaagcttgtgggagaatatgggctccgctgcaagcgggagctttggagggttcaatatgtgttgagccgtatcagaaatgcagcaaggaatctattgactctggatgagaaggacccacgccgtatttttgagggtgaagccctcttgaggaggatgaacaggtacggtctcctggacgagagtcagaacaagcttgattatgtcctggctttgactgtggagaactttcttgagcgccgccttcaaactcttgtttttaagactgggatggccaagtcaatccaccatgccagagtgctcattaggcaaaggcatatcagggttggaaggcaggttgtgaatgttccttcctttatggttagagtggactctcagaagcatattgacttctcacttacaagtccttttggtggtgggcgacctggtagagtgaagagaaagaacatgaaggcagctgcaaagaaggctgcaggtggtgacggagaagaagaggacgaagaataagtgctctgtttcagtttagtctttacttgtaatactggaggatgtcggtcggaccttgtctcttttatgtgtgtaataccggccccttaaatttttgcagttcttttcaagacttcaatatattaggaagtttcggatgacatttgtggctttcttgacatcatttttaccagagtttgtctccttttaacctttcaatgttccaatttcttagggttaaacttggcaaattgagttattttgcacatttgttgagggaatgatttgacatcagtaaaaaattctgccccatttgctgttttctttaaaaaaaaa

SEQ ID NO: 2600 - DNA, 1352 bp, Aristolochia fimbriata
acagtgtattcgctggaacaaagcatcggtgctatttaagaaacccgcgtagaagcggcctaatctcatatcgcattcgttgggccaaagactggtaaatcttgttgcagcccaacctcgttagggttttggcacctataaattcgtttctgaacgggatcggccgctcaccgctcttggttttaagcgtagggtttttagagggggcggagaaagacggggatcgtgtagaagatggttcacgttagcttctaccggaactatgggaagacatttaagaagcctcgtcgtccttatgagaaggagcgtcttgatgctgaacttaagcttgttggtgagtatggtctaagatgtaaaagggaactctggagggttcagtatgctttgagccgcatcagaaatgcagctagggaacttttgactcttgatgagaaaaaccctcgtagaatctttgaaggagaggcccttcttcgtaggatgaaccgatatgggctcttggatgaaagccagaacaagcttgattatgtcctcgccctgactgttgagaactttctggagcgtcgtctgcagactcttgtgttcaaggctggaatggctaagtcgatccatcatgctcgtgtgcttatcaggcaaaggcacatcagagtcgggaggcaagtggttaacattccctccttccttgtgagggtcgattcccaaaaacatatcgacttctcattgacaagtccccttgggggtggtcgccctggaagagtgaagcgaaagaaccagaaggctgctgcaaagaaagctgctggcggagatggagatgaggaggatgaagattaagcggatactgcctgagatgttttttcggcattttgtctttttattttatatctacatagtaacaacttgatacttaaatttgcctagtttaaaggtgtcggtttttcttgtacttttatcatccctctttgtgagaggtgacggatattttgccatttgttttaaatgaatgcttgcaaatttgtcttcggttcttgaatggctaagggattgcttagaactggtttttactgttcaactagtttttgctaggttatatttttgtcctgtagcgatgttgtttgtctagtgtgtcgttctttaagaaaactgtagtttgtcgagcattttttatttctgcgacttcatattctttcgattttcttaatcgactaagcccgcctcataccatctctgtttccatgtcagctgctgcatcaactatttcctaatacccttcattattcaacataagttcggacctccacttagttcccacaaagcttcatccttccttgtccttgttataggttcggtaagcagtg

SEQ ID NO: 2601 - DNA, 1090 bp, Fagus grandifolia
ctctccctccctcttcacacagcaccgctctgatccgaagccatggtgcacgtcagtttctaccgcaactatggtaagactttcaagaagccgcgtcgtccatatgagaaggagcgattggaccacgagttgaggcttgtgggagaatatgggctccgatgtaagagggagttgtggagggttcaatatgctttgagccgtatccgtaatgctgccagggagcttcttactctggatgagaagaatcctcgtcgtatctttgagggtgaggctcttttgcgaaggatgaacaggtatgggcttttggatgagagccagaacaagcttgattatgtccttgctctgactgtggagaacttccttgagcgccgtctccaaacccttgtgttcaagtcgggtatggccaagtcaattcaccatgctcgtgtgcttattaggcagaggcatatcagggttgggcgacaggtggttaacataccatctttcatggtgagagttgattctcagaagcatattgatttctctctcactagtcccttcggaggtggacgtcctggaagagtgaagcgaaagaaccagaaggcagctgccaagaaggcttctggtggggatggagatgaagaggatgaagaatgaagcttaggctagctccaaccctaggaactattgagtttttttttccttgtctcgcgtctttgtttcacttgttttattacctgacatttgttttcaaatctttattgtagtggatgttagtacatgtttcattttggtttatttggaatagaactcgaaagcactcctatggatcacccaaggttttgtttaagtaatgaaaattttggctgctgatgcctatatctgtttttgttggaaattgttgatccatatttgtttaaatgttgctgcatttcggcctttgcttgtttacgtttccagcaatatcgtttatgctttgagatgatgtgaggttctgttgcaattattgcatatgttagacgtgaatagttgattgttattattgttatacttatcatgaagaatgctctaccaataggatcgacctctaaccgagggtctgttattttcg

SEQ ID NO: 2602 - DNA, 1473 bp, Theobroma cacao
atgtataatgataatcataaaagaattgtttttgtttttaagttaatttgataaaaaaatcaaataagaaaaacaaattaggacccaaaaaatgtaacattgggaagtcgaaggaaacccacctgagatacggatactaagattgggctttggacttcatttaggtttgtttttgggctaggcctaaagaaaaatgactctcaattcaaaaaaaatcggcgtgtttggcaacagcaagttttgagtttccaggattagggttttgcatttttagggttgccttataagctcgccattgcctcatttgctgccttacttggccgacgacagcacctgagccagtgttgaagagacaaggcgcctccgcgcaacaaccatggttcacgtctccttttaccgcaactatgggaagacatttaagaagcctcgtcgtccttatgaaaaggagcgattggatgctgagctgaggctagtgggagagtacgggctgcgatgcaagagggaactctggagagttcagtatgctctaagccgcattcgaaatgctgcaagagaccttctgacccttgatgagaagaacccacgtcggatctttgagggtgaggctcttcttcgcaggatgaaccgatatgggcttttggatgagagccagaacaagcttgattatgtcttggccttgactgtggagaacttccttgagcggcgccttcaaactcttgtgttcaaggctggaatggctaagtctatccaccatgcccgagtgcttatcaggcagaggcatgttagggttggcaggcaggtagtcaacattccttcttttatggtgagggttgattcacaaaagcacattgatttctctctcactagtccatttggtggtgggcgtcctggaagagtaaagagaaggaatcagagggcagctgccaagaaggctgctggtggagatggagatgaagaagatgaagaatgagtaatggggtttgatctttttgcggatagttatagtaggactatctcatcaaagctagttttacatgacttgaaaagtgatgtcttggtgtttatttggatgaaattttgattgctatattttggacatcgtgttttactgaattttgttttagcttccaagataatgtttttccgtttttttcttacttgcatacagattatccttccctagcttgaagaatatgaatatggtgttaaattgtagtttctctccaagtggggcaaatattagttttagagctagggaattttccaagatgaaaatgttatttatcagccaattgagatttccccaaactgagtatgatgcagtagcagggaggcatatgatgttgtacgttgagttgtgaattgatgatgactctgtttacctagcttatcgattttgggattgaagtagccaaagtatacagttgcaattctgtatcacaaaatgtcaaaaaataaaaattcccatggctg

SEQ ID NO: 2603 - DNA, 1187 bp, Ricinus communis
agggtttgtttgtataaatgacagattgttgaattcgcttctccgtttcgtcttcctctggtgtttcgcaaaggagtgagccatggttcacgtcaatttctaccgaaactatgggaagacttttaagaagccccgtcggccatatgagaaggagcgtttggacgctgagctgaagcttgttggagagtatgggctccgatgtaagagggagttgtggagggttcaatatgctctgagccgcatccgtaatgcagcaagaatgcttctcactcttgatgagaaaaacccccgccgtatttttgaaggtgaagcccttctccgtaggatgaaccggtatggtcttttggatgagagccagaacaagctcgattatgtccttgccctgacagtagagaacttccttgagcgtcggctccaaacccttgtgttcaaatctggaatggcaaagtccatccaccatgctcgtgtgcttatcaggcaaaggcatatcagggttgggaggcaagttgttaatataccatctttcatggtgagggtggactcccagaaacacattgatttctctcttacaagtccattcggaggtggccgtcctggacgagtaaagagaaagaaccaaagggctgctagcaagaagagtggcggtgacggagatgaggaggaggaggattaagtattagactagggagtgtaggaccaactctaagaattcttgaggtattttgtttgtgcgttttttcccatcttcagaactagtgttttccattttcgaatttttggggttttattttttcgaatattggtgatttattcgagtttgaaaaaacaaacatttatccatatcataaatggtcagatatttggttcgtgaatttagtttgaagttgatgtgtctgtagaagaatgaaagtccccatagatccaattctttcctgtcaaagaagactatttgacatggtgtgaaggagtccaatcttttgtttcattgttgaactgtctctaccatgcaagaaccacatgttcaattatgtaagctctgatctgttggttcactagggttctagagcatgtctcactttggactttgtcatagcataccctgtcggctgaatgcattatttcacctcagtacttttcatatttgccgacagacattcttatatggcacatttatgttctttatagaa

SEQ ID NO: 2604 - DNA, 1229 bp, Ricinus communis
agggttttagggttaccttcctttataaactctcattttgaagactggaaaaacctagtgtaacacgcagagagagagagcaaaatctctgtgtagagaaaacggccccgttttagcagagccatggtgcacgtctccttctatcgcaactatggaaagacatttaagaagccccgtcgtccatatgagaaggagcgattggatgcagagctgaagctggtgggagagtatggtctgcgttgcaagagagagctttggagggttcagtatgctttgagtcgtatccgtaatgctgctagaatgcttttgactcttgatgagaagaacccacgccggatctttgagggtgaggcccttcttcgaagaatgaaccgctatggccttctcgaagagagccagaacaagcttgattatgtgttggccttgactgtggagaactttcttgagcgccgcctgcagacacttgtattcaagtctggtatggcaaagtccatccaccatgctagagtccttatcagacagaggcatatcagggtgggaaggcaggtggtgaacatcccatctttcatggtgaggattgattcacagaagcacattgacttctcattgacaagtccattcggtggtgggcgtcctggaagagtgaagagaaggaaccagagggcagctagcaagaaggcttctggtggagatggagatgaagaggatgaagagtgagccatgagttgaagaaaacaaaaaaactgttgctagtagaactcctgctgttgtctcatctagttttgttgtcaccctttctgaggctaggtttcttaaaaaaattactgcagtaatgttttgttttctgaacattgatattgtgtttgttttatgatgcatttgtgtatctatgactttttgctgaggatataatttttgctccaaatggcaacacaactggttaaatattatcttttaccccggatgttttcttgagtagatctttccttggatgtaacaaaccaagccggtgtgcgtgcatgagacggtcttctttaggcctgaacaacccatcattatcctagttggccacggtgattgcttcattagtcttttcatgttagaaactggagttgtaagaagggattttggcttaagcttaattttttctgtaactaatcggattaaaaactctttatgtattacggtattaccagtttaataattaatgagcgggagtaagaattgta

SEQ ID NO: 2605 - DNA, 834 bp, Cleome gynandra
ctcctctgtgcgatcttctcctctccgattcgcagccatggtgaacgtgagcttctaccggaactatgggaagaccttcaagaagccacgccgtccctatgagaaggaacgtctggatgctgagttgaagctcgttggagaatacggactccgctgcaagagagagttgtggagggtacagtatgcccttagccgcatccgaaatgctgctagagatcttctcactcttgatgagaagaaccctcgccggatatttgaaggtgaagctcttcttcgtaggatgaacaagtacgggcttcttgatgaaagccagaacaagctcgattatgtcttggctttgactgtcgagaacttcttggaacgtcgtcttcagaccctcgtctttaaatctggtatggctaagtcaatccatcatgctcgtgtcctcatcaggcaaaggcacatcagggttgggaggcaagtcgtgaacattccatcgttcatggtgagagtcgattcacagaagcacatcgacttttcactgaccagtccattcggtggagggcgtcctggaagagtgaagagaaggaacgagaaggcaggtgcgaagaaggctggaggtgacggtgacgacgaagatgaagagtgaagcctgaaaatggactgaaactgtccaaaaatgccttagttttggtcgtgttgctgaacttaatttgatatgtttctcagtaagttttggtagtggaccattgttttcttctacctttggttactttggaccttcctacaaaacaaaagttagttgctttgttcctcttaatgggttgatctaagatttgttacaccaaaaaaaaa

SEQ ID NO: 2606 - DNA, 1404 bp, Gossypium hirsutum
gccttctacagccgctggttatgtgggttaggattcgtaagcgctttcgcagaatacatggggacctcggcttcttccatccttctatctttattttctcgcctgtgacgagaagccgacgctaccatggttcacgtcagtttctaccgcaactatgggaagacctttaagaagccacgacgtccgtatgagaaggaacgattggatgctgagttgaggcttgtaggagagtatgggctccgatgtaagagggagctgtggagggttcagtatgctttgagccgcatccgtaatgctgctagggaccttctcactcttgatgagaagaaccctcgtcgtatttttgaaggtgaagcccttcttcgtaggatgaacagatatggacttttggatgagagccagaacaagctcgattatgtgttggctttgactgttgaaaacttccttgaacgtcgtttgcaaacgctcgtgttcaagactggtatggccaagtcaattcaccatgcacgtgtgttgatcaggcaacgacacataagggtcgggagacaggttgtgaacatcccgtccttcatggtgagggtcgactcccaaaagcatattgatttctctcttactagtccgtttggaggtggccgccccggaagagtgaagagaaagaaccagagagcagctgccaagaaggctgctggtggagatggtgatgaagatgatgaagagtaaaccttaggctactatcaaccaccagtaggaaccctttaaaagcctttgtttggaacatacaatatcctccattggtagacatggttttgagttttgtttccagaactttgttgtagtggatcttgatatatgttttgcatttactattgctgttttggtcggatttgaagttaattaagtgtgctgttttaagattaaaaaaaaaaacatctttattattgtgatctctatactagcaagctccaccattttgattgataatagatatgtattttgtataatcaacatgcagaagatatatttaataaatacaaaaaaaaaattaacataataaatataagatgtcatagctaacatcaaatccctttcctctccacccgtgtctcttccaaaataaattaaagcgaaaactgttcttttccagctgctgcttaaaggcatctctctcctttcttctctttgttgcgtccttaagtctttaccatctcccttttcccttctcattgttgggaccataggcaggcagcagtccgacggctcttctcattgttgatcactcctttctcatttgcttcattgtttcatctttccatttttccatttctccatttcggatatctcttcaacctctagtctattaaattttaaattaggtgtagggtttggccgttggcttctcccatt

SEQ ID NO: 2607 - DNA, 889 bp, Gossypium hirsutum
acctcggcttcttcccttccttgtatctttattttctcgcctttgacgaggagccgacgctaccatggttcacgtcagtttctaccgcaactatgggaagacctttaagaagccacgacgtccgtatgagaaggaacgattggatgctgagttgaggcttgtaggagagtatgggctccgatgcaagagggagctgtggagggttcagtatgctttgagccgcatccgtaatgctgctagggaccttctcactcttgatgagaagaaccctcgtcgtatttttgaaggtgaagcccttcttcgtaggatgaacaggtatggacttttggatgagagccagaacaagcttgattatgtcttggctttgactgttgaaaacttccttgagcgtcgtttgcaaactctcgtgttcaagactggtatggccaagtcaattcaccatgcacgtgtgttgatcaggcaacgacacataagggtcgggaggcaggttgtgaacatcccgtccttcatggtgagggtcgactcccaaaagcatattgatttctctcttactagtccgtttggaggtggccgccctggaagagtgaagagaaagaaccagagagcagctgccaagaaggctgctggtggagatggtgatgaagatgatgaagagtaaaccttaggctactatcaaccaccactaggaaccctttaaaagcctttgtttggaacttacaatatcctccattggtagacatggttttgagttttgtttccagaactttgttgtagtggatcttgatatatgttttgcatttactattgctgttttggtcggatttgaagttaattaagtgtgctgttttaagattaaaaaaaaaacatctttattattgtgttctctatg

SEQ ID NO: 2608 - DNA, 912 bp, Gossypium hirsutum
ccgtaatataaaagatcacgcttcgcctcttctttctttttaacttcggcttcttccttttgcacccaccctgtttctatctcggctctgacgagaagccggcgccgacatggttcacgtcagtttctaccgcaactatgggaagacctttaagaagcctaggcgtccttatgaaaaggaacgattggatgcagagttgagacttgtaggagagtatggactccgatgtaagagggagttgtggagggttcagtatgctttgagccgtatccgtaatgctgctagggatcttctcactcttgatgagaagaaccctcggcgtatttttgaaggtgaagcacttcttcgtaggatgaataggtatggacttttggatgagagccaaaacaagcttgattacgtcttggctttgactgttgagaactttcttgagcgtcgtttgcaaacactagtattcaagactgggatggccaagtcgattcaccatgctcgtgtgttgattaggcaaaggcacattagggttggtaggcaagtggtcaacatcccatctttcatggtgagggttgactctcaaaaacatattgacttctctctcacaagtcccttcggaggtggccgccctggaagagtgaagagaaagaaccagagagcagctgccaagaaggctgctgggggagatggcgatgatgaggaagatgagtaaacgttaaggccattaccctgcaactaggaacccttgaaagcatatgtttgaaactttgccatcacctccattgttagacatggtttgagttttgtttccagatctctactgtagcggatattggtatatgtcttgcatttagtaatctgtgtttttttatccctgatttaaagctatttaagtaattatgctgtttaaggattgaagta

SEQ ID NO: 2609 - DNA, 926 bp, Gossypium hirsutum
ttccgtaatataattatcacgcttcggctcttctttcttttaacttcggcttcttccttttgcacccgctctgtttctatctcggctctgacgagaagccggcgccgacatggttcacgtcagcttctaccgcaattatgggaagacctttaagaagcctaggcgtccatatgaaaaggaacgattggatgcagagttgagacttgtaggagagtatggactccgatgtaagagggagttgtggagagttcagtatgctttgagccgtatccgtaatgctgctagggatcttctcactcttgatgagaagaaccctcggcgtatttttgaaggtgaagcacttcttcgtaggatgaataggtatggacttttggatgagagccaaaacaagcttgattacgtcttggctttgactgtcgagaactttcttgagcgtcgtttgcaaacactagtattcaagactgggatggccaagtcgattcaccatgctcgtgtgttgattaggcaaaggcacattagggttggtaggcaagtggtcaacatcccatctttcatggtgagggttgactctcaaaaacatattgacttctctctcacaagccccttcggaggtggccgccctggaagagtgaagagaaagaaccagagagcagctgccaagaaggctgctgggggagatggtgatgacgaggaagacgagtagatgttaaggccattaccctgcaactaggaacccttgaaagcgtatgtttggaactttgccatcacctccattgttagacatggtttgagttttgtttccagatctctactgtagcggatattggtatatgtcttgctttagtaatctgtgttttttaaccctgatttaaagctatttaagtaattatgctgttaaaggattgaaatattttaatggatgacgt

SEQ ID NO: 2610 - DNA, 1052 bp, Flaveria ramosissima
ccgctttcctttaaagcgagttatcttaaccatgtagcccactaaaacatcacattttgttttgaaaaacagcccaacaaaagtagacccaatgggcctcatgaatgaactgattcatagacccatgaaaaccctaattgtatctcttcgctgttgcagcttcattcagacacctaaaccctaattatcagctaaggaagcagctgaggaagagcagcacgcgatagctgcattgacggtttgatatcgttcaacgatggttcatgtgtcattttaccgaaactatgggaagacttttaagaagcctcgacgtccatatgaaaaggagcgtttggacgcagagttgaagcttgttggagaatatggtcttcgatgcaagagggaactctggagggtgcagtatgcacttagccgaattagaaatgctgcaagaatgcttttgactcttgaagagaaggacccacgtaggatttttgagggtgaagcacttatgagaagaatgaatcgttatgggcttttggatgagagtcaaaataagcttgattatgtgctggctcttactgttgagaactttctagaacgtcgtttgcagacactggtcttcaagaccggcatggctaagtctatccatcatgctagagtccttatcaagcagaggcacatcagggtcgggagacaagtggtgaatgtaccatcattcatggtgagggttgactctcagaaacacattgacttttctctcactagtccatttggcggtggccgacctggcagagtgaagcgaaagaaccagaaagccgctgcaaagaaggcggcaggtggtgatgccgacgaagaggatgaagaatgagctgtcacctacatcttgttatatcaaaggtttcatctttttcatcttatcagacatcttttatttcatcttttcatagccttattatgttaggaatcgtttgattgctttcttgactgtgtttttttatgaatcttacaagtgattatgttttgttgtgctaaaacaagaggtttttaaagtttacatctgttttcgacat

SEQ ID NO: 2611 - DNA, 790 bp, Fraxinus spp
gctgcggatcaccggactgagggtaggaatcggcggcggcacgattagcaactatggtacacgtatccttttatcgaaactatgggaagacttttaagaagccccgccgtccctatgagaaggaacgactggatgctgagttgaagttggttggagagtatgggctgaggtgcaagagggagctttggagggttcaatatgctttgagccgcatcagaaatgctgcaagaaaccttcttactttggatgagaaggacccgcgtcgtattttcgagggtgaagcccttctgaggaggatgaacagatatggactgctggatgaaagccaaaacaagctcgattatgtcttagccctcacggtggagaacttccttgaacgccgcctccaaacacttgtgtttaaggcaggtatggccaagtcaattcaccatgccagagtgctcatcaggcaaaggcatatcagggttgggcgacaagttgtcaatgtaccatctttcatggtaagagtagattcccagaaacacattgatttctctcttacaagtcctttcggtggtggtcgtcccggtagagtgaagagaaagaaccagaaggctgctgcaaagaaggcttctggtggtgatgggggatgaggaggatgaagagtaagccaagctactagggattttgcttatgctcatgtagtgtactttgccaaactctttatggtttttgtcgtagatattttaaattagaaaattctaaacttctggtacttgttgattcttatcagtttcaaatccttgttaga

SEQ ID NO: 2612 - DNA, 1003 bp, Carpinus betulus
ttccaggactaggttttagggtgttcccttataaccaccaaagaaccaagctttctccttttaacttgggaagggagcgagcgatcaatcaagagagccatggtgcacgtctccttctaccgcaactatgggaagacctttaagaagccccgccgtccatatgagaaggaacggttggatgctgagttgaagcttgtgggagagtatgggctgcgatgcaagagagagctctggagggttcagtatgctctgagccgtattcgtaacaatgcgaggatgcttttgacccttgatgagaagaacccccgccgtatctttgagggcgaggctcttctccggaggatgaaccgatatgggcttttggatgagagtcagaacaagcttgattatgtcttggccctgaccgtggagaacttccttgagcgccgtcttcagacacttgtcttcaagtcaggcatggccaagtccatccaccatgctcgagtgctcattaggcagaggcatatcagggttgggaggcaggttgtgaatattgcatctttcatggtgagggttgattcacagaagcacattgatttctcacttaccagtccatttggtggtggccgacctggaagagtgaagcgaaagaatcagaaggcggctgctaagaaggctggtggtggagatgctgatgaagaggacgaggaatgaggcatgggttaggtctcttgctagtaatactagtagagcttgtgtctcaacttctgttgaactttcaatattttgcctgcactatttagtattgctttctttgagagaatagaattagctggtcgttattcatgtacaatccgtctttccttgggtttaatttaacatgttcgatcgagcccaatgatagcgggaacttattattgaggattgctagcatactttctgctgtcactgataagccttttaggcttgttatttgtatgtgggatgtggttattggctcaaacctatcagttgcgactgtttt

SEQ ID NO: 2613 - DNA, 809 bp, Carpinus betulus
cctcggcgcctgatcggaagccgacggagccatggtccacgtcagtttctaccgcaactatgggaagacattcaaaaagcctcgccgtccatatgagaaggagcgattggaccacgagctgaggcttgtgggagagtatgggctccgatgtaagagggagttgtggagggttcaatatgctttgagccgcatccgtaatgctgccagggaacttctcactttggatgagaagaatcctcgcaggatttttgagggtgaggcccttctgcgaagaatgaataggtatggacttttggatgagagccaaaacaagcttgattacgtccttgctctgaccgtggagaacttccttgagcgccggctgcaaacccttgtgttcaagtcgggtatggccaagtcaattcatcatgctcgtgtgcttattagacagaggcatatcagggttgggaggcaggtggttaacatagcatctttcatggtgagagttgattcccagaagcatattgatttctctctcactagtcccttcggaggtgggcgccccggtagagtgaagcgaaagaaccagaaggcagctgccaagaaggctggtggtggggatggagatgaggaggatgaagaatgaaagcttaggccagctccatccctaggaactatttgagtgttttttcttgttttgtgcccgtgtcaatcttctgtttcatgttttcttgcccgactctttttttcttctaaatttttattgtagtggattttggtacgtgtttcattttgatttatttggaatagaaccgaaatatgcaactctt

SEQ ID NO: 2614 - DNA, 811 bp, Ipomoea nil
gaaaccctagccttcccagcagcaattgttctctgcatttctgcagatcgcggcaggtgaacatggtgcacgtctccttttaccgcaactatgggaaaacattcaaaaagcctcgacgtccatatgagaaggagcgtttggatgctgagctgaagcttgttggtgaatatgggcttaggtgcaagagggagctttggagagttcagtatgctttgagccgtatcaggaataatgcaagaatgcttctgactcttgatgagaaggatccacgccgtatttttgagggtgatgccctccttaggagaatgaacaggtatgggttgctggacgagagccagaacaagctcgattatgtccttgctctcactgtggaaaatttccttgagcgccgtctccaaactctagtattcaaggctggtatggcaaagtctatccatcatgcaagagttctcattaggcaaaggcacatcagggttggaagacaggtggtgaatgttccatccttcatggtcagactggactcccagaagcacatcgatttctcgctcaccagtccatttggcggtggtcgccctggcagagtgaagcgaaagaaccagaaggctgcagctaagaaggcagcgggtggtgatggagacgaagaagatgaagagtgagcgcaatttctgtctaggcttctatgcctgtactggaaaaactttgactgcaattttgcagtttctcttgagggatatagttaaggttcattttgcaagatattttcaagatgcatttttctttttttctttctaaatcttgtgtggtagcaata

SEQ ID NO: 2615 - DNA, 813 bp, Ipomoea nil
gcagaaaccctagttagtgcctcagagctgcagaatttagcttccattgccgaactgaggttcttacctccggcggcccagcatggtgcacgttaacttttaccgaaactatggaaagacattcaagaagcctcgccgtccatatgagaaagagcgtttggatgctgagttgaagcttgtgggtgaatatgggcttaggtgcaagagggagctttggagagttcagtatgctttgagccgtatccgaaataatgcaagaatgcttctaacccttgatgagaaggacccacgccgtatttttgagggtgatgcactcctgaggaggatgaataggtatggcctgctggatgagagccaaaacaagcttgattatgtccttgccctcacagtggagaatttccttgagcgccgtctacagactctggtgtttaaggctggcatggcaaagtcaatccatcatgcaagagttctcattaggcaaaagcacatcagggttggaagacaggtggtcaatgtcccatccttcatggtcagggtcgactctcagaagcacatcgatttctcactatccagcccattcggtggtggccgacctggtagagtgaagagaaagaaccagaaggccgctgcgaagaaggcgtctggtggtgatggagatgaagaggatgaagaatgagcttgtttcttctgtgtagtagggtttaccctttttccccaatttgtttggaggttattgcaccttactacccttttgccaaaagcccaaaactctccgaggtcttattgcaccttactacccttacaagctttgag

SEQ ID NO: 2616 - DNA, 980 bp, Actinidia deliciosa
  misc_feature (612)..(612): n is a, c, g, or t
  misc_feature (636)..(636): n is a, c, g, or t
  misc_feature (756)..(756): n is a, c, g, or t
  misc_feature (759)..(759): n is a, c, g, or t
aagatacacaacgggcctattttcatcctctggtcccagtcctcgtaagaggctcggcccgttagggcttgggcgtgaaagaaatacaaataggtgtcgtctccgagaaagagaaaccctagacagactcgtcgttcatttccatcgtcttcaggagatcggagaaacgtttggcgagcaatcatggtgcacgtttcctattatcgcaactatgggaagacatttaagaaaccccgtcgcccctatgagaaggagcgattggatgctgagctgaagcttgtgggagagtatgggctacgctgcaagagggagctttggagggttcagtatgccctcagccgcatccgtaatgctgctagaatgcttctgacccttgatgagaagaacccccgccggattttcgagggtgaagcacttctgaggaggatgaacaggtacggtctgctggatgagagtcagaacaagcttgattatgtcctggctcttactgtggagaacttcctcgagcgacgcctccaaacacttgtgttcaagacgggtatggcaaaatcgattcaccatgccagagtgcttatcaggcaaagacatatcagggttgggaggcaggtggtnaacgttccctctttcatggtgagngtggactcacagaagcacatcgatttctcgttgacaagtcctcttggaggtggtcgtcctggtagagtgaagcgaaagaacatgaaggcagcggctaagaaagctgctggtggcgatggngangaagaagatgaagagtgaggccttggattcaatgtagtttttgatctttgctattttagctctgtttcttccctgcaatgtagtagtttttcttgagaaccttcaatataggaagttttgcatgcttttacatttatgctttctcaactctcatcaagattgtattttttagctttatcccaagttatgataacttgttttgcaagcttcaaaaaaaaaaa

SEQ ID NO: 2617 - DNA, 983 bp, Momordica charantia
ctccaattctcatctcgcaaaaccctagccgctctcctctgaagccgtgacagagaagagatcatggtccacgtctccttctacaggaactatgggaagactttcaagaaaccccgacgcccttatgagaaggagcgtttggatgctgagcttaaattggttggtgaatatgggcttcgttgtaagagggagctatggagggttcaatacgcactgagccgaatccgtaataatgcacgtatgcttttaacacttgatgaaaagaatccgcgtaggatttttgagggagaggcgctgctgaggaggatgaacaggtacggtcttttggacgagagccagaacaagcttgattatgtcttggctcttactgtggagaatttccttgagcgtcgtctccaaactcttgtgttcaagtctggtatggcaaagtctatccaccatgctagagttctcatcaggcagaggcatataagggttgggaggcaggtggttaatatcccatctttcatggtgagagttgattctcaaaagcacatagacttctctctcacaagtccattcggcggtggacgccccggaagagtgaagagaaagaaccagaaggcagctgccaagaaggccgctggtggagatggagacgaagaagatgaggattgagttgagatggtaaagatttagccgaaaggaaaggatctcaggtatctgaacctccctgatgggatgttacatcttttacaagttttgctttaattacttttcattggagattttgtgttctttggtggtggactagtttttgatcttgggacaatcttctcttttgttttagttgccatagttttgatgctattacaggacttattttctcaattttcctttgcattatgaatttattgagtttatttgatacaaatctggtggctgggcttatattatattcaggaatctgatgcattgtaatgttttattgaattctaattcca

SEQ ID NO: 2618 - DNA, 1049 bp, Momordica charantia
tagttggttccttattttacggtccgggggtcggtctttcttgaaatttcctcccgttcggcgcttctcgccttcgtctctagggcttttaatcgacatcacacaggtactgaagccgtaacagaggagaaatcatggtgcacgtctccttctataggaactatgggaagacattcaagaaaccacgacgcccttatgagaaggagcgtctggatgctgaacttaaacttgtaggtgaatatgggcttcgttgtaaaagggagttgtggcgggttcaatatgcactgagccgaatccgtaataatgcacgtatgcttttaacacttgacgaaaagaatccccgtaggatttttgagggggaggccctgcttaggaggatgaacaggtatggccttttggatgagagtcagaacaagcttgattatgtcttggcacttactgtggaaaacttccttgagcgtcgtctgcaaaccctcgtgttcaagtctggaatggcaaagtccatccatcatgctagagtgctcatcaggcagaggcatataagggttgggaggcaagtggttaatatcccatctttcatggtgagagttgattctcagaagcacattgacttctccctcacaagtccattcggaggtggacgccctggaagggtgaagagaaagaaccagaaggcagctgcgaagaaggctgctggtggagatggagatgaagaagatgaggattgagttattgactaaaaacaaatcatccgaaatggtaaaaattaggcaagaatctcaggtatctgagataaaagttcaacactcaaagtgaaccttatctatcccttgatgagaatgttacatcttttagaagttttgctttaattatttttcattagagatttcggttgttcttgggtggtgggactagtttttgatcttgtggacaggcttctcttctgtttttagtttccatagttttcatgcaatgacaggacttattttcccaatatttctttgcatcgtgaatttatttgttttatttgataaatatggtggctcttg

SEQ ID NO: 2619 - DNA, 884 bp, Olea europaea
ccctaatctgttgccttcagctgcagcaggaagagagagccggattggagatcgaatcagtgggggtcaacaacaatggtgcacgtctctttttaccgtaactatgggaaaacatttaagaagccccgtcgtccctatgaaaaggaacgactagatgctgaattgaagcttgttggagagtatggacttaggtgcaagagggaactctggagggttcagtatgcactaagccgcatcagaaatgctgcaagaaatcttctgactcttgatgagaaggaccctcgtcgtatttttgagggtgaagcccttttgaggaggatgaacaggtatggactgttggatgagagccagaataagctcgattacgtcctgtccctcacagtagagaatttccttgagcgccgcctgcaaacttgtgtgtttaaggcaggtatggctaagtcaatccaccatgctagagtgctcatcaggcaaaggcatatcagggttggtcgacaagtcgtcaatgtgccctcatttatggtgagagtggattcccagaagcacattgatttctctcttacaagtccatttggtggtggccgccctggtagagtgaagcgaaagaaccagaaggcagctgcaaagaaggcttcaggtggtgatggggatgaagatgatgaagagtgaaagctcggtggttaatgcggttaaaggtaataccaggcagctgcatccttagtttttcttgctgtcgtagcagtgtcttaaatgaactaatcgtggcttctgtccaagatattgagattaggatgttttgagcttcacaattattttcatgcctttttaaaggttttgtagtttttatttgacttcgatgattataaactatattttgctaggtt

SEQ ID NO: 2620 - DNA, 821 bp, Capsicum annuum
tcagcatagtagtgatttcaccttcgacgactgcactgccggtgaccaggaaatatggtgcatgtcaatttttaccgcaactatggaaaaacctttaagaagcctcgacgcccatatgagaaagagcgattggacgcagagttgaagcttgtcggagaatatggattaaggtgcaagagagagctttggagagttcagtatgcgttgagccgtatcagaaatgctgcaagaatgcttctgaccttggatgagaaagacccacgccgtatttttgaaggtgaagcactcttgagaaggatgaacagatatgggttattggatgagagccagaacaagctagattatgtcttagccctaactgtggagaactttcttgagcgtcgtcttcaaacccttgtcttcaagactggcatggccaagtcaatccatcatgctagagtactcattagacaaaggcatatcagagttggtaggcaggtggtgaatgttccttcttttatggtgagagtggactcccagaagcacattgacttctctctcaccagtcctttcggtggtgggcgccctggaagggtgaagcgaaagaaccaaaaggctgctgtaaagaaggcagctggtggtgatggagatgaggaagatgacgaatgagctcttatgtttatttacctttggattttatacttttgcctgtattgtactttcttgtttatgtaccctttcatatgttagaaatgttttttaacatatgaaatattaagtttaggctttggtctaaatttattattgaatcagtggatctagtagtatttaactaccagttt

SEQ ID NO: 2621 - DNA, 831 bp, Capsicum annuum
ctgcactgccggtgaccaggaaatatggtgcatgtcaatttttaccgcaactatggaaaaacctttaagaagcctcgacgcccatatgagaaagagcgattggacgcagagttgaagcttgtcggagaatatggattaaggtgcaagagagagctttggagagttcagtatgcgttgagccgtatcagaaatgctgcaagaatgcttctgaccttggatgagaaagacccacgccgtatttttgaaggtgaagcactcttgagaaggatgaacagatatgggttattggatgagagccagaacaagctagattatgtcttagccctaactgtggagaactttcttgagcgtcgtcttcaaacccttgtcttcaagactggcatggccaagtcaatccatcatgctagagtactcattagacaaaggcatatcagagttggtaggcaggtggtgaatgttccttcttttatggtgagagtggactcccagaagcacattgacttctctctcaccagtcctttcggtggtgggcgccctggaagggtgaagcgaaagaaccaaaaggctgctgtaaagaaggcagctggtggtgatggagatgaggaagatgacgaatgagctcttatgtttatttacctttggattttatacttttgcctgtattgtactttcttgtttatgtaccctttcatatgttagaaatgttttttaacatatgaaatattaagtttaggctttggtctaaatttattattgaatcagtggatctagtagtatttaactaccagtttaattggagtaagttcttgatatagattagttttttcactc

SEQ ID NO: 2622 - DNA, 1044 bp, Populus trichocarpa
ttaagtgacaaactttttttttttacttctttgagcacacgctcaaatattttttttttactctaaataaaatttttcttcggatatattattttctattatttaacatatcctaaatttttgcctaatagtggtttcgaagagaacccaaatatattattttaaaatccaagctcagtttaaggattccatgcgcttctggcactccattcctcgaaaaagctcattagggtttgcaggtcttccttgctgatctccgctcactctgctctcttgaagacaagccgactaaaccatggttcacgtcaatttttacagaaactatgggaagactttcaagaagccacggcgtccatatgagaaggaacggttggacgctgagctgaaacttgttggagagtatgggctccgtgctaagagggagttatggagggttcaatatgccctgagccgcatccgtaatgctgcaagaatgcttctcaccctggatgagaagaatccacgacgaatatttgaaggtgaagcccttctccgcaggatgaacaggtatggtcttctggaggagaaccagaacaagcttgattatgtcctggccctcactgttgagagcttccttgagcgtcgcctccagacccttgtgttcaaggctggcatggcaaagtctattcaccatgctcgcgtgctcatcaagcagaggcacattagggttggaaggcaggctgttaacattccatcttttatggtgagggttgactcccagaaacacattgatttctctctgacaagtccacttggaggtggccgtcctggaagagtgaagagaaagaatcagaaggctgctgccaagaaggcttctggtggagatggtgatgaagaggatgaggaataaatacctgaatagtaggctagtatctctcagaaccttgttttcagtccctttttaactaaattttcataagcatatttggttgtattcgaactagaacatgattttgtttactagcgaaaaaataaggtctaatgcagatctgcttttttctgtca

SEQ ID NO: 2623 - DNA, 737 bp, Solanum tuberosum
ggtacattgaaggagacgaacaaacatggtgcacgtctctttttatcgcaactatgggaagacctttaagaagccacgaaggccctacgagaaggagcgattggatgcagaattgaaacttgtaggagagtatggactaaggtgcaagagggagctttggagagttcagtatgctttgagccgtatcaggaatgctgctagaatgcttctgacattggatgagaaggattcacgtcgtatttttgaaggtgaagctctcctgaggaggatgaacaggtatggattgttggatgagagccaaaacaagcttgattatgtcttggcactcaccgtggagaactttcttgagcgtcgtctccaaacacttgtcttcaagactggcatggctaagtcaattcatcatgccagagtgctcatcaggcaaaggcatatcagagttggtaggcaggtggtgaatgttgcttcttttatggtgagagtggactcccagaagcacattgacttctctctcactagtccgtttggtggtggccgtcctggaagagtgaagcgaaagaaccaaaagtctgctgccaagaaggctgctggtggtgatggtgatgaagaggatgaagaatgatcaactatcttagtgtttggtctatttggcttgtagtactggcctatcttatttttctgctatttgtggtttatcttcatgtagtagtaaagaaatattaaacagaagtttctaattt

SEQ ID NO: 2624 - DNA, 897 bp, Solanum tuberosum
gatcccccggctgcagaatcagcacgagggtctcttcacaatcggcgacgacggtgccggtgaccagaaagtatggtgcatgttaacttttaccgcaactatgggaaaacctttaagaagcctcgacgcccttatgagaaggagcgattggatgcagagttgaagcttgttggagaatatggactgaggtgcaagagggagctttggagagttcagtatgccttgagccgtatcaggaatgccgcaagaatgcttctgaccttggatgagaaagacccacgccgtatttttgaaggtgaagcactcttgagaaggatgaacagatacggattattggacgagagccagaacaagcttgattatgtcttggccctcactgtagagaactttcttgagcgtcgtctccaaacccttgtcttcaagactggcatggctaagtctatccaccatgctagagtgctcattcgacaaaggcatatcagagttggtaggcaggtggtgaatgttgcttctttcatggtgagagtggactcccagaagcacattgacttctctctcactagtcctttcggtggtgggcgccctggaagagtgaagcgaaagaaccagaagtctgctgcaaagaaagcagctggtggtgatggagacgaggaagatgaagaataaactcttatgtttatttacgtttgggtgtttcacttctgcctatgttgtgtactttcttgttttatgtttttgcaatttaatctacctttaatatattagaaaatgtttttgacagaggtggagagaatattgagtttggatttagcacttgatattaagagaaattttttcttggatggaatattagattctgctcttctcccttttcccttgttcattagacactgaatt

SEQ ID NO: 2625 - DNA, 780 bp, Solanum phureja
atagcagtaccctttaccttctccgcgatctctgtacattgaaggagacgaacaaacatggtgcacgtctctttttatcgcaactatgggaagacctttaagaagccacgaaggccctacgagaaggagcgattggatgcagaattgaaacttgtaggagagtatggactaaggtgcaagagggagctttggagagttcagtatgctttgagccgtatcaggaatgctgctagaatgcttctgacattggatgagaaggattcacgtcgtatttttgaaggtgaagctctcctgaggaggatgaacaggtatggattgttggatgagagccaaaacaagcttgattatgtcttggcactcaccgtggagaactttcttgagcgtcgtctccaaacccttgtcttcaagactggcatggctaagtcaattcatcatgccagagtgctcatcaggcaaaggcatatcagagttggtaggcaggtggtgaatgttgcttctttcatggtgagagtggactcccagaagcacattgacttctctctcactagtccgtttggtggtggccgtcctggaagagtgaagcgaaagaaccaaaagtccgctgccaagaaggctgctggtggtgatggtgatgaagaggatgaagaatgatcaactatcttagtgtttggtctatttggcttgtagtactggcctatcttatttttctgctatttgtggtttatcttcatgtagtagtaaagaaatattaaacagaagtttctaattttggattttgca

SEQ ID NO: 2626 - DNA, 805 bp, Solanum phureja
ccttcgccatttctgttctcttcagcagatcggcgacgacggtgccggtgaccagaaagtatggtgcatgttaacttttaccgcaactatgggaaaacctttaagaagcctcgacgcccttatgagaaggagcgattggatgcagagttgaagcttgttggagaatatggactgaggtgcaagagggagctttggagagtccagtatgccttgagccgtatcaggaatgccgcaagaatgcttctgaccttggatgagaaagacccacgccgtatttttgaaggtgaagcactcttgagaaggatgaacagatacggattattggacgagagccagaacaagcttgattatgtcttggccctcactgtagagaactttcttgagcgtcgtctccaaacccttgtcttcaagactggcatggctaagtctatccaccatgctagagtgctcattcgacaaaggcatatcagagttggtaggcaggtggtgaatgttgcttctttcatggtgagagtggactcccagaagcacattgacttctctctcactagtcctttcggtggtgggcgccctggaagagtgaagcgaaagaaccagaagtctgctgcaaagaaagcagctggtggtgatggagacgaggaagatgaagaataaactcttatgtttatttacgtttgggtgtttcacttctgcctatgttgtgtactttcttgttttatgtttttgcaatttaatctacctttaatatattagaaaatgtttttgacagaggtggagagaatattgagtttggatttagcacttg

SEQ ID NO: 2627 - DNA, 874 bp, Solanum phureja
cttgcgtatattacccttcgccatttctgttctcttcagtagatcggcgacgacggtgccggtgaccagaaagtatggtgcatgttaacttttaccgcaactatgggaaaacctttaagaagcctcgacgcccttatgagaaggagcgattggatgcagagttgaagcttgttggagaatatggactgaggtgcaagagggagctttggagagttcagtatgccttgagccgtatcaggaatgccgcaagaatgcttctgaccttggatgagaaagacccacgccgtatttttgaaggtgaagcactcttgagaaggatgaacagatacggattattggacgagagccagaacaagcttgattatgtcttggccctcactgtagagaactttcttgagcgtcgtctccaaacccttgtcttcaagactggcatggctaagtcaatccaccatgctagagtgctcattcgacaaaggcatatcagagttggtaggcaggtggtgaatgttgcttctttcatggtgagagtggactcccagaagcacattgacttctctctcactagtcctttcggtggtgggcgccctggaagagtgaagcgaaagaaccagaagtctgctgcaaagaaagcagctggtggtgatggagacgaggaagatgaagaataaactcttatgtttatttacgtttgggtgtttcacttctgcctatgttgtgtactttcttgttttatgtttttgcaatttaatctacctttaatatattagaaaatgtttttgacacaggtggagagaattttgagtttggatttagcacttgatattaagagaatttttttcttggatggtatattacattctgctcttctcccttt

SEQ ID NO: 2628 - DNA, 977 bp, Tabernaemontana elegans
gttttcctctcagtccatttgcagcagcagatcgcagagctgaaaaccaccgcagcggcgggcggcagcaaccagcatggtgcacgtctccttctatcgcaactatggtaagaccttcaagaagcctcgtaggccatacgagaaggagcgtttggatgctgaactaaagcttgttggagaatatgggctgcggtgcaagagggagctttggagagttcagtatgtattgagccgtatcagaaatgcagcaagaaatctattgactctggacgagaaggacccacgccgtatctttgaaggtgaagcccttttgaggaggatgaacaggtatggtctgttggacgagagccagaacaagctcgattatgtcttggcactgactgtagaaaactttcttgagcgccgtcttcaaactcttgttttcaagactgggatggcaaagtcaatccaccatgccagagtgctcattaggcaaaggcatatcagggttggaaggcaggttgtcaatgttccctcttttatggttagagtggactctcagaagcacattgacttctcacttacaagtccttttggtggtgggcgcccgggcagagtgaagagaaagaacacaaaggcagctgcaaagaaggctgcaggtggtgacggagatgaagaggatgaagaatgagccctctgttttaatttaatcgttaattataatactggaggatgccggtcagatcttgtctctttcgtccgcgtaatactgcccctaagatttttgcagtttctgttgagactctcgtacatgtaggaagttttgcatgatttttttggctttcctgacatcattattaccaagaatttgttgtctttgaacctttttatgttacaacctctaagaattggcaaaatcaattatcttgcaatttgtgtttgaggtaacaatttctaagtcagtcaaaaatttactgccaattttgtctggtggtgag

SEQ ID NO: 2629 - DNA, 894 bp, Solanum lycopersicum
aaaaccctagtgtctctctaaccctagcagatttctcaattcatttcagcaggtcgccgattgaggacggcgccgtcaaccggtaaacatggtgcacgtttccttttaccgcaactatgggaagacctttaagaagcctcgacgtccttatgagaaggagaggttggatgcagagttgaagcttgttggagagtatggactgaggtgcaagagggagttgtggagagttcagtatgctttgagccgtatcaggaatgctgcaagaatgcttctgacccttgatgagaaagacccacgtcgtatttttgaaggtgaagctcttttgaggaggatgaacaggtatgggctgttggacgagagccagaacaagcttgattacgtcttggcactcactgttgagaacttccttgaacgtcgtctgcaaacacttgtcttcaagactggcatggccaagtcaatccaccatgcgagagtgctcatcaggcaaaggcatatcagggttggaaggcaagtcgtgaatgttgcttcattcatggtgagagtcgactctcagaagcacattgacttctctctaaccagtccttttggtggtgggcgtccaggaagagtgaagcgaaagaaccaaaagtctgctgccaagaaggctgctggcggtgatggtgatgaggatgatgaagaatgagcttttgagcaagaatttaaagaagaagtgtggcgacggaatcgttcatttttgaagtttttagttacctatgtagtgcttccttacattcctttcttcaatattttgatatcttcatatgttagaaagaaatgttcttagcggagattgtgagaatgtttttatgtttggattttgcactcatcttagagtttcaacaaaatgttttgaac

SEQ ID NO: 2630 - DNA, 876 bp, Tragopogon dubius
ggggacccttgaagcagcagtcgccgtcgggaggaacagagcaaacgccggattgacgtggaacaacaatggtgcacgtctccttctaccgcaactatggaaagacgttcaagaaacctcgtcgtccttacgagaaggaacgactggatgctgagttgaagctcgtcggagagtatggtctacgatgcaaaagggagctctggagagtgcagtatgctctcagccgcatccgtaacgccgcaagaatgcttctgactctcgaagagaaagaccctcgccgtattttcgaaggtgaagctctgatgaggaggatgaacaggtacggtttgttggacgagagccaaaacaagctcgattacgttctagccctcactgtggagaactttctagaacgccgtctccaaacactcgtcttcaagaccggtatggccaagtctatccaccatgccagagttctcatcaaacagaggcacatcagagttggaaggcaagttgtgaatgttccatcgttcatggtgagggtggattcccagaaacatattgacttctcactcacgagtccatttggtggtggtcgacctggaagagtgaagcgaaagaaccaaaaagcagcggcaaagaaggctgccggaggtgatgccgatgaggaggatgaagaatgagtattgggttagttttctttatgttcttcattctacttgctgccaccatgatgatatgcttttacaagtgagtgttttgttttttgtttacttttagactcttgttatattagtggattcttggtggttttttcaaaaagttattgttgcttgattttctgttgaagattttgtaatggattatggttttatggttttcaaattatgtgttgag

SEQ ID NO: 2631 - DNA, 1048 bp, Citrullus lanatus
cctccacttcggcgcttctttgttttcttgtttagggcttccgatcggagagcgcggcagggcagggagtgaagccgtagcagagaaccaatcatggtgcacgtctccttctatcgtaattatggaaagactttcaagaaaccgcgacgcccttatgagaaggagcgtctggatgcagaacttaaacttgtaggtgagtatgggcttcgttgtaaaagggagctatggagggttcaatatgcattgagccgaatccgtaataatgcaaggatgcttttaacccttgatgaaaagaatccgcgtaggatttttgagggagaggccctgcttaggcggatgaacaggtatggtcttttggatgagagtcaaaacaagctcgattatgtcttggctcttactgtcgagaatttccttgagcgtcgtctccaaactcttgtattcaagtctggaatggctaaatctattcaccatgctagagtgctcatcagacagaggcatataagggttgggaggcaagtggttaacatcccttctttcatggtaagagttgattctcaaaagcacatagacttctctctcaccagtccatttggaggtggacgccccggaagggtgaagagaaagaaccagaaggcagctgccaagaaggctgctggcggagatggtgatgaagaagacgaggattgagttactgactaaaaactcatcatatgggatggtaaagattagccaaggatctcaggtaactgagattaacctcaatgacctatttcctatagctaaaccttttctatcatattgatgagaatgttacgtcttttagaagttttgctttaatttttttttttttcatttagagatcttgtttgtttttttggtggactagtttccaattttggataagcatctgtttgaacttagtttccatagttttctcgacattattggacttcgttactcaaaacttctccgcatcatgaatgtattgtgttgatttttgatctatatctggcagcttggatcaggaatctgacccgtttcaaggttt

SEQ ID NO: 2632 - DNA, 805 bp, Avena sativa
gctccattacctccccgacctcactacccatcctgtggcggcgccggcgttgagaggcgggggcatcgtcaaccatggtgcacgtcaacttctaccgcaactacggtaagactttcaagaagccaaggcgtccgtatgagaaggagcgtcttgatgctgaactgaaactggtgggtgagtatggcctgaggtgcaagcgtgagctgtggcgtgtgcagtatgcccttagccgcatccgtaatgctgcaagggagctgctcacccttgacgagaagaacccccgtcgtatctttgagggcgcggctcttctgcgacgcatgaaccgctatggtctcctttctgaggaccagaacaagcttgattacgtacttgcgctcactgttgagaacttccttcagcgccgcctccagaccattgtcttcaagaatggcatggcaaaatccatccatcatgctcgtgtgctcatcagacaacgccacatcagagttgggaggcagcttgtcaacattccgtcgttcatggtgagagtcgacactgagaagcacgtggacttctccctcaccagcccacttggtggtggcgagcctggaagggtcaagaggaagaacctgaagaaggctgctggtggcggcggtggggatggtgatgaggaggaagagtgagcatgtgattcagctctgttttttagtagaacctaattttgctgtctcctgttagaacctaattttgttacatgtgtttggacaaaggttggtcactgtgggtgtctagtaatctctctttccagttcttcaatcgatcattg

SEQ ID NO: 2633 - DNA, 987 bp, Avena sativa
gactagccacccttctccccacacctccaccggcggcggccagcttgacgacccgcgccatcctgctgctgcggcggcagccagcttgaagacccgcgccatcctgctgcggcggcggcagccatggtgcacgtcaacttctaccgcaactatgggaagactttcaagaagccaaggcgtccgtatgagaaggagcgtcttgactctgagctgaagctggtcggggagtacggtctgcggtgcaagcgtgagctgtggcgcgtgcagtatgctctgagccgtatccgaaatgcagcaagggagctgctcaccctcgatgagaagaacccccgtcgcatctttgagggtgaagcgctcctccgccgcatgaaccgctacggtctccttgctgaggaccaaaacaagcttgattacgtgcttgcgctcactgttgagaacttcctccagcgccgtctccagaccatcgtcttcaagaatggcatggccaagtcaatccatcatgctcgtgtccttatcaggcagcgccacatcagggttggaaagcagctcgtcaacattccttctttcatggtgagggtcgacactgagaagcacgtggacttctcactcacaagcccactgggtggtggccttccaggaagagtgaagaggaagaaccagaagaaggcctcaggtggtggtggtggcgacggcgaggaggaggaagagtaagagctcatccttttgctttgaaggactccgtggcagaaattatcaaaaacttcagtttagatcgccttgttgaacttggaaccggatgttgttgaaactttgatttgagcttatgaacttagtggcgaagagattttgttgcctcggaatctagcattgggtactaaacttatgggtgtcagttttgcttggttaaatcagctggtgaagaaaccaactcagtgacactcgctgtgcttcaaatgtactccgtatgttggtatcgatcgaaatgtt

SEQ ID NO: 2634 - DNA, 861 bp, Lippia dulcis
ctttttcgactacgatcacgagatcggactgaggaggtcgacggcggcaaacgatggtgcacgtcaatttctatcgcaactatgggaagacttttaagaagccccgtcgtccctatgagaaggagcgattggatgctgagctgaaacttgttggtgaatatggtcttaggtgtaagagggagttatggagggttcagtatgcactgagccgtattaggaacaatgcaagaaatcttttaactcttgatgagaaggaccctcgtcgtatttttgagggtgaagcccttctgaggaggatgaacaggtatgggctacttgatgagagccagaacaagcttgattatgtcttggccctcacagttgagaatttccttgagcgccgcctccaaacccttgtgtttaaggctgggatggccaagtccatccaccatgccagagtccttatcaggcaaaggcatatcagggttggaaggcaagtagtcaatgtgccgtcattcatggtcagggtggactctcagaagcatattgatttctctctgaccagtccatttggtggtggccgtcctgggagagtaaagagaaggaaccagaaagcagctgccaagaaagcatctggcggcggagatggagatgaggatgatgaagagtgagctgtagtagtttatttagtggataattctaggaaagaatgttgcgagttttgtttctgcctctcatgtaggggcaaagtctttacaaaccataagtttttcttgttgagatattcatattcggattacttaaaggtttggcctgtctgttcacttctactgtcgatttctgtgctcaaattattattatgtgagttaaaaactcttgcac

SEQ ID NO: 2635 - DNA, 827 bp, Carthamus tinctorius
ggcgggggcgtctcttcgaagcgcggaggtcgccgggagcgggagaggaagatttcgcatcgccggatcgccgccggaaaacaatggttcacgtccccttctaccgcaactatggtaagacttttaagaagcctcgtcgtccttatgagaaggagcgattggatgctgagttgaagcttgtgggagagtatggtcttcgatgcaaaagggagctttggagggtgcagtatgctcttagtcgcattcgtaatgccgcaagaatgcttctgacccttgaagagaaggaccctcgtcgtatttttgagggtgaggcccttatgaggaggatgaacaggtatggtcttttggacgagagtcagaacaagctcgattatgtgcttgccctcactgtcgagaacttccttgagcgccgtcttcagacacttgtgttcaagactggtatggccaagtctatccaccatgctagagttctcatcaagcagagacacatcagggtgggaaggcaggtggtgaatgtaccatccttcatggtgagagtggactcacagaagcacatagacttttcactcacaagtccgtttggcggtggccgaccaggcagagttaagcgaaagaaccagaaggctgctgcaaagaaggctgccggtggagatgccgacgaggatgaggaagaatgagcttgctaggtagggtgagatatcgcttgcagtcttgagtcctatgagtattagttatcttggtaataactctttgtaggaagttttgggatgcttttacttggtcttttttatggatttaattgatagcttgattatgcaatggggttt

SEQ ID NO: 2636 - DNA, 865 bp, Sarracenia psittacina
tgttttcgtctttcctgctcaccgacggcacgccggcgtagccatggttcacgtcaatttctaccggaactatgggaagacatttaagaagcctcgtcgtccatatgagaaggaacgcttggatgctgagctgaagcttgtaggagagtatgggcttcgatgtaagagggaattgtggagggttcaatatgctctgagtcgtattcgtaatgctgcaaggatgcttctcactctcgatgagaaaaatccgcgccggatctttgagggtgaggcacttctacgcaggatgaacaggtatggcctgttggatgagagccaaaacaaacttgattatgtcttggctttgactgtggagaacttccttgaacgccgtcttcaaacgcttgtgttcaagacgggtatggctaagtcaattcaccatgcccgcgtcctcattaggcagagacatatcagggtcgggaggcaggtggttaacataccctcatttctggtgagggtggactctcagaaacacatcgacttctctctcacaagtcccctaggaggtggacgccccggaagagtcaagcgaaggaaccagaaggcggctactaagaaggctgctggtggcggagatggagatgaggaagatgaggagtaaacagagtggggcaatagacattatccgaaccttatcttgcgttgtcttttgcattttcttttctcctatctgaagttctaagttttcttacccgatcgccatcctcaaatttcagtcggaaattggagttttgcttgattggttagagtggattgaatacttgattatctgtttaaattgattttgtcatttggcttatggatatggaacgagtggttcggcaaa

SEQ ID NO: 2637 - DNA, 833 bp, Triphysaria pusilla
aacatttcctaccccgtaaccctcgagtggcttacagttcaactgcgaccagcaacagatcggacggactgaggacctcgccggcggtgaatcatggtccacgtttcgttttatcgcaactatgggaagacgttcaaaaagcctcgccgtccctacgagaaggagcgtctcgatgcagagctaaaactcgtcggagaatatggtctgaggtgcaagagggagctgtggagggttcagtttgccctgagccgcattcggaacaatgctagagacctcttgactcttgacgagaaggatcctcgtcgtatttttgagggcgaggcccttctgaggaggatgaacagatatgggctgctcgatgagagccagaacaagcttgattatgtcttagccctcactgttgagaactttctcgagcgtcgcctacagactcttgttttcaaggctggcatggctaagtccatccaccatgccagagtgcttatcaggcaaaggcatattagggttggaaggcaagttgttaatgtgccctcattcatggtgagggtcgattctcagaagcacattgatttctctttgacaagtccgtttggtggtggccgtcccggcagagtgaagagaaagaatcagaaggcggctgccaagaaggtttctggtggtggtgatggagacgaggatgacgatgaatgagctgtagttttgtttacttatttctgaatgatcatgttagaaacactgttatgaggatgtaaggatatggttttacaaactatattgcgtttttttgtttggaattcaagtttatcatggtttaagcttggtgtgtttgtgtg

SEQ ID NO: 2638 - DNA, 777 bp, Sarracenia psittacina
gacggctgacggcatcgcgacttagccatggttcacgtcaatttctaccggaactatggaaagacttttaagaagcctcgtcgtccctatgagaaggagcgtttggatgctgagctgaagcttgtgggagagtatgggctccgatgtaagagggagttatgagggttcagtatgctctgagccgcatccgtaatgccgcaaggatgcttctcactctcgacgagaaaaatcctcgccgtatctttgagggtgaggcccttcttcgaaggatgaacaggtatgggcttttggatgagagccagaacaagcttgattatgtgttggctttgactgtggagaacttccttgaacggcgccttcaaacccttgtgttcaagacgggcatggctaagtcgattcaccatgctcgtgtgctcattaggcagagacacatcagagttgggaggcaggtggttaacataccctcgtttatggtgagggtagattcccaaaaacacattgatttctctcttacaagtcctcttggaggtggacgccctggaagagtgaagcggaagaaccaaaaggcagcggctaagaaggtttctggtggagatggagacgaggaggacgaggagtgaatagcattggcaatagatatcaaatgggagggttttttttgtcttttgtcattctctctctctctctctctctcttcagctataagttctctttacccgattcccattctcaaacttcgttcgagtagatattggtgcaacttttgattgtttggtt

SEQ ID NO: 2639 - DNA, 1152 bp, Cannabis sativa
ggatataagagaaccattaggtttagggtttagcttactcaaaccatcaaaacggcttcctgagactgaaggttgagaacccagaagggcacctcacctcaggccaacaaccatggtgcatgtcaatttttaccggaattatggtaaaaccttcaagaagcctagacgtccttacgagaaggagcgtttggacgctgagttgaagctcgtcggagagtatggtctccggtgtaagagagagttgtggagggttcagtatgtgctgagccgaatccgtaacaacgctagaatgcttctgaccctcgacgagaaaaacccacgtcggatttttgagggagaggcccttctgaggaggatgaacagatacggattgttggatgagagccagaacaagctcgattacgttcttgctctaactgtcgagaactttttggagcgtcgtcttcagacccttgtcttcaagtccggtatggctaagtcaatccaccatgctcgagttcttatcaggcaaaggcacattagagttggaaggcaggtagtcaacatcccctcattcatggtgagggttgactctcagaagcacattgatttctccctcacaagtcccttcggaggtggtcgccctggccgtgtgaagcgaaagaaccaaaaggcagctgccaagaaggcttcaggtggagatggagatgaagaagacgaagaatgaagatcataggggtcctaagtgagtcttttttgtccaggaatttctttctctgttagcttttgtggtttttgtcaactccaccatggaatatcaatatgttataatcataggaagttttgcttgctatgctctaaatctgatctgtttttatttggtttgaaattatataactagatggcttattatatcaagatgagacactatttccttttatttggtttgaagttttggtggttttgttgggagtcactgcttaggtgactgatatattaggctttatatctagtgttactgctttagtatgaatcgccttattatttggtttaacaaagatgttacctaataagtaagcaaatagtacaccaaatggagttactccatcacactgtcatgtctttttgcttagattttctttcctagttaacatcttaattttttttattgta

SEQ ID NO: 2640 - DNA, 1506 bp, Cannabis sativa
tgcatttggtgttgaggctgtgtagaaaatgatatcatagttttcatagaagagaacacaagggattagggtttaggattatataggttacccaaaccatctaaaacggcctcctgagattgaaggttgagaaccgagaagggcacctcacctcaggtcgacaaccatggtgcatgtcaatttttaccggaattatggtaaaaccttcaagaagcctagacgtccttacgagaaggagcgtttggacgctgagttgaagctcgtcggagagtatggtctccggtgtaagagagagttgtggagggttcagtatgtgctgagccgaatccgtaacaatgctagaatgcttctgacactcgacgagaaaaacccacgtcggatttttgagggagaggcccttctgaggaggatgaacagatacggattgttggatgagagccagaacaagctcgattacgttcttgctctaactgtcgagaactttttggagcgtcgtcttcagacccttgtcttcaagtccggtatggctaagtcaatccaccatgcccgagttcttatcaggcaaaggcacattagagttggaaggcaggtagttaacattccttcattcatggtgagggttgactctcagaagcacattgatttctctctcacaagtcccttcggaggtggtcgccctggccgtgtgaagcgaaagaaccaaaaggcagctgccaagaaggcttctggtggagatggagatgaggaagacgaagagtgaagatcatagttgtactaagtgagtcttttttgtccaagattatcattctctgttctctgttaaattttgtggattatgttgactctatcgtagaacatgttatgatcataggaagttttgcttgctgtgctgtagtttttttcttttacaatttgataactagatggcttcttagatcataatgagactttatttcagttgttgatgattttagacacccgttactttactactacacattctcatccctctcattttttacatttatattttctttttcctttttcctggctttactaaaagattttgttctgattcctacttgggttactgaaattaggatcttactgtgttgaatcacaaatcaaatacatcaaattctcatggctttggtttagaatttcatttacatggaacttatttctcactcccacgctcttgttgattatattttggttcagaattttttaatttacaagtgacgtgaaaatatctaattaaatgggtgaggctcgagttacctttctgaaggttgttatcaatgaattcttacaaggctaaaaataattgcactgatttcatttctggagctttattgataaaaagcattggcgatgatatttgttacactatttacaagcactattttgttgtaccattttaaccaatttgatttagaatctattactgtgacaacttcaaacattcaacaccaaatattacaacaaatatatatttaggtggcg

SEQ ID NO: 2641 - DNA, 1092 bp, Gossypium raimondii
ttctctgtatataaagaacactcattcggtctcctccattttccccagtttttgtctctttcgctttctcgcctccgagaagaagccgacgccgccatggttcacgtcagtttctaccgcaattatgggaagacatttaagaagccaaggcgtccatacgagaaggaacgtttggatgctgagttgaggcttgtaggagaatatggtctccgatgtaagagggagttgtggagggttcaatatgctttgagccgaatcagaaatgctgctagggatcttctcactcttgatgagaagaaccctcgtcgtattttcgaaggtgaagctcttcttcgtaggatgaacaggtatggacttttggatgagagtcagaacaagctcgattatgtcttggctttgaccgttgagaacttccttgaacgccgcttgcaaacacttgtgttcaagactggtatggccaagtcaattcaccatgctcgtgtgttgattaggcaacgtcacatcagagtcggaaggcaggtggttaacatcccatcctttatggtgagggttgactcccagaaacatatcgacttctctctgacaagtccgttcggaggtggccgtcctggaagagtgaagagaaagaatcagagagcagctgccaagaaggccgctggtggagatggtgatgaagaggaagacgagtaaaccttaagctagtattggcaatagggcactcctaaaagagcctctgatgggaacttaccatttcctacattattagacatggtttgagttttgtttcaagacctttaatgtagtggatgttcgcatttgtatttgtctcggattttatgttacattgagcaattttgttattttgagattaaaatgtttaaattatagttcaccatttcgatcaatgtcatgcattttgtagctaagctgttgatgaattgcagtctgtagggttcatgatgtgtcacttacaattactgagcgcttaattatgtgttatcattaagtatttttgttttggagcattgggccattgaagctttgcttggtgccaagctcaagtgcttatgcaaaaagtaacttttggaagta

SEQ ID NO: 2642 - DNA, 1026 bp, Helianthus annuus
ctcggcccatttaacaaaccctagctgtatttcttcgcctcacctcacctcactcttgttgcaggttgatttctcacggcgtctccgttttcagcgaaggaagaaagtgagaagagcagcaagcagttgctgcactgaaattggacagcaatggtccatgtgtcattttatcgaaactatggaaagactttcaagaagccccgccgtccatacgagaaggaacgtttggacgctgagttaaaactcgtaggagaatacggtctccggtgcaaacgcgagctctggagggtgcaatacgctcttagtcgaattagaaatgccgcaagaatgcttttgacccttgaagaaaaggacccccgtcgaattttcgagggtgaagcacttatgaggagaatgaaccgttacgggcttttggatgagagccaaaacaagcttgattatgtgttggcacttaccgttgagaactttctagaacgtcgtttgcagacactcgtgttcaagaccggtatggctaagtctattcatcatgctagagtgctcatcaagcagaggcacatcagggttggaaggcaagtggtgaatgttccgtctttcatggtgagagttgactcacagaagcacattgacttctcgctcacaagtccctttggtggtggccgacccggcagagttaagcgaaagaaccaaaaagctgctgccaagaaggcggcaggcggtgatgctgacgaggatgatgaagaatgagctgttacttgtatcaaaggctttcttcatctctattatctttgtggtcgtcgtttatttattcgtctttcgaacctttttatccttaggaagttttggatgttttcgctttgatgttaaggttttgatatcggattatgtttttatatgctaaaacatggtgtttaatgttttaaggttggttaaccttaacgttaattagcttctggtagttaattatagttggatctaatacaactttgagaaataatagtgcaatcagacgggtcaaataaacatact

SEQ ID NO: 2643 - DNA, 840 bp, Helianthus annuus
gaagaagacaccaagtagccgcacgtcgaacaacaatggttcacgtctccttctaccgcaactatggtaagacttttaagaagccccgtcgtccttacgagaaggaacgattggatgctgagttgaagcttgtgggagagtatggtcttagatgcaagagggagctttggagagtgcagtatgctttgagtcgcattcgtaatgccgctagaatgcttttgacgcttgaggagaaggacccgcgtaggatctttgagggtgaggctcttatgaggagaatgaataggtatgggcttttggatgagagtcagaacaagctcgattacgtgcttgcgcttactgtggagaactttcttgaacgtcggttacagacacttgtgttcaagactggtatggctaagtctattcatcatgctagagttctcatcaagcagagacacattagggttggaaggcaggtggtgaatgtgccgtctttcatggtgagagttgactcgcagaagcacattgacttttcgctcactagtccgtttggcggtggccgaccgggaagagtgaagcgaaagaaccagaaggcggctgctaagaaagcggctggtggggatgctgatgaggatgatgaagaatgagctcgctcttttggttctgagtattagtgttgttttgctattgcgtgaggtctaatgagcatttgttattgctataatgactttttgtaggaagttttggatgctttgcaaagtcttttggtgattttatcaagtcattttatggattttttatgctttgaagttgttatttagaactcatttaattgcatatagaacatcaacatgtttt

SEQ ID NO: 2644 - DNA, 804 bp, Helianthus annuus
ggatttctcacggcgtctccgttttcagcgaaggaagaacgtgagaagagcagcaagcagttgctgcactgaaattggacagcgatggtccatgtgtcattttatcgaaactatggaaagactttcaagaagccccgtcgtccatacgagaaggaacgtttggacgctgagttaaaactcgtaggagaatacggtctccgatgcaaacgcgagctctggagggtgcaatacgctcttagtcgaattagaaatgccgcaagaatgcttttgaccctcgaagaaaaggacccccgtcgaattttcgagggtgaagcacttatgaggagaatgaaccgttacgggcttttggatgagagccaaaacaagcttgattatgtattggcacttaccgttgagaactttctagaacgtcgtttgcagacactcgtgttcaaaaccggtatggctaagtctattcatcatgctagagtgctcatcaagcagaggcacatcagggttggaaggcaagtggtgaatgttccgtctttcatggtgagagttgactcacagaagcacattgacttctcgctcacaagtccctttggtggtggccgacccggcagagttaagcgaaagaaccagaaagccgctgccaagaaggcggcaggcggtgatgccgaccaggatgatgaagaatgagctgttacctgtatcaaaggcgttcttcatctttattatctttgggggcggcggttatttattcggctttccaactttttaatcttaagaagtttggatgttttccctttgatggtaagggtttga

SEQ ID NO: 2645 - DNA, 898 bp, Helianthus annuus
cgctgttgcaggttcattcagatctctaaaccctaattatcagcatcagcagtaaaaggaacacgcgatcgctacatagtcagtgaatttgttcaacaatggttcacgtgtcattttaccgcaactatgggaagacttttaagaagccccgacgcccttacgagaaggagcgtttggatgcagaactaaagctcgttggagagtacggtcttcgatgcaaaagggaactctggagggtgcaatatgctcttagcaggattagaaatgctgcaagaatgcttttgactctcgaagagaaggacccacgtaggatttttgagggtgaagcgcttatgcgaagaatgaaccgttacgggcttttagacgagagtcaaaataagcttgattacgttctggctcttactgttgagaactttctagaacgccgtttgcagacacttgtgtttaaaactggtatggctaagtctattcaccatgctagagtccttatcaagcagaggcacatcagggtcgggcgacaagtggtgaacgtaccgtcattcatggtgagggttgactcacagaaacacattgacttttctctcactagtccgtttggtggtggccgaccaggcagagtgaagcgaaagaaccagaaggccgctgcaaagaaggcggcaggtggtgatgctgatgaggatgatgaagaatgagctgacgcctactttttgttaaatcaaaggtttcatgtttattgtcttacagtttgcggaactttttaatgtttgaaagttttcaactgctttcttgttaagaattttataatggattttgcattaatgtctaccgcaaaaagggcacggactggccgggccgcccctcgtccgggtcttaatcaaggctatttttatcttcggcg

SEQ ID NO: 2646 - DNA, 805 bp, Helianthus annuus
ggccgccgggagccagaagaagagatcattcaactagccgccgtcgtcgtaacgacgtcgtacaacaatggttcacgtctccttctaccgcaactatggtaagacattcaagaagccacgacgtccttatgagaaggaacgtttggacgctgagttgaagcttgttggtgaatacggtcttagatgcaagcgtgagctctggagggtgcagtatgccttgagccgcatccgtaatgctgcaagaatgcttctgacccttgaggagaaagacccacgtaggatctttgagggtgaagctcttatgaggagaatgaaccgatatggtctgcttgatgagagccagaacaagctcgattacgtgttggcccttactgtcgagaactttcttgaacgccgtcttcagacccttgtgtttaagactggtatggctaagtcgattcaccacgctagagttctcattaagcagagacacatcagggttggaaggcaggtggtgaatgtgccttcatttatggtgagagttgactcacagaagcacattgacttctcgctcactagtcccttcggaggtggccggccaggaagagtgaagcgaaagaaccagaaggcagctgcgaagaaggctgctggtggggatgctgacgaggatgacgaagaatgagcttacgtgcctggttcttagttttattgttggtttttatgtttttacttggatttagttaaatgataagtttatgctttggaattgctattttgaaacttattatcatatcattatgcttttatagaacattgccgtgtttgc

SEQ ID NO: 2647 - DNA, 829 bp, Helianthus annuus
atttctcacggcgtctccgttttcagcacaggaagaaagtgagaagagcagcaagcagttgctgcactgaagttggacaacaatggtccatgtgtcgttttatcgaaactatggaaagactttcaagaagccccgtcgtccatacgagaaggaacgtttggacgctgagttaaaactcgtgggagaatacggtctccgatgcaaacgcgagctctggagggtgcaatacgctcttagtcgaattagaaatgccgcaagaatgcttttgacccttgaagaaaaggacccccgtcgaattttcgagggtgaagcacttatgaggagaatgaaccgttacgggcttttggatgagagccaaaacaagcttgattatgtgttggcacttaccgttgagaactttctagaacgtcgtttgcagacactcgtgtttaaaaccggtatggctaagtctattcatcatgctagagtgctcatcaagcagaggcacatcagggttggaaggcaagtggtgaatgttccgtcgttcatggtgagagttgactcacagaagcacattgacttctcgctcacaagtccctttggcggtggccgacccggcagagttaagcgaaagaaccagaaagccgctgccaagaaggcggcaggcggtgatgccgacgaggatgatgaagaatgagctgttacttatatcaaaggctttcttcatctctattatctttgtggtcgtcgtttatttattcgttgtctttcgaacctttttactcttaggaagttttggatgttggtttcgctttgttaaggttttgatatcggattatgttttaatatg

SEQ ID NO: 2648 - DNA, 832 bp, Helianthus annuus
cgctgttgcaggttcattcagatctctaaaccctaattatcagcatcagcagtaagaggaacaagcaatcgctacattgacagtgaatttgttcaacaatggttcacgtgtcattttaccgcaactatgggaagacttttaagaagccccgacgcccttacgagaaggagcgtttggatgcagaactaaagctcgttggagagtacggtcttcgatgcaaaagggaactctggagggtgcaatatgctcttagcaggattagaaatgctgcaagaatgcttttgactcttgaagagaaggacccacgtaggatttttgagggtgaagcgcttatgcgaagaatgaaccgttacgggcttttagacgagagtcaaaataagcttgattacgttctggctcttactgttgagaactttctagaacgccggttgcagacacttgtgtttaaaactggtatggctaagtctattcaccatgctagagtcctcatcaagcagaggcacatcagggtcgggcgacaagtggtgaacgtaccgtcattcatggtgagggttgactcacagaaacacattgacttttctctcactagtccgtttggtggtggccgaccaggcagagtgaagcgaaagaaccagaaggccgctgcaaagaaggcggcaggtggtgatgctgatgaggatgatgaagaatgagctgccgcctactttttgttaaatcaaaggtttcatgtttattgtcttacagtttgcggaactttttaatgtttgaaagttttcaactgctttcttgatctttttgttaagaattttataatggattttgcattaatgtc

SEQ ID NO: 2649 - DNA, 792 bp, Helianthus annuus
ggccgccgggagccagaagaagagatcattcaactagccgccgtcgtcgtaacgacgtcgtacaacaatggttcacgtctccttctaccgcaactatggtaagacattcaagaaaccacgacgtccttacgagaaggaacgtttggacgctgagttgaagcttgtcggtgaatacggtcttagatgcaagcgtgagctctggagggtgcagtatgccttgagccgcatccgtaacgccgcaagaatgcttctgacccttgaggagaaagacccacgtaggatctttgagggtgaagcccttatgaggagaatgaaccgatatggtctgcttgatgagagccagaacaagctcgattacgtgttggcacttactgtcgagaactttcttgaacgtcgtcttcagacccttgtgttcaaaactggtatggctaagtcgattcaccacgctagagttctcattaaacagagacacatcagggttggaaggcaggtggtgaatgtgccttcatttatggtgagagttgactcacagaagcacattgacttctcgctcactagtcccttcggaggtggccgaccaggaagagtgaagcgaaagaaccagaaggcggctgcgaagaaggctgctggtggggatgctgacgaggatgacgaagaatgagcttacgtgcctggttcttagttttattgttggtttttatgttttttcttggatttagttaatgataagtttatgctttggagttgctattttgaaacttattatcatatcattatgcttttatagaacat

SEQ ID NO: 2650 - DNA, 864 bp, Helianthus annuus
ttatggcctgtagccgggagccagaagaagagatcattcaactagccgccgtcgtcgtaacgacgtcgtacaacaatggttcacgtctccttctaccgcaactatggtaagacattcaagaagccacgacgtccttacgagaaggaacgtttggacgctgagttgaagcttgtcggtgaatacggtcttagatgcaaacgtgagctctggagggtgcagtatgccttgagccgtatccgtaacgctgcaagaatgcttctgacccttgaggagaaagacccacgtaggatctttgagggtgaagcccttatgaggagaatgaaccgatatggtctgcttgatgagagccagaacaagctcgattacgtgttggcacttactgtcgagaactttcttgaacgtcgtcttcagacccttgtgttcaaaactggtatggctaagtcgattcatcatgctagagttctcattaaacagagacacatcagggttggaaggcaggtggtgaatgtgccttcgtttatggtgagagttgactcacagaagcacattgacttctcgctcactagtcccttcggaggtggccgaccaggaagagtgaagcgaaagaatcagaaggcggctgcgaagaaggctgctggtggggatgctgacgaggatgacgaagaatgagcttacgtgcctggttcttagttttattgttggtttttatgttttttcttggatttagttaatgataagtttatgctttggagttgctattttgaaacttattatcatatcattatgcttttatagaacattgctgtgtttgctgatctctttttaccgggtttctttgcgttgtttatttttatagtaaaaatc

SEQ ID NO: 2651 - DNA, 859 bp, Helianthus annuus
ggttgatttctcacggcgtctccgttttcagcgaaggaagaaagtgagaagagcagcaagcagttgctgcactgaaattggacagcgatggtccatgtgtcattttatcgaaactatggaaagactttcaagaagccccgtcgtccatacgagaaggaacgtttggacgctgagttaaaactcgtaggagaatacggtctccgatgcaaacgcgagctctggagggtgcaatacgctcttagtcgaattagaaatgccgcaagaatgcttttgacccttgaagaaaaggacccccgtcgaattttcgagggtgaagcacttatgaggagaatgaaccgttacgggcttttggatgagagccaaaacaagcttgattatgtgttggcacttaccgttgagaactttctagaacgtcgtttgcagacactcgtgttcaaaaccggtatggctaagtctattcatcatgctagagtgctcatcaagcagaggcacatcagggttggaaggcaagtggtgaatgttccgtcgttcatggtgagagttgactcacagaagcacattgacttctctctcacaagtccctttggcggtggccgacccggcagagttaagcgaaagaaccagaaagccgctgccaagaaggcggcaggcggtgatgctgacgaggatgatgaagaatgagctgttacttatatcaaaggctttcttcatctctattatctttgtggtcgtcgtttatttattcgtctttcgaacctttttatccttaggaagttttggatgttttcgctttgatgttaaggttttgatatcggattgtgttttaatatgctaaaacatggtgtttaatgttttaagg

SEQ ID NO: 2652 - DNA, 874 bp, Helianthus annuus
ggggttgcggttgatttctcacggcgtctccgttttcagcgaaggaagaaagtgagaagagcagcaagcagttgctgcactgaaattggagaacaatggtccatgtgtcattttatcgaaactatggaaagactttcaagaagccccgtcgtccatacgagaaggaacgtttggacgcggagttaaaactcgtaggagaatacggtctccgatgcaaacgcgagctctggagggtgcaatacgctcttagtcgaattagaaatgccgcaagaatgcttttgacccttgaagaaaaggacccccgtcgaatttttgagggtgaagcccttatgaggagaatgaaccgttacgggcttttggatgagagccaaaacaagcttgattatgtgttggcacttaccgttgagaactttctagaacgtcgtttgcagacactcgtgttcaaaaccggtatggctaagtctattcatcatgctagagtgctcatcaagcagaggcacatcagggttggaaggcaagtggtgaatgttccgtctttcatggtgagagttgactcacagaagcacattgacttctcgctcacaagtccctttggtggtggccgacccggcagagttaagcgaaagaaccagaaagccgctgccaagaaggcggcaggcggtgatgccgacgaggatgatgaagaatgagctgttacttatatcagaggctttcttcatctctattatctttgtggacttcgtttatttattcgtctttcgaacctttttatccttaggaagttttggatgttgttttcgttttgatgttaaggttttgatatcggattatgttttaatatgctaaaacatggtgtttaatgttttaaggttgg

SEQ ID NO: 2653 - DNA, 845 bp, Helianthus annuus
cgggggaattagggttccattaacatttcagtagcagcacaggccgccgggagccagaagacgagatcattcaactagccgccgtcgtcgtaacgacgtcgtacaacaatggttcacgtctccttctaccgcaactatggtaagacattcaagaagccacgacgtccttatgagaaggaacgtttggacgctgagttgaagcttgttggtgaatacggtcttagatgcaagcgtgagctctggagggtgcagtatgccttgagccgcatccgtaacgctgcaagaatgcttctgacccttgaggagaaggacccacgtaggatctttgagggtgaagctcttatgaggagaatgaaccgatatggtctgcttgatgagagccagaacaagctcgattacgtgttggcacttactgttgagaactttcttgaacgccgtcttcagacccttgtgttcaaaactggtatggctaagtcgattcaccacgctagagttctcattaaacagagacacatcagggttggaaggcaggtggtgaatgtgccttcgtttatggtgagagttgactcacagaagcacattgacttctctctcactagtcccttcggaggtggccggccaggaagagtgaagcgaaagaaccagaaggcggctgcgaagaaggctgctggtggggatgctgacgaggatgacgaagaatgagcttacgtgcctggttcttagttttattgttggtttttatgttttttgttggatttagttaatgataagtttatgctttggagttgctattttgaaacgtattatcatatcattatgcttttatagaacatcgccgtgtttgc

SEQ ID NO: 2654 - DNA, 834 bp, Helianthus annuus
cgctgttgcaggttcattcagatctctaaaccctaattatcagcatcagcagtaagaggaacaagcaatcgctacattgacagtgaatttgttcaacaatggttcacgtgtcattttaccgcaactatgggaagacttttaagaagccacgacgtccttacgagaaggagcgtttggatgcagaactaaagctcgttggagagtacggtcttcgatgcaaaagggaactctggagggtgcaatatgctcttagcaggattagaaatgctgcaagaatgcttttgactctcgaagagaaggacccacgtaggatttttgagggtgaagcgcttatgcgaagaatgaaccgttacgggcttttagacgagagtcaaaataagcttgattacgttctggctcttactgttgagaactttctagaacgccgtttgcagacacttgtgtttaaaactggtatggccaagtctattcaccatgctagagtcctcatcaagcagaggcacatcagggtcgggcgacaagtggtgaacgtaccatcattcatggtgagggttgactcacagaaacacattgacttttctctcactagtccctttggcggaggccgaccaggcagagtgaagcgaaagaaccagaaggccgctgcaaagaaggcggcaggtggtgatgctgatgaggatgatgaagaatgagctgtcacctacattttgttaaatcaaaggtttcatgtttattgtcttacatatttgcagaactttttaatgtctgacagttttcaattgttttcttgatctttttgttaagaatttttataatggattttgcattaatgtc

SEQ ID NO: 2655 - DNA, 753 bp, Helianthus annuus
cggcgtctccgttttcagcaaaggaagaaagtgagaagagcagcaagcagttgctgcactgaaattggacagcaatggtccatgtgtcattttatcgaaactatggaaagactttcaagaagccccgtcgtccatacgagaaggaacgtttggacgctgagttaaaactcgtaggagaatacggtctccgatgcaaacgcgagctctggagggtgcaatacgctcttagtcgaattagaaatgccgcaagaatgcttttgacccttgaagaaaaggacccccgtcgaattttcgagggtgaagcacttatgaggagaatgaaccgttacgggcttttggatgagagccaaaacaagcttgattatgtgttggcacttaccgttgagaactttctagaacgtcgtttgcagacactcgtgttcaaaaccggtatggctaagtctattcatcatgctagagtgctcatcaagcagaggcacatcagggttggaaggcaagtggtgaatgttccgtcgttcatggtgagagttgactcacagaagcacattgacttctcgctcacaagtccctttggcggtggccgacccggcagagttaagcgaaagaaccagaaagccgctgccaagaaggcggcaggcggtgatgccgacgaggatgatgaagaatgagctgtttcttatatcacaggctttcttcatctctataatctttgtggtcgtcgtttatttattcgtctttcgaacctttttatcc

SEQ ID NO: 2656 - DNA, 825 bp, Helianthus annuus
aaggaagaaagtgagaagagcagcaagcagttgctgcactgaaattggacagcaatggtccatgtgtcattttatcgaaactatggaaagactttcaagaagccccgtcgtccatacgagaaggaacgtttggacgcggagttaaaacttgtaggagaatacggtctccgatgcaaacgcgagctctggagggtgcaatacgctcttagtcgaattagaaatgccgcaagaatgcttttgacccttgaagaaaaggacccccgtcgaattttcgagggtgaagcacttatgaggagaatgaaccgttacgggcttttggatgagagccaaaataagcttgattatgtgttggcacttaccgttgagaactttctagaacgtcgtttgcagacactcgtgttcaaaaccggtatggctaagtctattcatcatgctagagtgctcatcaagcagaggcacatcagggttggaaggcaagtggtgaatgttccgtcgttcatggtgagagttgactcacagaagcacattgacttctcgctcacaagtccctttggcggtggccgacccggcagagttaagcgaaagaaccagaaagctgctgccaagaaggcggcaggcggtgatgccgacgaggatgatgaagaatgagctgttactcatatcagaggctttcttcatgtctattatctttgtggacgtcgtttatttattcgtctttcgaacctttttatccttgggaagttttggatgttgtttttcgctttgatgttaaggttttgatatcggattatgttttatatgctaaaacatggtgtttaatgtttt

SEQ ID NO: 2657 - DNA, 799 bp, Helianthus annuus
ggccgccgggagccagaagaagagatcattcaactagccgccgtcgtcgtaacgacgtcgtacaacaatggttcacgtctccttctaccgcaactatggtaagacattcaagaagccacgacgcccttacgagaaggaacgtttggatgctgagttgaagcttgttggtgaatacggtcttagatgcaagcgtgagctctggagggtgcagtatgccttgagccgcatccgtaacgccgcaagaatgcttctgacccttgaggagaaagacccacgtaggatctttgagggtgaagcccttatgaggagaatgaaccgatatggtctgcttgatgagagccagaacaagcttgattacgtgttggcccttactgtcgagaactttcttgaacgccgtcttcagacccttgtgttcaagactggtatggctaagtcgattcaccacgctagagttctcattaaacagagacacatcagggttggaaggcaggtggtgaacgtaccttcatttatggtgagagttgactcacagaagcacattgacttctcgctcactagtcccttcggaggtggccgaccaggaagagtgaagcgaaagaatcagaaggcggctgcaaagaaggctgctggtggggatgctgacgaggatgatgaagaatgagcttacatgcctggttcttagttttatggttggtttttatgttttttcttggatttagttgatgataagtttatgcttgggagttactattttgaaactgattatcatatcattatgcttttatagaacatcgccgtg

SEQ ID NO: 2658 - DNA, 805 bp, Helianthus annuus
ggccgccgggagccagaagaagagatcattcaactagccgccgtcgtcgtaacgacgtcgtacaacaatggttcacgtctccttctaccgcaactatggtaagacattcaagaagccacgtcgtccttatgagaaggaacgtttggacgctgagttgaagcttgttggtgaatatggtcttagatgcaagcgtgagctctggagggtgcagtatgccttgagccgcatccgtaacgctgcaagaatgcttctgacccttgaggagaaagacccacgtaggatctttgagggtgaagctcttatgaggagaatgaaccgatatggtttattggatgagagccagaacaagcttgattatgtgttggccctcactgtcgagaactttcttgaacgccgtcttcagacccttgtgttcaaaactggtatggctaagtcaattcaccacgctagagttctcattaagcagagacacatcagggttggaaggcaggtggtgaatgtgccttcatttatggtgagagttgactcacagaagcacattgacttctcgctcactagtcccttcggaggtggccgaccaggaagagtgaagcgaaagaaccagaaggcggctgcgaagaaggctgctggtggggatgctgatgaggatgacgaagaatgagcttatgcctctggttcttagtttcattgttggtttttatgtttttttcaaggatttagttaatgataagtttttgctttggagttgctattttgaaacttattatcatatcattatgcttttatagaacatcgccgtgtttgc

SEQ ID NO: 2659 - DNA, 839 bp, Helianthus annuus
aattagggttccattaacatttcagaagcagcgcaggccgccgggagccagaagaagagatcattcaactagccgccgtcgtcgtaacgacgtcgtacaacaatggttcacgtctccttctaccgcaactatggcaagacattcaagaagccacgacgtccttatgagaaggaacgtttggacgctgagttgaagcttgtcggtgaatacggtcttagatgcaagcgtgagctctggagggtgcagtatgccttgagccgcatccgtaacgctgcaagaatgcttctgacccttgaggagaaagacccacgtaggatctttgagggtgaagctcttatgaggagaatgaaccgatatggtttattggatgagagccagaacaagcttgattatgtgttggccctcactgtcgagaactttcttgaacgccgtcttcagacccttgtgttcaaaactggtatggctaagtcgattcatcacgctagagttctcattaagcagagacacatcagggttggaaggcaggtggtgaatgtgccttcatttatggtgagagttgactcacagaagcacattgatttctcactcactagtcccttcggaggtggccgaccaggaagagtgaagcgaaagaaccagaaggcggctgcgaagaaggctgctggtggggatgctgatgaggatgacgaagaatgagcttacgtgcctggttcttagttttattgttggtttctatgttttttcttggatttagttaatgataagtttatgctttggagttgctattttgaaacttattatcatatcattatgcttttatagaacattgccatgtttgc

SEQ ID NO: 2660 - DNA, 814 bp, Helianthus annuus
acggcgtctccgttttcagcacaggaagaagtgagaagagcagcaagcagttgctgcactgaaattggacaacaatggtccatgtgtcattttatcgaaactatggaaagactttcaagaagccccgtcgtccatacgagaaggaacgtttggacgcggagttaaaactcgtaggagaatacggtctccgatgcaaacgcgagctctggagggtgcaatacgctcttagtcgaattagaaatgccgcaagaatgcttttgacccttgaagaaaaggacccccgtcgaattttcgagggtgaagcacttatgaggagaatgaaccgttacgggcttttggatgagagccaaaacaagcttgattatgtgctggcacttaccgttgagaactttctagaacgtcgtttgcagacactcgtgttcaaaaccggtatggctaagtctattcatcatgctagagtgctcatcaagcagaggcacatcagggttggaaggcaagtagtgaatgttccgtctttcatggtgagagttgactcacagaagcacattgacttctcgctcacaagtccctttggcggtggccgacccggcagagttaagcgaaagaaccagaaagccgctgccaagaaggcggcaggcggtgatgccgacgaggatgatgaagaatgagctgttacttgtatcaaaggctttcttcatctctattatctttgttggacgtcgtttatttattcgtctttcgaacctttttattccttaggaagttttggatgttttcgctttgatgttaaggttttgatatcggattatgtttt

SEQ ID NO: 2661 - DNA, 938 bp, Amsonia hubrichtii
gtatttgcggaggagttcgccgagccgagctgaagatcacggcagcggcgggcagcagcagccaacatggtgcacgtctccttttatcgcaactatggtaagaccttcaagaagccccgtaggccctatgagaaggagcgtttggacgcagaactgaagcttgtgggagaatatgggctgcggtgcaagagggaactctggagggttcaatatgtgttgagccgtatcagaaatgcagcaagaaatctattgactttggatgagaaggacccacgccgtatctttgagggtgaagccctgctgaggaggatgaacaggtatggtctgctggatgaaagccagaacaagctcgattatgtcttggctttgactgtagagaactttcttgagcgccgccttcaaacccttgttttcaagactggaatggcaaagtcaattcaccatgccagagtgctcatcaggcaaaggcatatcagggttggaaggcaggttgtcaatgttccttcttttatggttagagtggactctcagaagcacattgacttctcacttacaagtccttttggtggtgggcgccctggtagagtgaagagaaagaacatgaaggcagctgcaaagaaggctgcaggtggtgatggagatgaagaagaagaagaatgaaacttctgttttaatttagtcatcaattataatattggagaatgtcagtcagacctcgtttcttttgtccgtgtaataccacccgctaagatttttgcagtttctttcaaggctttgatatgtgtaggaattttggatgatttttgtggcttattttggcagcttattaccagaatctgttattttaaatatcctaatgtttttaaggattaaattggcaaattgagttattttgctgcatatttgtttgaggaaacaatctcatagaatccaaaaaa

SEQ ID NO: 2662 - DNA, 879 bp, Artemisia annua
agggtttcattctaagcagcagcagcagcgccgaacaacaatatggttcacgtctcattttaccgcaactatggcaaaactttcaagaagccaagacgtccttatgagaaggagcgtttggatgctgagttgaagcttgtcggagagtatggtcttcgatgcaaaagggagctctggagggtgcagtatgctcttagccgtatccgtaatgctgcacgtatgcttttgacccttgaggagaaggacccacgtcgtatctttgaaggtgaagctcttatgaggagaatgaacagatatggtcttctggatgagagtcagaacaagctcgattacgtgttggctcttactgttgagaactttcttgaacgtcgtcttcagacacttgtgtttaagactggcatggctaagtctatccatcatgctagagttctcatcaagcagagacatatcagggttggaaggcaggtggttaatgtgccatccttcatggtcagagtggactcacagaagcacatagatttctcacttactagtccgtttggaggtggtcgacctggaagagtgaagcgaaagaatcagaaggcagctgctaagaaggctgcaggaggagatgctgatgaggatgacgaagaatgagcttactcggctggttctaaaatttgatgttactatctgttgtcatagcaactctttgtaggaagttttggatattttatgttgcatctgctctctttttgtggatttagattatgcttttgaggtcctaaagtatgtgttttgaacttgagattacagttggttctaaagtaaaggatcttattctatttcgtcatcaaaaaaaaaaaaaaaatacatgtcggatctagaatgagtgcgtct

SEQ ID NO: 2663 - DNA, 905 bp, Artemisia annua
tactccgacggggctctgagattttagcagccgccggatcatcatcatcgacgtcgaacaaggatggttcacgtctctttttaccgcaactatggcaaaactttcaagaagccccgtcgtccttatgagaaggagcgtttggatgctgagttgaagctggtcggagagtatggtcttcgatgcaaaagggagctctggagggtgcaatatgctcttagccgtatccgtaatgctgcacgtatgcttttgacccttgaggagaaggacccacgtcgtatctttgaaggtgaagctcttatgaggagaatgaacagatatggtctgttggatgagagtcagaacaagcttgattatgtgttggctcttactgtggagaactttcttgagcgtcgtctccagactcttgtcttcaagactggtatggccaagtctatccaccatgctagagttcttatcaagcagagacacatcagggtgggaaggcaggtggtgaatgtgccatctttcatggtgagagtagactcacagaagcacattgatttctcactcactagcccatttggaggaggccgacctggaagagtgaagcgaaagaaccagaaggctgctgcaaagaaggctgcaggtggtgatgctgatgaggatgatgaagaatgagcacagatggctctatatcgaaggtcaacgagtattaagttcatcataatgtctttgtaggaagttttggatgctttgctggaatatttgatgccgtttgtatttgtctttctgtggatttagttaaatgattagataatgctttcaagttgctcagttatgtggttgattaaaacttgatattactgtggtttaaaaattaagatcatattctctcttttggtatttataaaatatcgacatgtttc

SEQ ID NO: 2664 - DNA, 1164 bp, Catharanthus roseus
aggtttagtcttgttcgagttcattttgtatcggctcttagaagagcagatcgccgagctgaagatcaccggcagaggcgggcggcagctgagaagatggtgcacgtttccttttatcgcaactatggtaagaccttcaagaagccccgtaggccctatgagaaggagcgtttggatgctgagttgaagcttgttggagaatatgggttgaggtgcaagagggagctttggagggttcaatatgttttgagccgtatcagaaatgctgcaagaaatctattgactttggatgagaaggacccacgtcgtatctttgagggtgaagcccttttgaggaggatgaacaggtatggtctgcttgatgagggccaaaacaaacttgattatgtcttggctctgactgtagagaacttccttgagcgccgccttcaaacccttgttttcaagtctgggatggcaaagtcaatccaccatgccagagtgctcattaggcaaaggcacataagggttggaaagcaggttgtcaatgttccttccttcatggttagagttgactctcagaagcacattgacttctcaattacaagtcccttcggtggtggtcgtcctggcagagtgaagagaaagaacatgaaggcagctgcgaagaaggcatctggtggtgatggagatgaagaggatgaagaataagcattttgctttgatttagtcattgatcataatactgaaggatatcaatcagaccttgtttctattctccatgtaatgctgccctctaagattttttgcagttcaaagacttttcatacatgtaggaagttttggatgttttttttgtggctttcttgaaatcattatcaccagaaatgattacctttaagctttctgatgtagtaacttctgagagttaattatcaattgagttaatttgctcatttgtttgaggaaccatttaatatctgttagatttttgccccatatctagtgctaagtcactctatgctggtttggagtgttggatcctgatttttttgccatcgtagtgagtcactagggttagattatatttgctcatttgagtttcaagtactttcctgaatttacctggaaaaggtacttatgtttagccctgatgatcaaaaagatgcttaaactgattctgcc

SEQ ID NO: 2665 - DNA, 916 bp, Centaurea maculosa
  misc_feature (35)..(36): n is a, c, g, or t
  misc_feature (879)..(879): n is a, c, g, or t
cgcggggattttctgtattagggttttctttcggnngtctcttcgaagcatcggaggctgccggagaagatatcgcatcgcgtagccgccggattgccaccggacaaccatggttcacgtccccttctaccgcaactatggcaagacttttaagaagcctcgtcgtccttatgagaaggagcgattggatgctgagttgaagcttgtgggagagtatggtcttcgatgcaaaagggagctttggagggtgcagtatgctcttagtcgcattcgtaatgctgcaagaatgcttctgacccttgaagagaaggacccacgtcgaatttttgagggtgaggcccttatgaggaggatgaacaggtacggtcttttggacgagagtcagaacaagctcgattatgtgcttgccctcactgtcgagaactttcttgagcgccgtctccagacacttgtgttcaagactggtatggccaagtctatccaccatgctagagttctcatcaagcagagacacatcagggtgggaaggcaggtggtgaatgtaccatccttcatggtgagagtggactcacagaagcacatagacttctcactcacaagtccgtttggcggtggccgacctggcagagttaagcgaaagaaccagaaggccgctgcaaagaaggctgctggtggggatgctgacgaggaggatgaagaatgagcttgataggtaggagggtgaggtatcgcttgcagtcttgagtcctatgagtattagttatcttgggtaataactctttgtaggaagttttgggaagcttttacttggtcttttctatggatttaattgatagcttgattatgcaaatggggttttgctaaaattatgtgattgantaaatttgatattttctgttggctgggctgtttttga

SEQ ID NO: 2666 - DNA, 865 bp, Castanea mollissima
ctctgcacttctctgctgatccgaagcaatggtgcacgtcgttttctaccgcaactatgggaagactttcaagaagccgcgtcgtccatatgagaaggagcgattggaccacgagctgaggcttgtgggagaatatgggctccgatgtaagagggagttgtggagggttcaatatgctttgagccgcatccgaaatgctgccagggagcttcttactcttgatgaaaagaaccctcgtcggatctttgagggtgatgcccttttgcgcaggatgaaccggtatggacttttggatgagagccagaacaagcttgattatgtcctggccttgaccgtggagaactttcttgagcgccggctccaaacccttgtgttcaagtcgggtatggccaagtctattcaccatgctcgagtgcttattaggcagaggcatatcagggttgggaggcaggtggttaacataccatctttcatggtgagagttgattctcagaagcacattgatttctcccttgctagtcccttcggaggtggtcgccctggaagagtgaagcgaaagaaccagaaagcagctgccaagaaggcttctggtggggatggaggtgaggaggatgaagaatgaagcttaggctagctccaaccctaggaactatttgagttttttttcctatctggcatctttatgtttgtcacttgttcgcttacctgacatttgttttcaaatctttatcctagtgaattttagtacatgtttcattttggtttatttggaatagaacttgaaagcactcctatggatcactgagattttgtttaattaatgaaaattttggcagttgatgcctatatctattttatttggaaa

SEQ ID NO: 2667 - DNA, 879 bp, Cichorium intybus
aggcgggggagcgcattcgccgctcggggagggaggacagagcgaacgccggattgacgtcctgcaacaatggtgcacgtttcgttttatcgcaactacggtaaaacattcaagaagccccgtcgtccatatgagaaggaacgtctagacgctgagctcaaactcgtcggagaatatggtctccgatgcaaaagagagctctggagggtccaatacgctctcagccgtatccgtaacgccgcgagaatgcttttaactcttgaagagaaagatccacgaagaatcttcgaaggtgaagctctcatgaggagaatgaacaggtacggtttactcgatgaaagccaaaacaagctcgattacgttcttgccctaacagtcgaaaacttcctcgaacgtcgtcttcaaaccctcgtcttcaaaactggtatggccaaatccatccaccatgctagagtcctcatcaaacaaaggcacatcagagttggaaggcaagttgtgaatgttccatcgttcatggtgagggtggactcacagaaacatattgatttctcactcacgagtccgttcggtggtggccgacctggaagagtaaagaggaagaaccagaaagcagccgctaaaaaggctgccggaggtgatgctgatgaagacgatgaagaatgagcattttgataattgttacatcgatcatgctttaccaccatgaggactaaaaaagtgagtgtttttgttcttttgattactttagacttttgttattagtggattcttggtggtttttaagaagctattgttggttgattttctgttaaagattttgtaatggattatggatttagggttatctaaagtttatgtttgtttaagttttgcaaaaaa

SEQ ID NO: 2668 - DNA, 895 bp, Cichorium intybus
cggcacacaggggaggccgccgagagagtgagaggaagacatcaatcaagtagccgccggatcgaccttgaacaacaatggttcacgtctccttctatcggaattatggcaaaacttttaagaagcctcgtcgtccttacgagaaggagcgattggatgctgagttgaagttggtcggagagtatgggcttagatgcaaacgggaactctggcgtgttcagtacgctctcagcagaatccgtaatgcagctagaatgcttttgactcttgaggagaaagatccacgtaggatctttgaaggtgaagctcttatgagaaggatgaacaggtatggtctgttggatgagagccaaaacaaactcgattatgttcttgctcttactgttgagaacttccttgagcgccgccttcagacacttgtcttcaagactggtatggccaagtcaatccaccatgctagagtcctcatcaaacagagacacataagggtgggaaggcaggtggtgaatgtgccatctttcatggtgcgtgttgactcacagaagcatattgacttttcactgacgagtccatttggaggtgggcgacctggaagagtgaagaggaagaatcagaaggcagctgcaaagaaggcgtctggtggtgatgctgatgaagatgatgaagagtgaggtttaaaagttaagatattgtgaggtttatgagtatttgttatcttgataataactcttttgtaggaagttttggatgattttggaagttttttcttggttttaatttatgtggattcagttgatgatatatgtgttgggggtaggatattgggtgatgatgataatcctaaacctttgaattatttcaaattataaaaatgcaataatagtatgtttttttt

SEQ ID NO: 2669 - DNA, 769 bp, Cirsium arvense
tacttcagaagcatcggaggctgccggagaaagatatcgcatcgcgtagccgccggatcgccgccggacaaccatggttcacgtccccttctatcgcaactatggtaagacttttaagaagcctcgtcgtccttatgagaaggagcgattggatgctgagttgaagcttgtgggagagtatggtcttcgatgcaaaagggagctttggagggtgcagtatgctcttagtcgcattcgtaatgctgcaagaatgcttctgacccttgaagagaaggacccgcgtcggatttttgagggtgaggcccttatgaggaggatgaacaggtacggtcttttggacgagagtcagaacaagctcgattatgtgcttgccctcactgtcgagaacttccttgagcgccgtcttcagacacttgtgttcaagactggtatggccaagtctatccaccatgctagagttctcatcaagcagagacacatcagggtgggaaggcaggtggtgaatgtaccatccttcatggtgagagtggactcacagaagcacatagacttttcactcacaagtccgtttggcggtggccgacctggcagagttaagcgaaagaaccagaaggccgctgcaaagaaggctgccggtggggatgctgacgaggaggatgaagaatgagcttgctaggtaggagggtgagggtatcgcttgcagtcttgagtcctatgagtattagttatcttggtaataactctttgtaggaagttttgggatgctttt

SEQ ID NO: 2670 - DNA, 876 bp, Cirsium arvense
tacttcagaggcatcggagtctgccggagaaagatatcgcatcgcgtagccgccggatcgccgccggacaaccatggttcacgtccccttctaccgaaactatggcaagacttttaagaagcctcgtcgtccttatgagaaggagcgattggatgctgagttgaagcttgtgggagagtatggtcttcgatgcaaaagggagctttggagggtgcagtatgctcttagtcgcattcgtaatgctgcaagaatgcttctgacccttgaagagaaggacccacgtcgaatttttgagggtgaggcccttatgaggaggatgaacaggtacggtcttttggacgagagtcagaacaagctcgattatgtgcttgccctcactgtcgagaacttccttgagcgccgtctccagacacttgtgttcaagactggtatggccaagtctatccaccatgctagagttctcatcaagcagagacacatcagggtgggaaggcaggtggtgaatgtaccatccttcatggtgagagtggactcacagaagcacatagacttttcactcacaagtccgtttggcggtggccgacctggcagagttaagcgaaagaaccagaaggctgctgcaaagaaggctgccggtggggatgctgacgaggaggatgaagaatgagcttgctaggtaggagggtgaggtatcgcttgcagtcttgagtcctatgagtattagttatcttggtaataactctttgtaggaagttttgggatgcttttagttggtcttttttatggatttaattgatagcttgattatgcaaatcggtttttgctaaaattatgtgattgattaaattttgacaaaaagaaaaagtaccgactgcg

SEQ ID NO: 2671 - DNA, 880 bp, Coffea canephora
gagcgctctattagctctcctcatttccagatcgccgagctgaaaaccaccgcattggcgcggccgggcaacagaagcagcaatggtgcacgtctctttttaccgcaactatggaaagacatttaagaagcctcgtcgtccctatgagaaggagcggctggatgctgagttgaggcttgttggagagtatgggcttagatgcaagagggagctttggagggttcagtatgctttgagtcgcatcagaaatgcagcaagaaatcttttgactctggatgagaaagacccacgtcgtgtctttgagggcgaagcccttctgaggaggatgaacaggtatgggctgctggatgagagccagaataagctcgattatgtcttggctcttactgttgagaacttccttgagcgccgtcttcaaacacttgtgtttaagactggtatggcaaagtcaatccaccatgccagagtactcattaggcagaggcatatcagggtcgggaggcaggttgtgaatgtgccttcctttatggtcagagtggactctcagaagcacattgatttctcactcacaagtccttttggtggtggacgtgctggtagagtaaagagaaagaaccagaaggcagctgcaaagaaggctgctggtggcgatggagatgaagaggatgaagaatgaggtgtcagtttataatgtaatgggtgatatagtactggagagaatcagaactttacttttgctcctgtaatactgtctcctaaattgtttgtgattgctgttaaaaccttaaggtttaggaggttttggaatctttggatgcttgctgcctttttttggcttaaattattatggaacttttatcattattgcttgaggtttatt

SEQ ID NO: 2672 - DNA, 966 bp, Gossypium hirsutum
ttcgctttctcgcctccgagaagaagccgacgccgccatggttcacgtcagtttctaccgcaattatgggaagacatttaagaagccaaggcgtccatacgagaaggaacgtttggatgctgagttgaggcttgtaggagaatatggtctccgatgtaagagggagttgtggagggttcaatatgctttgagtcgaatcagaaatgctgctagggatcttcttactcttgatgagaagaaccctcgtcgtattttcgaaggtgaagctcttcttcgtaggatgaacaggtatggacttttggatgagagtcagaacaagctcgattatgtcttggctttgaccgttgagaacttccttgaacgccgcttgcaaacacttgtgttcaagactggtatggccaagtcaattcaccatgctcgtgtgttgattaggcaacgtcacatcagagtcggaaggcaggtggttaacatcccatcctttatggtgagggttgactcccagaaacatatcgacttctctctgataagtccgttcggaggtggccgtcctggaagagtgaagagaaagaatcagagagcagctgccaagaaggccgctggtggagatggcgatgaagaggaagacgagtaaaccttaagctagtattggcaatagggcactcctaaaagagcctctgatgggaacttaccatttcctacattattagacatggtttgagttttgtttcaagaccttttatgtagtggatgttcgcatttgtatttgtctcggattttatgttacattgagcaattttgttattttgagattaaaatgtttaaattatagttcaccattttgagcactgtcatgcattttatagctaagatgttgatgaattggcaatctgtagggttcacgatgtgtcactcacagatactgagcacttgatgatgtgttatcagtaagtatttttgttttggagc

SEQ ID NO: 2673 - DNA, 986 bp, Cucumis sativus
ggcgcttctttgtttttagggcttccgatcgagagcgcggcgggcaaggcagggagtgaagccgtaccagagaaccaaacatggtgcacgtctccttctatcgtaattatggaaagacttttaagaagcctcgacgtccttatgagaaggagcgtttggatgcggaacttaagcttgtaggtgaatatgggcttcgttgtaaaagagagctgtggagggttcaatatgcattgagccgaatccgtaataatgcaaggatgcttttaactcttgatgaaaagaatccgcgtaggatttttgagggtgaggccctgcttaggaggatgaataggtatggtcttttggatgagagtcaaaacaagctcgattatgtcttggctcttactgttgagaatttcctcgagcgtcgtctccaaactcttgtgttcaagtctggaatggctaaatctattcaccatgctagagtgctcatcagacaaaagcatataagggttgggaggcaagtggttaacatcccttctttcatggtgagagttgattcacaaaagcacatagacttctctcttaccagtccatttggaggtggacgccccggaagggtgaagagaaagaaccagaaagcagctgccaagaaggctgctggtggagatggagatgaagaagacgaggattgagttactgactagaaactcatcattagagaatggtaaaagattagccaagggtctcaggtaactgagattaacctcaacaacctatttcctgcagctagactttttcttgtattgcattgatgagaatgttacatctcttagaagttttgcgttaatttttttgtttcccatttagagctgtttttatggtggatggaactagctttcaattttggacaagcgtctgtttgaacttagtttccatagttttgttgccatgattggacctcgttactcataactcctccacatcttgaatgtattgagtttatt

SEQ ID NO: 2674 - DNA, 958 bp, Cucumis sativus
gtaaaaaaccctagcaaaccctagccgctcttcatatacctctcttcctctttttctcgtctctcttcttctttctctggcagtggagatcattcggttagtgaagccgtagcagagaagagatcatggtgcacgtttccttctataggaattatgggaagacgttcaagaaaccccgacgtccttatgagaaggagcgtctggatgcagagttgaaattggttggagaatatgggcttcgttgtaagagggagttgtggagggttcagtatgctttgagccgaatccgaaacaatgcccggatgctcttaacactcgatgagaagaatccgcgtaggatttttgaaggagaggctctccttaggagaatgaacagatatggtctcttggatgagagtcagaacaagctcgattatgtcttggctcttactgtggagaatttccttgagcgtcgtctccaaactctcgtgtttaagtctggtatggccaagtccatccaccatgctagagtgctcatcaggcagaagcatatcagggttggaaggcaggtggtgaacattccttcgttcatggtgagagtagactcccagaagcacattgacttctccctcacaagtccgttcggaggtggtcgccctggaagagtgaagagaaagaatcagaaggctgccgcaaagaaggctgctggaggagatggagatgaagaggatgaagattgagttacttaaacgttatctatctatcactattttatcagaaagaatgttacatccttagaagttttgttgctttaaatatgtttgaattagagaacttgtttgccttttttgttatggggattttattaacaacctatttggtttttagttgccacagtttttcatgctttgatattggattattttgaggactcagttcttctctatatttcaacgcattatgaattattttcacttca

SEQ ID NO: 2675 - DNA, 1011 bp, Cucurbita pepo
ttctcgtgttagggcttttgatcgagatcgcggtcggggctgaagccgctgcagagaagaaagcatggtgcacgtctccttctataggaactatgggaagacttttaagaaacctcgacgcccttatgagaaggagcgtttggatgcagaacttaaacttgtaggtgaatatgggcttcgttgtaaaagggagctatggagggttcaatatgcattgagccgaatccgtaataatgccaggatgcttttaactcttgacgaaaagaatccccgtaggatttttgagggagaggccctgcttaggaggatgaacagatacggtcttttggatgagagtcaaaacaagctcgattatgtcttggctcttactgtcgagaatttccttgagcgtcgtcttcaaactctcgtgtttaagtctggaatggccaagtctatccaccatgccagagtgctcatcagacagaagcatataagggttgggaggcaagttgttaacatcccttctttcatggtaagagtcgattcccagaagcacatagacttctctctcactagtccgtttggaggtggtcgccccggaagggtgaagagaaagaaccagaaggcagctgccaagaaggccgcaggtggtgatggagatgaagaagatgaagattgagtttctgacttaaaactcatcatctgagacagtaaagattagccaatggtctcaggtatctgagattaacctttatgtcctatttcctcctccagctaaacctatcgtaatatttttcacttagagatcttgtttgtttttggtggtgggactagttttcaattttggacaagcttctcttcggacttagttgacatagttttcttgccatgattggacttttttactcaaaattcctccgcatcatgaatgtattgagttgatttggtctagctcagcttgttgtatctagaaatgtgatccgtttcaagatttcaatgaattttaattcctaggctcgcgagctcttgaat

SEQ ID NO: 2676 - DNA, 858 bp, Cynara scolymus
  misc_feature (706)..(706): n is a, c, g, or t
  misc_feature (817)..(817): n is a, c, g, or t
  misc_feature (822)..(823): n is a, c, g, or t
  misc_feature (830)..(830): n is a, c, g, or t
tttgggctttcatctaccctatatagtcgaagaactaaatcaggcgtatttcttactacttcgacttattttgcttttctctcaaaggcagccatggttcacgtcaatttctaccgcaattatggaaaaactttcaagaagcctcgtcgtccatatgagaaggagcgtttggatgccgaattgaagctcgtaggagagtatgggctccgttgtaaaagagaactatggagggttcaatacgcattgagtcgcattcgtaatgctgcacgtatgcttctcactcttgacgagaaagacccacgccgaatttttgaaggtgaagcccttctacgtagaatgaataggtatgggcttttggatgagagccaaaacaagctcgattatgtcttggctttgactgttgagaactttcttgaacgccgtcttcaaacacttgtattcaaaactggcatggcaaagtcgattcatcatgctcgtgtgctgattaggcagaggcatatcagggttgggaggcaagtggttaatgttgcatcgttcatggtgagggtggactctcagaaacacatcgacttctctcttactagtccattcggaggtggccgtcctggaagagtgaaacgaaagaaccaaaaagccgctgctaaaaaggcttctggtggagatggagatgaagaggatgaagattgagggaatcttatcgataccngtaagtctccacatttgtaccttttacttttcaatcaatgttgttttgttacttaacagtaaacaccaagtcttcatgatttagttttcttatagtatttgttgttgtggnactcnnagtgtcnatttatacaacttttttggttgcgaatg

SEQ ID NO: 2677 - DNA, 872 bp, Taraxacum officinale
ttcggccggggagcaaacccttgtagcagcagtcgccgtcgggggaggtaagatcagagcaaacgcctgattgccgttaaacaacaatggtgcacgtctccttctaccgcaactatggaaagacgttcaagaagccacgacgtccttatgaaaaggaacgactagacgctgagttgaaactcgtcggagagtacggacttcgatgcaaaagagagctctggagggtgcaatatgctctcagcagaatccgtaacgctgcaagaatgcttcttactcttgaagagaaagatccacgaagaatcttcgaaggtgaagctctcatgaggaggatgaacaggtacggtttgctagatgagagccaaaacaagctcgattacgttcttgctctcactgttgagaactttctagaacgccgtcttcaaactctcgtcttcaaaactggtatggccaaatccatccaccatgctagagtcctcatcaaacaaaggcacatccgagttggaaggcaagttgtgaacgttccatcattcatggtgagggtggattcacagaaacacattgatttctcactcacaagtccgtttggaggtgggagacctggaagagttaagcgaaagaaccagaaagcagctgctaagaaggcttctggaggtgatgctgatgaagatgatgaagaatgatctgatgttgatcttatttgccaccatgaggtttacaagtgagtgttttgttctttgtttactttaaaactttttcttagtggattattggtggttttttaagaagttattgtttgttgattttctgttgaagattttgtaatggatttttatggggttttagagttatctaaattctatgtttacctttac

SEQ ID NO: 2678 - DNA, 838 bp, Taraxacum officinale
cttaggccggggaactttaaatcagcgcagaggtgtaggccgccggaagtgagagggagatatcactcaattaaccgccgggttgacgtcggacaaacatggttcacgtctctttctaccgcaactatggaaaaaccttcaagaagccccgtcgtccatatgagaaggagcgattagatgctgagttgaaactcgttggagagtacggccttcgctgcaaaagggagctatggagggtgcaatacgctctgagccgaatccgtaatgcagcaagaatgctcttaaccctggaagaaaaagatccacgcaggatcttcgagggagaagccctaatgaggagaatgaacagatacggtctgttggatgagagccaaaacaagctcgattacgttcttgctctaactgttgaaaacttccttgaacgtcgccttcagacccttgtcttcaaaactggtatggccaagtctatccaccatgctagagtcctcatcaagcaaagacacatcagggtgggaaggcaggtggtgaatgtaccgtctttcatggtgagagttgactcacagaagcatattgacttttcactcaccagtccatttggaggtggacgacctggaagggtgaagagaaagaaccagaaggcggctgctaagaaggcttctggtggtgatgctgatgaggatgatgaagagtgaggttcatgatgtttatgagtgcttttgttatcttggtaataactttatgtaggaagttttgaatattttgggaaatattttggttgttctttacatgatttctgtggattcagttaatgatagattatggatttcagttggacaaa

SEQ ID NO: 2679 - DNA, 865 bp, Taraxacum officinale
gcaggtttgaagctttctttccctatcaccttaacttagcaagcagctgagaaggaacaatggtgcacgtttcgttttaccgcaactatggtaaaaccttcaagaagcctcgacgtccatacgagaaggagcgtttggacgcggagttaaaactcgtgggagaatacggactccgatgcaaacgagagctttggagggtccaatacgcgctaagccgtatccgaaatgccgcgagaatgcttctcactctcgaagaaaaagatccacgtaggatcttcgaaggtgaagccttaatgagaagaatgaatagatacgggcttttagacgagagccaaaacaagctagattacgttcttgcccttaccgtcgagaactttctagaacgtcggttacagacactcgtgtttaaaaccggtatggccaagtccatccatcacgctagagtcctcatcaagcaaagacacatcagggtggggaggcaggtggtgaatgtgccgtcgtttatggtgagagttgactcgcaaaagcatattgacttttcgctgacgagtccgtttggaggtgggagaccggggagagtgaagcgaaagaatcagaaggcggctgctaagaaggcggctggtggagatgctgacgaggatgacgaagaatgagctgacctgtcacctattgtgttattttgatatttttcggatcttttttattatagcaagtttttggttttgtaagggatattatgcaattaagttattcttcaagggttgtgatgaaacattgtaactttttaagttagtctttgtttaaacaagagatggttgcttttgctcaaatcaaagaaatcaactgggccgagacggccgaacag

SEQ ID NO: 2680 - DNA, 814 bp, Eschscholzia californica
gaactactttccgcttcactttccctccgccatttcagttgaagtacattaatccaagcacatcggaggacggtggtgaactgaaccggcgacgttgaagatcgaggatggtccacgtcaacttttaccggaactatgggaaaacattcaaaaagcctcgtcgtccatatgagaaggagcggctggatgctgagctgaagcttgttggtgagtatgggttgagatgtaagagagaattgtggagggttcaatatgctttgagtcgtatccgtaatgctgctagaatgcttcttacacttgatgagaagaaccctcgccgtatatttgagggtgaagctcttcttcgtaggatgaacagatacggacttttggatgagagtcagaacaagctcgattacgttttggcccttactgttgagaacttccttgagcgtcgtcttcaaactctagtattcaagtctggtatggctaagtcaattcatcacgcacgtgtgctcatcagacagagacacatcagggttgggaggcaggtagtgaacatcccttctttcatggtgagggttgattcacagaaacacattgatttctcactcaccagtcctctgggaggtggaagacctgggagagttaagagaaggaacatgaaagcagctgcaaagaaagctggtggtggagatggtgatgatgaagatgaagattaagctatatctgacaacatctgtcagcaaaaaatctgatgaggttcactttctgatatctatctccctcattttgcattagagaaacttagagagattcttcttaacttggaacc

SEQ ID NO: 2681 - DNA, 714 bp, Euphorbia peplus
tttttcccttggagggggcggcgttgatagagatcagagccggagcaatggtgcacgtttcgttctatcgcaactatgggaagacattcaagaagccaaggcgtccttacgagaaggagaggttagatgcagaactgaagctggtgggagaatacggactgcggtgcaagagagaattgtggagggtgcagtatgcattgagtcgcataaggaatgcagcgagaatgcttctgacactagatgagaagaacccacgcagaatctttgagggagaggcccttctccgaagaatgaaccgttatgggctattggacgagtctcaaaacaagcttgattatgtgttggcattgactgttgagaacttcctcgagcgtcgcctccaaactcttgttttcaagtctggtatggctaagtccatccaccatgctcgtgtcctcatccgccagaggcatatcagggtcggaaggcaagcggtgaacataccatctttcatggtgagggtggactcccagaaacatatcgacttttcattgaccagtccactcggccctggacgacctggaagagtcaagagaaggaaccagagggctgctaacaaaaaggcttctggaggagatggtgatgaagaggatgaggagtgatctcttaggaaatttaaactttaaaacctacttttgctaagtgacgttactttgtgactgccaatattttgct

SEQ ID NO: 2682 - DNA, 881 bp, Fagopyrum esculentum
ccatttgtagcaggcaagcggcgactcggccctccattcctaagtgacaaatcgagaagagggcgccaaccattctgaagttggccagccatggtgcacgtttcatactatcgcaactatgggaaaacctttaagaagccccgtcgtccttacgagaaggaacggttggatgctgagctaaagctggttggagagtatggacttcgttgtaagagggagttgtggagggttcaatatgccttgagtcgtatccgtaacaatgctagacatcttttgaccctggatgagaagaattcccgccgtatctttgagggcgaggctcttcttaggaggatgaatcgttatggtctgcttgacgagagccaaaacaagctcgattacgtcttgtctctaaccgtggagaacttccttgagcgtcgtctccagacacttgtgttcaaatctggaatggccaagtccattcaccatgcccgtgttcttatcaggcagaggcacatcagggttgggaggcaggtagtgaacatcccctcattcatggtgagggttgactctcagaagcacattgatttctctctgaccagtccattcggaggaggcagaccaggaagagtgaagagaaagaaccagaaggcggctgccaagaaggcttctggcggagatggtgatgaggaggatgaagagtgaagcatcaagttctgatgacattgctgaggtgtgaactcatgatgttttgaatattttggtagcattatttactttagatcctatgttatttttcaagtaattctctatttacggttttgttaggcatgaacatgagctttccgatcaatgtttggcttcttagatatttggtattaatgtaagtttacataaatttt

SEQ ID NO: 2683 - DNA, 923 bp, Fagopyrum esculentum
tccccattttctagcaggcaaacggcgactcggcgctccattcctaagatcgagaagagggcgccaaccattctgaagttggccagccatggtgcacgtttcatactatcgcaactatgggaaaacctttaagaagccccgtcgtccctatgagaaggaacgattggatgctgagctaaagctggtgggagagtacgggcttcgttgtaagagggagttgtggagggttcaatacgccttgagtcgtatccgtaacaatgctagacatcttttaaccctggatgagaagaactcacgtcgtatctttgagggtgaggctcttcttaggaggatgaaccgttatggtttgcttgacgagagccaaaacaagctcgattacgtcttgtctctaaccgttgagaacttccttgagcgtcgcctccagacacttgtgttcaaatctggaatggccaagtctattcaccatgcccgtgttcttatcaggcagaggcacatcagggttgggaggcaggtagtgaacattccctcattcatggtgagggttgactctcagaagcacattgatttctcactgaccagtccattcggaggaggcagaccaggaagagtgaagcgaaagaaccagaaggcggctgctaagaaggcttccggcggagatggtgatgaggaggatgaagagtgaagcataaagttgtgatgacattgctgaggtgtgaactcatgatgttttgaatattttggtagcattagaagtatccatctatgataccatttactttagatgctgtgttatttttcaagtacttctctatttacggttttgttaggcatgaacatgaactttctgatcaatcttagatatttggtattaatggaattttacataatttttgcgcacatttgacttaaaaaaaagaaaaaca

SEQ ID NO: 2684 - DNA, 1017 bp, Flaveria ramosissima
gattagaagcagcacagagggtggccgccggaggcagaagagatcaatcaagtagccgccggagtatcgacgtcgaacaacaatggttcacgtctctttctaccgcaactatggtaagacttttaagaagccgcgtcgtccttatgagaaggaacgattggatgctgagttgaagcttgttggtgaatatggtcttcgatgcaaaagggagctttggagggtgcagtatgctttgagccgcattcgtaatgctgcaagaatgcttttaacacttgaggagaaggacccacgtcgtatctttgaaggtgaggctcttatgaggagaatgaacaggtatggtctgttggatgagagtcaaaacaagctcgattatgtgcttgccctcactgtggagaactttcttgaacgccgtctccagacccttgtgttcaagactggtatggccaagtcaattcaccatgctagagttcttatcaagcagcggcacatcagggttggaagacaggtggtgaatgtaccttcattcatggtgagagtggactcacagaagcacattgacttctcactcacaagtccatttggaggtggcagaccaggaagagtgaagcgaaagaaccagaaggcagctgcaaagaaggctgctggtggagatgctgatgaggatgacgaagaataagctcactcttttggctcttaatcttaatatctgttgcaattgtgacgcgtatgagtaatcgttatcatccataattactgttcgtaggaagttttggatgctttgtcatgtgtttgttgctttttatatcttctcatggatttagttaatgacaagtttatgctttgggttgctactttgaaacttatatcattatgcttttagaacttctacatgtttggtaatcttatttgaccaggttttcttttagtaaaaaaaaaaagaaaaaagtaaaactctgcgtgtatacactgtcttactagagacgtcgccaacggacgacacgaagggaggtagggggg

SEQ ID NO: 2685 - DNA, 977 bp, Flaveria ramosissima
ctctcattgttgttgcaggttgattgctcacggcatctcaattatcagcaacagaagcaggtaagaaagagcagcaagcaattgctgcattgaagttggactacaatggttcatgtgtcattttatcgaaactatgggaagaccttcaagaagccccgtcgtccatatgagaaagaacgtttagatgcggagttaaaacttgtgggcgaatatggtcttcgatgcaaaagagagctttggagggtgcaatatgctcttagccgaattagaaatgctgcaagaatgcttctgacccttgaagaaaaggacccacgtaggatttttgagggtgaagctcttatgaggagaatgaatcgctatgggcttttggatgagagccaaaataagcttgattatgtgttggccctcacagtcgagaactttctagaacgccgtttgcagacacttgtgttcaaaaccggtatggccaagtctattcaccatgctagagtgctcatcaagcagaggcatatcagggttggaaggcaagtagtgaatgtcccttcattcatggtgagagtcgactcacagaaacacattgacttctctctcacaagtccatttggcggtggccgacctggtagagtgaagcgaaagaaccaaaaggccgctgcaaagaaggcggcaggcggtgatgccgacgaggatgatgaagaatgagctatcgccgaagtctgttatatcaaaggttccatccttatattatctttccagacattgttttttatctctactttttcagaaccttttatccttaggaagttttggatgcttttttccttgtgttgttaagaacaccatcatggattatgtttgtcttccaacaaactctaaacatgttcgcttagaggttccacaagtctaaatgctcgcgtgcagtcagcggggggaatattttgcttgagccaagtttcgttgaaggttgggatgtaaaaggt

SEQ ID NO: 2686 - DNA, 775 bp, Flaveria ramosissima
tgagaaagagcagcaagcaattgctgcattgaagttggactacaatggttcatgtgtcattttatcgaaactatgggaagaccttcaagaagccccgtcgtccatatgagaaggaacgtttggatgcggagttaaaacttgtgggcgaatatggtcttcgatgcaaaagagagctttggagggtgcaatatgctcttagccgaattagaaatgctgcaagaatgcttctgacccttgaagaaaaggacccacgtaggatttttgagggtgaagctcttatgaggagaatgaatcgctatgggcttttggatgagagccaaaacaaacttgattatgtgttggcgctcactgtcgagaactttctcgaacgccgtttgcagacacttgtgttcaaaaccggtatggccaagtctattcaccatgctagagtgctcatcaagcagaggcatatcagggttggaaggcaagtagtgaatgttccatcattcatggtgagagttgactcacagaaacacatcgacttctctcttacaagtccatttggcggtggccgacctggtagagtgaagcgaaagaaccaaaaagctgcagcgaagaaggcggcaggcggtgatgccgatgaggatgatgaggaatgagctatcaccaaagttttttatatcaaaggtcccatctttatattacctttccagacattgttttttatcccaactttttcagaaccttttattgttaggaagttttggatgttgtttgcttgtgttgttaagaacat

SEQ ID NO: 2687 - DNA, 859 bp, Flaveria ramosissima
tcactctcattgttgttgcaggttgattgcttacggcatctcaattatcagctacagaagcaggtgagaaagagcagcaagcaattgctgcattgaagttggactacaatggttcatgtgtcattttatcgaaactatgggaagaccttcaagaagccacgtcgtccatatgagaaggaacgtttagatgcggagttaaaacttgtgggcgaatatggtcttcgatgcaaaagagagctttggagggtgcaatatgctcttagccgaattagaaatgctgcaagaatgcttttgactcttgaagaaaaggacccacgtaggatttttgagggtgaagctcttatgaggagaatgaatcgctacgggcttttggatgagagccaaaataagcttgattatgtgttggccctcacagtcgagaactttctagaacgtcgtttgcagacacttgtgttcaaaaccggtatggccaagtctattcaccatgctagagtgctcatcaagcagaggcatatcagggttggaaggcaagtagtgaatgtcccttcattcatggtgagagttgactcacagaaacacattgacttctctctcacaagtccatttggcggtggccgacctggtagagtgaagcgaaagaaccaaaaggccgctgcaaagaaggcggcaggtggtgatgccgatgaggatgatgaagaatgagctatcgccgaagtctgttatatcaaaggttccaccattatattatctttccagacaattgttttttatcccaactttttcagaaccttttattgttaggaagttttggatgttgtttgcttgtgttgttaagaacactataatggattttgtttgt

SEQ ID NO: 2688 - DNA, 827 bp, Flaveria ramosissima
tgttgttgcaggttgattgctcacggcgtctcaactatctgctacagaaaggtgagaaagagcagcaagcaattgctgcattgaagttggactaccatggttcatgtgtcattttatcgaaactatgggaagacctttaagaagccccgtcgtccatatgagaaggaacgtttggatgcggagttaaaacttgtgggcgaatatggtcttcgatgcaaaagagagctttggagggttcaatatgctcttagccgaattagaaatgctgcaagaatgcttctgacccttgaagaaaaggacccacgtaggatttttgagggtgaagctcttatgaggagaatgaatcgctatgggcttttggatgagagccaaaataagcttgattatgtcttggccctcactgtcgagaattttctagaacgtcgtttgcagacacttgtgttcaaaaccggtatggccaaatctattcaccatgctagagtgctcatcaagcagaggcatatcagggttggaaggcaagtagtgaatgtcccatcattcatggtgagagtggactcacagaaacacattgacttttctctcacaagtccatttggcggtggccgacctggtagagtgaagcgaaagaaccaaaaggccgctgcaaagaaggcggcaggcggtgatgccgatgaggatgatgaagaatgagctatcgccgaagtctgttatatcaaaggttccaccattatattatctttccagacattgttttttatctcaactttttcagaacctttatccttaggaagttttggatgcctttttgcttgtgttgttaagaacac

SEQ ID NO: 2689 - DNA, 871 bp, Flaveria ramosissima
cttcagaagcagcacagagggtggccgccggaggcagaagtgatcaatcaagtagccgccgtcgtatcgacgtcgaacaacaatggttcacgtctccttctaccgcaactatggtaagacttttaagaagccgcgtcgtccttatgagaaggaacgattggatgctgagttgaagcttgttggtgaatacggtcttcgatgcaagagggagctttggagggtgcagtatgctttgagtcgcattcgtaatgctgcaagaatgcttctgacacttgaggagaaggacccacgtcgtatctttgaaggtgaggctcttatgaggagaatgaacaggtacggactgttggatgagagtcagaacaagcttgattatgtgctggctctcactgtggagaactttctcgaacgccgtctccagacccttgtgttcaagactggcatggccaagtcaatccaccatgctagagttcttatcaagcagagacacatcagggttggaaggcaggtggtgaatgtaccttctttcatggtgagagtggactcacagaagcacattgacttctcactcacaagtccatttggaggtggccgaccaggaagagtgaagcgaaagaaccagaaggcagctgcaaagaaggctgctggtggagatgctgatgaggatgatgaagaataagctcacttatttggctcctaatcttaatatcttttgcaattgtgacgcgtatgagtaatcgttatcatccataattactgttggtaggaagttttggatgctttgtcatgtgtttgttgctttttatatcttctcatggatttagttaatgacaagtttatgctttgggttgctactttgaaacttatatcatta

SEQ ID NO: 2690 - DNA, 607 bp, Flaveria ramosissima
atctacatccaacaacaatggttaaagtctccttctaccgcaactatggtaagacttttaagaagccccgtcgtccttacgagaaggagcgattggatgctgagttgaagcttgttggtgaatatggtcttcggtgcaagagggagctttggagggtgcagtatgctctcagtcgcattcgtaatgctgcaagaatgcttttgactctcgaggagaaggacccgcgtaggatctttgagggtgaagcacttatgaggagaatgaataggtatggcttgttggatgagagtcagaacaagctcgattatgtgctggcgcttactgtcgagaactttcttgaacgtcgtctccagacccttgttttcaagactggtatggctaagtctatccaccatgctagagttctcatcaagcagaggcacatcagggttggaaggcaagtggtaaatgtgccatctttcatggtgagagttgactcgcagaagcacattgacttttcactcaccagtccgtttggcggtggccgacctggtagagtgaagcgaaagaaccagaaggcggctgctaagaaggcagctggtggggatgctgatgaggatgatgaaga

SEQ ID NO: 2691 - DNA, 603 bp, Flaveria ramosissima
acatccaacaacaatggttaaagtctccttctaccgcaactatggtaagacttttaagaagccccgtcgtccttacgagaaggagcgattggatgctgagttgaagcttgttggtgaatatggtcttcggtgcaagagggagctttggagggtgcagtatgctcttagtcgcattcgtaatgctgcaagaatgcttttgacccttgaggaaaaggacccgcgtaggatctttgagggtgaagcacttatgaggaggatgaacaggtatgggctgttggatgagagtcagaacaagcttgattatgtgctggcgcttactgtcgagaactttcttgaacgtcgtctccagacccttgttttcaagactggtatggctaagtctatccaccatgctagagttctcatcaagcagaggcacatcagggttggaaggcaagtggtaaatgtgccatctttcatggtgagagttgactcgcagaagcatattgacttttcactcaccagtccatttggcggtggccgacctggtagagtgaagcgaaagaatcagaaggcggctgctaagaaggcagctggtggggatgctgatgaggatgatgaaga

SEQ ID NO: 2692 - DNA, 721 bp, Flaveria ramosissima
atcagctaaggaagcagctgaggaagggcagcacacgatagctgcattgacggtttgatatcgttcaacgatggttcatgtgtcattttaccgaaactatgggaagacttttaagaagcctcgacgtccatatgaaaaggagcgtttggatgcggagttgaagcttgttggagaatatggtcttcgatgcaagagggaactctggagggtgcagtatgcgcttagccgaattagaaatgctgcaagaatgcttttgactcttgaagagaaggacccacgtaggatttttgagggtgaagcacttatgagaagaatgaaccgttacgggcttttggatgagagtcaaaataagcttgattatgtgctggctcttactgttgagaactttctagaacgtcgtttgcagacgcttgtcttcaagaccggcatggctaagtctattcaccatgctagagtcctcattaaacagaggcacatcagggtcgggaggcaagtggtgaatgtaccatcattcatggtgagggtcgactcccagaaacacatcgacttttctctcaccagtccttttggcggtggccgacctggcagagtgaagcgaaagaaccagaaagccgctgcaaagaaggcgtcaggtggtgatgctgacgaggatgatgaagaatgagctgtcacttacatcttgttatatcaaaggtttcatctttttcatcttatcagacat

SEQ ID NO: 2693 - DNA, 834 bp, Flaveria ramosissima
agaagcagcacggagggtggccgccggaggcagaagagatcaatcaagtagccgccggagtatcgacgtcgaacaacaatggttcacgtctccttctaccgcaactatggtaagacttttaagaagccgcgtcgtccttatgagaaggaacgattggatgctgagttgaagcttgttggtgaatatggtcttcgatgcaaaagggagctttggagggtgcagtatgctttgagccgcattcgtaatgctgctagaatgcttttgacacttgaggagaaggacccacgtcgtatctttgaaggtgaggctctaatgaggagaatgaacaggtatggtctgttggatgagagtcagaacaagctcgattatgtgctggccctcactgtggagaactttctcgaacgccgtctccagacccttgtgttcaagactggtatggccaagtccatccaccatgctagagttcttatcaagcagagacacatcagggttggaaggcaggtggtgaatgtaccttcattcatggtgagagtggactcacagaagcacattgacttctcactcacaagtccatttggaggtggcagaccaggaagagtgaagcgaaagaaccagaaggcagctgcaaagaaggctgctggtggagatgccgatgaggatgacgaagaatgagctcactcttttggctcttaatcttaatatctgttgcaattgtgacgcgtatgagtaatcgttatcatccataattactgttggtaggaagttttggatgctttgtcatgtgtttgttgctttttatatcttctcatggatttagttaatgacaagtttatg

SEQ ID NO: 2694 - DNA, 851 bp, Flaveria ramosissima
ctctcattgttgttgcaggttgattgctcacggcgtctcaattatcagctacagaagcaggtgagaaagagcagcaagcaattgctgcattgaagttggactaaaatggttcatgtgtcattttatcgaaactatgggaagaccttcaagaagccccgtcgtccatatgagaaggaacgtttggatgcagagttaaaacttgtgggagagtatggccttcgatgcaaaagagagctctggagggtgcaatacgcccttagccgaattagaaatgctgcaagaatgcttctgacccttgaagaaaaggacccacgtaggatttttgagggtgaagctcttatgaggagaatgaatcgttatgggcttttggatgagagccaaaacaaacttgattatgtgctggccctcactgttgagaactttctagaacgccgtttgcagaccctcgtgtttaaaactggtatggccaagtctattcaccatgctagagtgctcatcaagcagaggcacatcagggttggaaggcaagtagttaatgttccatcattcatggtgagagttgactcacagaaacacatcgacttctctctcactagtccatttggtggtggccgccctggtagagtgaagcgaaagaaccaaaaagccgctgcaaagaaggcggcaggcggtgatgccgatgaggatgatgaagaatgagctatcattaaagtttattatatcaaaggtctcatctctatatcagctttccagacattggtttttatcccaactttttcagaaccttttatcgttaggaagttttggatgtttttgcttgtgttgttaagaccaccataatggattatgtt

SEQ ID NO: 2695 - DNA, 1093 bp, Flaveria ramosissima
tcttgttgttgttgcaggttgattgctcacggcgtctcaactatcagctacagaaaggtgagaaagagcagcaagcaattgctgcattgaagttggactacaatggttcatgtgtcattttatcgaaactatgggaagacctttaagaagccccgtcgtccatatgagaaggaacgtttggatgcggagttaaaacttgtgggcgaatatggtcttcgatgcaaaagagagctttggagggttcaatatgctcttagccgaattagaaatgctgcaagaatgcttctgacccttgaagaaaaggacccacgtaggatttttgagggtgaagctcttatgaggagaatgaatcgctatgggcttttggatgagagccaaaataagcttgattatgtcttggccctcactgtcgagaactttctagaacgtcgtttgcagacacttgtgttcaaaaccggtatggccaaatctattcaccatgctagagtgctcatcaagcagaggcatatcagggttggaaggcaagtagtgaatgtcccatcattcatggtgagagttgactcacagaaacacattgacttttctctcacaagtccatttggcggtggccgacctggtagagtgaagcgaaagaaccaaaaggccgctgcaaagaaggcggcaggcggtgatgccgatgaggatgatgaagaatgagctatcaccaaagttttttatatcaaaggtttcatctctatattacctttccagacactgtttttcatcccaactttttcagaaccttttattgttaggaagttttggatgttgtttgcttgtgttgttaagacactataatgtattttgtttgtcttccaacaaactctaaacatgtttgtttagaggttccacaagtctagttgcatacctaaaatctcatgagaggaagttaagatttttcagtaggtggttcccaataagtaaaggtctcacctgcagtcaggcggtggcattagttcggctggtgcgtaggtttgaccgaaggattggggacggaaagggtgcgggtcttggttttagtagtccgctgttaggtggtcgataagtgtagtca

SEQ ID NO: 2696 - DNA, 844 bp, Zingiber officinale
  misc_feature (157)..(157): n is a, c, g, or t
  misc_feature (169)..(169): n is a, c, g, or t
  misc_feature (560)..(560): n is a, c, g, or t
  misc_feature (584)..(584): n is a, c, g, or t
  misc_feature (587)..(587): n is a, c, g, or t
  misc_feature (721)..(721): n is a, c, g, or t
gaactctagaaccaaccatggttcacgtcagtttctacagaaactatgggaagacatttaagaagcctcgccgtccctatgagaaggagaggcttgatgcggaactgaagttggtcggtgagtatgggcttcgctgcaagcgggaactctggagggngcagtatgcacngagcaggattcgaaatgctgcaagggagcttttgacacttgatgaaaagaaccctcgtcgtatttttgaaggagagcctctccttcgccggatgaaccgctatggactccttaatgaaggacagaacaagcttgattatgtccttgccctcactgttgagaacttcttggagcgtcgtcttcagactcttgtcttcaagtcagggatggcaaagtctattcaccatgcaagggtcctcatcagacagcgccatataagagtgggtaggcaggtggtcaacatcccatcattcatggtgagggttgattcaggaaagcacatcgacttctccttgatgagtccattcggtggtggccgccctggaagggtgaagagaaagaaccaaaaggcngcggcaaagaaggctgctggcggngangatgaagaagatgaagaatgagcaatatgcatcacaaatgtgatggtttggttttactactcccctatttaaccagtttatgctgattttgttgtcagtttcttctgaaccttttgagttagcaccttatcttnccctctctggaactcttggagttttactttaaacttggttttttggaatctgatgaatcttatattgtttagacaccagccatttcatatttaatatagatctgagaatgctgattgctttca

SEQ ID NO: 2697 - DNA, 849 bp, Humulus lupulus
gaaggttgagaagcgctgcacctcagctcaggccaagaaccatggtgcatgtcaatttttacaggaactatggtaaaacctttaagaagccgagacgcccttatgagaaggagcgtttggacgctgagctgaagctcgttggagagtatgggctgcggtgcaagagagagctatggagggttcagtatgtgttgagccgaatccgtaacaatgctagaatgcttctgaccctcgacgagaaaaacccacgtcggattttcgagggagaagcccttctgaggaggatgaacagatacgggttgttggatgagagccagaacaagctcgattacgttctcgctcttactgtcgagaactttttggagcgtcgtcttcagacccttgtcttcaagtccggtatggctaagtccatccaccatgcccgagttcttatcaggcaaaggcacattagagttggaaggcaggtagtcaatatcccctcatttatggtgagggttgactctcagaagcacattgatttctctctcacaagtcccttcggaggtggtcgccctggccgcgtgaagcgaaagaaccaaaaggcagctgccaagaaggctgctggtggagatggagatgaggaagacgaagaatgaaagatcataggggtcctaagtgagtcttttttgtccaggattttccttctcttagattttgtggtttttgtcaactctatcatgaaacatgtttcaatcataggaagttttgcttgctatgctctaaatctaatctgttttttagttttgttttttagtttgaatttgacaagttgattactagatggtcttcttatatcaagtttgagactct

SEQ ID NO: 2698 - DNA, 868 bp, Humulus lupulus
acaggaaaccctactctccttctcctcctccttctcttctccatctgatcaagccatggttcacgtcaacttctacaggaactatgggaagacgtttaagaagcccagacgcccttacgagaaggagcgtttggacgctgagctgaagcttgttggagagtatggtctgcggtgcaagcgagagctgtggagagtccaatatgtgttgagccgaatccgtaacaatgcaagaatgcttctgacccttgatgagaaaaacccacgtcgtattttcgagggggaagcccttttgaggaggatgaacagatatgggctgttggacgagagccagaacaagctcgattacgttctcgcacttactgtggagaactttttggagcgccgtcttcagacccttgtattcaagtctggtatggctaagtccatccaccatgctcgagttctcatcaggcaaaggcacattagggttgggaggcaagtagtcaatatcccctcattcatggttagggttgactctcagaaacacattgacttctctctcacaagtcccttcggaggtggtcgccctggccgagtgaagcgaaagaaccagaaggcagctgccaagaaggctgctggtggagatggagatgaggaagacgaagaatgaagtagttcccattgagtcttttagtctagccttttctgtatctcttgcagatttttgttttttttttcaactctattttttgctttttgtcaactctatcatggattttgttatgagactttagtttaagaatgtgtgatatgtaccccttctgaacacatttcacatctccaaattcattgtctggtttacaagtatgatgcaatcacattgaaatca

SEQ ID NO: 2699 - DNA, 926 bp, Humulus lupulus
ctcctgaaattgaaggttgagaactgagaagggtacctcacctcaggccaagaaccatggtgcatgtcaatttttacaggaattatggtaaaacctttaagaagccgagacgcccttacgagaaggagcgtttggacgctgagctgaagctcgttggagagtatggtctgcggtgcaagagagagctatggagggttcagtatgtgttgagccgaatccgtaacaatgctagaatgcttctgaccctcgacgagaaaaacccacgtcggattttcgagggagaagcccttctgaggaggatgaacagatacgggttgttggatgagagccagaacaagctcgattacgttctcgctctgactgtcgagaactttttggagcgtcgtcttcagacccttgtcttcaagtccggtatggctaagtccatccaccatgcccgagttcttatcaggcaaaggcacattagagttgggaggcaggtagtcaacatcccctcattcatggtgagggttgactcacagaagcacattgatttctctctcacgagtcccttcggaggtggtcgccctggccgagtgaagcgaaagaaccaaaaggcagctgccaagaaggctgctggtggagatggagatgaggaagacgaagagtgaagatcataggggtcctaagtgagttttttgtccaagattatctttctccgttaaattttgtggtttttgtcaactatcatagaacatgttatgatcataggaagttttgcttgctgtgctctaatctttttttcttcttttacaatttgataactagatggcttcttagatcatattgagactttatttcagttgttgatgattttagacacccattactaaacattctcatgctcttttatttcagttttgatgatgttagacacctatatatta

SEQ ID NO: 2700 - DNA, 970 bp, Ipomoea nil
gctagtggccactctcagctccggatttcagtttgatcgccgaactgagaattccaccgccggcggcccaaaatggtgcacgtcaacttttaccggaactatgggaagacatttaagaagcctcgtaggccatatgagaaagagcgattggatgctgagttgaagcttgttggtgagtatggacttaggtgcaagagggaactctggagggttcagtatgcattgagccgtatcaggaataacgcaagaatgcttctcacactcgatgagaaggacccaaggcgtatttttgagggtgatgcccttttgagaaggatgaacaggtatggcttgcttgatgagagtcagaacaagcttgattatgtccttgccctaactgtggagaacttccttgagcgccgtctccaaactcttgtgttcaaggctggcatggcaaagtcaatccatcatgctagggtgctcattaggcaaaagcacatcagggttggaaggcaggttgtgaacgtcccctccttcttggtcagagtggactcgcagaagcacattgatttctcactgtccagtccttttggtggcggtcgccctggtagggtgaagcgaaagaaccagaaggcagctgccaagaaggctgctggcggcgatggagatgaagaggatgaagagtgagtgaggtgcttttgttgctaatcaaaaaccaaagaatgaaattcttcttacattctgttttggatttttgttacactctacctccaagtggagaggcttagcttggaatttttctctttttgtttttactttctatttatgttccttgttacttcaacttttaaatatccttttagaacttttcctcagtgctcttcattttcataacccccctcgtcactttgttactatttgattaatctcaaggcagtaagacaattagattatagccgaatatgtgaaaaagggttatcacttatcagag

SEQ ID NO: 2701 - DNA, 900 bp, Ipomoea nil
ctcgtgtcagctccccttctccaccgcagatcgccgagctgaggttctgaccggcggtcggtcaacatggttcacgtttcattttaccgcaactatggaaagacattcaagaagccacgtcgtccatatgagaaagagcgtttggatgctgagttgaagcttgtgggtgagtatgggcttcgatgcaagagggagctgtggagagttcaatatgctttgagtcgtattaggaataatgcaagaatgcttcttactcttgatgagaaggacccacgcaggatctttgagggtgatgcactcctgaggcgtatgaacagattcggcttgctggatgagagccagaacaaacttgattatgtccttgctctcactgtggagaacttccttgagcgccgtctgcagactttggtgtttaaggctggcatggcaaagtcaatccaccatgcaagagtgctcattaggcaaaggcacatcagggttggaagacaggtggtgaatgttccctcctttatggtcaggctcgactcccagaaacacattgatttctcactcaccagtccatttggtggtgggcgccctggtagagtaaagagaaagaaccaaaaggctgctgccaagaaggctgctggtggagatggagacgaagaagatgaagaatgagcttccacatctcttagggtagaagaatattgtcctgtgttctatgtagttttttatcgggatgaaagtagacttcgtattatgtttattacatgcaacagtgcctatttcctatattatctgcagtttcatggcttgagagctaggaggtttttgatattacaaagagattcatgtctaattctatgttggacttatttttattttttttgtgatagtatgtactctgtattgaatgat

SEQ ID NO: 2702 - DNA, 732 bp, Actinidia deliciosa
  misc_feature (8)..(8): n is a, c, g, or t
  misc_feature (538)..(538): n is a, c, g, or t
  misc_feature (650)..(650): n is a, c, g, or t
ctcacgcntacacacacagaggtctggtcggcgagctccaaccatggtgcacgtttcctattaccggaactatgggaaaacattcaagaaacctcgccgcccatatgagaaggagcgattggatgctgagcttaagcttgtgggagagtatgggctccgctgcaagagggaactttggagggttcagtatgctttgagccgcatccgtaatgctgctagaatgcttctaaccctggatgagaagaatccccggagaatttttgaaggtgaggcccttttgaggaggatgaacagatatggtctgctcgatgagagccagaacaagctcgattatgtcttggcccttaccgtggagaacttcctcgagcgtcgcctccaaacgcttgtcttcaagacgggtatggcaaagtcaatccaccatgccagagttctcatcaggcagaggcatatcagggttgggaggcaggtggtcaacgttgcctctttcatggtgagggtggattcacagaagcacattgacttctcgctgacaagtccncttggaggtggacgccctggcagagtgaagcgaaagaacacaaaggcagctgcaaagaaggctgctggcggagatggagatgaagaagatgaagagtgatgccttgcattcntataggtttgtcatggcaatactagcaagtgttgcctaaactttgttcacctttgcctggctagtactgctattactgatac

SEQ ID NO: 2703 - DNA, 922 bp, Lactuca sativa
cttggcggggactcctgcttttgcaggtttatttttcgcatcgtctccattgagcagcagctgagaaggagagagagagagcaacaagcattgacatagacaacaatggtgcacgtctcgttttaccgcaactatgggaaaactttcaagaaaccccgtcgtccatacgagaaggaaagattagatgctgaactgaagcttgttggagaatatgggcttagatgcaaaagagagctttggagggttcaatatgcactgagcagaatccgtaatgctgcaagaatgcttctgacccttgaagaaaaggacccacgtaggatctttgaaggtgaagcccttatgagaaggatgaacagatatggacttttggatgagagccaaaacaagctagattacgttcttgcccttactgttgaaaactttcttgaacgccgtttacagacacttgtattcaaaactggaatggccaaatccatccaccatgctagagttctcatcaagcaaaggcacatcagggtgggaaggcaagtggtgaatgttccatcattcatggtgcgtgttgactcccagaagcatattgacttttctctcaccagtccctttggaggcgggcgacctggcagagtcaagcgaaagaaccaaaaggcggctgccaagaaggcgtcaggtggggacgctgacgaggatgatgaagagtgatgacatgtcatcatgtttcatcttttttactatcttgtcaacatgctttattttgatatttttcagaacctctaaacatagcaagttttttatttgataatatggatatcatgcaatcaagtaagtgtctcaagggtgagtaaacattaaaactttatgctcatttttgtgacattgtttttattaatcaagtaaacgtaaagccaaatgtccctttaatctt

SEQ ID NO: 2704 - DNA, 822 bp, Lactuca sativa
gcggggctcctaagagcagcgcagagggaggaggccgccggtagtgaggagaacatcaaccaagtagccgccgtatcgacgttgaacaaccatggttcacgtctctttctaccgcaactatggaaaaaccttcaagaagccacgtcgcccttatgagaaggaacgattagatgctgagttgaagctagtaggagagtacggtttgagatgcaaaagggagctatggagggtgcaatacgcacttagcagaatccgtaacgctgcaagaatgcttctaacccttgaagaaaaagacccacgtaggatctttgaaggtgaagccctaatgagaaggatgaacagatatggactcttggatgagagtcaaaacaagctcgattatgttcttgccttaactgttgaaaacttccttgaacgtcgccttcagacacttgtgttcaagactggtatggcaaagtcaatccaccatgctagagtcctcatcaagcaaagacacataagggtgggaaggcaagttgtgaatgtgccttctttcatggtgagagttgactcacagaagcatattgacttttcactcacgagtccatttggaggtgggagacctggaagagtgaagaggaagaaccagaaggcggctgcaaagaaggcttctggtggagatgctgatgaggatgatgaagaatgaaaagcttgaaaaatgttatgaggtttattatgagtacttttgttatcttgataataactcttttgtaggaagttttgaatgcttttggaatattttttgttggtttttttacttgttttgagttggaaaaattgtgt

SEQ ID NO: 2705 - DNA, 865 bp, Lactuca sativa
atttttcgcatcgtctccattgagcagcttaggaagcagctgagaagtagagagagcaacaagcgatcactgcattgacagacaacaatggtgcatgtttcattttaccgcaactatgggaaaactttcaagaaaccccgacgtccatacgagaaggagagattagatgctgagctgaagcttgttggagaatacgggctcagatgcaaaagagagctttggagagttcaatacgccctcagcagaatccgtaatgctgcaagaatgcttcttacccttgaagaaaaggacccacgtaggatctttgaaggtgaagcccttatgagaaggatgaacagatatggacttcttgatgagagtcaaaacaagctagattacgttcttgccctcactgttgaaaactttcttgaacgccgtttacagacactcgtctttaaaactggtatggccaaatccatccaccatgctagagttctcatcaaacaaaggcacatcagggtgggaaggcaagtggtgaatgttccatcattcatggtgcgtgttgactctcagaagcatattgacttttctctcactagtccctttggaggcgggcgacctggcagggtcaagcgaaagaaccaaaaggcggctgccaagaaggcgtctggtggggatgctgacgaggatgatgaagagtgatgacctgtcgtgtctgatgtcatccttcatgttttttcaaaggttttgtctttactatcttgtcaaacatcgtttattttgatatttttctgaacctttaaacatagcaagttttttaaattataatatggatatttatgcaatcagtctctagaatgatgaaacattttaacttttatgctaa

SEQ ID NO: 2706 - DNA, 854 bp, Lactuca sativa
ggagcagcagtcgccgtcggggggagggaggagcatagcaaacaccgtattgacgtcgagcaacaatggtgcacgtctccttctaccgcaactatggaaaaactttcaagaagcctcgtcgtccctacgaaaaggaacgactagacgcagagctgaaattggtcggagaatacggtctccgatgcaaaagagagctctggagggtgcaatatgcactcagcagaatccgtaatgctgcaagaatgcttctaactctcgaggagaaagatccacgaagaatcttcgaaggtgaagctctcatgaggaggatgaacaggtatggtttgctggatgagagccaaaacaagctcgattacgttcttgccctaactgttgaaaacttccttgaacgtcgtctccaaacactcgtcttcaaaactggaatggccaaaagcatacatcatgctagagtcctcatcaaacaaaggcacatcagagttggaaggcaagttgtgaatgttccatcgttcatggtgagggtggattcacagaagcacattgatttctcactcacgagtccatttggaggtgggagacctggtagagttaagcgaaagaaccagaaagcagctgcaaagaaggcttcaggtggtgatgctgatgaagatgatgaagaatgagagcatttgagtagtagttcttgtgtttgatcttatttgccaccatgaggtttacaagtgagtgttttgttctttgtttactttagactttttcttagtggattattggtggtttttaagaagttattgtttgttgatttttctgttgaagattttgtaatggattttatggggttttagagttatctaaattct

SEQ ID NO: 2707 - DNA, 970 bp, Lactuca sativa
ggcccttaacataaacccataaatcaatccggcccatgaagatatacattataaccctaacacaattaccactcagccaaacccttgaagcagcagtcgccgtcggggggagggaggagcatagcaaacaccgtattgacgtcgagcaacaatggtgcacgtctccttctaccgcaactatggaaaaactttcaagaagcctcgtcgtccttacgaaaaggaacgactagacgcagagctgaaattggtcggagaatacggtctccgatgcaaaagagagctctggagggtgcaatatgcactcagcagaatccgtaatgctgcaagaatgcttttaactcttgaggagaaagatccacgaagaatcttcgaaggtgaagctctcatgaggaggatgaacaggtatggtttgctggatgagagccaaaacaagctcgattacgttcttgccctcactgttgaaaacttccttgaacgtcgtctccaaacactcgtcttcaaaactggaatggccaaaagcatacatcatgctagagtcctcatcaaacaaaggcacatcagagttggaaggcaagttgtgaatgttccatcgttcatggtgagggtggattcacagaagcacattgatttctcactcacgagtccatttggaggtgggagacctggtagagttaagcgaaagaaccagaaagcagctgcaaagaaggcttcaggtggtgatgctgatgaagatgatgaagaatgagagcatttgagtagtagttcttgtgtttgatcttatttgccaccatgaggtttacaagtgagtgttttgttctttgtttactttagactttttcttagtggatttattggtggtttttaagaagttattgtttgttgatttttctgttgaagattttgtaatggattttatgggattttagagttatctaaattctatttgaaattctgcaagtttcgcttgcta

SEQ ID NO: 2708 - DNA, 864 bp, Liriodendron tulipifera
cttctctctcccacggtaacagcgaagcgagggtggagaagcggcagctgcgatggtccacgttagcttctaccgcaactatggaaagacattcaagaagccgcgtcggccgtacgagaaggagcggctggacgcggagctgaagctggtgggagagtacgggctgaggtgcaagcgcgagctgtggcgggtgcagtatgctctgagccgcatcaggaacgcggcgcgggagctgctgaccctggacgagaagaacccgcggcggatcttcgagggtgaggcgctgctgcggcgcatgaaccgctacggcctgcttgacgagagccagaacaagctcgattacgtgcttgcgctgaccgtcgagaatttccttgagcgcaggctgcagacacttgtcttcaagtccggcatggccaagtccatccaccacgcccgcgtcctcatcaggcagaggcatatcagggttgggaggcaggtcgtcaacattccttccttcatggtgcgggtagattcacaaaagcacattgatttctcgcttactagcccgctgggaggaggacgccctggaagggtgaagagaaggaatcagaaagctgctgctaagaaggcttctggtggagatggtgatgaggaagacgaggattaagcacccttacctcattttggtcatggtaggagacttttttttattgtttcgtggtattttatagaggaactgttgcttgtctttttgtcttcttgatgatcgggacaaatgagttttctttttatttttgatgcaaatggtacaagatggtttatgaagttctaagttttgagtttgataattgaatgtgttctttggatttactcgagctttaccac

SEQ ID NO: 2709 - DNA, 970 bp, Cucumis melo
gccgctcttcatatacctttcttcccccttctcctccacccttcttctttctctggcagtggagatcattctgttagtgcagccgtagcagagaagagatcatggtgcacgtttccttctataggaattatgggaagacgttcaagaaaccccgacgtccttatgagaaggagcgtctggatgcagagttgaaattggttggagaatatgggcttcgttgtaagagggagttatggagggttcagtatgctttgagccgaatccgaaacaatgctcggatgcttttaacactcgatgaaaagaatccgcgtaggatttttgaaggagaggctctccttaggaggatgaacagatatggtctcttggatgagagtcagaacaagctcgattacgtcttggctcttactgtggagaatttccttgagcgtcgtctccaaactctcgtgttcaagtctggtatggccaagtctatccaccatgctagagtgctcatcaggcagaagcatattagggttggaaggcaggtggtgaacattccttctttcatggtgagagtagactcccagaagcacatcgacttctccctcacaagtccattcggaggtggtcgtcctggaagagtgaagagaaagaaccagaaggctgccgcaaagaaggctgctggaggagatggagatgaagaggatgaagattgagttacttaaaccttatctatctatcactattttatcagaaagaatgttaaatccttcttagaagttttgctttaaatatgtttgaattagggaactcgcttgcctttttgttatggggattttattaacaacctatttggtttttagttgccacagtttttcatgctttgatattggattattttgagaactttgttcttctctaatatttctacgcattatagaaatttaatttttacaacttacaatttaggtactaaaaaaaaaaaaaaaaa

SEQ ID NO: 2710 - DNA, 988 bp, Cucumis melo
ggggcgcttctttgttttcgtgtttagggcttccgatcgagagcgcggcgggcagggcagggagtgaagccgtacctgacaacaaaacatggtgcacgtctccttctatcgtaattatggaaagacttttaagaagcctcgacgtccttatgagaaggagcgtttggatgcggaacttaagcttgtaggtgagtatgggcttcgttgtaaaagagagctgtggagggttcaatatgcattgagccgaatccgtaataatgcaaggatgcttttaacccttgatgaaaagaatccccgtaggatttttgagggtgaggcccttcttaggaggatgaataggtatggtcttttggatgagagtcaaaacaagctcgattatgtcttggctcttactgttgagaatttccttgagcgtcgtctccaaactcttgtgttcaagtctggaatggctaaatctattcaccatgctagagtgctcatcagacaaaagcatataagggttgggaggcaagtggttaacatcccttctttcatggtgagagttgattcacaaaagcacatagacttctctcttaccagtccattcggaggtggacgccccggaagggtgaagagaaagaaccagaaggcagctgccaagaaggctgctggtggagatggagatgaagaagacgaggattgagttactgacactagaaactcatcatttgagatggtaaagattagccaagggtctcaggtaactgagattaacctcaagaacctatttcctgcggctagaccttttcttctattgcattgatgagaatgttacatctcttagaagttttgcgttaatttctctttttccatttagagctgttttttccggtggtggaactagctttcatttttggacaagcgtctgtttgaacttagtttccatagttttgttgccatgattggacttcgttactcaaaactcctccctatcttgaatctattgggt

SEQ ID NO: 2711 - DNA, 821 bp, Quercus alba
cctctctgttgatccgaagcaatggtgcacgtcgttttctaccgcaactatgggaagactttcaagaagccgcgtcgtccatatgagaaggagcgattggaccacgagctgaggcttgtgggagaatatgggctccgatgtaagagggagttgtggagggttcaatatgctttgagccgcatccgaaatgctgccagggagcttcttactcttgatgaaaagaatcctcgtcggatctttgagggtgatgcccttttgcgtaggatgaacaggtatggacttttggatgagagccagaacaagcttgattatgtcctggccttaaccgtggagaactttcttgagcgccggcttcaaacccttgtgttcaagtcgggtatggccaagtctattcaccatgctcgtgtgcttattaggcagaggcatatcagggttgggaggcaggtggttaacataccatctttcatggtgagagttgattctcagaagcacattgatttctctcttgctagtcccttcggaggtggtcgccctggaagagtgaagcgaaagaaccagaaggcagctgccaagaaggcttctggtggggatggaggtgaggaggatgaagaatgaagcttaggctagctccaaccctaggaactatttgagttttttttcctatctggcatctttatgttcggcacttgttcgcgtacctgacatttgttttcaaatctttatcctagtgaattttagtacatgtttcattttggtttatttggaatagaactcgaaagcactcctatggatcaccaagattttgtttaatcaatgaaaat

SEQ ID NO: 2712 - DNA, 809 bp, Elaeis guineensis
ggcgggagacggcgagggagaacaagaaccagcgatggttcacgttagcttctaccggaattatgggaagaccttcaagaagccccgccggccctacgagaaggagcggctggacgccgagttgaagctcgtcggtgagtacgggctccggtgcaagagggagctgtggagggtccaatactctcttagccggatccggaacgcagcgagggagctcttgacgctggacgagaagaaccctcgccggatctttgagggagaggccctcctccgccgcatgaaccggtatgggcttctcgacgagaaccagaacaagctggattatgttctggctctcaccgtggagaactttcttgagcgccggctccagacgctcgtgttcaagtctgggatggcaaaatctattcaccatgccagggtccttatcaggcagcgtcacatcagggttggtaggcaagtggtcaacattccatcatttttggtgagggtggattcagcaaagcacattgacttctctctcacaagtccatttggtggagggcgccctggaagagtgaagagaaagaatcagaaggctgcagcaaaaaaggcagctggaggtgatggcgatgaagatgatgaggaatgagtactttttctttcaatggtattacagttttggtagcttcctttgttgtgtaacttaaaagtttgttttgtttcatgctaagatgtttctgtcacttgtagaagggtaactgattattgcttctgtttgaagggatcacaaggtgatggattttgagatgttgaatttttggttatatttg

SEQ ID NO: 2713 - DNA, 829 bp, Phalaenopsis aphrodite
aggagaggactcgccatggttcacgttagcttctacaggaactatgggaagacattcaagaaacccaggcgtccctacgagaaggagcggctggacgcggagctgaagctggttggggagtacgggcttcggtgcaagagggagctgtggagggttcagtatgctctgagcaggatcaggaatgcggcgagggagcttctgacgctggatgagaagaatccaaagcggatatttgagggggaggctcttcttcgccggatgtttcgatacgggcttttggaggaggggcagaacaagctcgactatgtcttagctctgactgtggagaacttcctggagcgcaggctgcaaacccaggtcttcaagtctggaatggcgaagtccattcaccacgctagggttctaatcaggcagcgccatattcgggttggaaggcaggtggtgaatattccctcattcatggtgagggtggattcagcaaaacacattgatttttcgctcaccagtcctttcggcggcggccgccctgggagagtcaagcggaagaaccagagagctgccgctaagaaggctgctggtggtgatgccgaagaagaagacgaagaatagaactgaaatgtttgtcttgtgagccttcaatttacttctccattattacattttcatcccatttttaggtgattttatgctttcaacctttggattgtttggatggataaggattttgcgggtccactgtcattttttgttttgcagttatttccaggatttgcgataagtttttgggttatgatgttttaactactgagttatgaggagtttatgtttt

SEQ ID NO: 2714 - DNA, 957 bp, Phalaenopsis aphrodite
aaatctcccaccgtcccgcctccgttgcgactccagttctctgtaagcgaggcggctttggagtttggtctttttgggagaaccagccatggttcacgttagcttttacaggaactacgggaagactttcaagaagccccgtcgtccgtacgagaaggaacggctggacgcggagcttaagctggtcggggagtatgggttaaggtgcaaaagggagctgtggagggttcagtatgcgctgagccggatccgtaatgcagcgagggagctcctgacacttgatgagaagaaccctaagcgaatttttgagggtgaggctcttcttcgccggatgtttagatacgggctgctggaggagggtcagaacaagctcgactacgtcttggccttgactgtggagaactttctggagcgcaggctgcaaacccaggtctttaagtctggaatggccaagtcgattcaccatgctagggtcctcatcaggcagcgccatattcgggtgggtagacaagttgtgaatattccatctttcatggtgagggtggattcagctaagcacattgatttttcactcaccagcccctttggtggtggccgccctggaagagtcaagcggaagaaccagagggctgcagccaagaaggcagctggaggtgatggggatgaggaagatgaagattaatctcttccatttttctctttttttttttatttaaccaatggacgagacaccattactttgtgagccccttgttactactttctgatttgtcctttttaaagaaatttaacttgaatttattatgcgtttttgcaatctgttttcgttttgccgtgaaatgaatttgggattctcttaaactttttaattttaatgtacgaatacgtctgaatgtttagattgcatgaatttcgatgttcatgatcagtggtactttagcctttttttaataactt

SEQ ID NO: 2715 - DNA, 832 bp, Lippia dulcis
ctgcgatcagcagcggcatatcggtgggctgaaaatcgcatcggcgacgggggcagcggcggagagccatggtgcacgtgaacttttaccgaaattatgggaagacatttaagaagcctcgtcgtccctatgagaaagagagacttgatgctgagctaaagcttgttggagaatatggtctgaggtgtaagagagagctctggagggttcagtatgctctgagccgtattaggaataatgcaagaatgcttttgactcttgatgagaaggatcctcgtcgtatttttgaaggtgaagcccttctaaggaggatgaacagatatgggctgttggatgagagccagagcaagctcgattatgtcttggcacttactgtggagaatttcctagagcgccgcctccaaactctcgtgtttaaggctggtatggccaagtcgattcatcatgctagagtactcatcaggcaaaggcatatcagggttgggaggcaagtcgtgaacgtaccatcctttatggtgagggtggattcccagaagcacattgatttctctctgacaagtccgttcggtggtggtcgccctggtagagtgaagagaaggaaccaaaaagcagctgcaaagaaggcttctggtggtgatggagatgaagaagatgaagagtgagctcttgtagtagtttattatggaattaattggtgccattttgacttttatttctgctgtttgtattgtctttaagctctcagtggattttgttgagatattaagaattaaaaagaattctaagattcgggatgttgctattgacaattaatgttaagttcccaaaaaag

SEQ ID NO: 2716 - DNA, 981 bp, Platanus occidentalis
cgtcctctgcaatctttccctttcaacacgaggcgggaacggcgacggaggcatggtgcacgttaatttctataggaactatgggaagactttcaagaagcctcgtcgtccttacgagaaggagcgtttggacgctgagttgaagctcgtcggagagtacggtctccgatgtaagagggagttgtggagggttcagtacgctctgagccgcatccgtaatgctgcgagggagcttctcactcttgacgagaagaatccacgccggatattcgagggtgaagcccttttgcggaggatgaacaggtatgggcttttagacgagagccagaacaagcttgattatgtattggcccttactgtggagaactttctcgagcgccgtctccagactcttgtgttcaagtcgggtatggcaaaatcgatccatcatgcccgagtgctcattaggcagaggcatatcagggttgggaggcaggtggttaacattccatcattcatggtgagggtggactcgcagaagcacatcgatttctcgctcactagtccacttggtggcggccgccctggccgagtgaagagaaagaaccagatggcagctgccaagaaggctgctggtggggatggagatgaagaggatgaggattgagcccgtgttcgtccgtcatttataactagctttccctcaactcctttaggaagtttgccttttttttttttttttgtagaacttaagatcttaaagttgataagtagaagttttgggtggtttatgttttagacagacatacacactcttgatcgtcactatgaagaattttgcttcgtttattttactatatgttttttgaatacagggtgagttgttacgttattgatatttggtatgtggaattgatgactgggtgtccgttccaccatgagccgtttggattttattttggtctgtgggtgttcaaatgtggatgcgatttgtaaactaac

SEQ ID NO: 2717 - DNA, 844 bp, Sarracenia psittacina
acgagcgagctgaagaaacagcaatggtgcacgtctcgttctaccgaaactacgggaagacatttaagaaaccccgccgtccctatgagaaggagcggttggatgctgagctgaagcttgtgggagaatatggacttcggtgcaaaagggaattgtggagggttcagtatgctctgagtcgtattcgtaatgctgcgaggatgcttcttactcttgatgagaagaaccctcgccgaatctttgagggtgaagctcttctccgaaggatgaaccgttatggccttttggatgagagtcagaataaactcgattatgtcttagcgttgactgtggagaacttccttgagcgccgtctccaaacacttgtgttcaaaactggtatggcaaagtccatccatcatgctagggtgctcatcagacagaggcatatcagggtcggaaggcaggtggtgaacatcccatctttcctggtgagagttgactctcagaagcacattgatttctcgctgacaagtccactgggaggtggacgccctggtagggtaaagagaagaaaccagaaggcagctgccaagaaggctgcaggtggagatggagatgaagaggacgaggaatgagtgctgataaggaattttgcttgtagcaataatatgttgcgttcctgatcctgcattagacaccatcctactataggatagttttgttatagaccttcaaatttggtattggtatttgaaatgactttttgtttttttgataatagaaatgactttttgttgtgttttattgtatgtgattgcaagtatttttgacattctttaaagaaagtggtttgtgttttgtg

SEQ ID NO: 2718 - DNA, 825 bp, Silene vulgaris
agagagtgaagcagaacaacaataatggtgcacgttaatttctaccgcaactatgggaagacctttaagaagcctcgccgcccttacgagaaggagcggttggatgctgagttgaagcttgtgggagagtatgggcttaggaacaagagagagttgtggagagttcagtatgtgttgagtcgtatccgtaatgctgcccgtcatcttctcacccttgatgagaagaacccacgtcgtatctttgagggtgaggctctactccgtaggatgaaccggtatggtttactcgaagagggtcagaacaagctcgattatgtgttggctcttaccgttgagaacttccttgagcgtcgccttcagacacaagtcttcaagtctggaatggccaagtctatccatcatgctcgtgtgcttatcaagcaaaagcacatcagggttggaaggcaggtggtgaatgtcgcgtcattcatggtcagagttgactcacaaaagcacattgacttctcattgaccagtccattcggaggaggtcgtcctggaagagtgaagcgaaagaatcagaaggctgctgctaagaaggcttctggtggagatggagacgaggacgatgaggagtaagcattcaactattcctagtatgccgtagcttcacaactttatttttgatgcatggtgacttttgtttcatctttgttgtcattatcaactttaaataatagtacccttttttttagcttgtgatcgtggttcctatatgtgattacctttgtggtcctaaggcttgtgttatgcacatttagaacttaagttgtttgacaatgttac

SEQ ID NO: 2719 - DNA, 948 bp, Solanum phureja
aaaccctagtgtctctctaaccctagctgatttctcagttcatttcagcaggtcgccgattgaggacggcgccgtcaaccggtaaacatggtgcacgtcaacttttaccgcaactatgggaagacctttaagaagcctcgacgtccttatgagaaggagaggttggatgcagagttgaagcttgttggagagtatggactgaggtgcaagagggagttgtggagagttcagtatgctttgagccgtatccgaaatgctgcaagaatgcttctgacccttgatgagaaagattcacgtcgtatttttgaaggtgaagctctcttgaggaggatgaacagatatggattgttggatgagagccagaacaagctcgattatgtcttggcactcactgtcgagaacttccttgaacgtcgtctgcaaacccttgtgttcaagactggcatggctaagtcaattcaccacgcaagagtgctcatcaggcaaaggcatatcagggttggaaggcaagtggtgaatgttgcttcattcatggtgagagtggactctcagaagcacattgacttctctctaaccagtccttttggtggcgggcgtccaggaagagtgaagcgaaagaaccaaaagtctgctgccaagaaggctgctggcggtgatggtgatgaggaggatgaagaatgagcttttgcgtaagaacccaaagaaagctgtctggtgatggaactgttaatttttgaagtttttagttacctatgtagttcttccttacattcctttcttcgatattttggtatcttcacatattagaaagaaatgtttttagcagagattgtgagaatatttttatgtttggattttgcactcatctttagagtttcaacaatttgtttttaacaagactacctcttgttttatgagatagaagtgagtctagtaagttattccctc

SEQ ID NO: 2720 - DNA, 875 bp, Euphorbia esula
  misc_feature (6)..(6): n is a, c, g, or t
  misc_feature (53)..(53): n is a, c, g, or t
  misc_feature (62)..(62): n is a, c, g, or t
  misc_feature (260)..(260): n is a, c, g, or t
  misc_feature (410)..(410): n is a, c, g, or t
  misc_feature (512)..(512): n is a, c, g, or t
tttttnccttggagggggcggcgttgatagagatcagagccggagcaatggtncacgtttcnttctatcgcaactatgggaagacattcaagaagccaaggcgtccttacgagaaggagaggttagatgcagaactgaagctggtgggagaatacggactgcggtgcaagagagaattgtggagggtgcagtatgcattgagtcgcataagaaatgcagcgagaatgcttctgacactagatgagaagaacccacgccgnatctttgagggggaggcccttctccgaaggatgaaccgttatgggctattggacgagtctcaaaacaagcttgattatgtgttggcattgactgttgagaacttcctcgagcgtcgcctccaaactcttgttttcaagtctggtatggcnaagtccatccaccatgctcgtgtcctcatccgccagaggcatatcagggtcggaaggcaagcggtgaacataccatctttcatggtgagggtggactcccanaaacatatcgacttttcattgaccagtccactcggccctggacgacctggaagagtcaagagaaggaaccagagggctgctagcaaaaaggcttctggaggagatggtgatgaagaggatgaggagtgattccttctcataggaaatttaaacctacttttggtaagtaatgttacttggttaaatttgtgactgccaacatttttcttaggaaaagctttcggattgatatgtttaattttagacttgtgtaattgtatttttgtttggggtttatttaagttgttcctatgtttatgacctttcatgaggatttgaattttgcttagaatggaactatttaattttatggtttcaaggatt

SEQ ID NO: 2721 - DNA, 855 bp, Helianthus annuus
cgcggggacctcactcttgttgcaggttgatttctcacggcgtctccgttttcagcgaaggaagaaagtgagaagagcagcaagcagttgctgcactgaaattggacagcaatggtccatgtgtcattttatcgaaactatggaaagactttcaagaagccccgccgtccatacgagaaggaacgtttggacgctgagttaaaactcgtaggagaatacggtctccggtgcaaacgcgagctctggagggtgcaatacgctcttagtcgaattagaaatgccgcaagaatgcttttgacccttgaagaaaaggacccccgtcgaattttcgagggtgaagcacttatgaggagaatgaaccgttacgggcttttggatgagagccaaaacaagcttgattatgtgttggcacttaccgttgagaactttctagaacgtcgtttgcagacactcgtgttcaagaccggtatggctaagtctattcatcatgctagagtgctcatcaagcagaggcacatcagggttggaaggcaagtggtgaatgttccgtctttcatggtgagagttgactcacagaagcacattgacttctcgctcacaagtccctttggtggtggccgacccggcagagttaagcgaaagaaccaaaaagctgctgccaagaaggcggcaggcggtgatgctgacgaggatgatgaagaatgagctgttacttgtatcaaaggctttcttcatctctattatctttgtggtcgtcgtttatttattcgtctttcgaacctttttatccttaggaagttttggatgttttcgctttgatgttaaggttttgatatcggattatgtttttatatg

SEQ ID NO: 2722 - DNA, 835 bp, Helianthus annuus
aagaagaagagccgcacgtcgaacaacaatggttcacgtctccttctaccgcaactatggtaagacttttaagaagccccgtcgtccttacgagaaggaacgattggatgctgagttgaagcttgtgggagagtatggtcttagatgcaagagggagctttggagagtgcagtatgcattgagtcgcattcgtaatgccgctagaatgcttttgacgcttgaggagaaggacccgcgtaggatctttgagggtgaggctcttatgaggagaatgaataggtatgggcttttggatgagagtcagaacaagctcgattacgtgcttgcgcttactgtggagaactttcttgaacgtcggttacagacacttgtgttcaagactggtatggctaagtctattcatcatgctagagttctcatcaagcagagacacattagggttggaaggcaggtggtgaatgtgccgtctttcatggtgagagttgactcgcagaagcacattgacttttcgctcactagtccgtttggcggtggccgaccaggaagagtgaagcgaaagaaccagaaggcggctgctaagaaagcggctggtggggatgctgatgaggatgatgaagaatgagctcactcttttggttctgagtattagtgttgttttgctattgcgtgaggtctaatgagcatttgttatcgctataatgactttttgtaggaagttttggatgctttgcaaagtcttttggtgattttatcaagtcattttatggattttttatgctttgaagttgttatttagaactcatttaattgcatatagaacatcaacatgttttgt

SEQ ID NO: 2723 - DNA, 919 bp, Helianthus annuus
cagagtacgcgggggcataaccgctgttgcaggttcattcagatctctaaaccctaattatcagcatcagcagtaaaaggaacacgcgatcgctacatagtcagtgaatttgttcaacaatggttcacgtgtcattttaccgcaactatgggaagacttttaagaagccccgacgcccttacgagaaggagcgtttggatgcagaactaaagctcgttggagagtacggtcttcgatgcaaaagggaactctggagggtgcaatatgctcttagcaggattagaaatgctgcaagaatgcttttgactctcgaagagaaggacccacgtaggatttttgagggtgaagcgcttatgcgaagaatgaaccgttacgggcttttagacgagagtcaaaataagcttgattacgttctggctcttactgttgagaactttctagaacgccgtttgcagacacttgtgtttaaaactggtatggctaagtctattcaccatgctagagtccttatcaagcagaggcacatcagggtcgggcgacaagtggtgaacgtaccgtcattcatggtgagggttgactcacagaaacacattgacttttctctcactagtccgtttggtggtggccgaccaggcagagtgaagcgaaagaaccagaaggccgctgcaaagaaggcggcaggtggtgatgctgatgaggatgatgaagaatgagctgacgcctactttttgttaaatcaaaggtttcatgtttattgtcttacagtttgcggaactttttaatgtttgaaagttttcaactgctttcttgttaagaattttataatgggttttgccttaatgtctaccgcaaaaagggcacggactggccgggccgcccctcgtccgggtcttaatcaaggctatttttatcttcggcg

SEQ ID NO: 2724 - DNA, 775 bp, Helianthus annuus
ggagccagaagaagagatcattcaactagccgccgtcgtcgtaacgacgtcgtacaacaatggttcacgtctccttctaccgcaactatggtaagacattcaagaagccacgacgtccttacgagaaggaacgtttggacgctgagttgaagcttgtcggtgaatacggtcttagatgcaaacgtgagctctggagggtgcagtatgccttgagccgtatccgtaacgctgcaagaatgcttctgacccttgaggagaaagacccacgtaggatctttgagggtgaagcccttatgaggagaatgaaccgatatggtctgcttgatgagagccagaacaagctcgattacgtgttggcacttactgtcgagaactttcttgaacgtcgtcttcagacccttgtgttcaaaactggtatggctaagtcgattcatcatgctagagttctcattaaacagagacacatcagggttggaaggcaggtggtgaatgtgccttcgtttatggtgagagttgactcacagaagcacattgacttctcgctcactagtcccttcggaggtggccgaccaggaagagtgaagcgaaagaatcagaaggcggctgcgaagaaggctgctggtggggatgctgacgaggatgacgaagaatgagcttacgtgcctggttcttagttttattgttggtttttatgttttttcttggatttagttaatgataagtttatgctttggagttgctattttgaaacttattatcatatcattatgctttt

SEQ ID NO: 2725 - DNA, 908 bp, Nicotiana tabacum
ccccctcccgttcccttcagcagatcgccgacgacagcggcggtgaccggaaaacatggtacacgtcgccttttatcgtaactatggaaagacctttaagaagcctcgacgtccatatgagaaggagcgattggatgccgagttaaagcttgttggagaatatggattgaggtgcaagagggagctttggagagttcagtatgccttgagccgtatcaggaatgctgcaagaatgcttctgactttggatgagaaagacccacgtcgtatttttgaaggtgaagcactcttgaggaggatgaatagatatgggttattggatgagagccagaacaagctcgattacgtcttgtctctcactgtggagaactttcttgaacgtcgtcttcaaactcttgtcttcaagactggcatggctaagtcaatccaccatgctagagtactaattaggcaaaggcatatcagagttggtaggcaggtggtgaatgttccttcttttatggtgagactggactcccagaagcacattgacttctctctcatcagtccttttggtggtgggcgccctggaagagtgaagagaaagaaccaaaaggctgctgcaaagaaggcatctggtggcgacggagacgaggaagatgaagaatgagctcttatgtttatttgcatttggatcttatacttcgcctatttagtactttcttgttttatgttttgcaacttttatgtactgtcgcgtgttagaaatgttttggtttggtttagcacttgttaggctttggcctaaatttatgattgaatcagatgacctggttttaagagcagttttgtctttgtttaaactagacaatgaattgttggggtttacttgaatcaaattcgagatcatacataacagctcccaatcg

SEQ ID NO: 2726 - DNA, 1130 bp, Nicotiana tabacum
  misc_feature (128)..(128): n is a, c, g, or t
  misc_feature (182)..(182): n is a, c, g, or t
  misc_feature (185)..(185): n is a, c, g, or t
  misc_feature (838)..(838): n is a, c, g, or t
  misc_feature (885)..(885): n is a, c, g, or t
accgaagaacttcattaaatcaaaccctagtgtctctctaaccctatcagtttcttctttcactttcagcaggtacgtagccgatctgaagacggcgccgtcgaccggtaaacatggtacacgtcgcnttttaccgcaactatgggaagacctttaagaaacctcgacgtccctttgagaanganagattggatgcagagttgaagctcgttggagagtatggactgaggtgcaagagggagctgtggagagtccagtatgctttgagccgtatcaggaatgctgcaagaatgcttctgacccttgatgagaaagatccacgtcgtatttttgaaggtgaagcactcttgaggaggatgaacaggtatggtttgttggatgagagccagaacaaactcgattatgtcttgtcactcactgttgagaacttccttgagcgtcgtctgcaaacccttgttttcaagactggcatggctaagtcgatccaccatgctagagtactcattaggcaaaggcatatcagagttggaaggcaagtggtgaatgttccttcgtttatggtcagagtggactctcagaagcacattgacttctccctaaccagtccttttggtggcggacgccctggaagagtgaagagaaagaaccaaaaggctgctgccaagaaggcttcaggtggtgatggtgacgaggaggatgaagaataagcatttgcactagaaccaaaaggaagccgacggtgatggagcttgtgttcgtttttatttagttacccatgtagtgcttccttacattcctttcttcgatattgtgtaccttcatatgttagaaagaaatnttcttagcagagattgggagaatgttttgaagtttggattttgcacngatggttagagttttgacaatttgtttttgaaccagacgacatgttatttaagtggttgaagtgagtccagcaagattattgcctcgcttcagcccttttctttagatagaccatgaattttttttactctgagattgcatgtcattttacggtgttgtaatctgaaagtctggactatcttcttggtcgaacttttggtttttggcaattaagtcacctgagaaatccagtggtttttagatgc

SEQ ID NO: 2727 - DNA, 838 bp, Nicotiana tabacum
catctcctttccccttccccttccccttcccttcagcagatcgccgacgacagcggcggtgatcggaaaacatggtccacgtcgccttttatcgtaactatgggaagacctttaagaagcctcggcgtccctatgaaaaggagcgattggatgcagagttgaagcttgttggagaatatggattgaggtgcaagagggagctgtggagagttcagtatgctttgagccgtatcaggaatgctgcaagaatgcttctgaccttggatgagaaagacccacgtcgtatttttgaaggtgaagcactcttgaggaggatgaacagatatgggttattggatgagagccaaaacaagctcgattatgtcttgtctctcactgtggagaactttcttgagcgtcgtctccaaacccttgtcttcaagactggcatggctaagtctatccaccatgctagagtgctcattagacaaaggcatatcagagttggtaggcaggtggtgaatgttccttcttttatggtaagactggactcccagaagcacattgacttctctctcatcagtcctttcggtggtgggcgccctggaagagtgaagagaaagaaccaaaaggctgctgcaaagaaggcatctggtggcgatggagatgaggaagatgaagaatgagctcttatcttttcttgtgtttggatttaatatttatacttgcctatttagtacttgttttatgttttgctacttttatgtactgtcgtgtgttagaaatgtttttaatgaagatattttgggtttggtttagcacttgttaggcttaggcctaaatttatgattgaatcaga

SEQ ID NO: 2728 - DNA, 880 bp, Tragopogon dubius
cgtcggggacttcacagctcttgcaggttgatttctcgcgtcgtctcagttagcaggaagcagctgagagaggttacctcattggcatcagataacaatggtgcatgtctcgttttaccgcaactatgggaaaactttcaagaagccccgtcgtccatacgagaaggagcgattagatgctgagttaaagcttgttggagaatacggtcttcgatgcaaaagagagctctggagggtgcaatatgctctcagtcgcatccgtaatgctgcaagaatgcttctaacccttgaagaaaaggacccacgtaggatctttgagggtgaggctcttatgagaaggatgaacaggtatggcttgttggatgagagccaaaacaagctggattacgttcttgcccttactgttgaaaactttcttgagcgccgtttacagacacttgttttcaaaactggtatggccaagtccattcatcatgccagagtcctcattaagcaaaggcacatcagggttggaaggcaagtggtgaatgttccatcattcatggtgagagttgactcacagaaacacattgacttttctctcactagtccctttggaggcggccgacctggcagagtgaagcgaaagaaccaaaaggcggctgccaagaaggcggctggtggtgatgctgacgaggatgatgaagaatgagctttcaccattttgttctatcaaaaaaggttaaatctttttactattattatcttagcaaacattgttatttcatcttattttgaaccttgtatcctaggaagttttgatgtttttttggtaacgaatatatcgagatcctaaagtgttgaaacataataaacgtcatattatcgtagggttaattat

SEQ ID NO: 2729 - DNA, 822 bp, Tragopogon dubius
tctacttcatagagaagaaggggaggccgccggaagcgagaggaagatatcaatcaagtagccgccggatcgacgtcgaacgacaatggttcacgtctccttctaccgcaactatggtaagacattcaagaagcctcgacgtccttacgaaaaggagcgattagacgctgagctgaaactcgtcggagagtacggtctccggtgcaaaagggagctatggagggtgcagtacgctctgagccgcatccgtaacgccgcaagaatgcttctaaccctagaagagaaagacccacgtagaatcttcgaaggtgaagctctgatgagaaggatgaacaggtatggcctattggacgagagccaaaacaagctcgattacgtccttgccctaactgttgaaaactttcttgaacgccgccttcaaacactcgtgttcaagactggtatggccaagtcaatccaccacgctagagtcttaatcaaacagagacacataagggttggaaggcaggtggtgaatgtgccgtcgttcatggtgagggtggattcacagaagcatattgatttctcgttgactagtccgtttggaggtgggcgacctggaagagtgaagcgaaagaaccagaaggcagctgctaagaaggctgctggtggagatgctgatgaagatgatgaagaatgagagatattgtgaggtttatgagggtgtttgtttattttgatatgatgactattttgtaggaagttttgctttgtgaaagttttttgttggattaatttaaggataagttatgcaatggtgttgacgaaaaaaaaaaaaaagta

SEQ ID NO: 2730 - DNA, 917 bp, Triphysaria pusilla
aattaaagtttgtgaaatgcaattagggtttgctcatatattaaagaaaaccctctcccttcatttccttcagagcattgtgcccttcagccgacgtagcctgtcactatggtgcacgttagcttctaccgcaactatggcaaaaccttcaagaagcctcgccggccctatgagaaggagcgtttggatgctgagctgaagctcgttggagagtatgggcttcgttgcaagagagagctatggagggtccaatttgcgctgagccgtatccgtaacaatgctcgagaccttctcacacttgatgagaaagaccctcgccgtatctttgaaggagaagcccttctccgaaggatgaacagatacgggcttttggacgagagccagaacaagctcgattacgtcttggccctaactgtcgagaactttcttgaacgtcgtttgcagactctagtgttcaaggctgggatggccaagtctattcaccacgctcgtgtgctcatcaggcagaggcacattagggttgggagacaagtggtgaatgtgccttcgttcatggttagagttgattcccagaaacatattgatttctcactcacaagcccattcggaggtggccgtcccggaagagttaagcgaaagaaccagaaagctgctgctaagaaagctggcggtggtggtgatgaagaggaggacgaggattaagttgcaataaaaaactaaagttttactgttcttgattttgctttaattttgtaaaaggagtctattgaagtttttttttgcttgcttttatcttcattttctcagatatgagccttttgatggagaatgctgtggtttatgtaggaatatcagtgatatgaggattctttttatataatttcataacatattctgatccgtaggtcggatttgtg

SEQ ID NO: 2731 - DNA, 947 bp, Citrullus lanatus
aaaccctagccgcttcttattcccttttgcttcatataccctcttctcttctcgctctcctctctctggcattcgagatcatctccttgtgaagccgtagcagagaagagatcatggtgcacgtctccttttataggaattatgggaagacattcaagaaaccccgacgtccttatgagaaggagcgtctggatgcagagttgaaattggttggagaatatgggcttcgttgtaagagggagttatggcgggttcaatatgctttgagccgaatccgaaacaatgctcggatgctcttaacacttgatgaaaagaacccgcgtaggatttttgagggagaggctctccttaggaggatgaacagatatggtcttttggatgagagtcagaacaagctcgattatgtcttggcccttactgtggagaatttccttgagcgtcgtctccaaactctagtgttcaagtctggtatggccaagtctatccatcatgctagagtgctcatcaggcagaagcatataagggttggaaggcaagtagtcaatatcccttctttcatggtgagggtcgactcccagaagcacatagacttctctctcacaagtccgttcggaggtggacgccctggaagggtgaagagaaagaaccagaaggcggctgcaaagaaggctgctggaggagatggagatgaagaagatgaagattgagttacctaaaccttatctgtcactatttatgagagaatgttaaatccttcttaggagttttgctttaaatatgtttgaattaggtaacttgtttgttttctttggttatggggatttcattaacgtatttggtctttaagttgccacagttttcatgcattgatactggaccatttgaaggacttcgtttttctcaatatttctatgcattatgaattatttttagttcatttgatctaa

SEQ ID NO: 2732 - DNA, 1058 bp, Lactuca sativa
ggtttcattacgaccttctctacctaagaagcagcgcagagggaggaggccgccggtagtgaggagaacatcaaccaagtagccgccgtatcgacgttgaacaaccatggttcacgtctctttctaccgcaactatggaaaaaccttcaagaagccacgtcgcccttatgagaaggaaagattagatgctgagttgaagctagtaggagagtacggtttgagatgcaaaagggagctatggagggtgcaatacgcacttagcagaatccgtaacgctgcaagaatgcttctaacccttgaagaaaaagacccacgtaggatctttgaaggtgaagccctaatgagaaggatgaacagatatggactcttggatgaaagccaaaacaagctcgattatgttcttgccttaactgttgaaaactttcttgaacgtcgccttcagacacttgtgttcaagactggtatggcaaagtcaatccaccatgctagagtcctcatcaagcaaagacacataagggtgggaaggcaagttgtgaatgtgccttctttcatggtgagagttgactcacagaagcatattgacttttcactcacgagtccatttggaggtgggagacctggaagagtgaagaggaagaaccagaaggcggctgcaaagaaggcttctggtggagatgctgatgaggatgatgaagaatgaaaagcttgaaaaatgttatgaggtttattatgagtacttttgttatcttgataataactcttttgtaggaagttttgaatgcttttggaagatttttgttggtttttttacttgttttttttgtggattcagttaatgatagattatgaattggagttggaaaaattgtgttgaatcttgggattttaggtgatccaaatacttactttagcatgttcgatagcatttcatccaacaattgttggaaagttaatcctgggtttgaaactactttaacattttaagaaaaattaggtataatgtaggttctttttttagtagagtatgtattattctgaaaaacaacattggattatgt

SEQ ID NO: 2733 - DNA, 792 bp, Cleome gynandra
tcgtctcttctttgcttcgcaaccatggtgaacgtcagcttctaccgcaactatgggaagaccttcaagaagccacgacgtccctatgagaaggagcgtcttgacgctgagttgaagcttgtcggagaatatgggcttcgttgcaagagagaattgtggagagttcaatatgcccttagccgcatccgtaatgctgctagggaccttctcactcttgatgagaagaaccctcgccgaatctttgagggtgaagcccttctccgtagaatgaacaagtatggtcttcttgatgaaagccaaaacaaactcgattatgtcttggctttgactgtcgagaacttcctggaacgtcgtctccagacccttgtcttcaagtctggtatggccaagtcgattcatcatgcccgtgtcctcatcaggcagaggcatatcagggtcgggaggcaagtggtgaacatcccatcattcatggtgagagttgattcacagaagcacattgacttctcgctcaccagtccattcggtggaggccgtccaggaagagtgaagagaaggaacgagaaagccggtgccaagaaggcaggcggtgatggagacgaggaagacgaagagtgaaggtctagagataccttaaaaatggactgagattggtccatacatgccttagtactgtttttactgttcggtttgagacaatttctgtcatagaggaagtattatgatgcttttattagtagaccgttgctttcttatccattttgttctatttacaaagactacttgtttgcttcc

SEQ ID NO: 2734 - DNA, 635 bp, Parthenium argentatum
aagaaggtgaggagaccagcaagcaatcgctgcattaaaatcggacaaccatggtgcatgtgccattttatcgaaactatggaaagactttcaaaaagccccgtcgtccgtacgagaaggaacgtttggatgcagagttaaaacttgtgggagaatacggtctccgatgcaaaagggagctctggagggtgcaatatgctcttagccgaattagaaatgctgcaagaatgcttttgactcttgaagaaaaggacccccgtaggatttttgagggtgaagctcttatgaggagaatgaatcgttatgggcttttggatgagagccaaaataaacttgattatgtgttggcccttactgttgagaactttttagaacgtcgtttgcagacacttgtcttcaaaaccggtatggctaagtccattcatcatgctagagtgctcatcaagcagaggcacatcagggtcggaaggcaagtagtgaatgttccatcattcatggtgagagtcgactcacagaagcacattgacttctctctcacaagtccctttggcggtggccgacctggcagagttaagcgaaagaaccagaaagccgctgcaaagaaggcggcgggcggtgatgatgacgaggatgat

SEQ ID NO: 2735 - DNA, 4209 bp, Zea mays
cccctttcttctccgtctcctccctgcctatcccatcccatcatcgtcgtctccctaccgcaatcgaagaaagggccgggctcaaccgagccctcaaatcgccgcatcgcgcccctagctctctccgtctccctcatcctgacctcgattcgagctagtttcgggaagcaaaggtaccggatcaacccccttgatcacccatggtgcccagggatagggcgcacagcgccgctgctgccaccgcgcccccgacggagaagcccgttcaagggcctatccagaacaacaagtgcgaaaagaaggctccaaagaaggtgcataaatctgagagagagaaacgtaagcgggacaagcagaatgatctctttggtgagctgggaaacatgctagaacctgatagacagaacaatggaaaggcatgcatattaagtgacactacacgaatacttaaagatctactttcacaagtagaatctcttcgaaaggagaacaacacgctgaagaatgagtctcattatgtcgctttggagagaaatgaactactggatgaaaccaatatgatccgtggcgaaatatcagaccttcaaaacgagatgaggatgcggctagaagacaactctatctggagtcatgacacttctagaccaaatcttacagcaccccatccagcgaccacagtatttacattgcagcattcaccacatccacaagtcattgcaacaatgacacttcctctgcaacagccagcagtcgttgagcaatcttacgctgccccacggcgggagctacagctattccctgaagctgcacccactgaagatactgagccaccacaaaacgaggggacctctaatcatgtgatgcggccgcaggcgaggtacccaccagcaatgaccactttgcctgggcatgtatatccagtccttccaagagtggaagatgagcaacgcagcagcggcactactggtagcagagaggaaggcggggtaggcaaccgttaacagctcgagtacaaaacgagagatctggctcacagtttgaaaagttctcgtagtttcaactttaatgtttccattctagctgatgtgctaaagaaaccttaaaacctatgcggctgtgcctgcacatgtaaatatcattccactctgtattacccgaacttaatcttcaactagttacttcgatgggagcaatctatctttgttagttcgtccacttcgtagtttatctgtagtacttgtaccaagcagaagttcaaggagtacctgattcgagaaaacatgttaatcactctttgtatctatagttctgtacaagcttggataactccgagcaaacgctagtctgcctgatgtaccactgtacagttacaatttttctcactggaaatcccaccttgagtatggttgcttaaattcagcaagtctggatacatcagcaagcaacaataacggagctgcagcctgcttccttcttcacagagattttctgtgtttctgaatccctcacttgagctatctcatcccaccggccttctgatgcgtatgtgttcgacagcagaatggcatctgaaggatggtagtggccaatggcgtccaactgtgcctgcaccatcctccccagcttcgcattgccatacactctgcaggcggcaagcaacgctctccacgccgtagcatcaccatgggatgacactctctgtatgagttcataggcttcatgtagacgccctgctcgtcccaggagatcgatgacgcagctgtagtgctcagggctgggagatatgccgtatcgctgcaccattgtctcgaggaattccttcccttcctgcaccaacccgccatggctacaagcagttagcagggctaggaaggtgaccccgttaggagccacaccgtcttccatcatcctgtagaacaaggagacggcggagcctggctgcccattaactccaaatcccatgaccatcgctgtccatgccttcacgtccctatctcgtattgcatcgaagactgcagctgcctcactggggcacccgcacttgaagtacatgtccatgatcgctgtcccgagcgtgctgtcaagctcgagccgtgcctcttcagcaagctcatggacagagcgaccggctgccaatgccccagacgctccacacgcagagagaacgcccacaagcgtcccagaactaggtctcatcccaagctgtctcattccaccaatcaagtccatcgcctcctggatctgcccagcctttgcatagccatccgccatacaattacacagcaccaagtctcttctagctgtctcatgaaacaccttgcttgcacactcaatgctgccctccctcacatacatcctcaccattgctgccgcaaccttcacatcgtcgcataaccctgccttagcgcagaagccatgcactgactccccttgccagccacacccaatcaaggtgatcaccacggtcacgttgacatccactccagaccacctcattgccgtgaacatctgaaccgctgtgcccacatcccctacattgacgtagcctccgatcatcgtgttccacgacacagcgtccttctcaggcatttccgcgaacatcctccgcgcgtccgccatgctcccgctgctgcagtagaagtggcacagcacattccgtaggctcacaatgtccaggaacccgtactgcagcacgagcgcgtgcacctgcttgccaatcgaagctgcctcggcgtcattggggattttcgcgcagagcgcgagcagcggctggaacgcgaactcgttgagctcggggaggcgcgcccgcgcggaggcgaggaccgagagggatgcggcgagggaggtcgcggaggggcacgacgagagcgcgcggaggatggcggtgtggtggaagagcgtgggccgcggcacggcggcgaagagggagagcgcgtaggggagcggcgcgagcggggaggcgatgagcctagcggtggggaacgcgtggtgcgggaagtgggagcatttcagcatcagggcgtggagctggagcaagtgccctggccgcgtcgccgacttgagcagcgccgtcagcggcttccgcggtagcatcgcccttggttgggagggcacgagctcgccggctcgttcgcatgagaggagacgtgtggactgttcgtcaggcgcgcgtgcgcgtgtcgccagtgcaaaaaaaataacgtaggctcagcggcgttcggggtgtccatctagcgaaaaaagcccagagcgggccgatgacactttacattactgaaccattactgaacatatagaatttagtgaagcccggcccatctaatcaaagctagggtttcttcgtccactccacccccccggctccgtctctcacgttagtttctaccgcaactatgggaagactttcaagaagccacgacgtccgtactagaaggagcgcctagatgctgagttgaagctggttggtgagtatggcctccgctgcaagcgtgagctgtggcgcgtgcagtatgccctgagccgtatcaggaatgcagccagggagctgctcaccctggatgagaagaacccacgccgtatctttgagggcgaggcactcctccgccgcatgaaccgacatggtctccttggtgagggacagaacaagcttgattatgtgctttgccctcactgttgagaactttctccagcgccgcctccagaccatcgtcttcaagaatggcatggccaagtccatccaccatgctcgtgttctgatcaggtagcgccatatcagggtggggaggcagcccgtcaacattccctcgttcatggtcagggtcgagtcagagaagcacatcgacttctccctcaccagtcctctgggtggtggtcctgctggaagggtgaagcgcaagaaccagaaggcctctggcggcggtggcggcggcgatggcgaggaggacgacgagtagtgctacgtaggattctgcgacatcaattggttgaaaatgtgagatggacactctagattattgtgtggtcttcaattcagaaatcctgcgatggtaaacaattttgcagcccgctactgacactcttgtttaattcaagcattggcatcgtgtccggacaccatgaattgtattcttgtttgcgtggctatttgctcgtctagcctttaggtcaatgtttaagactgaatcaaattggtagccaagtttgcattct

SEQ ID NO: 2736 - DNA, 818 bp, Centaurea maculosa
gcttcattttgctttctcaaggcagccatggttcacgtcaatttctaccgcaattatggaaaaactttcaagaagccccgtcgtccgtatgagaaggagcgtttggatgctgagttgaagctcgtaggagagtatgggctacgttgcaaaagagagctatggagggttcaatatgcattgagtcgcatccgtaatgctgcacgtatgcttcttactcttgaagagaaagacccacgccgaatctttgaaggtgaagcccttcttcgcaggatgaataggtacgggcttttggacgagagccagaacaagctcgattacgtcttggctttgaccgttgagaactttcttgaacgccgacttcagacactcgtgttcaaaactggcatggcaaagtctattcatcatgctcgtgtgctgattaggcagaggcatatcagggttggaaggcaagtggttaatgttgcatccttcatggttcgggtggactctcagaaacacatcgacttctctctcactagtccgttcggaggtggccgtcctggaagagtgaagcgaaagaaccaaaaagcagctgctaaaaaggcttccggtggagacggtggagatgaagaggatgaagattaagccatcttaatgaatacccgtaagtctcttatgattgtacttttcgctttttctcaatcaatgttgttagttgttacttaaacagtaaacacccaagttttatgatttagttttcttatagtatttgttgttggactccatcatgtttcaagttatacaacttttttggatgcaaatgagattatttttctccg

SEQ ID NO: 2737 - DNA, 841 bp, Centaurea maculosa
ccaccctatatagccgaagaagcaaatccttctacttcttgcttcattttgcattctcaaaggcagccatggttcacgtcaatttctaccgcaattatggaaaaactttcaagaagccccgtcgtccatatgagaaggagcgtttggatgctgagttgaagctcgtaggagagtatgggctacgttgcaaaagagaactatggagggttcagtatgcattgagtcgcatccgtaatgctgcacgtatgcttcttactcttgaggagaaagacccacgccgaatctttgaaggtgaagcccttcttcgcaggatgaataggtacgggcttttggacgagagccaaaacaagctcgattacgtcttggctttgactgttgagaactttcttgaacgccgtcttcaaacacttgtgttcaaaactggcatggcaaagtcgattcatcatgctcgtgtgctgattaggcagaggcatatcagggtcggaagacaagtggttaatgttgcatctttcatggttcgggtggactctcagaaacacatcgacttctctctaactagtccgttcggaggtggccgtcctggaagagtgaagcgaaagaaccaaaaagcagctgctaaaaaggcgtccggtggagacggtggagatgaagaggatgaagattaagccatcttaatgatacccgtaagtctcttatgattgtacttctcgtttttcaatcaatgttgttagttgttacttaaacagtaaacaccaagttttatgatttagttttcttatagtatttgttgttgaactccatcatgtgtcaagttatacaacttttttggatgcaaatgaga

SEQ ID NO: 2738 - DNA, 937 bp, Centaurea maculosa
  misc_feature (35)..(35): n is a, c, g, or t
  misc_feature (37)..(37): n is a, c, g, or t
  misc_feature (665)..(665): n is a, c, g, or t
  misc_feature (762)..(762): n is a, c, g, or t
  misc_feature (778)..(778): n is a, c, g, or t
  misc_feature (794)..(794): n is a, c, g, or t
cgcggggaacctagaagagaagaaaagcaagcagnangcagcagcagcagcagtcgccgccggtggacggaggagcatagcaaccgccgccttgacgacgtcaatcaacaatggtgcacgttaacttctaccgcaactatggaaagactttcaagaagccccgtcgtccttatgagaaggaacgactggatgctgaattgaagcttgtcggtgagtacggtcttagatgcaaaagagagctctggagggtgcagtacgctcttagccgcatccgtaatgccgcaagaatgcttttgacccttgaggagaaagacccacgaagaattttcgagggtgaggctcttatgaggaggatgaacagatatggtctgttggacgagagccaaaacaagctcgattatgtgttggccctcactgttgaaaacttccttgagcgccgccttcagacacttgtcttcaagactggtatggcgaaatccatccaccatgccagagtcctcattaagcagaggcatatcagagttggaaggcaagttgtgaacgttccatcgttcatggtgagagtggactcacagaaacacatcgacttctcgctcacaagtccgttcggaggtggccgacccggaagagtgaagcgaaagaaccagaaggcggctgcgaagaangcagctggaggaggagatgccgatgaggatgatgaagaatgagcacttggttgctacttcttatatctatgtttttttgtccgtacaagtgaatgtnttgttctgggtttctntagactggggagttantgtttcttgatttactgctgagatttgtatgaattatgttttaagatttctagatacaacaacatgatagcatcactaatgacggcgctagtaactcgagaatgcttccctatattgagtcggtattatagcctaggcacttg

SEQ ID NO: 2739 - DNA, 918 bp, Cirsium arvense
gggtttctagatttagggcattctctactactaccctatatagccgaagaagcaaatcggtcatatttcttgcttcattttgcattctcaaaggcagccatggttcacgtcaatttctaccgcaactatggaaaaactttcaagaagccccgtcgtccatatgagaaggagcgtttggatgctgagttgaagctcgtaggagagtatgggctacgttgcaaaagagaactatggagggttcagtatgcattgagtcgcatccgtaatgctgcacgtatgcttcttactcttgaggagaaagacccacgccgaatctttgaaggtgaagcccttcttcgcaggatgaataggtacgggcttttggacgagagccaaaacaagctcgattacgtcttggctttgactgttgagaactttcttgaacgccgtcttcaaacacttgtgttcaaaactggcatggcaaagtcgattcatcatgctcgtgtgctgattaggcagaggcatatcagggtcggaagacaagtggttaatgttgcatccttcatggttcgtgtggactctcagaaacacatcgacttctctcttactagtccattcggaggtggccgtcctggaagagtgaagcgaaagaaccaaaaagcagctgctaaaaaggcttcaggtggagacggtggagatgaagaggatgaagattaagccatcttaatgatacccgtaagtctcttatgattgtactttttgctttttcaatcaatgttgttagttgttacttaaacagtaaacaccaagttttatgatttagttttcttatagtatttgttgttgaactccatcatgtgtcaagttatacaacttttttggatgcaaatgagattatttttcttacaaaaaagtaaaaaagtaccgactgcgactcta

SEQ ID NO: 2740 - DNA, 869 bp, Prunus persica
cactgctcggcagctctctctctctctacgatcttttctggatctgacctaaggctaaccagccatggtgcacgttagcttctaccgcaactacgggaagacttttaagaagccacgacgtccttatgagaaggagcgtctggatgctgagttgaagctggttggagaatatgggcttcgatgcaagagggagttgtggagagttcagtatgctttgagtcgtatccgaaatgctgctagggaacttcttactctggatgagaaaagtcctcgccgtatctttgagggtgaggcccttcttcgcaggatgaacaggtatgggcttctggaagagacccaaaacaagctcgattatgttttggcattgactgtggagaactttttggagcgtcggcttcaaacccttgtgttcaagactggtatggctaagtccatccaccacgctagggtgcttataaggcaaaggcacatcagggttggaaggcaggttgtcaacatcccatctttcatggtgagggttgactcccagaagcacattgacttctcaatcactagtcccctcggaggtgggcgccccggaagagtgaagagaaggaaccagaaggcagctgccaagaaggctgcaggtggtggtgatggagacgaagaagatgaagagtgaagagtggatgaggcctcaacttagatcgtgcttttattttatgtgctccttatttcatcgttagtttcttttactgacttcacagtctgtattgtagtggatggtggtaaacgtttcctgttcttgttttattgcgcctagaactcaaatgttttgcttttaaataccttagtaatgaattttgtggtggtaacttgagagattttta

SEQ ID NO: 2741 - DNA, 879 bp, Carthamus tinctorius
cgctaggcggggctgcttattttgctttctcaaggcagccatggttcacgtcaatttctaccgcaattatggaaaaactttcaagaagccccgtcgtccatatgagaaggagcgtttggatgctgagttgaagctcgtaggagagtatgggctacgttgtaaaagagaactatggagggttcagtatgcattgagtcgcatccgtaatgctgcacgtatgcttcttactcttgaggagaaagacccacgccgaatctttgaaggtgaagcccttcttcgcaggatgaataggtatgggcttttggatgagagccaaaacaagctcgattacgtcttggctttgactgttgagaactttcttgaacgccgacttcaaacacttgtgttcaaaactggcatggcaaagtcgattcatcatgctcgtgtgctgattaggcagaggcatatcagggtgggaagacaagtggttaatgttgcatccttcatggttcgggtggactctcagaaacacatcgacttctctcttactagtccgttcggaggtggccgtcctggaagagtgaagcgaaagaaccaaaaagcagctgctaaaaaggcttccggtggagacggtggagatgaagaggatgaagattaagccatcttaacgatacccgtaagtcttttatgattgcacctttcactttttcaatcaatgttgttagttgttacttaaacagtaaacaccaagttttatgatttagttttcttatagtatttgttgaactccatgatgtgtcaagttatacaacttttttggatgcaaatgagatcatttttcttcatattatgctgtagtagatctctctacaagtgtggttatatatccttcattccatg

SEQ ID NO: 2742 - DNA, 929 bp, Triphysaria pusilla
aatcccgcaatcctcgagtggcttacagttctgctgcgaccagcacagatcggccggactgagaaacgcggcggtggtgaatcatggtgcacgtctcattttaccgcaattatggaaagacattcaaaaagcctcgtcgtccctacgagaaggagcggctcgatgctgagctaaaacttgttggagaatatggtcttaggtgtaagagggagctgtggagggttcagttcgcactgagccgtatccggaataacgctagagaccttttgactcttgacgagaaagatcctcgtcgtatttttgagggtgaggccctaatgaggaggatgaacaagtatgggctgcttgacgagagccagaacaagctcgattatgtcttggccctcactgttgagaactttcttgagcgtcgtcttcagactctggtcttcaaggccggtatggctaagtccattcatcatgctagagtgcttatcaggcaaaggcatatcagggttggaaggcaagttgtgaacgtgccctcgttcatggttagagttgattcacagaagcacattgatttctctctgacaagtccgttcggtggtggccgtcccggaagagtgaagcgaaagaaccagaaggcagctgctaagaaggcctctggtggtggtgatggagatgaggatgacgaggaatgagctctagtttcatttgcttgaattctgaatgaaatgttagaaaacaatgttatgactgagtttttctgatggaacatatataaggatatggtgttacaaactatcaacgtttttttgttgggatattcaaatttatgatggtttacgcctttggtatgttcgtgtggaactaatgaagttgatttttagttatttatgtttcaacttatgatgacccattttaatatattttgttattctcaaaaaaaa

SEQ ID NO: 2743 - DNA, 892 bp, Triphysaria pusilla
ctcccgtttctactacgatcagcaattccagatcggcggagctacgatcgtctaggtgacggcccagaagaaccatggtgcacgtctcgttttaccgcaactatgggaagacctttaagaagcctcgtcgtccctacgagaaggagcgacttgatgctgagctgaagctcgttggagaatacggtttgaggtgcaaaagggagctctggagggttcagtttgcactgagccgtatcaggaacaatgcaagagacctcttgacccttgatgagaaggatccacgtcgtatctttgaaggtgaagcccttatgaggaggatgaacaagtatgggttgctggacgagagccagaacaagctcgattatgtgttggccctcactgttgagaactttctcgagcgtcgcctacaaactcttgtgttcaaggctggcatggctaagtctattcatcatgctagagtgctgataaggcaaaggcatatcagagttgggaggcaggttgtcaacgtgccatctttcatggtgagagtcgactctcagaagcatattgatttctcactgaccagcccgttcggtggtggccggcccggtagagtgaagcgaaagaaccagaaggctgctgcaaagaaggcgtctggtggtggagatggagacgaggatgatgaagagtaagcaatggtggtagtgtttttttcagttattgttattcgtactattaagaagcagtgtgtttaagatgttatgaattacgatgatgaatttcttaaagctttgatatgttcctttgacaatcagttttggtgtgtttttcatttatatcgaagatgaactttttgattatatgtatttggtttttcttcatattgttcttgaataagaagtgtcaatcttgg

SEQ ID NO: 2744 - DNA, 948 bp, Triphysaria pusilla
aaatgcaaaattgtgattcgagtccacattaactgctatggacgaatgcaattcccttttcgattgagctttttagctcgggcttgagagcttctagtccttgttgctcgtaatcagacagagtctcgagtggcttacagttctactgcgaccagcacagatcggccggactgagaaacgcggcggtggtgatggtgcacgtctccttttaccgcaactatgggaagacattcaaaaagcctcgtcgtccctatgagaaggagcggctcgatgctgagctaaaacttgttggagaatatggtcttaggtgtaagagggagctgtggagggttcaattcgccctgagccgtatccggaataacgcacgagaccttttgactcttgacgagaaagatcctcgtcgtatttttgagggagaggccctaatgaggaggatgaacaagtatgggctgctcgatgagagccagaacaagctcgattatgtcttggccctcactgttgagaactttcttgaacgtcgccttcagactctggtcttcaaggcgggtatggctaagtccatccaccatgctagagtgctgataaggcaaaggcatatcagagttgggaggcaggttgtcaacgtgccatctttcatggtgagagtcgactctcagaagcatattgatttctcactgaccagcccgttcggtggtggccggcccggtagagtgaagcgaaagaaccagaaggccgctgcaaagaaggcgtctggtggtggagatggagacgaggatgacaatggtggtagtgtttttctttcagttattgttattcgtactattaagaagcagtgtgtttaagatgttatgaattacgatgatgaatttcttgaagctttgatatgttccttcgacaatcagttttgatgtgtttttttatttatatcgaagatgaactttttgtgct

SEQ ID NO: 2745 - DNA, 1053 bp, Phaseolus coccineus
gaaccctagctgcgaaacctagtgcaccggaagggttgagaagcagacagagaggagccatggtgcacgtttccttttaccgaaactatgggaaaacgttcaagaagcctcgtcgtccatacgagaaggaacgtttggacgccgagttgaagctggttggggagtacgggcttcgctgcaagagggagttgtggagggttcagtacgccctcagccgtatccgtaataatgccaggaatctgttgacactggatgagaagaacccgcgccgaatcttcgagggtgaagcacttctccgaagaatgttccgttacggacttctcgacgagacgcagaacaagctcgattacgtgttggccctcaccgttgagaactttctcgaacgccgcctccaaaccctcgtcttcaagtctggcatggccaagtccattcaccacgccagagtcctcatccgccaaaggcacatcagggttgggagacaggtggtgaacattccatcgttcatggttagggttgattctcagaagcacattgacttctcactcacgagtccacttggtggtggtcgtcctggacgcgtgaagcgaaagaaccaaaaggctgccgctaaaaaggctgctggcggagatggagatgaggaggatgaagattaggttatttttggctagcaatcttttaagatattttgcccactatttaatttgtgatgtagacattttagaattttgtcatgctctgactcttatagtttttgccgtccttgtttcttgtttgaggtgaagttttgcctgagatatgatgattttgaactgttctttctaaaagtgatcaattgttgctacaatgcttgtggtgatctctggtgttttcataatttgaaccaactactgttacatctgtgattataggctggaaggcatttaaaaaaaatgatttggtaaggtgcccaatacaatagttttggtctcaattacagattatagaagtacattggacatttgttgtaaaacatcacagaaagtagcaagaatatttgtgcattgattttctgtt

SEQ ID NO: 2746 - DNA, 1434 bp, Gossypium raimondii
ttggtgcagacggtgcaaacaaagatagtcgtacaacaataattttaatagtttagtgacttaaataacaactttaaagttgactttttcagcttaatttttttgggggctatcaaatgaaaatccattagggtttaggcttttccctgtatataaatttcaactctccacttcatatctctttccgtacttcggcatcttcccctttccctccaactttaatctaccacaactgtaacgacgccatggttcacgtcagtttctaccgtaactatgggaagacctttaagaagccaagacgtccatatgagaaagaacgattagatgcagagttgaggcttgtaggagagtatgggctccgatgtaagagggagttgtggagggttcagtatgctttgagccgtatccgtaatgctgctagggaccttctcacccttgatgagaagaaccctcgtcgtatttttgaaggtgaagctcttcttcgtaggatgaacaggtatggacttttggatgagagccagaacaagcttgattatgtcttggctttgactgtcgagaacttccttgaacgccgcttgcaaacacttgtgttcaagactggtatggccaagtctattcaccatgcccgtgtcttgattaggcaaaggcatatcagggtcgggaggcaggttgtcaacatcccatccttcatggtaagggttgactcgcaaaaacatatcgatttctctctcactagtccgtttggaggtggccgacctggaagagtgaagagaaagaaccaaagagcagctgccaagaaggctgctggcagagatggcgatgaagaggaagatgagtaaaaccttagagggctactaccacccttagttacccttaaatagttttggagcttgccatttccttctccccattattagatatggtacgtatcttgcttctagacctttatctttagcgtatcttggtatatgtttttcatttaatattatgttcttttttcttggattggaagttaatgaaaggttattttgttcatttaaactagttagatagttcatatgttgcatgaactgggatgtaatattggatactgagtatgtgtccaatatggggtacgtttaaatttttgagtattttcatgtactccaaaaagtttttggaggatcgtactttggtttgatgtggtcagtgtatcaattaaggattgatggcatcatatgttcctaacaaactttgtgagattttgttgtcataataatgtctaatcattaatgattttgttttttttctcaacataatgatttttgttgtgctggaccttaaggatttatgcttgaactcaagctgtcccatagcaaggcaatcgatcttggctactcttttcccaattccaatcccttgctagatatttgccagttggagcttgagctatcg

SEQ ID NO: 2747 - DNA, 890 bp, Secale cereale
tcagcgctagggttttgctggcaggtataaaataccccttcttctcctctcgcattcctccctcctatcaactcgaccacagagcggcggcggcggcgggcggcagcgggagagagagaggagagagctccagccatggtgcacgtcaacttctaccgcaattatggcaagacattcaagaaaccaaggcgtccttatgagaaggagcgtcttgatgcagaactaaagctggttggtgagtatggactgaggtgcaagcgtgagctctggagggttcagtatgcattgagcaggatccgtaatgctgcaaggcactacgagggaatagggctgatgagagatcccgcgtatcttgaggcgctgctctctccgtcgcatgaaccgctatggtctccttgctgagggccaggataagcttgattacgtccttgccctgactgctgagaacttccttgcaaggcgcctcaagactcttgtcttcaaggctggcatggcaaaatccatccaccatgcccgtgtcttaatcaggcaacgccacatcagggttggcaggcagattgtcaatgtcccctcattcatggtgagggtggaatcggagaagcacatcgatttctcactgacaagtccattcggtggaggccctgcaggcagggtgaagagaaagaaccagaagaaggcaagtggtggcggtgacgctggtggtgatgaggaagaggaatgaggaactatcaccttatatttatcaaatgctggtgttatgagtactttagctgagaggcctgagacttacatgggttatcctcttgtcgtttttgtcacattatctctgttgttagcatgtatgcactttatgtttggatctatttggccgtgatgaaagttatctaaaa

SEQ ID NO: 2748 - DNA, 839 bp, Helianthus annuus
ggggttgcggttgatttctcacggcgtctccgttttcagcgaaggaagaaagtgagaagagcagcaagcagttgctgcactgaaattggacaacaatggtccatgtgtcattttatcgaaactatggaaagactttcaagaagccccgtcgtccatacgagaaggaacgtttggacgctgagttaaaactcgtaggagaatatggtctccgatgcaaacgcgagctctggagggtacaatacgctcttagtcgaattagaaatgccgcaagaatgcttttgacccttgaagaaaaggacccccgtcgaattttcgagggtgaagcacttatgaggagaatgaaccgttacgggcttttggatgagagccaaaacaagcttgattatgtgttggcacttaccgttgagaactttctagaacgtcgtttgcagacactcgtgttcaaaaccggtatggctaagtctattcatcatgctagagtgctcatcaagcagaggcacatcagggttggaaggcaagttgtgaatgttccatctttcatggtgagagttgactcacagaagcacattgacttctcgctcacaagtccctttggcggtggccgacccggcagagttaagcgaaggaaccagaaagccgctgccaagaaggcggctggcggtgatgccgacgaggatgatgaagaatgagctgttacttgtatcacaggctttcttcatctctattatctttgtggacgtcgtttatttattcgtctttcgaacctttttgtccttaggaagttttggatgttttcgctttgttgttaaggttttgatatcggattatgttttcatatg

SEQ ID NO: 2749 - DNA, 749 bp, Helianthus annuus
gaagaaagcgagaagagcagcaagcagttgcagcactgaaatcggacaacaatggtccatgtgtcgttttatcgaaactatggaaagactttcaagaagccccgtcgtccatacgagaaggaacgtttggacgctgagttaaaactcgtaggagaatacggtctccgatgcaaacgcgagctctggagggtgcaatacgcacttagtcgaattagaaatgccgcaagaatgcttttgacccttgaagaaaaggacccccgtcgaattttcgagggtgaagcccttatgaggagaatgaaccgttacgggcttttggatgagagccaaaacaagcttgattatgtgttggcacttaccgttgagaactttcttgaacgccgtttgcagacactcgtgttcaaaaccggtatggctaagtctattcatcatgctagagtgctcatcaagcagaggcacatcagggttggaaggcaagtggtgaatgttccgtcgttcatggtaagagttgactcacagaagcacattgacttctcgctcacaagtccttttggcggtggccgacccggcagagctaagcgaaagaaccagaaagctgctgccaagaaggcggcaggcggtgatgccgacgaggatgatgaagaatgagctgttacttatatcaaaggctttcttcaagtctattatctttgtggacgtcgtttatttattcgtctttcgtacctttttatctctaggaagttttggatgtt

SEQ ID NO: 2750 - DNA, 1081 bp, Amborella trichopoda
gccagctagggttgcttggtatagctaaagccacactctccttcgtcttcgtagcgtgaggccaaaccagagcggaggaggaggaagccatggttcacgtcagcttttacagaaactatggaaagactttcaagaaacctaggcgtccttatgagaaggaacgtttggatgctgagctgaaacttgtaggagagtatgggcttcgttgcaagagagagctatggagggtgcaatatgctctcagtcgcatcaggaatgctgcaagagagcttctcactctagatgagaagaatccaaagcgtatattcgagggagaagccctccttcgcaggatgaataggtatggtctccttgatgagagccagaacaagctcgattatgtgttggccttgactgtggaaaatttccttgagcgccgcctccaaacccttgttttcaagtcgggaatggccaagtcgatccaccatgctcgtgtgcttatcagacaaaggcatatcagggttggaaggcaagtggtgaacattccgtcgttcatggtgagggtggactctcaaaaacacattgacttctctctcactagcccactcggtggtggtcgcccaggacgtgtgaagcgaaagaacttgaaggctgcttccaagaaggctgctggaggagacggagacgaggaggatgaggattgagctttttacctttttgtggtaatcagagtaataattcttactaaaacattttacctttgctttctttaccccgttctttggaggagccaacttttgttgcttttttggagactttggattttagatgggagagagaactttagctcttgtggctgttttcttttgtaagaggtatttttgttctattgctttcatgctgacttttgaatggttgagggagatcatttactactggaatgcctttctggtttgactcactcgattataaagacaatttcataatttacagaagaggaatggcacttaaaggatcatcattaatttttgacatatatctcaagaaaagttatcacatgagtgtgagatttaggtgattgtgtttattgataattttttta

SEQ ID NO: 2751 - DNA, 1005 bp, Amborella trichopoda
gtctggctccttcgtcttcgtagcgtgaggccaaaccagagcggaggaggaggaagccatggttcacgtcagcttttacagaaactatggaaagactttcaagaaacctaggcgtccttatgagaaggaacgtttggatgctgagctgaaacttgtaggagagtatgggcttcgttgcaagagagagctatggagggtgcaatatgctctcagtcgcatcaggaatgctgcaagagagcttctcactctagatgagaagaatccaaagcgtatattcgagggagaagccctccttcgcaggatgaataggtatggtctccttgatgagagccagaacaagctcgattatgtgttggccttgactgtggaaaatttccttgagcgccgcctccaaacccttgttttcaagtcgggaatggccaagtcgatccaccatgctcgtgtgcttatcagacaaaggcatatcagggttggaaggcaagtggtgaacattccgtcgttcatggtgagggtggactctcaaaaacacattgacttctctctcactagcccactcggtggtggtcgcccaggacgtgtgaagcgaaagaacttgaaggctgcttccaagaaggctgctggaggagacggagacgaggaggatgaggattgagctttttacctttttgtggtaatcagagtaataattcttactaaaacattttacctttgctttctttaccccgttctttggaggagccaacttttgttgcttttttggagactttggattttagatgggagagagaactttagctcttgtggctgttttcttttgtaagaggtatttttgttctattgctttcatgctgacttttgaatggttgagggagatcatttactactggaatgcctttctggtttgactcactcgattataaagacaatttcataatttacagaagaggaatggcacttaaaggatcatcattaatttttgacatatatctcaagaaaagttatcac

SEQ ID NO: 2752 - DNA, 765 bp, Ambrosia trifida
gcagcacagaggaggtggccgccaggagccaaaccagatcaatcaagtaaccgccgtcgtaacgacgtcgtacaaccatggttcacgtccctttctaccgcaactatggtaagacattcaagaagccacgtcgtccttatgagaaggaacgattggatgctgagttgaagcttgttggtgagtacggtcttagatgcaaacgtgagctatggagggtgcagtatgctttgagccgtatccgtaatgccgcaagaatgcttttgactcttgaggagaaggacccacgtcgtatctttgagggtgaagcgcttatgaggagaatgaaccggtatggtttgctggatgagagccagaataagctcgattacgtgctcgctctcactgttgagaactttcttgaacgtcgtctccagacacttgtgtttaagactggtatggctaagtcgattcaccatgctagagttctcattaagcagagacacatcagggttggaaggcaggtggtgaatgtgccttctttcatggtgagagttgactcacagaagcacattgacttctcactcactagtccattcggaggtggtcgtccaggaagagtgaagcgaaagaaccagaaggcggctgcgaagaaggctgctggtggtgatgctgacgaggatgatgaagaatgagcgtattctgctggttcttagttttattgttgctctttaagttttttcgttggatttagttaatgatatgtttatgctttgagttgctattttg

SEQ ID NO: 2753 - DNA, 871 bp, Ambrosia trifida
caggttatcgctgcattgaattcggacaacaatggtccatgtgcctttttatcggaactatggaaagactttcaagaagccccgccgtccatatgagaaggaacgtttggatgcagagctaaaacttgtgggagaatacggtcttcgatgcaaaagggagctctggagggtgcaatatgctcttagccgaattagaaatgctgctagaatgcttttgacccttgaagaaaaggacccccgtaggatatttgagggtgaagctcttatgaggagaatgaaccgttatggacttttggatgagagccaaaacaagcttgattacgtgttggcccttactgttgagaactttcttgagcgacgtttgcagacactcgtgttcaaaactggcatggctaagtctattcatcatgctagagtgctcatcaagcagaggcacatcagggttggaaggcaagtagtgaatgttccctcattcatggtgagggtagactcacagaagcacattgacttctctcttacaagtccatttggcggtggccgacctggcagagttaagcgaaagaaccagaaagcagcggcaaagaaagcggcaggtggtgatgctgatgaggatgatgaagaatgagctgtcactcgatcttgttatacaaaaggcttttatcatctttggtatctttgcagacattatgtactcatctttcagaaccttttatccttaggaagttttggatgttttcttggctttgttaaggttttgatgtcggattatgttttaatgcgctaaacgcgtttattatttactatttacgattggttagccttgtcatttttggtttatggtagttaattacggttaagatgaaaaaagaaa

SEQ ID NO: 2754 - DNA, 713 bp, Ambrosia trifida
tttttcagtagcagcacagaggaggtggccgccaggagccaaaccagatcaatcaactatccgccgtcgtaacgacgtcgttcaaccatggttcacgtccccttctaccgcaactatggtaagactttcaagaagccacgtcgtccttatgagaaggaacgattggatgctgagttgaagcttgttggtgagtatggtcttagatgcaaacgtgagctttggagggtgcagtatgctttgagccgtatccgtaatgctgcaagaatgcttctgactcttgaagagaaggacccacgtcgtatctttgagggtgaagcgcttatgaggagaatgaaccggtatggtctcttggatgagagccagaacaagctcgattacgtgctcgctctcactgttgagaactttcttgaacgccgtctccaaactcttgtgttcaagactggtatggctaagtcaattcaccatgctagagttctcattaagcagagacacatcagggttggaaggcaggtggtgaatgtgccttctttcatggtgagagtggactcacaaaagcacattgacttctcactcacaagcccattcggaggtggtcgtccaggaagagtgaagcgaaagaaccagaaggcggctgcaaagaaggctgctggtggcgatgctgacgaggatgatgaagaatgagtgtactgtgctggttcttagtttcattgttg

SEQ ID NO: 2755 - DNA, 748 bp, Ambrosia trifida
ttttgattcagccctctatacccttattatcagcagtaagagggataagcagttgctgcattgacagtcctgttcaagaatggttcatgtgccgttttaccgaaactatgggaagacttttaagaagcctcgacgtccgtatgagaaggagcgtttggatgcggagttaaagctcgttggagaatacggtttgcgatgcaagagggagctatggagggtgcagtatgctcttagtaggattaggaatgctgcaagaatgcttttgactcttgaagagaaggacccgcgtaggatttttgagggggaagcgcttatgcgaaggatgaaccgttatgggcttttggacgagagtcagaataagcttgattatgtgctggctcttactgttgagaactttttagaacgccggctgcagacgcttgtgtttaagactggtatggctaagtctattcatcatgctagagtccttatcaagcagaggcacatcagggtcgggaggcaagtggtgaatgtaccatcattcatggtgagggttgactcacagaaacacatcgacttttctctcactagtccatttggtggtggccgacctggcagagtgaagcgaaagaaccagaaggccgctgcaaagaaggctgcaggtggtgatgctgatgaggatgatgaagaatgagctaccatctactttctgttaaatcaaaggtttcatctttaatatcgtaatcgttttcagaaccttttattgtta

SEQ ID NO: 2756 - DNA, 874 bp, Antirrhinum majus
  misc_feature (76)..(76): n is a, c, g, or t
  misc_feature (89)..(89): n is a, c, g, or t
cggcacgagcggcacgagcggcacgaggggtttcagcgccatatattatagagcaatcatcttcttcctctttttncctgctagtcttnttccttttgctccggcggacgtagccctaacaatatggtgcacgtcaatgtttaccgcaattatgggaagacctttaagaagccccgacgtccctatgagaaagagcgtttggatgctgagctgaggcttgttggagaatatgggctccggtgcaagagagagctgtggagggtgcaatatgcattgagtcggatccgtaatgctgctagaaatcttctcacccttgacgagaaagacccccgtcgtatctttgaaggtgaggcccttcttcgcaggatgaataggtatgggcttctggatgagagccagaacaagctcgattacgtgttggccctcactgtggagaactttcttgaacgccgcctccagactcttgtgttcaaggctggcatggccaagtctattcaccatgctcgtgtgttgattcgtcagaggcacatcagggttggaagacaggtagtcaatgttgcatccttcatggtgagagttgactcgcagaaacatattgacttctcacttactagcccattcggtggtggtcgtgctggaagagtgaagcgaaagaaccagaaagctgctgccaagaaatctggtggcggtgatgaagaagaggacgaggagtaagctgtgtttctactatagaaaccctgaagatgtagggactagtgactttttgatttacaaaatggattttcgaattttgaactttatccttttcccttttgatgcaacttatgtctctattttccccatttttggttgagatgttattgaagatttccta

SEQ ID NO: 2757 - DNA, 804 bp, Arnica chamissonis
ggatagagagggtggccgccgggaggcagaagaagatatcaatcaagtagccgtcggatcggcgtctaacaacaatggttaacgttccgttctaccgtaactatggtaagacttttaagaagcctcgacgtccttatgagaaggaacgattggatgctgagttgaagcttgttggtgaatatggtcttcgatgcaaaagggagctctggagggtgcagtatgctctcagccgcattcgtaacgctgcaagaatgcttctgactcttgatgagaaggatccgcgtaggatctttgagggtgaagctctcatgaggagaatgaacaggtatggtctgttggatgagagtcagaacaagctcgattacgtgctagccctgaccgtggagaactttcttgaacgccgtctccagacccttgtttttaagactggtatggctaagtctatccaccatgctagagttctcattaagcagagacacatcagggttggaaggcaggtggtgaatgtgccatctttcatggtgagagttgactcacagaagcacattgacttttcactcaccagtccgtttggcggtggccgacctggaagagtgaagcgaaagaaccagaaggcggctgctaagaaggcagctggtggcgatgctgatgaggatgatgaagaatgagctcactcttctggctctaagttttaatttcttttgctattctgaggtttatgagtatttcttgtcattacaatgactgtttgtaggatgttttggatgctttgcaaagttatttggtgcttttattaagtttttt

SEQ ID NO: 2758 - DNA, 830 bp, Arnica chamissonis
cagagggtggccgccgggaggaagtagagatcaatcaggtagccgccgaatcgacgtcgaacaacaatggtccacgtcaatttctaccgcaactatggtaagactttcaagaagcctcgtcgtccttatgagaaggagcgattggatgctgagttgaagcttgttggtgaatacggtcttcgatgcaaacgtgagctttggagggtgcaatatgctctgagccgcatccgtaatgctgctagaatgcttttgactcttgaggagaaggatccgcgtaggatttttgagggggaagctctaatgaggagaatgaaccggtatggtctgttggatgagagccagaacaagcttgattatgtgttggccctcactgtggagaactttcttgaacgccggcttcagacacttgttttcaagactggcatggctaagtcgatccaccatgctagagttctcatcaagcagaggcacatcagggttggaaggcaggtggtaaatgtaccttctttcatggtgagggtggactcacaaaagcacattgacttctcactcacaagtccatttggaggtggccgacccggaagagtgaagcgaaagaaccagaaggcggctgcaaagaaggctgctggtggggatgctgatgaggatgacgaagagtgagctcactatctagctcataatcttagtatcttttgcactcgtgacgcctatgagtaactgttatcatccataattactgttcgtaggaagttttggattcttggtcatgtgttttttgctctttatattttcatggattagttaatgataagattatgctttggaatccc

SEQ ID NO: 2759 - DNA, 891 bp, Persea americana
atcgcgtgtgggctctctttcacttccttctttttcgaggaacgccgaaggaggaggagaagaagaagaagacgaagaagaaccggccatggtccacgtcagcttctaccgaaactatgggaagactttcaagaagccacggcgtccgtacgagaaggagcgtctcgacgctgagctgaagctcgtaggcgagtacgggctccgctgcaagcgagagctatggcgcgtgcagtatgccttgagccgcatcaggaacgccgcgagggagcttctcacgctcgatgagaagaaccctcgtcggatctttgagggtgaggcgcttcttcgccggatgaaccgccatgggctccttgacgagagccagaacaagctcgattatgttctcgccctcacggtggagaacttcctcgagcgccgcctgcagaccctcgtcttcaagtcgggaatggccaagtccattcaccacgcccgcgtcctcatcaggcagaggcatatcagggttggaaggcaggttgtgaacattccttctttcatggttcgggtagactcgcaaaagcacattgatttctcactaacgagcccacttggaggtggccgtgctggtcgggtgaagcgaaagaaccaaaaggccgctgccaagaaggcctctggtggtgacggtgatgaggaggatgaggattaagcatcaaacatcttagttgcaagagatggtgggggacagatttgtctctttcaaagcctctgcgtgagtaattagtagcaagaaactttgtttgctttgttatcaaacagtccttttgttttgctaagtattaggtgatggatgtttgatttaagttttttggtttgatattgtggtgactggattcctggtccaatatgaatcaatta

SEQ ID NO: 2760 - DNA, 824 bp, Ocimum basilicum
gcaccagtagcagatcggactgacggcttcagcagccagaaaccctggtgcacgtctccttttaccgcaactatgggaagacattcaagaagccccgccgcccctatgagaaggagcgtcttgatgcagagttgaagctggttggagaatatggactcaggtgtaagagagagctttggagggttcagtatgctttgagccgaatcaggaataatgcaagaaatctgctgactcttgacgagaaggatcctcgtcgtatttttgaaggtgaagctcttctgaggaggatgaataggtatgggctccttgatgagagccagaacaagctggattatgtcttggccctcacagtagagaactttctggagcgtcgcctgcaaactcttgtgtttaaggcgggtatggccaagtccattcaccatgctagagttcttatcagacagaggcatatcagagttgggaggcaagtagttaatgtgccttcatttctagtgagggtggactcccagaagcacattgatttctctctcacaagtccattcggtggtggccgtccgggcagagtgaagagaaggaaccagaaggcagctgcgaagaaggcttctggtggtgatggagatgaggatgatgaggagtgaggtttcatttcttatttatgtcgagataatgttaggaagctctgttgctgtaagttatcagtgtttttgtttgagatgctcacatttatgttacctaagttttggcacctttgtctaactatgtgttgttccctttattcagttgaatgtgttgaactctgttatgcaagacaggatttttgagct

SEQ ID NO: 2761 - DNA, 837 bp, Ocimum basilicum
catgaagttcaacttctttgtctcagccgatcggagtgagagcgtcgtccgccggaaaccatggtgcacgtctcgttttaccgcaactatgggaagacatttaagaagccccgtcgtccctatgagaaggagcggttggatgctgagttgaaacttgttggtgaatatggactcaggtgcaagagagagctgtggagggttcagtatgctttgagccgcattaggaataatgcaagaaatctcctgactcttgatgagaaggatcctcgccgtattttcgaaggtgaagctcttctgaggaggatgaacaggtatgggctcctcgatgagagccaaaacaagcttgattatgtcttggctcttactgtcgagaacttccttgagcgtcgcctgcaaactcttgtgtttaaggctggtatgacgaagtccattcaccatgctagagttctcatcaggcagaggcatatcagagttgggaggcaagttgttaacgtgccttcattcctggtgagggtggactcccagaaacacattgatttctctctaactagtccatttggtggtggtcgccctggtagagtaaagagaagaaaccagaaggctgctgcaaagaaggcttctggtggtgatggtgatgaagatgatgaagagtgaggtttaatttctttgttgacgatatttgccagcaagctctgttataagtttttctttactgctgatttttgaaacgctcctcaaaattactagctttttgtttgagatattaaaatttacggcttcttttgattgatgatgtagcatctgttcatttgatagccttctaaaaaatttcccagt

SEQ ID NO: 2762 - DNA, 855 bp, Phaseolus coccineus
taggccgggggcgaaacctagtgcaccggaagggttgagaagcagacagagaagagccatggtgcacgtttccttctaccgaaactatgggaaaacgttcaagaagcctcgtcgtccatacgagaaggaacgtttggacgccgagttgaagctggttggggagtacgggcttcgctgcaagagggagttgtggagggttcagtacgccctcagccgaatccgtaacaatgccaggaatctgttgacactggatgagaagaacccgcgccgaatcttcgagggtgaagcacttctccgaagaatgttccgttacggacttctcgacgagacgcagaacaagctcgattacgtgttggccctcaccgtcgagaactttctcgaacgccgcctccaaaccctcgtcttcaagtctggcatggccaagtccattcaccacgccagagtcctcatccgccagaggcacatcagggttggaagacaggtggtgaacattccatcgttcatggttagggttgattctcagaagcacattgacttctcactcacgagtccacttggtggtggtcgtcctggacgcgtgaagcgaaagaaccaaaaggctgccgctaaaaaggctgctggcggagatggagatgaggaggatgaagattaggttatttttggctagcaatcttttaagatattttgctcactttttaatttgtgatgtagacattttagaattttgtcatgctctgactcttatagcttttgccgtccttgtttcttgtttgaggtaaagttttgcgtgagatatgatgattttgaactgttctttctaaaagtgatcaattgttgctgcaatgcttgtggtag

SEQ ID NO: 2763 - DNA, 1040 bp, Fagus grandifolia
gtttacgacgggtcgggctaggcttaactaggtttgtaattccaggattagggttttagggttgccttataagcacaaatccatcgccttcattttttacctagctgatagtagcgagcgagcgagagagtgagagagtgagccatggtgcacgtctccttctaccgcaactatggaaagacctttaagaagccccgccgcccctatgagaaggagcggttggatgctgagttgaagctcgtgggagagtatgggctacgatgcaagagagagctgtggagggttcagtatgctctgagtcgtattcgtaacaacgcaaggatgcttctgacccttgatgagaagaacccacgtcgaatctttgagggtgaggctcttcttagaaggatgaacaggtatgggcttttggatgagagtcagaacaagcttgattatgtcttggccctcactgtggagaacttccttgaacgccgtcttcagacacttgtcttcaagtcgggaatggccaagtccatccaccatgctcgagtgcttattaggcagaggcatatcagggttggtaggcaggttgtgaatattccatctttcttggtgagggttgattcacagaagcacattgatttctcacttaccagtccatttggtggtgggcgacctggaagagtgaagcgaaggaatcagaaggcagctgctaagaaggcctctggtggagatgcagatgaagaggacgaggaatgagtcatgggttaggacatttactagtaatactactagtaggactggggtgtcaactttgttgaactttcaatgttttgcttgcaatttttagtattgctttaagtgagaatagaactagcttcttgttatttatgtacaagctgtgtttccttggctttaaaatatgttttccgagcccaatggtagaggaggaaattcgtcatggtggattgctagctagagtttcagctgtcgtttatgagcctttcaggctgttaattatacgtgggatgttcttattggctatgttaatggctgataaa

SEQ ID NO: 2764 - DNA, 1408 bp, Theobroma cacao
aattggcttagttatttcattatatcattagaatcctcaatgtacactgaaattcaaaatctttctctatataccacaataactcatatgcatgctctacaagcatatacatcaagtttttcaagtttactcatcaaatcacttggccaacaccacatttaggccatatcaaaaattaagggtgttacaccgtagaagagtctgtattatccattccgatatcaaccgattattgcaaaaataaatcccatgtctatggcgaaatatgtgcctttgcttacaattaaaaaaaaaaacatgaggaaagaattattggtggaaaattgttgaatcacagaggacaaaacaaagtttgggcttttggtctaaagaacaagctgacttcctttttttctttctttcgtttcctatctttcttagctccactatattaaagacccaataggcccaaatcaacctttcaggagcctattcaaaacgaagaggaaatattagggtttagggtttcctatataaagtgatcacacctcctccgtcttcagccctagttccgcttcttccttctccgcccttttcgcttcgctacgagaagccaacgctgctatggttcacgtcagtttctatcgcaactatgggaagacctttaagaagccaaggcgtccatatgagaaggagcgtttggatgctgagttgaggcttgtaggagagtatgggctccgatgtaagagggagttgtggagggttcagtatgcattgagccgtatccgaaatgcagcaagggatcttctcactcttgatgagaagaaccctcgtcgtatttttgaaggtgaagcacttcttcgtaggatgaataggcatgggcttttggatgagagccagaacaagctcgattatgtcttggctttgactgttgagaacttccttgaacgccgcttgcaaacactcgtgttcaaggctggtatggccaagtcaattcaccatgctcgtgtgctgattaggcaaaggcatatcagggttgggaggcaggtggtcaacatcccatctttcatggtgagggtggactctcaaaagcatattgacttctctctcacaagtccattcggaggtggtcgccctggaagggtaaagagaaggaaccagagggcagctgccaagaaggctgctggtggagatggtgacgaagaggaagacgagtaaaccttaggctaataccaccattaggaaccataaaaggccgtatgtttgaaacttgccatctccattgttagacatggtttgatttttgtttgcagtcctttattgtagtggatcttggtatatgttttgcatttactattctgtttttaccggatttgaacctaattgagtaattgtgttgttttaagattaaaagattttaattttgatc

SEQ ID NO: 2765 - DNA, 883 bp, Catharanthus roseus
cctgacgggtttcttcctcgtcttcctccgactactgacggccagcaaccctacctaggcagccatggtgcacgtcagtttctaccggaactatgggaagactttcaaaaaacctcgtcgtccatacgagaaggaaagattggatgcagagttgaagctcgttggggagtacggactccgttgcaagagggaactgtggagggtgcaatatgcacttagccgaattcgtaacaatgcaagaatgcttctcactcttgatgagaaagacccccgtgactatttgagggtgaagcccttctgcgtaggatgaacaggtatggacttttggatgaaggtcagaacaagcttgattatgtcttggccttgactgtggagaatttccttgaacgtcgccttcaaacacttgtgttcaagacgggtatggctaaatcaatccaccatgcccgagtgctcattagacagaggcatatcagggttgggaggcaggtggtgaatgtgccatccttcttggttagggttgactctcagaaacacattgacttttcaattacaagtccctttggtggtggccgtcctggaagagtgaagcgaaagaaccagaaagctgctgccaagaaagctgctggtggtgatggtgatgaagaggatgaggaatgagcaattcatgttcaatatttgcttagtaactcttcccaaaccaactatcttatgttattgttagttgaaattttgtcatggtagtgccctcctcttgcttgtttaaagatatgaatagtcactttggttattataatgcgtgaggataatatattagatttgcttttatttgccatatcatttgcacctctcaccttattggaatctttaatatttgctttgttac

SEQ ID NO: 2766 - DNA, 979 bp, Cedrus atlantica
tgtgattccaggggagcaggagtggcagaggaggaggagagatggtgcacgtaagtttttaccgtaactatgggaagacgttcaagaagccccggcggccctacgagaaggagcggctcgacgcagagctgaaattggttggagaatacgggctgcgaaacaagagagagctctggagggttcaatacacgctaagccgcatacgaaatgcagcgcgtatgcttttgacgttggatgagaaaaaccctcgcaggatattcgaaggagaagccctgctgcggcgtatgaacaggtatggtctcctggacgagacccaaaacaagctcgattacgtcctcgctctcactgtcgagaacttcctcgagcgccgacttcagactctcgtcttcaaatccggcatggccaaatccatccatcatgcccgtgttctcatcaggcaacgccacatcagggtaggtaggcaggttgtgaatattccatctttcatggtaagggttgattcgcaaaagcacattgatttctcacttacaagcccacttggtgggggacgtcctggtcgtgtaaaacgaaagaacatgaaggcagcatcaaagaaggctgctggtggagatggagaggaagaggatgaggaataagtcatagtagtattaccgaccaagaaaaatttgctgcacaatctcttgtttagtgtgtggcttttagatattattgaaagaacgtttttagccggtttttcctggctgctgcaacaactggttgtgaaactttggcaataggccttcatgcattttaaatttggcaatagtcagcatatattttaaattttgtcagtttactggctgttgcaagatgtttggtttgttaaaacattggtaataggttagaataaacttcaaaatttgttcgactttgatcacagtccaggactgtgtggtagtaaacagcaaatgctgatttatttcatttccttttactgtaa

SEQ ID NO: 2767 - DNA, 1014 bp, Cirsium arvense
atatgttttcttatctttgttcataagtttagctacaattgtttggtcttataaatatcgactaaatacggcacctgaagcaaaaggatcatggccgataattggtcacctcccatctttagaagcagcgccggacgccgggagggaacaagaggaagatattgccggatcggcgttgaacaacaatggttcacgttcccttctatcgcaactatggtaagacttttaagaagccacgtcgtccttatgagaaggaacggctggatgctgaattgaagcttgttggagagtatggtcttcgatgcaaaagggagctttggagggttcaatatgctcttagtcgcattcgtaatgccgcaagaatgcttctgacccttgaggagaaagacccacgtaggatctttgaaggtgaagcccttatgaggagaatgaaccgatatggtcttttggatgagagtcagaataagctcgattatgtgctggctctaactgttgagaactttcttgagcgccgactccagacacttgtgttcaagaccggtatggctaagtccatccaccatgctagagttctcatcaaacaaagacatatcagggtgggaaggcaggtggtgaatgtaccatcttttatggtgagagtggactcacagaagcatatagatttctcgctcacaagtccttttggcggtggtcgacctggcagagttaagcgaaagaaccagaaggcggctgcaaagaaggcggctggtggagatgctgatgaggatgatgaagaatgaggtcacttttgcagtctttggtcctattgagtaatttatcttggtaataactcttttgtaggaagttttggatgctttttgttgccttttacttgggtgttttttggatttaattgatggtagattatgcaattgtgttgctaaaattattgattaaattttgggatagaaagattattatcttttgccatttcctgttagcctggctgtttttttggtacctatagacgtggtt

SEQ ID NO: 2768 - DNA, 1029 bp, Gossypium hirsutum
tctctttcgctttctggcctccgagaagaagccgacgccgccatggttcacgtcagtttctaccgcaattatgggaagacatttaagaagccaaggcgtccatacgaaaaggaacgtttggatgctgagttgaggcttgtaggagaatatgggctccgatgtaagagggagttgtggagggttcaatatgctttgagccgaatcagaaatgctgctagggatcttctcactcttgatgagaagaaccctcgtcgtattttcgaaggtgaagctcttcttcgtaggatgaacagatatggacttttggatgagagtcagaacaagctcgattatgtattggctttgactgttgagaacttccttgaacgccgcttgcaaacacttgtgttcaagactggtatggccaagtcaattcaccatgctcgtgtgttgattaggcaacgtcacatcagagtcggaaggcaggtggttaacatcccatcctttatggtgagggttgactcccagaaacatatcgacttctctctgacaagtccgttcggaggtggccgtcccggaagagtgaagcgaaggaatcagagagcagctgccaagaaggccgctggtggagatggtgatgaagaggaagacgagtaaaccttcagctagtattggcaatagggcactcctaaaagagcctgtgatgggaaattaccatttcctacattattagacatggtttgagttttgtttcaagacctttaatgtagtggatgttcgcatttgtatttgtctcggattttatgttaaattgagcaattttgttattttgagattaaaatgtttaaattatggttcaccatttcgatcaatgtcatgcattttgtggctaagctgttgatgaattgcagtctgtagggttcatgatgtgtcacttacaattactgagcgcttaattatgtgttttatcattaagtgtttttgttttggagtcattgggccattgaagctttgcttggtgccaagctcaagtgcttatgcaaaaagtaa

SEQ ID NO: 2769 - DNA, 1306 bp, Gossypium hirsutum
gggggctatcaaatgaaaatccattagggtttaggcttttccctgtatataaatttcaactctccacttcatatctctttccgtacttcggcatcttcccctttccctccaactttaatctaccacaactgtaacgacgccatggttcacgtcagtttctaccgtaactatgggaagacctttaagaagccaagacgtccatatgagaaagaacgattagatgcagagttgaggcttgtaggagagtatgggctccgatgtaagagggagttgtggagggttcagtatgctttgagccgtatccgtaatgctgctagggaccttctcacccttgatgagaagaaccctcgtcgtatttttgaaggtgaagctcttcttcgtaggatgaacaggtatggacttttggatgagagccagaacaagcttgattatgtcttggctttgaccgtcgagaacttccttgaacgccgcttgcaaacacttgtgttcaagactggtatggccaagtctattcaccatgcccgtgtcttgattaggcaaaggcatatcagggtcgggaggcaggttgtcaacatcccatccttcatggtaagggttgactcgcaaaaacatatcgatttctctctcactagtccgtttggaggtggccgacctggaagagtgaagagaaagaaccaaagagcagctgccaagaaggctgctggcagagatggcgatgaagaggaagatgagtaaaaccttagaggggtactaccacccttagttacccttaaatagttttggagcttgccatttccttctcccctttattagatatggtacgtatcttgcttctagacctttatctttagcgtatcttggtatatgtttttcatttaatattatgttcttttttcttggattggaagttaatgaaaggttattttgttcatttaaactagttagatagttcatatgttgcatgaactgggatgtaatattggatactgagtatgtgtccaatatggggtacgtttaaatttttgagtattttcatgtactccaaaaagtttttggaggatcatactttggtttgatgtggtcagtgtatcaattaaggattgatggcatcatatgttcctaacgaactttgtgagattttgttgtcataataatgtctaatcattaatgattttgtttttttctcaacataatgatttttgttgtgctggaccttaaggatttatgcttgactcaagctgtcccatagcaaggcaatcgatcttgactactcttttcccaattccaatcccttgctagatatttg

SEQ ID NO: 2770 - DNA, 1003 bp, Vigna unguiculata
gtgcaccgtaaggttgagaagcagcaagagaggagccatggtgcacgtttccttctacagaaactatgggaaaacattcaagaagcctcgtcgtccatacgagaaggaacgtttggacgctgagttgaagctggttggggagtacgggcttcgctgcaagagggagttgtggagggttcagtacgccctcagccgtatccgtaacaatgccaggaatctgttgacgttggatgagaagaacccgcgccgaatcttcgagggtgaagcacttctccgaagaatgttccgttacggacttcttgacgagacgcagaacaagctcgattacgtgttggccctcaccgtcgagaactttctcgaacgccgcctccaaaccctcgtcttcaagtctggcatggccaagtccattcaccacgccagagtcctcatcagacagaggcacatcagggttgggagacaggtggtgaacattccatcattcatggttagggttgattctcagaagcacattgacttctcactcacgagtcctcttggtggtggccgtcctggacgcgtgaagagaaagaaccaaaaggctgctgctaaaaaggccgctggtggagatggagatgaggaggatgaagattaggttattaattgatagcaacctttcaagatcttgtgcgcagtttttaatttatgatgtagacaatttagaattttgtcatgccctgactcttataaatttttccgtacttgttttttgtttgaggtaaagttgtgcctgagatatgatgattttgaactgtgctttctcaaagtattcaagttttgctgcaatgcttgtggtcatctggtattttcaccctcgttatcaaatgcccttacatttgcgatttaaggctagaagcaattttaaaaaaatgatttggtaagttgctcatggttttggtctgaatgacagtacaaaagtgaccgtaaacatcactgaaattagcaataatatttgagttgattttct

SEQ ID NO: 2771 - DNA, 1029 bp, Vigna unguiculata
gaaccctaggagcgaaaaccttgtgcaccgtaaggttgagaagcagcaagagaggagccatggtgcacgtttccttctacagaaactatgggaaaacattcaagaagcctcgtcgtccatacgagaaggaacgtttggacgctgagttgaagctggttggggagtacgggcttcgctgcaagagggagttgtggagggttcagtacgccctcagccgtatccgtaacaatgccaggaatctgttgacgttggatgagaagaacccgcgccgaatcttcgagggtgaagcacttctccgaagaatgttccgttacggacttcttgacgagacgcagaacaagctcgattacgtgttggccctcaccgtcgagaactttctcgaacgccgcctccaaaccctcgtcttcaagtctggcatggccaagtccattcaccacgccagagtcctcatcagacagaggcacatcagggttgggagacaggtggtgaacattccatcattcatggttagggttgattctcagaagcacattgacttctcactcacgagtcctcttggtggtggccgtcctggacgcgtgaagagaaagaaccaaaaggctgctgctaaaaaggccgctggtggagatggagatgaggaggatgaagattaggttattaattgatagcaacctttcaagatcttgtgcgcagtttttaatttatgatgtagacaatttagaattttgtcatgccctgactcttataaatttttccgtacttgttttttgtttgaggtaaagttgtgcctgagatatgatgattttgaactgtgctttctcaaagtattcaagttttgctgcaatgcttgtggtcatctggtattttcaccctcgttatcaaatgcccttacatttgcgatttaaggctagaagcaattttaaaaaaatgatttggtaagttgctcatggttttggtctgaatgacagtacaaaagtgaccgtaaacatcactgaaattagcaataatatttgagttgattttctcttg

SEQ ID NO: 2772 - DNA, 902 bp, Cucurbita pepo
tgcctctcttctcctctcctttgcattctggaccattgagttagtgaagacgtagcagagaagagatcatggtgcacgtctctttctataggaactatgggaagactttcaagaaaccccgacgtccttatgagaaggagcgtttggatgcagagttgaagttggttggagaatatgggcttcgttgtaagagggagttgtggagggttcaatatgcattgagccgaatccgaaacaatgctcggatgctcttaacacttgatgaaaagaacccgcgtaggatttttgagggagaggctctgcttaggaggatgaacaggtatggtcttttggatgagagtcagaacaagctcgattatgtcttggcccttactgtggagaatttccttgagcgtcgtctccaaactctcgtattcaagtctggtatggcaaagtcaatccatcatgctagagtgctcatcaggcaaaagcatataagggttggaaggcaggtcgtgaacatcccttctttcatggtgagggtcgattcccagaagcacatagacttctctcttacaagtccgtttggaggcgggcgtcctggaagggtgaaaagaaggaatcagaaggcagctgcaaagaaggctgctggaggagatggagatgaagaagatgaggattgagttatcgactgagaaataatgagattagccctcaatatctatatcttttatctatcagagagaatatttcatctttttagaagttttgctttaaagtactttgaattagaaaacttgtctgttattattattggtttttgtcatgagaattagcgtttaacctatttggttttagttgccacagttttctgcatcactttgaaccactttgttttcctcaatactccaatgcattatgaa

SEQ ID NO: 2773 - DNA, 832 bp, Cucurbita pepo
agatcgcggcgaggactgaagccggagcggagaagacatggtgcacgtctctttctacaggaactatggaaagacgttcaagaaacctcgacgtccttatgagaaggagcgtctggatgccgagcttaaacttgtaggtgaatatgggcttcgttgtaaaagggagctatggagggttcaatatgcattgagccgaatccgtaataacgcaagaatgcttttaactctggatgaaaagaatccgcgtaggatttttgagggagaggctctgcttaggaggatgaacaggtatggacttctggatgagagtcaaaacaagcttgattatgttttggcacttacggtggagaatttccttgagcgtcgtcttcaaaccctcgtattcaagtctggaatggcgaagtctattcatcatgcgagagtgctcatcaggcaaaagcatataagggttgggaggcaggtggttaacatcccttctttcatggtgagagttgattctcaaaagcacatagacttctctctcactagtccatttggaggtggtcgccctggaagagtgaagagaaggaaccagaaggcagccgccaagaaggctgctggtggagatggagatgaagaagatgaggattgagttatcgagtaaactcataatccgagatgatggtaaaagattagccaaggatctcaggtatctgagattaacctcaagtcctgtttccttctccagctaaccttgagctttctctgttgatgaaatgttatgtttctagaagtttgctttgattaattttcatttagagattttgattgttctccggtgtggcactagttt

SEQ ID NO: 2774 - DNA, 1001 bp, Cucurbita pepo
agccgctgctcttactctcttttccttcttcagctacttctcttccctctctgtggcattcaagatcattctgtaagtgaagccgttgcagagaagggatcatggtgcacgtctccttctataggaactatgggaagacattcaagaaaccccgacgtccttacgagaaggagcgtctggatgcagagttgaaattggttggagaatatgggcttcgttgtaagagggagttatggagggttcaatatgctttgagccgaatccgaaacaatgctcgtatgctcttaacacttgatgaaaagaacccgcgtaggatttttgagggagaggctctccttaggaggatgaacaggtatggtctttggatgagagtcagaacaagctcgattatgtcttggcccttactgtggagaatttccttgagcgtcgtctccaaactctcgtgttcaagtctggtatggctaagtctatccatcatgctagagtgctcatcaggcagaagcatataagggttggaaggcaggtggtcaacatcccttctttcatggtgcgggtcgattcccagaagcacatagacttctcactcacgagtccgtttggaggcggccgtcctggaagggtgaagcgaaagaaccagaaggcagctgcaaagaaggctgctggaggcgacggtgatgaagaagatgaggattgagttattgacgaaaaaaatgattatccgagatgaaaacgattagctgaggatctcaggtactgagatcagcctcaatctaaaccttatctattgatatttgaaagagaatgttacctcctcttagaagttttgctttaaatatttttgaattagagaacttgtttgttttttttggttatggcgacttgattataacctatttggtttgtttaagttgtcactagtttcatgaattgaattacttgtatactatgtgaaggactcttagtttttttttcttaaattattttatttactatgaattatt

SEQ ID NO: 2775 - DNA, 802 bp, Cynara scolymus
  misc_feature (745)..(745): n is a, c, g, or t
  misc_feature (753)..(753): n is a, c, g, or t
cggggtctcttcgaagcagcggaggccgccgggagcgagagcaagatatcgatcgagtagccgccggatcgacgtcgaacaacaatggttcacgtccccttctatcgcaactatggtaagacttttaagaagccccgtcgtccttatgaaaaggagcggttggatgctgagttgaagcttgttggagagtatggtcttcgatgcaaaagggagctttggagggtgcaatatgctcttagtcgcattcgtaatgccgcaagaatgcttttgacccttgaggagaaggacccacgtaggatttttgagggtgaagcccttatgaggaggatgaacaggtatggtcttttggatgagagtcagaacaagcttgattatgtgctggcccttaccgtggagaacttccttgagcgacgtctccagacacttgtgttcaagactggtatggccaagtctatccaccatgctagagttctcatcaagcagagacacatcagggtgggaaggcaggtggtgaatgtaccatccttcatggtgagagtggactcacagaagcacatagacttctcactcacaagtccgtttggcggtggccgacctggcagggttaagcgaaagaaccagaaggcagctgcaaagaaggctgctggtggagatgctgacgaggatgacgaagaatgaactgacttgcatttgagtcctatgagtacttgttatcttggtaataactcattgtaggaagtttggntgcttgcnatctttttgttgcttttatggattaattgatgataggttgattttacaa

SEQ ID NO: 2776 - DNA, 849 bp, Cynara scolymus
  misc_feature (6)..(6): n is a, c, g, or t
  misc_feature (838)..(838): n is a, c, g, or t
gcagcngcagttgccgccggtggaaggaggaacatagcaagcgccgtgttgacgtcaaacaaccatggttcacgtcaacttctaccgcaactatggaaagaccttcaagaagccccgtcgtccttatgaaaaggaacgactggatgctgaattgaagcttgttggggagtatggtcttagatgcaaaagggagctctggagggtgcagtatgctctcagtcgaatccgtaatgcagcaagaatgcttttgacccttgaggagaaagacccacgcaggatttttgagggtgaggcccttatgaggaggatgaacagatatggtctgttggatgagagccaaaacaagcttgattatgtgttggccctcactgtggagaacttccttgagcgccgccttcagacactcgtcttcaagactggcatggcaaaatccatccaccatgccagagtcctcattaaacagaggcatatcagagttggaaggcaagtggtgaacgttccatcgttcatggtgagagtggactctcagaaacacattgacttctcgctcacaagtccgtttggaggtggtcgacctggaagagtgaagcgaaagaaccagaaggcagctgcgaagaaggctgctggaggggatgccgatgaggatgatgaagaatgagcatttagctacttcttataaatctatgttttgtccttataggtgaatgttttgtcctgttttcctttagactggtttttaagatggtatttgttgcttcatttactgctctgaggattttgtaatggattatgggttgtaggatttttcaaatctgtctgttagaaaattgcaaatttngcttatatttc

SEQ ID NO: 2777 - DNA, 934 bp, Eucalyptus grandis
gaaacgacgaaagcttccacctcgtcttccatctctctgaggggtaaagcaaccgagcggccagccgacgcagagccatggtgcacgtcagcttctaccggaactatgggaagaccttcaagaagccgcggcgcccctatgagaaggagcggctcgatgcagagctgaagctcgtgggagagtatggtctccggtgtaagagggagttgtggagggtgcagtacgtattgagccgtatccgtaacaatgcgaggatgcttctcacactcgatgagaaaaacccacgcaggatttttgaaggtgaggcgctactgcgcaggatgaaccggtacgggcttctggacgagagccagaacaagctcgattatgttctggctctcaccgtggagaacttccttgagcgccggcttcagacgcttgtgttcaagtctggaatggctaagtcaattcatcatgcccgtgtgcttataagacagaggcacataagggtcgggaggcaggtggtcaacattccatctttcatggtaagggttgattcccagaagcatatcgatttctccctaacgagcccgttcggaggtggccgcccaggaagagtgaagagaaagaacacgaaggcagcttcgaagaaggcatctggtggagatggagaggaagaggatgaagattgaaccttaggctagttcctgtttctgtaaaccgcaactatgagcgtctcctttctcacctgacctttttgcatccatcaggaatctggctttttgacctgagacagtggtcttttatactttgttccggtagatcttcctacatgttctgcagttttgtttttctcgatcaattcggattagggtctctttggtaatgttcacaatgtttcgtcctctgatttggccaagaattagagttcttttttctctctgggggccttcaa

SEQ ID NO: 2778 - DNA, 873 bp, Flaveria ramosissima
gattagaagcagcacagagggtggccgccggaggcagaagagatcaatcaagtagccgccggagtatcgacgttgaacaacaatggttcacgtctctttctaccgcaactatggtaagacttttaagaagctgcgccgtccttatgagaaggaacgattggatgctgagttgaagcttgttggtgaatacggacttcgatgcaaaagggagctttggagggttcagtatgctttgagccgcattcgtaatgctgcaagaatgcttttaacacttgaggagaaggacccacgtcgtatctttgaaggtgaggctcttatgaggagaatgaacaggtatggtctgttggatgagagtcagaacaagctcgattatgtgcttgccctcactgtggagaactttcttgaacgtcgtctccagacccttgtgttcaagactggtatggccaagtcaattcaccatgctagagttcttatcaagcagagacacatcagggttggaagacaggtggtgaatgtaccttcattcatggtgagagtggactcccagaagcacattgacttctcactcacaagtccatttggaggtggccgaccaggaagagtgaagcgaaagaatcagaaggcagctgcaaagaaggctgctggtggagatgctgatgaggatgacgaagaatgagctcactcttttggctcttaatcttattatcttttgcaattgtgacgcgtatgagtaatctttatcatccataattactgttggtaggaagttttggatgctttgtcatgtgtttgttgctttttatatcttctcatggatttagttaatgacaagtttatgctttgggttgctactttgaaacttatatcgatatt

SEQ ID NO: 2779 - DNA, 629 bp, Flaveria ramosissima
acgtccaacaacaatggttaaagtctccttctaccgcaactatggtaagacttttaagaagccccgtcgtccttacgagaaggagcgattggatgctgagttgaagcttgttggtgaatatggtcttcggtgcaagagggagctttggagggtgcagtatgctctcagtcgcattcgtaatgctgcaagaatgcttttgactcttgaggagaaggacccgcgtaggatctttgagggtgaagcacttatgaggagaatgaataggtatggcttgttggatgagagtcagaacaagctcgattatgtgctggcgcttactgtcgagaactttcttgaacgtcgcctccagactcttgttttcaagactggtatggctaagtctattcaccatgctagagttctcatcaagcagaggcacatcagggttggaaggcaagtggtaaatgtgccatctttcatggtgagagttgactcgcagaagcatattgacttttcactcaccagtccatttggtggtggccgacctggtagagtgaagcgaaagaaccagaaggcggctgctaagaaagcagctggtggtgatgctgatgaggatgatgaagaatgagctcattctttggttctgagtt

SEQ ID NO: 2780 - DNA, 811 bp, Flaveria ramosissima
ctcacggcgtctcaattatcagctaccgaagcaggtgagaaagagcagcaaccaattgctgcattgaagttggactaaaatggttcatgtgtcattttatcgaaactatgggaagaccttcaagaagcccgtccgtccatatgagaaggaacgtttggatgcagagttaaaacttgtgggagagtatggtcttcgatgcaaaagagagctctggagggtgcaatacgcccttagccgaattagaaatgctgcaagaatgcttctcacccttgaagaaaaggatccacgtaggatttttgagggtgaagctcttatgaggagaatgaatcgttatgggcttttggatgagagccaaaacaaacttgattatgtgctggccctcactgttgagaactttctagaacgccgtttgcaaactctcgtgtttaaaactggtatggccaagtctattcaccatgctagagtgctcatcaagcagaggcacatcagggttggaaggcaagtagttaatgttccatcattcatggtgagagttgactcacagaaacacattgacttctctctcactagtccatttggtggtggccgacctggtagagtgaagcgaaagaaccaaaaagccgctgcgaagaaggcggcgggcggtgatgccgacgaggatgatgaagaatgagcaatcgttaagtttattatatcaaaggttccatctctatatcggctttgcagacattgtttttattcccaactttttctagaaccttttatctttaggtaagttttggtatgcttttgcttgtgttgttaagaacac

SEQ ID NO: 2781 - DNA, 724 bp, Flaveria ramosissima
cagagtacatggaacgtcagaagaagatatcaatcaagtagccgcgagatcgacgtcgaacaacaatggttaagtctccttctaccgcaactatggtaagacttttaagaagcccgtcgtccttacgagaaggagcgattggatgctgagttgaagcttgtgggtgaatatggtcttcggtgtaagagggagctttggagggtgcagtatgctctcagtcgcattcgtaatgctgcaagaatgcttttgacccttgaggagaaggacccgcgtaggatctttgagggtgaagctcttatgaggagaatgaataggtatggtctgttggatgagagtcagaacaagcttgattatgtgttggctcttactgtcgagaactttcttgaacgtcgtctccagactcttgttttcaagactggtatggctaagtccatccaccatgctagagttctcatcaagcagaggcacatcagggttggaaggcaggtcgtaaatgtgccatctttcatggtgagagttgactcacagaaacacattgacttttcactcaccagtccatttggtggtggccgacctggtagagtgaagcgaaagaaccagaaggctgctactaagaaggcagctggtggtgatgctgatgaggatgatgaagaatgagctcattctttggttctgagttttaattaggagcttttgctatcttgacgtctatgagttatttttt

SEQ ID NO: 2782 - DNA, 769 bp, Guizotia abyssinica
gtctacttcagaagcagagcagagagagtggccgccggtagggagaagaagacatcagctgccagatcgacgttgaacaaccatggttcacgtcaacttctaccgcaactatggtaagactttcaagaagccgcgtcgtccttatgagaaggaacgattggatgctgagttgaaacttgttggtgagtatggtcttcgatgcaaaagggagctgtggagggtgcaatatgctcttagtcgcattcgtaatgctgcaagaatgcttctgactcttgaggagaaggacccacgtcgtatctttgagggtgaagctcttatgaggagaatgaacaggtacggtctgttggacgagagtcagaacaagctcgattatgtgctggcacttactgttgagaactttcttgaacgccgacttcagacccttgttttcaagactggtatggccaagtctattcaccatgctagagttctaatcaagcagagacacattagggttggaaggcaggtggtgaatgtgccatctttcatggtgagagttgactcacagaaacacattgacttttcactcaccagtccgttcggtggtggccgacctggaagagtgaagcgtaagaaccagaaagcagctgctaagaaggcagctggtggtgatgctgatgaggacgatgaagaatgagctcatctgtctggttttaagttcgaatatcttttgctattttgacttccatgagtatttgtatcattacatactgtttttaggaagttttgg

SEQ ID NO: 2783 - DNA, 735 bp, Heritiera littoralis
aaccatggttcacgttagtttctatcgcaactatgggaagacctttaagaagccaaggcgtccatatgaaaaggaacgattggatgcagagttgaggcttgtaggagagtatgggctccgatgtaagagggagttgtggagggttcagtatgcattgagccgtatccgaaatgctgctagggatcttctcactcttgatgagaagaacccccgtcgtatttttgaaggtgaagcacttcttcgtaggatgaataggtatggacttttggatgagagccagaacaaactcgattatgtcttggctttgactgttgagaacttccttgagcgccggttgcaaacacttgtgttcaagtctggtatggccaagtcgattcaccatgctcgtgtgttgatcaggcaaaggcatatcagggttgggaggcaggtggtcaacatcccttccttcatggtgagggttgactcccaaaaacatattgacttctctctcacaagtccatttggaggtggccgccctggaagagtgaagagaagaaaccagagagccgctgctaagaaggctgctggtggagacggtgatgaagaggaagacgagtaaaccttaggctattagcaggccactagaaaccctaaaagcctcttttcggaacttgccatctcctccgttataagacatggtttgagttttgtttctagatctttattgtagtggatcttgctatatgttttgtcatt

SEQ ID NO: 2784 - DNA, 881 bp, Carpinus betulus
ctcgatcttcaactcccgcaccgtctgtcctcgtcattctcgcttcagatcgcggacttagggtaagagcaccggctgcgcagcatggtgcacgtctccttttaccgaaactatgggaaaacctttaagaagcccagacgtccctacgagaaggagcgtctggacgcggagctgaagctcgttggtgagtatggtctgcggtgcaagagggagctctggagggtgcagtatgcactcagtcgcattcgtaacaatgcgaggatgcttctgacactggatgagaagaacccacgtaggatttttgagggtgaagccctgttgaggaggatgaacaggtacgggttgctagacgagagccagaacaagctcgattacgtgttggcccttactgtcgagaactttcttgagcgccgtcttcaaaccctggtgttcaagtccggtatggccaagtccattcaccatgccagagtgcttatcaggcagaggcatattagggttggcagacaggtagtcaacattgcctcattcatggtgagggtagactcacagaagcacattgatttttcgctcacgagtccatttggtggtggacgtcctgggagagtgaagcgcaggaaccaaaaggcagctgccaagaagactgctggtggagatggagatgaagaagaggaagagtaagctcaaaactttagatatgagatggtaatggtaataatagagtttttccaaacagtaactggggctttctgtgaatggccctgcatagagaagttttgcttgtttccttgactatttgtttttggttattattggatagttaacttatctctcatgagaattatcttaaatttactaatgcttaaattactacaattttaatt

SEQ ID NO: 2785 - DNA, 895 bp, Mesembryanthemum crystallinum
ggcagcatcagggagagctgagagataagctcgccatcggtgagcaaccatggtccacgttaactactatcgcaactatgggaagacatttaagaagcctcgtcgcccatacgagaaggagcgtttggatgctgagctgaagctcgtcggtgagtatgggcttcgtaacaagagagagctctggagggttcagtatgttctgagtggtatccgtaatgctgcaaggcatcttcttaccctcgatgagaagaaccctcgccgtatctttgaaggtgaagctcttttgagaaggatgaacatgtatgggcttttggacgagggtcaaaacaagctcgattacgtgttggccttgacagtcgagaacttcttggaaaggcgtcttcagacactcgttttcaagtccggtatggccaagtctatccatcatgccagggttctcatcaggcagaggcatattagggttgggagacaagttgtgaatgttccctctttcatggtgagggtggactcacagaagcacattgatttctcactgaccagccccttcggaggtggccgcccaggtagggtaaagcgaaagaaccagaaatcagctgccaagaaggcatctggtggagacggtgatgaagatgacgaggagtaagctatcaacccactcaataggcatagagactcgagatctttgttagtacttcgaatgttgaatatggcccccaggtctcctaagagcttttcctattttcatatttcagtcagactggttttgttcacctttttggttgtaggaagttttgagtgcttgctgataagtttaaacccattagaatatgcccaatgaatgtgttcactgcagattcagtgtgttttatgaatgcaacaatagattactatttct

SEQ ID NO: 2786 - DNA, 690 bp, Mesembryanthemum crystallinum
gagagtgagagagaggcggctctggcggaggagtagaacaagagaacaaccatggtgcacgttaacttctaccgcaactatgggaagacattcaagaagccccgtcgtccttatgagaaggagcgtttggatgctgagttgaagctcgtcggagagtacgggctacgtaacaagagggagctctggagggtgcagtatgtgttgagtggtatccgtaatgctgcccgtcatcttcttactcttgatgagaagaacccacgtaggatctttgagggtgaagctttgctccgaaggatgaaccgttatggactgttggaggagggtcagaacaagctcgattatgtcttggctcttaccgtggagaacttccttgagcgtcgtcttcaaacccttgttttcaagtcagggatggccaagtccatccatcatgcccgtgtcctcatcaggcaaaagcacattagggttggaaggcaggttgtcaacatcccctcattcatggtcaggcttgattctcagaagcacattgacttctctctcacaagtccattcggtggtggtcgtcctggaagagtgcagaggaagaaccagaaggctgctgctaagaaggctggtggcggtgatggagatgacgatgatgaggagtgaacattaacacctagaaatttgctgtagtatcagaaccacgaccca

SEQ ID NO: 2787 - DNA, 799 bp, Glycyrrhiza uralensis
aaacgaaacgactcgtagggcgcgagagcagagcagagcagagaaggaaggaagaaggcgagggctccgccgcaaaacacaatggttcacgtgtcgttttaccgcaactatgggaagacattcaagaagcctcgtcgtccatacgagaaggagcgtttggacgctgagctgaagctggttggagagtacgggctacggtgcaagcgtgagctgtggagggttcagtacgccctcagtcgcatccgcaacaacgcgaggaaccttctcacactcgacgagaagaaccctcgcaggatcttcgaaggtgaggcactgctccgcaggatgttccgttacgggctcctagatgagacccagaacaagctcgattatgtcctcgctctcaccgtcgagaacttcctcgaacgccgccttcagacccttgtcttcaaatctggcatggccaagtccatccaccacgctagggtcctcatcagacagaggcacatcagggttgggaggcaagtggtgaacatcccctctttcatggtgagggttgactctcagaagcatattgacttttcacttacaagtcctcttggtggtgggcgcccaggaagggtgaagagaaagaaccaaagggctgctgctaagaaggctgccggtggagatggagatgaggaggatgaggattaaactatatcattgtcataatgactttctctagtgcatttagatctttgtgctagcttttaatttgtgtctctagtatatcgttattgactgctatacctttttcttcatctttcgttcttgtttg

SEQ ID NO: 2788 - DNA, 1382 bp, Liriodendron tulipifera
  misc_feature (89)..(89): n is a, c, g, or t
  misc_feature (105)..(105): n is a, c, g, or t
  misc_feature (111)..(111): n is a, c, g, or t
  misc_feature (127)..(127): n is a, c, g, or t
  misc_feature (139)..(139): n is a, c, g, or t
  misc_feature (154)..(154): n is a, c, g, or t
  misc_feature (172)..(172): n is a, c, g, or t
  misc_feature (178)..(178): n is a, c, g, or t
  misc_feature (181)..(181): n is a, c, g, or t
  misc_feature (183)..(183): n is a, c, g, or t
  misc_feature (193)..(193): n is a, c, g, or t
  misc_feature (250)..(250): n is a, c, g, or t
  misc_feature (265)..(265): n is a, c, g, or t
  misc_feature (277)..(277): n is a, c, g, or t
  misc_feature (279)..(279): n is a, c, g, or t
  misc_feature (285)..(285): n is a, c, g, or t
  misc_feature (322)..(322): n is a, c, g, or t
  misc_feature (327)..(327): n is a, c, g, or t
  misc_feature (335)..(335): n is a, c, g, or t
  misc_feature (358)..(358): n is a, c, g, or t
  misc_feature (407)..(407): n is a, c, g, or t
  misc_feature (411)..(411): n is a, c, g, or t
  misc_feature (414)..(414): n is a, c, g, or t
  misc_feature (438)..(438): n is a, c, g, or t
gcgcccagtggatgttgattgcactaggagttttgggattagtgaagagaagcaaaggaaaagggtggtgtcaatgactgcatttgttngaaatcagaatggggntattgntgaagcaatccggatntggaaaagcaantttgacaaggagttncaaggcatcgaggaatgncccatntgntncagcatcatncacacgaccaatcacagcctcccccgcctcgcatgcaagacctgcaagcacaaattncactcagcttgcctntacaagtggttntnaacatnccacaaatcaacatgccctttgtgccaaactccattntgagntggaaaangattttatggaacccatgttttnccatgcgcaccccctggaattggaacagcaccacacatgttgcattttnggtnccntaagtagagaaaagtgcggtattngatggtgcaaatgtcagttcccttgtgagctgcttattaaaaaaaaaaaaaaaaaactcgaactaagggatggtacacgtcagcttctacaggaactatgggaagaccttcaagaagccgaggcggccttacgagaaggagcggctggacgcggagctgaagttggtgggggagtacgggctgcggtgcaagcgcgagctgtggcgcgttcaatacgcgctgagccgcatccggaacgcggcgcgggagctcctcaccctcgatgagaagaacccacgtcggatcttcgagggcgaggcgctgctgcggcgcatgaaccggtacggcctgctcgatgagagccagaacaagctcgattacgtgcttgccctgaccgtcgagaacttcctcgagcgcaggttgcagacgctcgtcttcaagtcgggcatggccaagtccatccatcacgcccgtgtcctcatccggcagaggcacatcagggttggtagacaggtggtcaatataccatcctttatggtgcgggtggactcccagaagcatatcgatttctcgcttacgagcccacttggtggtggacgccctggaagggtgaagcgaaggaaccagaaagctgctgccaagaaggcatctggtggggacggcgatgaggatgatgaagattagatttatgatcttcctgatgcggcgggaggcatctgttgtgggcggtgatgaggaagaacttcgttttgtttgctttctcttagggtagacatgtcgctagttttatgaagtgtgttctccttagttttgcttaaccttcgccaatgaagatgatggatttttgcggtgtctttttagatgagaatgtggcggtgggtattggatggagttaaaccttgtagtttgatagagatacaagaaatggatgggctatagttatgaataatccatgttttatttaa

SEQ ID NO: 2789 - DNA, 919 bp, Lotus japonicus
ggaccctcagtcgcagcagcagaagcaaaacggaggaggagtgagcgcaccgcaccgccgcatttcacgatggtgcacgtttcattttaccgcaactatgggaagacgttcaagaagccccgccgtccgtacgagaaggagcgtctggacgcggagctgaagctcgtcggagaatacggtctccggtgcaagcgcgagctctggagggtgcagtacgcgctcagccgcatccgcaacaacgctaggaacctgctcacgcttgatgagaagaatcctcgccggatctttgagggtgaggctttgttgaggaggatgtttcgttatgggcttcttgatgagactcagaacaagcttgattatgttcttgctcttactgttgagaattttctcgagcgaaggcttcagactcttgtgtttaagtctgggatggctaagtcgattcatcatgctagggttcttatcagacagaggcatatcagggttggaaggcaggtggtgaacattccatctttcatggtgagggttgactcacagaagcatattgacttttcactcaccagtcctcttggtggtggacgccccggaagagtgaagcgaaagaaccaaaaggctgctgctaagaaggcctctggtggagatggtgatgaggaagatgaggactaaactatcactgtttgttgcttactattagtgtttctagatcttgtgctgccttttatttggtgtcctcactcttattattgactgttatacctgttttttaatcattgcttcttgtgttagaaaatatactttgccctaagatattatgttgttttgaacttggttatttgaagtatcaagctttttcttgtgttagaaaatatactttgccctaagatattataatcgagtttgtagtgagtttgtaaaaaaaaaa

SEQ ID NO: 2790 - DNA, 953 bp, Tropaeolum majus
cggccgggagggtttaggcattcgctgctttatattcttccttcgacactgaagcttaaggctgttaccccaggtttttcagctctcatcaacgagtagtcgacggagctatggttcacgtgaatttctacaggaactatgggaagacctttaagaagcctcgtcgtccttatgagaaggaacgtttggatgctgagttgaagctcgttggagaatacgggctcaggtgtaagagagagttgtggagggtgcagtatgctttgagtcgcatccgtaatgctgcaagggaacttctcacactggatgagaagaatcctcgtcgtatttttgaaggtgaagcccttcttaggaggatgaacaggtacggtctgttggatgagagccaaagcaagcttgattatgttttggctttgactgttgagaattttcttgagcgccgactccaaactcttgtgttcaagtctggaatggcaaagtcaatccatcatgctcgtgtgctcatcaggcagaggcatatcagggttggaaggcaggttgtcaacatcccttccttcatggtcaggatggattcccagaagcacattgacttctcactaactagtccattcggaggtggtcgcccaggaagagtgaagagaaggaacatgagggcagcaagcaaaaaagcatcaggtggggatggagatgatgaggatgaggaatgattattaagttagtaaaattcgccttacttatggcttcttttgagatctaaatttatattaagactgtccaaacatcagttttgttatcttgattagaacataatcatgtcagttttttaacaaaacaagtacccagccatccattttctgtttttgaatcacttaaaacgattgatcttagatatgaaatccaatctttttgtgttgaaggctaaacctttattttgacataatggtattatattttat

SEQ ID NO: 2791 - DNA, 872 bp, Elaeis guineensis
cttcaccttggcattagagagcgagagagggacgaagacgattgccggagaagacggcgaggtaaccagccatggtccacgttagcttctaccgcaactatgggaagactttcaagaagccccgtcgtccatacgagaaagagcgtttggatgcggagctgaagcttgttggtgagtacggtctccgggccaagcgggagctgtggagggtccagtatgcattgagtcgcatccggaatgctgcgagggaactgcttacccttgatgagaagaacccacggaggatttttgagggagaggccctcctgcgccggatgaaccggtatgggctcctagatgagaaccagaacaagcttgattatgttctggccctcaccgtggagaacttccttgagcgccggctccagacccaggtgttcaagtctggaatggccaagtctatccaccatgccagggtcctcataaggcagcgccacatcagggttggccgccaggtggtgaacattccttcattcatggtgagggttgactcagctaagcacattgattttgctctcaatagtccatttggtggaggtcgccctggaagagtgaagcgaaagaaccagaaggcagcagctaagaaggcagcaggaggtgatggtgatgaggaagatgaagattaagaagttgatcatggacttggtagcaaataattgtcagtttaggttcccaaatattgttttgaaggcttttgttagatttcgccagtgaaccattgtgttctctcgctttttgaccgttggaatatgaagttgtgttgcaccattgactttgctttctttcagatgttgcatcacccaagtggtgccccaggttgcatttttatcatg

SEQ ID NO: 2792 - DNA, 646 bp, Parthenium argentatum
gcatatcagcagccgcctgatcgacgttgaacaacaatggttcacgttcccttttatcgcaactatgggaagacttttaagaaaccccggcgtccatacgagaaggaacgattggatgctgagttgaagcttgtgggagagtatggtcttcgatgcaagagggagctttggagggtgcagtatgctttgagccgtattcgtaatgccgcaagaatgcttttgactcttgaggagaaggatccgcgtaggatttttgagggtgaagcgcttatgaggagaatgaacaggtatggactgttggatgagagtcagaacaagctcgattacgtgcttgcgcttactgtggaaaactttcttgaacgccgtctccagacacttgtgttcaagactggtatggccaagtctattcatcatgctagagttcttattaaacagagacacatcagggttggaagacaggtggtgaatgtaccatctttcatggtgagagttgactcgcagaagcacattgacttctcactcactagtccgttcggaggtggccgacctggaagagtgaagcgaaagaaccagaaggcggctgcaaagaaggcagctggtggggatgctgatgaggatgatgaagaatgagctcactcttcttgct

SEQ ID NO: 2793 - DNA, 634 bp, Parthenium argentatum
cgtaacgacgtcgtacaacaatggttcacgtccccttctaccgcaactatggtaagaccttcaagaaaccacgccgtccttatgagaaggaacgattggatgctgagttgaagcttgttggcgagtacggtcttagatgcaaacgtgagctttggagggtgcaatatgctttgagccgcatccgtaatgctgcaagaatgcttctgactcttgaggagaaggacccgcgtcggatctttgagggtgaagcacttatgaggagaatgaaccggtatggtttgttggatgagagccaaaacaagctcgattacgtgctggccctcactgttgagaactttcttgaacgccgtctccagacccttgtgttcaagactggtatggctaagtctattcaccatgctagagttcttatcaagcaaagacacatcagggttggaaggcaagtggtgaatgtaccgtcattcatggtgagagtggactcacagaagcacattgacttctcactaacgagcccattcggaggaggccgaccaggaagagtgaagcgaaagaaccagaaggcggctgcaaagaaggctgctggtggggatgctgacgaggatgacgaagaatgagcttacgcatctggttcttt

SEQ ID NO: 2794 - DNA, 977 bp, Cajanus cajan
gaacttgagctgcgtaaacctagtgtgcaccgtgagggttgagaagcagagaagatggtgcacgtttctttctaccgaaactatgggaaaacgttcaagaagccgcgtcgtccatacgagaaggagcgtttggatgcagagttgaagctcgtcggagagtacgggctccgctgcaagagggaactgtggagggttcagtacgccctcagccgcatccgtaacaatgcgaggaatctgttgaccctcgacgagaagaatccccgtcgaatcttcgagggtgaggcccttctccgaagaatgttccgttacggtcttctcgacgagacgcagaacaagctcgattacgtcctcgccctcaccgtcgagaactttctcgaacgccgcctccaaaccctagttttcaaatccggcatggccaagtccattcaccacgctagggttctcatcaggcagaggcacatcagggttgggaggcaggttgtgaacattccatcattcatggttagggttgattcacagaagcacattgacttctcgctcacgagtcctctaggcggtggtcgtcctggccgagtgaagcgaaagaaccaaagggctgctgctaagaaggctgctggaggagatggagatgaggaggatgaagattaaattaatggctagttgtgtttagatctttcgctccttttatatttgtgttggtagacattttagaattttgtcaattgtcatgctctgactcttataattttgatgtccttgttccttgttttgaggtaaagctgtgcctgagatatgctgttttgaatatttatttctaaagtattgaagttttgctccatttctctggtatttctgcaactagaaggaattactaatacattggttattgtaggctttaaggcaatacctattacttttgatttataatgcataatgttattgtttgggtcagatgacggaatcataaagtaatcctg

SEQ ID NO: 2795 - DNA, 784 bp, Platanus occidentalis
ggtctctctccctctcgattaggcgggaacggcaacggagccatggtgcacgttaatttctatcggaactatgggaagactttcaagaagcctcgtcgtccgtacgagaaggagcgtttggacgctgaactgaagctcgttggagagtacggactccgttgtaagagggagttgtggagggttcagtacgctctgagccgcatccgtaatgccgcgagggagcttctcactcttgatgagaagaatcctcgccggatctttgagggtgaagcccttcttcgcagaatgaaccggtatgggcttttggacgagagccagaacaaactcgattatgtcttggctcttactgtggagaacttccttgaacgccgtctccagactctcgtgttcaagtccggtatggctaagtcgatccaccacgctcgagtgttgatcaggcagaggcatatcagggttgggaggcaggtggttaacattccatctttcatggtcaggatggactcacagaagcacattgatttttcgctcacgagtccacttggaggtggccgccctggacgagtgaagagaaagaaccagaaggcagctgcaaagaaggcagctggtggggatggagatgaagaggatgaagattgagtctcatcttgtgttagttgtttattttgttacttgctttttcccaacatttatttgataggagttttttcttgagagaactttagatgtaatggtttacaagttagaattttggatcgttaagttatttatgaaaaatcttgctttg

SEQ ID NO: 2796 - DNA, 823 bp, Platanus occidentalis
ctctgttctctttatccctctcgacatcaggcgggaacggcgacggagccatggtgcacgttaatttctacaggaactatgggaagactttcaagaagcctcgacgcccgtacgagaaggagcgtttggacgctgagctgaagcttgttggagagtacgggcttcgatgtaagagggagttgtggagggttcagtacgcactgagccgcatccgtaatgctgcgagggagcttctcactcttgatgagaagaaccctcgccggatctttgagggtgaagcccttctccgtaggatgaaccggtatgggcttttggacgagagccagaacaagctcgattatgtgttggctcttactgtggagaattttcttgagcgccgtctccagactcttgtgttcaagtcgggcatggccaagtcgatccaccacgcccgagtgctcatcagacagaggcacatcagggttgggaggcaagtggttaacattccatcattcatggtgaggatggactcgcagaagcatattgatttctcactcactagtccacttggaggtggccgccctggacgagtgaagagaaagaaccagaaggctgctgccaagaaggctgctgggggcgatggagaagaagaggacgaggattaagtattggtttggatttgttgacttattttgtctccagccctttcctcaactcctattaggtaggagttttttcccgagaactttagatgttaaggtttataagttagcagttttgggtgttttatgttatatacctttttgattgtcactgaagaattttgcttcgtttattttattaa

SEQ ID NO: 2797 - DNA, 841 bp, Carthamus tinctorius
  misc_feature (805)..(805): n is a, c, g, or t
attggcggggaacctagaagagaacagcagcagcactcgccgccggtggaggagggaggagcatagcaaccgctgcgttgacgtcaatcgacaatggtgcacgttaacttctaccgcaactatgggaagactttcaagaagcctcgtcgtccttatgaaaaggaacgattggatgctgaattgaagcttgtcggtgagtacggccttagatgcaaaagagagctctggagggtgcagtatgcccttagccgcatccgtaatgcagctagaatgcttttgactctggaagagaaagacccgcgaagaatttttgagggtgaggcccttatgaggaggatgaacagatacggtctgttggatgagagccaaaacaagctcgattacgtgttggccctcactgttgaaaacttccttgagcgccgcctgcagacactcgtcttcaagactggcatggcgaaatccatccaccatgccagagtcctcattaagcagaggcatatcagagttgggaggcaagtggtgaacgttccatccttcatggtaagagtggactcgcagaaacacattgacttttcgctcacgagcccgttcggaggtggtcgacctggaagagtgaagcgaaagaaccagaaggcggctgcaaagaaggcggctggaggtgatgccgaggaggatgatgaagaatgagcacttggttgctacttcttatatctatgttttgcccgtacaagtgaatgttttgttctggtttcctttagactggagttattgtttcttgatttactggttgaggattttgtaatgnattatggtttttaggattttctaaattcaatgtctg

SEQ ID NO: 2798 - DNA, 686 bp, Scabiosa columbaria
ctctattttgtgcgaggcgctcgtcttccttgtattgctgaagacaagagagaatggttcacgtcaatttctatcgcaactatgggaagacatttaagaagccacgtcgcccctatgagaaggagcgtttggatgctgagttgaagcttgtaggggagtatggacttaggtgtaaaagagagctatggagggttcagtatgcattgagccgaatccgtaatgccgcgagaatgcttcttaccctagatgagaaagatccacgtaggatctttgagggtgaagctcttcttcgtaggatgaatcgccatgggcttcttgatgaaagccagaacaagctcgattatgtcttggctttgactgtcgagaactttctggagcgtcgccttcaaacccttgtgttcaagactggtatggccaagtctattcaccatgctcgtgtccttattaggcagaggcatatcagggttggcaggcaggtggttaatgtgccgtcattcatggtgagagttgactctcaaaagcatattgatttctctctaactagccccttcggaggtggtcgacctggaagagtgaagcgaaggaaccagaaggctgctgccaagaaagctgctggtggtgatggtgaggaggaagatgaggactgaagaattatatccatatagtatttcacttcattccttttt

SEQ ID NO: 2799 - DNA, 1005 bp, Silene vulgaris
gccttcctcctttcatctcacacacactttttagagagagggagagttagagagagaaagagagagtttctgtgtgaagcaggacagctatggtgcacgtcaatttcttccgcaactatggcaagacctttaagaagccccgacgtccttacgagaaggagcgtttggatgctgagttgaagctagttggagagtatggacttcgtaacaagagggagttgtggagggtgcagtatgtgttgagtcgtatcaggaatgctgcccgtcatcttcttacccttgatgagaagaacccccgtcgtatctttgagggtgaggctttgcttcgtaggatgaacaggtatggtctgctggaagagggacagaacaagctcgattttgtcttggctcttactgttgagaacttccttgagcgccgtcttcagactcaggtcttcaaatctggaatggccaagtccatccatcatgcccgtgtgcttatcaagcaaaagcacatcagggtcggaaggcaggttgtgaatgtaccatcattcatggtcagggtcgactcacagaagcacattgatttctcacttacaagtccattcggaggtggtcgccccggaagagtgaagcgaaagaaccagaaggctgctgccaagaaggcatctggaggagatggagatgaagaggatgaggactgagcgtttaactagtagtcgagtacaagtatgctctagttggcaacccagacgtttcttttttatagtttgagaacatggttttgttttggatgtcggtttttgtttcatctttgttgtgaacttaaaagactagatttctgctgctagcatttgccattttcagtcttcgcgtgagtactgtttctcttctcaggcctgtcctcatttggtactgaagttcgaagttgcttgttatttacctgaataggacccaaagttggttcaaaatagttggtctcgtactcttgtgtgctgagtggctagtacacggaacaaaaaaaaa

SEQ ID NO: 2800 - DNA, 1091 bp, Glycine max
gaagttcagctgcgaaaacctagtgcaccgtaagggttgtgaagcaggcagagaagagccatggtgcacgtttctttctaccgaaactatgggaaaacgttcaagaagcctcgtcgtccctacgagaaggagcgtttggacgccgagttgaagctggtcggtgagtacgggcttcgctgcaagagggagttatggagggtccagtacgccctgagccgcatccgtaacaacgccagaaacctattgacccttgatgagaagaaccctcgccgtatcttcgagggtgaagcccttctccgaagaatgttccgttacggactcctcgacgagacacagaacaagctggattatgtgttggctctcaccgtcgagaactttctcgaacgccgcctccaaaccctcgtcttcaagtctggcatggccaagtccatccaccacgccagagtcctcatcaggcagaggcacatcagggttgggagacaggtggtgaacatcccatcgttcatggttagggttgattcgcagaagcacattgacttctcactgaccagtcctcttggtggtggtcgtccaggacgcgtgaagcgaaagaaccaaagggctgctgctaagaaggctgctggtggagacggagatgaggaggatgaagattaaattattaatggcttctgatatttatagaccttgtgctcgtttttttatctgtgtcggtagacattttagatttttgaaatggtctgacttttataattttggcattcttgtttcttgtttgaggtaaagctgtgcctgagatatgatgtttttgaactgttctttctaaagtattcaagttttgctccaatgcctgtggtgatctctggtgtttttgcaactcggttctacttgctaatattatcggtggttgtaggcttctttgcataagacagttagttagaagttaaaatgctcaaagatattgttttggtccatcaaatgacagaattagttcttgggggcctgatttcagctatggtttcatcgagtacaactaggtttcatggtataatgacgaattctagattttattctatgctaagcaatacttgtgt

SEQ ID NO: 2801 - DNA, 1083 bp, Glycine max
tcagctgcgaaatccttgtgcaccgtaagggttgtgaagcaggcagagaagagccatggtgcacgtttccttctaccgaaactatgggaaaaccttcaagaagcctcgtcgtccgtacgaaaaggagcgtttggacgccgagttgaagctggtcggtgagtacggacttcgctgcaagagggagttgtggagggttcagtacgctctcagccgcatccgtaacaacgccagaaatcttttgaccctcgacgagaagaacccgcgccgtatcttcgagggagaagcccttctccgaagaatgttccgttacggacttctcgatgagactcagaacaagcttgattacgtgttggctctcaccgtcgagaactttctcgaacgccgcctccaaaccctcgttttcaagtctggcatggccaagtccatccaccacgccagagtcctcatcaggcagaggcacatcagggttgggagacaggtggtgaacatcccatcattcatggttagggttgattcgcagaagcacattgacttctcactgaccagtccacttggtggtggtcgtccaggacgtgtgaagagaaagaaccaaagggctgctgctaagaaggctgctggtggagatggagatgaggaggacgaagattaaattattaatggctactgatatttaggccttgcggttgttattttttttatattatctgtgttggtagacattttagatttttgaaatggtctgacttgttataattttgccatccttgtttcttgttttgaggtaaagctgtgcctgagatatcatggttttgaactgttctttctaaactattcaagttttgttccaatgcctgtggtgatcaatggtattcttgcaacttgattcaactgctaatatattggtggttttaggcttccagtgcattagacatttagttattagttaaaattctcacaagagtcaaagttattgttttggttcattaatgcagaattagtacacacttggggcctgtgttcagccatggtttcattgagcacaactaggattttcacagtataatcattatgccatgatgaaca

SEQ ID NO: 2802 - DNA, 785 bp, Taxus baccata
ggcatttgtggatttgatgttttacctgggtgggggtgaagaagactaggaggcggcggcggcagaggcagagagagagatggtgcacgtcagtttttatcgcaactatgggaagacgttcaagaagccgaggcggccatacgagaaggagcggctggacgcggagctgaagctggtgggagagtacggcctgcgaaacaaaagggagctgtggagggtgcaatacactctcagccgcatccgtaaggcagccagaatgcttctgactttggacgagaagaaccctcgtcgtatattcgaaggggaggccttgctgcggaggatgaacaggtatggtctcctcgacgagagccagaacaagctcgattatgtcttggctttgactgtggagaatttcttggaacgccgcctgcaaaccctcgtcttcaaggctggcatggccaagtccatccaccacgctcgcgtcctcatcaggcaaaggcacatcagggttggtaggcaggtggtgaatattccatctttcatggtacgtgttgattctcaaaagcatattgatttctcacttacaagtccacttggtgggggacgtcctggtcgtgttaaacgaaagaacatgaaggcagcatcaaagaaggctgctggtggagatggagaggaagaggatgaggaatgaggcatgaaatggtactgttggctaataaaatctttgttagatcttatttttcataatgcaaagtctggtagattaaaaggatatatgttgatcaaagtattttggtcgctgc

SEQ ID NO: 2803 - DNA, 919 bp, Nicotiana tabacum
ggatcatctcctttccccttccccttccccttcccttcagcagatcgccgacgacagcggcggtgatcggaaaacatggtacacgtcgccttttaccgcaactatgggaagacctttaagaaacctcgacgtccctttgagaaggagagattggatgcagagttgaagcttgttggagagtatggactgaggtgcaagagggagctgtggagagtccagtatgctttgagccgtatcaggaatgctgcaagaatgcttctgacccttgatgagaaagatccacgtcgtatttttgaaggtgaagcactcttgaggaggatgaacaggtatggtttgctggatgagagccagaacaaactcgattatgtcttgtcactcactgttgagaacttccttgagcgtcgtctgcaaacccttgtcttcaagactggcatggctaagtcaatccaccatgctagagtgctcattaggcaaaggcatatcagagttggaaggcaagtggtgaatgttccttcgtttatggtcagattggactctcagaagcacattgacttctccctaaccagtccttttggtggcggacgccctggaagagtgaagagaaagaaccaaaaggctgctgccaagaaggcttcaggtggtgatggtgacgaggaggatgaagaataagcatttgcactagaaccgaaagaaagctgttggtgatgcagctgttcgtttttggagtttttagttacccatgtagtgcttccttgcattcctttcttcgatattgtgtaccttcatattttagaaagaaatgttcttagcagagattgggagaatgttttgaagtttggattttgcaccgatggttagagtttagacaatttgtttttgaatcagacgatgtgttatttaagttgtagaagcgagtcca

SEQ ID NO: 2804 - DNA, 865 bp, Triphysaria pusilla
tctctgtcctgtgttctctttctagttcttctgtttcagccaacgtagccactgtcaccatggtgcacgttagcttctaccgcaactatggaaaaaccttcaagaagcctcgcaggccttatgagaaggagcgtttggatgctgagctgaagcttgtcggagagtatgggcttcgttgcaagagagagctatggagggttcaatttgcgttgagccgtatccgtaacaatgctcgagaccttctcacacttgatgagaaagatccccgccgtatctttgaaggcgaagcccttctccgtaggatgaaccgatatgggcttttggatgagagccagaacaagctcgattacgtcttggccctcactgtggagaactttctggaacgtcgtctgcagactctggtgttcaaggctgggatggctaagtctattcaccacgctcgtgtgctcatcaggcagaggcacattagggttgggaggcaagtggtgaatgtgccgtctttcatggttagagttgattcccagaaacatattgatttctcactcacgagcccatttggaggtggccgtgctggaagagtcaagcgaaagaaccagaaagctgctgcaaagaaagccggtggtggtggtgatgaagaggaagatgaggattaagctgcaattaaaaaactaaagatttatttgtgttggatgcttgcttttgctttaattttgtaaaaggattcttggttcattagttcaagatttttaatttttgtcctgactttttcttcatttcctctgatgtgagatttaaattaagaatgttgtggtgtatgttggaatattagtgatgagtttttttttatatttcgtactatattctt

SEQ ID NO: 2805 - DNA, 889 bp, Tripterygium wilfordii
ttccctgcattgccgctatcgcaacttgaggagaagccgacggagctatggtgcacgttaatttctacagaaactatggaaagacttttaagaagccgcgtcgtccatatgaaaaggaacgtctggacgcggagctgaagcttgttggggaatatgggctccgctgtaagagggagttgtggagggttcagtatgcactaagccgtatccgtaatgctgcaagaatgcttcttaccctggatgagaaaaatacacgccgtatctttgagggtgaagctcttcttcgtaggatgaacagatatgggctcctggatgaaagtcagaacaagcttgattatgtcttggcccttaccgttgagaacttccttgagcgtcgccttcaaacgctagtgttcaagtccggcatggcaaagtcaattcaccatgcccgtgtgctcatcaggcaacgacatatcagggtggggagacaggttgtcaacataccatctttcatggtgagggttgattcccagaagcacattgacttctctctgacaagtccattcggaggtggccgtgccggtagagttaagcgaaagaacatgaaagctgctgccaagaaagctgctggaggagacggtgatgaagaggatgaggaataaacaagaatgaaggctactgctaaacaagctgatggggtggttttattttaggcttctatctctagaacaagttttttttgtttcattatattattttgtagtggatattattatgtcttatgtctctatctgttatggattgggctacaacaatgctgtttgagctaagtatggttccttttgatgatgacatttgtgaatttgatttctctgtgcatgagaaaaccgtgaatctttgtcttgatgac

SEQ ID NO: 2806 - DNA, 939 bp, Utricularia gibba
gttcatttctcgcggcgatcgtccgaagaagattgaggtaactggtaaaatctaacgccggccgcgccggagagaagcaatggttcacgtttctttctaccggaactatgggaagacgtttaagaaaccccgtcgtccctatgaaaaggagcgtcttgatgcagaattgaagcttgttggggagtatgggttgagatgcaaaagggagctgtggagggttcagtatgcactcagccgcatcagaaacaatgcaagagatcttttgactcttgatgagaaggattctcgtcgtatttttgaaggtgaagcccttttgcggaggatgaataggtatgggctactggatgagagtcagaacaagcttgattatgtcttggctttaactgtcgaaaacttccttgagcgtcggcttcaaactctcgtcttcaaggccggtatggctaagtccattcatcatgctagagtcctgatcaggcacaggcatatcagggttggaaggcaagttgtgaatgttccctctttcatggtgagagtggactcccagaagcatattgacttctccctcacgagtccatttggtggaggccgccctggtagagtgaagagaaggaaccagaaggcagcttcgaagaaggcttctggtggcgatgatgatgaggaagatgaagagtgagctgagtagcaagatctaggtggcttcaatcgtattgtcaggttaccccctgtttttttccttacgacttcaagttaaacgttgtcgttccaccccccgacttctctatattgccttttctcttgtccttccaatgtgttctgctcttcagattcagtcattacatgtttggttcatttgctcatctgtaacctgatgctttgccctgatgaacggtatttttcttgcccatacatcagcttgtcctgatgaatcatgatatcttc

SEQ ID NO: 2807 - DNA, 927 bp, Juglans hindsii x Juglans regia
  misc_feature (6)..(7): n is a, c, g, or t
gggggnngctgctgaagagagagcgagacagggagcgagcaagagagagccatggtgcacgtctcgttctaccgcaactatgggaagacctttaagaagccccgccgtccatatgagaaggagcgtttggatgctgagttgaagcttgtgggagagtatgggctgcgatgcaagagagagctgtggagggttcagtatgctctgagccgtattcgtaacaatgcaaggatgcttctgacccttgatgagaagaatccacggaggatctttgagggtgaagctcttctccggaggatgaaccgttatgggcttttggatgagagtcagaacaagcttgattatgtcttggccctgactgtcgagaactttcttgagcgccgccttcagacacttgtcttcaagtcgggcatggcaaagtctatccaccatgctcgagtgctcatcaggcagaagcatataagggttgggagacaggttgtaaacatcccatcattcatggtgagggttgattcacagaagcacattgatttctcacttaccagtccatttggtggtggacgacctggaagagtgaagcgaaggaaccaaaagagcgctgctaagaaggctgctggcggagatgcagatgaggaggacgaggaatgagccatggattttgggacgttgcatgctagtggggctggggtctcaacttatgttgaactttcaatattttggttgcactgtttaacatcgttttaaatgaagaatagaactggctggttgatatttgtgtacaatttgtgtttccattatcgagaattattgtaggttgctgacattgactggcctttatgctagttatttctttgtgggatgtgcttcttggccatgttagtggtttacaaatcaagttggaactagcctagtattttggtctactgtcgc

SEQ ID NO: 2808 - DNA, 739 bp, Euphorbia peplus
gtttccttctatcgcaactatgggaagacattcaagaagcctcgccgtccctatgagaaggagcgtttagatgcagaacttaagttggttggagaatatggtctgcgttgcaagcgagagttgtggagggtccagtatgcgttgagccggatccgtaatgctgctagaatgcttttgactctagacgagaagaacccacgccggatctttgagggtgaggcccttctccgcaggatgaaccgttatggtctattggatgagagtcagaataagctcgattatgtgctggccttgactgttgagaacttcctggagcgccgcctacagacactagttttcaagtctggtatggccaagtccatccaccatgctcgggtgcttattaggcagaggcatatcagggttggaaggcaagtggtaaacatcccatcattcatggtgagggtggactcacaaaaacacattgacttctcattgacaagtccattcggcggtggacgaccaggaagagtaaagagaaggaaccagagggctgctagcaagaaggcttctggagatggtgatgaagaggatgaagagtgagtaagttatggcttagggtatctagtttaaaaagctactttggaacagtgtttaattttagacttttgtaattgaattttggaatgtggttaaagttgtggttatgcaagaactttcatgaggatttgatttttgcttccaatggaatactactgcc

SEQ ID NO: 2809 - DNA, 618 bp, Euphorbia peplus
gtttccttctatcgcaactatgggaagacattcaagaagcctcgacgtccctatgagaaggagcgtctagatgcagaactgaagttggtgggagaatatggtctgcgttgcaagagagagttgtggagggtgcagtatgcgttgagccgtattcgtaatgctgctagaatgcttttgactctagatgagaagaacccacgccggatctttgagggtgaggcgcttctccgcaggatgaaccgttatggtctattagacgagagtcagaataagctcgattatgtgctggccttgactgttgagaacttcctggagcgccgcctacagacactagttttcaagtctggtatggccaagtccatccaccatgctcgggtgcttattaggcagaggcatatcagggttggaaggcaagtggtaaacatcccatcattcatggtgagggtggactcacaaaaacacattgacttctcattgacaagtccattcggtggtggacgacctggaagagtaaagagaaggaaccagagggctgctagcaagaaggcttctggagatggtgatgaagaggatgaagagtgagttatggcttagggtatgtagtttaaaaagctactt

SEQ ID NO: 2810 - DNA, 735 bp, Euphorbia peplus
gcgatggtgcacgttaacttctatcgcaactatgggaagacatttaagaagccccgtcgcccctacgagaaggaacgattggatgctgaactcaagctggtcggagaatacggtcttaggtgcaagagagaattgtggagggtacaatatgctttgagtcgcatccgtaatgctgcaagaatgcttttgactcttgatgagaagaacccacgccgtatctttgagggggaggcccttctccgtcggatgaaccgttatggtcttttggacgagtctcaaaacaagcttgattatgtcttggccttgactgttgagaacttcctcgagcgtcgcctgcagactctagttttcaagtctggtatggctaagtctatccaccatgctcgtgtcctcatcaggcagaggcatatcagggttggaaggcaagcagtgaacataccatctttcatggtgagggtggactcccagaaacatatcgacttttcattgacaagtccacttggtcccggacgacctggaagagttaagagaaggaaccagaaggctgctagcaagaaggcttctggagatggtgatgaagaggatgaggagtgagtcccatctcataggaaatttattgttgaaaacctactttttgcaagtgatgttacttttgtgactgccaatatttttcttagaaaaagctttggaattgatatgtttaatttggacttgtggaatagtaattttgttcgg

SEQ ID NO: 2811 - DNA, 791 bp, Euphorbia peplus
ggaaggcgtggattgatagatcggagctatggtgcatgttaacttctatcgcaactatggcaagacattcaagaagccccgtcgtccctacgagaaggaaaggttagatgccgagctgaagttggtcggagaatatggtctccggtgtaagagagaattgtggagggtgcagtatgcattgagtcgcatccgaaatgctgcaagaatgcttttgactcttgatgagaagaacccacgtcgtatctttgagggggaggctcttcttcgacgtatgaaccgttatggtctattggatgagagtcaaaataagcttgattatgtcttagccttgactgttgagaacttcctcgagcgtcgcttacagactcttgttttcaagtcgggtatggcaaagtccattcaccatgctcgtgtcctcatcaggcagaggcatatcagggttggaaggcaagcggtgaacataccatctttcatggtgagggtggattcacaaaagcatatagacttctcattgacaagtccactcggtcctggacgacctggaagagtaaagagaaggaaccagaaggctgctagcaagaaggcctctggagatggtgatgaagaggatgaggagtgagtcatctcataggaaaataaacctacttttggtttagtgatgttacatctgtgactgccaatattttccggattgatatgtttaattttagacttgtgtaattctgtttttgtttgggatttaagttgttcctatggttatgacctttcatgaggatttgaattttgctcag

SEQ ID NO: 2812 - DNA, 834 bp, Euphorbia peplus
ggcgatagagatcagaggagcagaggagagcgatggtgcacgttaacttctatcgcaactatggcaagacattcaagaagcctcgtcgtccctatgagaaggaaaggttggatgcggaactcaagctcgtcggagaatacggtcttcgctgcaagagagaattgtggagggtacagtatgctttgagtcgcatccgtaatgctgcaagaatgcttttgactcttgatgagaagaatccacgccgtatttttgagggggaggcccttctacgtcggatgaaccgttacggtctattggacgagagtcaaaataagcttgattatgtcttggccttgactgttgagaacttccttgagcgtcgcctgcagactctagttttcaagtctggtatggctaagtccatccatcatgctcgtgtcctcatcaggcagaggcatatcagggttggaagacaagcggtaaacataccatctttcatggtgagggtggactcccagaaacatatcgacttctcattgactagtccacttggtcctggacgacctggaagagtaaagagaaggaaccagaaggctgctagcaagaaggcttctggagatggtgatgaagaggatgaggagtgagtcctcctcattggaaattgagttttaacttactttttgcaagtgatgttacttttgtgactgccaatatttttattaggaaaagctttcgttttgatatgttcaattttagactcatggaattgtacttctgtttggggtttagttcttcctatgtttatgacctttcatgaggagttaaattttgcttacaatgaaactattaaatttt

SEQ ID NO: 2813 - DNA, 801 bp, Euphorbia peplus
tgtgcggcgttagagatcagaggagcagaggagagcaatggtgcacgttaacttctatcgcaactatggcaagacattcaagaagcctcgtcgcccctacgagaaggaacgattagatgctgaactcaagctggtcggagaatacggtcttcgctgcaagagagaattgtggagggtccagtatgctttgagtcgtatccgtaatgctgcaagaatgcttttgactcttgatgagaagaacccacgccgtatctttgagggggaggcccttcttcgcaggatgaaccgttatggtttattggacgagagtcaaaataagcttgattatgtcttggccttgactgttgagaacttcctcgagcgccgcctgcagactctagttttcaagtctggtatggcaaagtccatccaccatgctcgtgtcctcatcaggcagaggcatatcagggttggaagacaagcggtgaacataccatctttcatggtgagggtggactcccagaaacatatcgacttctcattgactagtccacttggtcctggacgacctggaagagtaaagagaaggaaccagaaggctgctagcaagaaggcttctggagatggtgatgaagaggatgaggagtgagccttctcattggaaatttagttttaacttgctttttgcaagtgatgttacttttgtgactgccaatatttttattaggaaaagctttcattttgatatgtttaattttagactcatggaattgtacttttgtttggggtttagttcttcctgtgtttatgacctttcgtgag

SEQ ID NO: 2814 - DNA, 897 bp, Pseudoroegneria spicata
  misc_feature (4)..(4): n is a, c, g, or t
  misc_feature (6)..(8): n is a, c, g, or t
  misc_feature (21)..(21): n is a, c, g, or t
  misc_feature (858)..(858): n is a, c, g, or t
  misc_feature (888)..(888): n is a, c, g, or t
cctncnnncaccggcggcgcncagctcgacgacccgcgcgatcctgcggaggcggcagccatggtgcacgtcaacttctaccgcaactatggcaagaccttcaagaagccaaggcgtccgtatgagaaggagcgtcttgacgctgagctgaagctggttggggagtacggtctgcgggccaagcgtgagctctggcgtgtgcagtacgccctgagccgtatccgaaatgctgcgagggagctgctcaccctggatgagaagaacccccgccgtatctttgagggtgcagcgctcctccgccgcatgaaccgctacggtcttctcagcgaggaacagaacaagcttgattacgtgcttgccctcactgttgagaacttcctccagcgccgtcttcagaccatcgtcttcaagaatggcatggccaagtcaatccatcatgctcgtgtccttatcagacagcgccacatcagggttggaaagcagctcgtcaacattccttctttcatggtgagggttgacactgagaaacacgtcgacttctcactcacgagccccctgggcggtggacctgctggaagggtgaagcggaagaaccagaagaaggcctcaggcggcggtggtgatgacggcgaggaggaggaagactaagagctcagccttgtggaacttgcaaaaagagatttggaacttttgattcgagcttagaaacttagtggtgcagagctttcgttgcttttactcagaatcttgctgtggctgtcagttctaaaactagacttgttggttttgcttggttagtaaccaccgggtgaacaagtgaactctgtgaagctgcttcatattttgtgaactagaggnatcttggtattacaggtctggtgttgagtnaaaaaaaaa

SEQ ID NO: 2815 - DNA, 641 bp, Ambrosia trifida
aggtggccgccaggagcaaaccagatcaatcaactatccgccgtcgtaacgacgtcgtacaaccatggttcacgtccccttctaccgcaactatggtaagactttctagaagccacgtcgtccttatgagaaggagcgattggatgctgagttgaagcttgttggtgagtatggtcttagatgcaaacgtgagctttggagggtgcagtatgctttgagccgtatccgtaatgctgcaagaatgcttctgactcttgaagagaaggaccctcgtcgtatctttgagggtgaagcgcttatgaggagaatgaaccggtatggtctgttggatgagagccagaacaagctcgattacgtgctcgctctcactgttgagaactttcttgaacgccgtctacagactcttgtgttcaagactggtatggccaagtcaattcaccacgctagggttctcattaagcagagacacatcagggttggaaggcaggtggtgaatgtgccttctttcatggtgagagttgactcacaaaagcacattgacttctcactcacaagcccattcggaggtggtcgtccaggaagagtgaagcgaaagaaccagaaggcggctgcaaagaaggctgctggtggggatgctgacg

SEQ ID NO: 2816 - DNA, 780 bp, Guizotia abyssinica
tcagtatcgagtttcagtcgacagtgccgaggatatgcccgggaagtcggccattacgggcggggacttcagaagcagcgcatagagggtggccgccggctgtcagaaccgatcaatcaagtagccgccgtatcgacgtcggacaaccatggttcacgtccctttctaccgcaactatggtaagactttcaagaagccacgtcgtccttatgagaaggaacgattggatgctgagttgaagcttgttggtgagtatggtcttcgttgcaaaagggagctctggagagtgcaatatgctctgagccgcattcgtaatgctgcaagaatgcttctgacacttgatgagaaggacccacgtagaatcttcgagggtgaagcccttatgagaagaatgaacaggtatggtctgttggatgagagccagaacaaactcgattacgtgctagccctcactgtggagaactttcttgaacgccgtctccagacccttgtttttaagactggtatggctaagtcgatccatcatgctagagtcctcatcaagcagagacacatcagggttggaaggcaggtggtgaatgtagcttcctttatggtgcgtgtggactcacagaagcacatcgacttctcactcacaagtccattcggaggcggccgaccaggaagagtgaagcgaaagaaccagaaggcggctgcaaagaaggctgctggtggagctgatgacgaggatgatgaagaatgagctcgatctttaacccacgagctattgctatcatctat

SEQ ID NO: 2817 - DNA, 911 bp, Mimulus guttatus
gcccatcagaaaccctagtttttcatttgcactccgatcagctggtcggactgaggtcgtcaccggcggaaaatcatggtccacgtctgcttttaccgcaactatggcaagacttttaagaagccgcgtcgcccctacgagaaggaacgattggacgccgagttgaaactggtcggagagtacggcctaaggtgcaagagagagctttggagggtacagtatgcactgagccgtataaggaataatgccaggaatcttttgactctcgacgagaaagaccctcgtcgtattttcgagggcgaagcccttatgaggaggatgaacaagtacgcactgctagacgagagccagaacaagctcgattacgtcttggcactcactgttgagaactttctcgagcgccgcctgcaaactcttgttttcaaggctggtatggctaagtccatccaccatgctcgagttcttatcaggcaaagacatatcagggttggaaggcaagttgtaaacgtgccctcgttcatggtaagggtggattctcagaagcacattgacttctccctaacaagtccgtttggtgggggccgccccggtagagtgaagagaaggaaccagaagtcagcttcaaagaaggcttctggtggtgatggagacgaggatgaagaggagtgaaaatcttaattagtcgatgattattcatacaattgcttgctaagtagaattatggttttgtctctgatgctacctcatgtagtgctcgtgtctcatataaattattagcggttttggttgagatatttcgataattaggaacatttcagatttgtcatttttatttttcgttatatttatgtttaagttggactcttgaatcttattatacgaaaaatgttgaagttggatgagtataagtt

SEQ ID NO: 2818 - DNA, 898 bp, Quercus alba
attgcgcggcgccatcgtcctccacctctcgccatttgtattcagatcgtttaaccagaggactaacagtacggcttaactcacaccatggtccacgttgccttttaccgaaactatgggaaaacctttaagaagccaagacgtccctacgagaaggagcgtctggatgctgagttgaggctggtgggagagtatgggctgaggtgtaagagagagctgtggagagtacagtatgctctgagtcgaattcgtaacaatgctagaatgcttttgaccctggatgagaagaaccaacgtcgtatttttgagggtgaagcccttctgaggaggatgaacaggtatgggttactagacgagagccagaacaagctcgattatgtgttggcactcactgtcgagaactttctggagcgacgtttacagaccctggtgttcaagtctggcatggccaagtccattcaccacgctagagtgcttatcaggcagaagcatataagggtcgggagacaggtggtcaatattccctcatttatggttagggtggactcacagaagcacattgatttttcattgaatagtcctttcggtggtggacgccctgggagagtgaagcgcaggaaccaaaagtcagctgcgaagaaggctgctggtggagatggaggagacgaagatgaagaagagtaagctgaactttagatataagacgataatgatcatcatttcttttttaaactacgactggcctttttgagaaggctatgtcagttaagttttgttttgctattttcttcattatttttgagaatatgttggttttgcatattatttgatattaggtacgcgagaattttcttggagacaaaagaggaaagaatagggttggaaagaaagagaaaag

SEQ ID NO: 2819 - DNA, 859 bp, Valeriana officinalis
caggcaaacatggtgcacgtcaatttctatcgcaactatgggaagacattcaagaagccccgtcgtccatatgagaaggagcgtttggatgctgagttgaagctggttggagagtatggactgaggtgtaaaagagagctatggagggttcagtacgcacttagcagaatccgaaatgcagcaagaatgcttctaaccctagatgagaaagaccagcgtcgtatctttgagggtgaagctctgcttcgcaggatgaaccgttatggtcttcttgatgaaagccagaacaaactcgattatgtcttggctttgactgtcgagaactttcttgaacgtcgccttcagaccctcgtcttcaaggctggtatggccaagtccattcaccatgctcgtgttctcatcaggcagaggcacatcagggttgggaggcaagtggtgaatgtaccatccttcatggtgaaactcgactctcagaagcacattgacttctctttgaccagtccattcggaggtggcaggcccggaagagtgaagagaaggaaccagaaatctgcagcaaagaaagctgctggtggtggtgatggagatgaagaagacgaggattgagaaatcaatttgcttcttagtttacatcacttatcaatcagttaagtttttttgggattgttcttgttgaattatgactacatctttttgttgctttgttaaactatcggattagtgttatgttttcttctttgttttcgcaagttttggtttactttttctcatgagtatgaacctttcataattcatgtattacaactcggtactcggtatcatctgattttgagataacctgaatgagagtcgacttcct

SEQ ID NO: 2820 - DNA, 845 bp, Valeriana officinalis
ttctagtgagggcgcaggcaaacatggtgcacgtcaatttctatcgcaactatgggaagacattcaagaagccccgtcgtccatatgagaaggagcgtttggatgctgagttgaagctggttggagagtatggactgaggtgtaaaagagagctatggagggttcagtacgcacttagcagaatccgaaatgcagcaagaatgcttctaaccctagatgagaaagaccagcgccgtatctttgagggtgaagctctgcttcgcaggatgaaccgttatggtcttcttgatgaaagccagaacaaactcgattatgtcttggctttgactgtcgagaactttcttgaacgtcgccttcagaccctcgtcttcaaggctggtatggccaagtccattcaccatgctcgtgttctcatcaggcagaggcacatcagggttgggaggcaagtggtgaatgtaccatccttcatggtgaaactcgactctcagaagcacattgacttctctttgaccagtccattcggaggtggcaggcccggaagagtgaagagaaggaaccagaaatctgcagcaaagaaagctgctggtggtggtgatggagatgaagaagacgaggattgagaaatcagtttgcttcttagtttacatctcttatcaatcagttaagtttttttgggattgttcttgttgaattatgactacatctttttgttgctttgttaaactatcggattagtgttatgttttcttctttgttttcgcaagttttggtttactttttctcatgagtatgaacctttcataattcatgtattacaactcggtagtattcaaaaatcgtaaaaa

SEQ ID NO: 2821 - DNA, 945 bp, Phaseolus coccineus
gtaaaatttagggtttctcatttaaaaaggcgaaacaaagggagacagaagatccaggcgcaagtgcgagtagaggacagcagcggagaaggaaaaacggcaccgccgtagaagacaacagtcatggtccacgtttcgttttacaggaactatggaaagacgttcaagaagccgcgtcgtccgtatgagaaggagcgtctggacgcggagctgaagctggtgggggagtacgggctgcggtgcaagagggagctctggagggtgcagtacgcccttagccgcatccgtaacaacgcgcgtaacctcctcacgctcgacgagaagaacccgcgccggatctttgagggcgaggctctcctccgccgcatgttccgctacggtctcctagacgagacccagaacaaactcgattacgtcctcgcactcactgtcgagaacttcctagagcgtcgcctccagaccctcgtcttcaagtccggcatggccaagtccatccaccatgccagggttctcatcaagcagaggcacatcagggttggtaggcaagtggtgaacatcccctctttcttggtgagggtggactcacagaagcacattgacttttcacttacaagtccccttggtggaggacgccctggaagagtgaagagaaggaaccaaagggctgctgctaagaaggcagcaggtggagatggagatgaggaagatgaggattagactattaatgatgtctttttagtgcatttacaccttctgttaccttttactttacgtgcattagattatcgtttttgattgtaatacattttcatcctcggttccatgtttgggaaaacattttgcttgacatattatgtttttttcaacttatatattaagattttcttttaaataattttgattttaattaattcgttttctgccctcaacttctaacgaaccttg

SEQ ID NO: 2822 - DNA, 896 bp, Phaseolus coccineus
aggaattaggattttgtgatttaaaaaggcgaaacaaagggagagagaagatcgagggcgcaagcagagcggagtaggaaaacggcaccgccgtagaagaccacagtcatggtgcacgtttcgttttacaggaactatggaaagacgtttaagaagccgcgtcgtccgtacgagaaggagcgtctggacgcggagctgaaactggtgggggagtacggcctgcgctgcaagagggagctctggagggtgcagtacgccctcagccgtatccgcaacaacgcgcgtaacctcctcactctcgacgagaagaacccgcgtcggatctttgagggcgaggctctcctccgccgcatgttccgctacggtctcctcgacgagacccagaacaaactcgattacgtcctcgcactcaccgtcgagaacttcttagagcgccgcctccagaccctcgtcttcaagtccggcatggccaagtccatccaccatgccagggttctcatcaagcagagacacatcagggttggtaggcaagtggtgaacatcccgtctttcttggtgagggtggactcacagaagcacattgacttttcacttacaagtccccttggtggaggacgccctggaagagtgaagagaaggaaccaaagggctgctgctaagaaggcatcaggtggagatggagatgaagaagatgaggattagagtcttaatgaagcctttctagtgcatctactttacgtgcctagattatcgttttttattgttatacattttcatcctcggttccttgtttgtgaaaacattttgcatgacatattatgttcttttcaacttatatattttaaagtattaagattttcttttaaataattttgatgtttattgattcattttct

SEQ ID NO: 2823 - DNA, 1023 bp, Vaccinium corymbosum
ctccttacttaccccgtggttgtcggtccgttggctagtctcagagctagttggttactacaacgcagtgtcgcctagttacggccgggctctctctcacccgtttcttttgcatttccatagcctccgcgaaattggcgaactggtagccgtgctatcatggtgcacgttaactactatcgcaactatgggaaaacttttaagaaacctcgtcgcccctacgagaaggagcgacttgatgctgagctgaagctagtgggagagtatgggctccgctgcaagagggagctttggagggttcaatatgctttgagccgcatccgaaatgctgcaagaatgcttcttacccttgacgaaaagaatcagcgcagaattttcgagggtgaagccctgttgaggaggatgaacaggtatggtctgcttgatgagagccagaacaagctcgattatgttttggccctcactgtggagaatttcctcgaacgtcgcctccagactcttgttttcaagacgggtatggcaaagtcgattcaccatgccagggtgctaatcaggcagaggcatatcagggttgggaggcaggtggtcaatgttccttccttcatggtgaggctggactcccagaagcacattgatttctcgttgacaagtcctcttggtggtggacgtccaggtagagtcaagcgaaagaacatgaaggctgctgctaagaaggctgccggtggtgacggagacgaagaagacgaagagtgaaggccttgcatcggtgtagttgttttctgttgcagcattagcatttgtggccttgtgtttcgtcacatttgccagcttactacttcaatttaaagagtttatggtgttttgagaaccctatattgtaggaagttttgaatgcttttatggttgtgcgtttcttgactatcccttagaacatatttgttcatcttgtttcttgtgacgatgatagaagtattatggaagattcagtcgttatttggcttctgtggatgagtcgaagataag

SEQ ID NO: 2824 - DNA, 1171 bp, Abies balsamea
aaaggatttttagggttttgtaggaagcgatagggttttttcacattcaatacaatacatcatgggaggttttgtctgatgcttgtttgtgagttcgggggagcaggaggagtagcagcaaagcaggaggtggagagatggtgcacgtcagtttttaccgcaactatgggaagacgttcaagaaaccccggcggccctacgagaaagagcggctcgacgcagagctgaaattggtgggagaatacgggctgcgaaacaagagagagctgtggagggttcaatacacgctgagccgcatacgaaatgcagcgcgtatgcttctgacgctggacgagaaaaaccctcgccggatattcgaaggagaagccctgctgcggcgtatgaacaggtatggtctcctggacgagacccaaaccaagctcgattacgtccttgctctcaccgttgagaacttcctcgagcgccgccttcagactcttgtcttcaaatctggcatggccaagtccatccatcatgcccgtgttctcattaggcaacgccacatcagggttggtaggcaggtagtgaatattccatctttcatggtaagagttgattcgcaaaagcacattgatttctcactgacaagtccacttggtggtggacgtcctggtcgtgtaaaacgaaagaacttgaaggcagcttcaaagaaggctgctggtggagatggagaggaagaggatgaggaatgagaggcatagtagtattaccggccaagacaagttcgctgcacaatctcttctttagcatgaggcttataaattttgttgaaagaatgtttttattcagggttttctggctgctgcaacaactggttgtgaaactttggcaatagatctgcgtacattttaaatttggcaatagtcagcatacattttatattttgtcagtttactgactactgcaagatgtttcgtttgtttaaacattggtaataggttttagagtacaccttaaaatttgctggactttgattacagtccagggctgtgtggcagtaaacagcaaatgttgatttatttcattccatttactgaaaatttgaattttgtacatttaattatgtcgtttttaatggtatgttctgtttaatgtcactggtaagaacagcaatatttcatttgatccttcc

SEQ ID NO: 2825 - DNA, 837 bp, Ambrosia trifida
tctattttcagctaaggaagaaggttaggaaagcagcaggttattgctgcattgaattcggacaaccatggtccatgtgccattttatcgtaactatggaaagactttcaagaagccccgccgtccatacgagaaggaacgtttggatgcagagctaaaacttgtgggagaatacggtcttcgatgcaaaagggagctctggagggtgcaatatgctcttagccgaattagaaatgctgcaagaatgcttctgacccttgaagaaaaggacccccgtaggatatttgagggtgaagctcttatgaggagaatgaaccgttatggacttttggatgagagccaaaacaagcttgattacgtgttggcccttactgttgagaactttctagagcgtcgtttgcagacactcgtgttcaagactggtatggctaagtctatccatcatgctagagtgctcatcaagcagaggcacatcagggttggaaggcaagtagtgaatgttccatcattcatggtgagagtagactcacagaagcacatcgacttctctcttacaagtccatttggcggtggccgacctggcagagttaagcgaaggaaccagaaagcagctgcaaagaaggcagcaggcggtgatgctgatgaggacgatgaagaatgagctgtcactcgatctttgttatacaaaaggcttttatcatctttggtatctttgcagacataatgtattcatctttcggaaccttttatccttaggaagttttggatgttttcttggctttgttatggttttgatgtcggattatgttttaatgcgctaaacatgtttattgttta

SEQ ID NO: 2826 - DNA, 758 bp, Ambrosia trifida
tttcagtagcagcacagaggaggtggccgccaggagccaaaccagatcaatcaactatccgccgtcgtaacgacgtcgttcaaccatggttcacgtccccttctaccgcaactatggtaagaccttcaagaagccacgtcgtccttatgagaaggagcgattggatgctgagttgaagcttgtaggtgagtatggtcttagatgcaaacgtgagctttggagggtgcagtatgctttgagccgtatccgtaatgctgcaagaatgcttctgacccttgaggagaaggacccacgtcggatctttgagggtgaagcgcttatgaggagaatgaaccggtatggtctcttggatgagagccagaacaagcttgattatgtgctcgctctcactgttgagaactttcttgaacgccgtctacagactcttgtgttcaagactggtatggccaagtcaattcaccacgctagagttctcattaagcagagacacatcagggttggaaggcaggtggtgaatgtggcttctttcatggtgagagtggactcacaaaagcacattgacttctcactcacaagcccattcggaggtggtcgtccaggaagagtgaagcgaaagaaccagaaggcggctgcaaagaaggctgctggtggcgatgctgatgaggatgatgaagaatgatcgtacacggtgctggttctttgtttcattgttgcttctttaagtttttcattggtatttagttaatgataagtttatg

SEQ ID NO: 2827 - DNA, 964 bp, Arnica chamissonis
agcgcagagggtggccgccgggaggcagtagagatcaatcaagtagccgccgaatcgacgtcaaacaacaatggtccacgtcaatttctaccgcaactatggtaagactttcaagaagcctcgtcgtccttatgagaaggagcgattggacgctgagttgaagcttgttggtgaatacggtcttcgatgcaaacgtgagctttggagggtgcaatatgctctgagccgcatccgtaatgctgctagaatgcttctgactcttgaggagaaggatccacgtaggatttttgagggcgaagctcttatgaggagaatgaaccggtatggtctgttggatgagagccagaacaagcttgattacgtgttggccctcactgtggagaactttcttgaacgccggcttcagacacttgttttcaagactggcatggctaagtcgatccaccatgctagagttctcatcaagcagaggcacatcagggttgggaggcaggtggtaaatgtaccttctttcatggtgagagtggactcacaaaagcacattgacttctcactcacaagtccatttggaggtggccgacccggaagagtgaagcgaaagaaccagaaggcggctgcaaagaaggctgctggtgcagatgctgacgaggatgacgaagagtgagctcactatctagctcttaatcttaatatcttttgcacttgtgacgcgtatgagtaatagatatcatccataattactgttggtaggaagttttggattcttggtcatgtgtttatcgcttgtttttattttcatggatttgtgaatgataagattatgctttggaatagctatcttgaaacttgttgtcactgtgctgggttcatggattttgtgttggagtgtagtttaatgaaatacaacttgactctttagctttgaggaaagctatagattcaagttatccttgtttttagaaag

SEQ ID NO: 2828 - DNA, 851 bp, Phaseolus coccineus
aaagggagacagaagatccaggcgcaagtgcgagtagaggacagcagcggagaaggaaaaaacggcaccgccgtagaagacaacagtcatggtccacgtttcgttttacaggaactatggaaagacgttcaagaagccgcgtcgtccgtatgagaaggagcgtctggacgcagagctgaagctggtgggggagtacgggctgcggtgcaagagggagctctggagggtgcagtacgccctcagccgcatccgtaacaacgcgcgtaacctcctcactcttgacgagaagaacccgcgccggatctttgagggcgaggctcttctccgccgcatgttccgctacggtctcctagacgagactcagaacaaactcgattacgtcctcgcactcaccgtcgagaacttcctagagcgtcgcctccagaccctcgtcttcaagtccggcatggctaagtccatccaccatgctagggttctcatcaagcagaggcacatcagggttggtaggcaagtggtgaacatcccctctttcttggtgagggtcgactcacagaagcacattgacttttcacttacaagtccccttggtggaggacgccctggaagagtgaagagaaggaaccaaagggctgctgctaagaaggcagcaggtggagatggagacgaggaagatgaggattagactattaatgatgtctttttagtgcatttacaccttgtgctaccttttactttacgtgcttagattatcgtttttgattgtaatacattttcatcctcggtttcttttgggaaaacattttgcttgacctattatgtttttttcaacttatatattaagattttctttt

SEQ ID NO: 2829 - DNA, 798 bp, Phaseolus coccineus
cagagcggagtaggaaaacggcaccgccgtagaagaccacagtcatggtgcacgtttcgttttacaggaactatggaaagacgtttaagaagccgcgtcgtccgtacgagaaggagcgtctggacgcggagctgaaactggtgggggagtacgggctgcgctgcaagagggagctctggagggtgcagtacgccctcagccgtatccgcaacaacgcgcgtaacctcctcactctcgacgagaagaacccgcgtcggatctttgagggcgaggctctcctccgccgcatgttccgctacggtctcctcgacgagacccagaacaaactcgattacgtcctcgcactcaccgtcgagaacttcttagagcgccgcctccagaccctcgtcttcaagtccggcatggccaagtccatccaccatgccagggttctcatcaagcagagacacatcagggttggtaggcaagtggtgaacatcccgtctttcttggtgagggtggactcacagaagcacattgacttttcacttacaagtccccttggtggaggacgccctggaagagtgaagagaaggaaccaaagggctgctgctaagaaggcatcaggtggagatggagatgaagaagatgaggattagactattaatgaagcctttctagtgcatctactttacgtgcctagattatcgtttttgattgttatacattttcatcctcggttccttgtttgtgaaaacattttgcatgacatattatgttcttttcaacttatatattttaaagtattaagattttctt

SEQ ID NO: 2830 - DNA, 907 bp, Phaseolus coccineus
tctagtagtggccattatgccggggtttctcatttaaaaaggcgaaacaaagggagacagaagatccaggcgcaagtgcgagtagaggacagcagcggagaaggaaaaacggcaccgccgccgtagaagacaacagtcatggtccacgtttcgttttacaggaactatggaaagacgttcaagaagccgcgtcgtccgtatgagaaggagcgtctggacgcggagctgaagctggtgggggagtacgggctgcggtgcaagagggagctctggagggtgcagtacgcccttagccgcatccgtaacaacgcgcgtaacctcctcacgctcgacgagaagaacccgcgccggatctttgagggcgaggctctcctccgccgcatgttccgctacggtctcctagacgagacccagaacaaactcgattacgtcctcgcactcactgtcgagaacttcctagagcgtcgcctccagaccctcgtcttcaagtccggcatggccaagtccatccaccatgccagggttctcatcaagcagaggcacatcagggttggtaggcaagtggtgaacatcccctctttcttggtgagggtggactcacagaagcacattgacttttcacttacaagtccccttggtggaggacgccctggaagagtgaagagaaggaaccaaagggctgctgctaagaaggcagcaggtggagatggagatgaggaagatgaggattagactattaatgatgtctttttagtgcatttacaccttctgttaccttttactttacgtgcattagattatcgtttttgattgtaatacattttcatcctcggttccatgtttgggaaaacattttgcttgacatattatgtttttttcaacttatatattaagattttcttttaaa

SEQ ID NO: 2831 - DNA, 916 bp, Cephalotaxus harringtonia
cccagggtgtcttttgactcgcctcctttttattgagagcttcgctacctctcgtggttttacgtttttagctgggtggggacgaaaacgattaggaggcggaggcggaggcagaggcagaggcagacacaggcatggtgcacgtcagtttttatcacaactatgggaagacgttcaagaagccgaggcggccatacgagaaggagcggcttgatgcggagctcaagctggtgggagaatatggtctgcgaaataaacgagaactgtggagggtgcagtacacgctcagccgcatccgcaacgcagccagaatgcttttgactttggacgagaagaactcacgtcgtatattcgaaggggaggcgctgctgcggaggatgaataggtatggcctcctcgacgaaggccaggacaagctcgattatgtcttggctttgaccgtcgagaactttttggaacgccgcctgcagaccctcgtcttcaaggccggaatggccaaatccatccaccacgcccgcgtcctcatcaggcaaaggcacatcagggttggtaggcaggtggtgaatattccatctttcatggtacgagttgattctcaaaagcatattgatttctcacttacaagtccacttggtgggggacgtcctggtcgtgttaaacgaaagaacatgaaggcagcatcaaagaaggctgctggtggagatggagaggaagaggatgaggaatgaggcatgtagtggtacttttggcaaagaaaatcttgctagatcttattttcataacagaaagtctggtagattgaaaggatgtctgttgaacagagtattttggttgttgctagatggtggtgaactttggcaataggtcaagtaaacatcaatttaaaattggtttaaacttcctttgttatctaaac

SEQ ID NO: 2832 - DNA, 764 bp, Cleome spinosa
ttcgtgcgatcgtctcttcttcgctcccttgccatggtgaatgtcagcttctaccgcaactatgggaagaccttcaagaagccacgtcgtccctatgagaaggagcgtcttgacgcggagttgaagctcgtcggagaatacgggctccgttgcaagagagagctgtggagggttcagtatgcccttagccggatccgtaatgctgctagggatctcctcactctcgatgagaaaaaccctcgtaggatctttgagggtgaagcccttctccgcagaatgaacaagtacgggcttctcgacgaaagccagaacaagctcgattacgtattggctttgactgtcgagaacttcctggaacgtcgcctccagacccttgtcttcaagtctggtatggccaagtcgatccatcacgcacgtgtcctcatcaggcaaaggcacatcagggtggggaggcaactagtgaacattccatcgttcatggtgaaagtcgattcacagaagcatatagacttctccctcaccagtccatttggcggtggccgacccggaagagtgaagagaaggaacgagaaggccggcgccaagaaggctgggggaggcgacggtgacgaggaagacgaagagtgaaacagatcttagtaaagcttaaaaagaatggatctagacgtcgtgtcatgacttgatgtgctttttgtttctcagtaacttccccctcgtattcccctactcgtggttccttccttttcggaccaattacagaaccg

SEQ ID NO: 2833 - DNA, 1065 bp, Gossypium hirsutum
actctccacttcatttctctttccgtactccggcatcttcccctttcccttcaactttaatctaccacaactgtaacgacgccatggttcacgtcagtttctaccgtaactatgggaagacctttaagaagccaagacgtccatatgagaaagaaagattagatgcagagttgaggcttgtaggagagtatggtctccaatgtaagagggagttgtggagggttcagtatgctttgagccgtatccgtaatgctgctagggaccttctcacccttgatgagaagaaccctcgtcgtatttttgaaggtgaagctcttcatcgtaggatgaacaggtatggacttttggatgagagccagaacaagcttgattatgtcttggctttgactgtcgagaacttcctggaacgccgcttgcaaacacttgtgttcaagactggtatggccaagtctattcaccatgctcgtgtcttgattgggcaaaggcatatcagggtagggaggcaggttgtcaacatcccatccttcatggtaagggttgactcgcaaaaacatatcgatttctctctcacgagtccatttggaggtggccgacctggaagagtgaagagaaagaaccaaatagcagctgccaagaaggctgctggcggagatggcgatgaagaggaagatgagtaaaaccttagagggctactaccacccttagtaacccttaaatagttttggagcttgcaaattttcttctcccattattagatatggtacgtgtcttgcttctagacctttatctttagtgtatcttggtatatgttttacatttaatattattttcttttttcttgtattggaagttaatgaaaggttattttgttcatttaaactagttagatagttcatatgttgcatgaactgggatgtaatattggatactgagtatgtgtccaatatggggtacgtttaaatttttgagtattttcatgtactccaaaaagtttttggaggatcgtactttggtttgatgtggtcagtgtatcaattaaggattgatggcatcatatgttcctaa

SEQ ID NO: 2834 - DNA, 860 bp, Vigna unguiculata
acagaagatctagtgtgaggtcggaagagcgagcagagcacaggagcggtaggaaaaaacggcagcgccgtagaagagaaaaaccatggtccacgtttccttttacaggaactatggaaagacgttcaagaagccgcgtcgtccgtacgagaaggagcgtctggacgcggagctgaagctggtcggagagtacggactgcgctgcaagagggagctgtggagggtgcagtacgccctcagccgcatccgcaacaacgcgcgtaacctcctcactctcgatgagaagaaccctcgccggatcttcgagggcgaggctctcctccgccgcatgttccgctacggtctcctcgacgagacccagaacaaactcgattacgtcctcgcactcactgtcgagaacttcctcgagcgccgcctccagaccctcgtcttcaagtcaggcatggccaagtccatccaccatgctagggttctcatcaagcagagacacatcagggttggtaggcaagtggtgaacatcccatcgttcttggtgagggttgactcacagaagcacattgacttctcacttacaagtccccttggtggaggacgtcctggaagagtgaaaagaagaaaccaaagggctgctgctaagaaagccgcaggtggagatggagatgaggaagatgaggattagactattaattatgtatttctctactgcatttacaccttgtgtcaccttttactttacgagcctagattatggtttttgattgttatacattttcatcctcggttccttgtttgagaaaacattttgtttgacatattatgttttttgaagttatatattttaaagtatcaagattttcttt

SEQ ID NO: 2835 - DNA, 892 bp, Vigna unguiculata
aaaggagacagaagatctagtgtgaggtcggaagagcgagcagagcacaggagcggtaggaaaaaacggcagcgccgtagaagagaaaaaccatggtccacgtttccttttacaggaactatggaaagacgttcaagaagccgcgtcgtccgtacgagaaggagcgtctggacgcggagctgaagctggtcggagagtacggactgcgctgcaagagggagctgtggagggtgcagtacgccctcagccgcatccgcaacaacgcgcgtaacctcctcactctcgatgagaagaaccctcgccggatcttcgagggcgaggctctcctccgccgcatgttccgctacggtctcctcgacgagacccagaacaaactcgattacgtcctcgcactcactgtcgagaacttcctcgagcgccgcctccagaccctcgtcttcaagtcaggcatggccaagtccatccaccatgctagggttctcatcaagcagagacacatcagggttggtaggcaagtggtgaacatcccatcgttcttggtgagggttgactcacagaagcacattgacttctcacttacaagtccccttggtggaggacgtcctggaagagtgaaaagaagaaaccaaagggctgctgctaagaaagccgcaggtggagatggagatgaggaagatgaggattagactattaattatgtatttctctactgcatttacaccttgtgtcaccttttactttacgagcctagattatggtttttgattgttatacattttcatcctcggttccttgtttgagaaaacattttgtttgacatattatgttttttgaagttatatattttaaagtatcaagattttctttaaataatatttctcaacttcatttt

SEQ ID NO: 2836 - DNA, 857 bp, Vigna unguiculata
agggcgaagatctagttgcagtcggaagagcgacaagcggagaaggtaagcggcagcggcatagttgccgtagaagacaatcaccatggtccatgtgtccttttacaggaactatggaaagacgttcaagaagccgcgtcgtccgtacgagaaggagcgtttggacgcggagctgaagctggtgggggagtacgggttacggtgcaagagggagctgtggagggttcagtatgccctcagccgcatccgcaacaacgcgcgtaatctcctcactctcgatgagaaaaatccgcgccggatctttgagggcgaggctctcctccgccgcatgttccgctacggtctcctcgacgagacccagaacaaactggattacgtccttgcactcactgtcgagaacttcctcgagcgccgcctccagaccctcgtcttcaagtccggcatggccaagtctatccaccatgctagggttctcatcaaacagagacacatcagggttggtaggcaagtggtgaacatcccatcattcttggtgagggttgactcacagaagcacattgacttttcacttacaagtccccttggtggaggacgccctggaagagtgaagagaaggaaccaaagggctgctgctaagaaggccgcaggtggagatggagatgaggaagatgaggattaggttattaattatctctttctgtattgcatttacactttgtgccattacgtgcctagattatcgtttttgactgtcatacatttttatcctaggtttcttgtttggtaaaacattttgtttgacatattattcttttgaacttaaatatcaagattttcctttaaacaaaaaaaaaaaa

SEQ ID NO: 2837 - DNA, 881 bp, Vigna unguiculata
attagggtttataagggcgaagatctagttgcagtcggaagagcgacaagcggagaaggtaagcggcagcggcatagttgccgtagaagacaatcaccatggtccatgtgtccttttacaggaactatggaaagacgttcaagaagccgcgtcgtccgtacgagaaggagcgtttggacgcggagctgaagctggtgggggagtacgggttacggtgcaagagggagctgtggagggttcagtatgccctcagccgcatccgcaacaacgcgcgtaatctcctcactctcgatgagaaaaatccgcgccggatctttgagggcgaggctctcctccgccgcatgttccgctacggtctcctcgacgagacccagaacaaactggattacgtccttgcactcactgtcgagaacttcctcgagcgccgcctccagaccctcgtcttcaagtccggcatggccaagtctatccaccatgctagggttctcatcaaacagagacacatcagggttggtaggcaagtggtgaacatcccatcattcttggtgagggttgactcacagaagcacattgacttttcacttacaagtccccttggtggaggacgccctggaagagtgaagagaaggaaccaaagggctgctgctaagaaggccgcaggtggagatggagatgaggaagatgaggattaggttattaattatctctttctgtattgcatttacactttgtgccattacgtgcctagattatcgtttttgactgtcatacatttttatcctaggtttcttgtttggtaaaacattttgtttgacatattattcttttgaacttaaatatcaagattttcctttaaactattttttgttcatcaactttta

SEQ ID NO: 2838 - DNA, 1045 bp, Cryptomeria japonica
gtgttattagtctggggagagacgaagaacaggcagaggcagaggaggttctgcggcagccatggtgcacgttagcttttatcgcaactatggtaagacctttaagaagcctcgtcgtccttatgagaaagaacggttggatgctgagctaaagttggttggagagtatggtctccgtaacaaaagagaactctggagggttcagtatgccctgagccgtattcgtaatgcagcaagaatgcttcttactcttgatgagaagaatcctcgtcggatctttgagggtgaggctttgctgcgtcgcatgaacaggtatggacttcttgatgagagtcagaacaagcttgattatgttttggcattgacggttgagaacttccttgagcgccgactccagacccttgtgttcaagtctgggatggccaagtcaatccaccatgctcgtgtgctcatcagacaacgacatataagggttggccgtcaggtggtgaatataccatctttcatggtcagagttgattcacagaagcacatagacttctctttaactagtcctcttggtggaggacggcctggtcgtgtgaagcgaaagaacatgaaggcagcatcaaagaaggctgcaggcggagatgaagaggaggacgaggattgagtgatagcaaaatagatagcctttactttgctgtcgtagagatttgtttgatgctccaatgtcttggagcttgtggctttgctagaaatatgatgtaggaccttctttaatatatactgtagtcaagttttgttttgatcattcattcctcttcctaagagctggaatgagacggatggctattaagagtaaatttaacaaagttcttttccttccattatttgatttataggttggttgtaatttgcactcagttgattgacagcagcttatgttagtttcaaaatgtcaaggcagaaaaaattaggttcttaatcctgttttgttttgggcttttggacagcttactaagagctgaagtgaatttggtgctatataagtattttgcaatgc

SEQ ID NO: 2839 - DNA, 841 bp, Eschscholzia californica
cttttctcctgggatctcttgtttcaagtctagcaggaggaagccatggttcacgttaacttctacaggaattatggaaagactttcaaaaagccccgtcgtccatatgagaaagagcgtcttgatgctgagctgaagctagtcggagagtacgggctacgatgtaagagggaactctggagggttcagtatgctctaagtcgtatccgtaatgcggctagaatgcttcttacccttgatgagaaaaacccacgaaggatttttgaaggtgaagctcttcttagaaggatgaatcgatatgggcttttggacgagagccagaacaagctcgattacgtgttggctctaactgttgagaacttccttgagcgtcgtctgcagactctcgtgttcaagtcgggtatggcaaaatcgatccaccatgctcgtgtcctcattagacagaggcatatcagggttgggaggcaggtagtaaacattccatcgttcatggtgagagtcgactctcagaagcacatcgacttctcactcacaagtcccctcggaggtggacgcgctggtagagtgaagcgaaggaacctaagggcagcttctaagaaggctggtggtggagatggcgatgaggaggatgaggattgagttcttcattaagatcttcaacaccagtcgtggtagggaattgtcgtagtctttcacttggttatgattctaagtcctttgttttcgtagtttttgaacctctcttttcttttaaatgtcagaagttgttttgtttgaattatatctttattatacaatattgacattatcgtaatataacttgttgactaaaaaaaaaaaa

SEQ ID NO: 2840 - DNA, 883 bp, Eschscholzia californica
agagcgcagaactaaaccagcgacggtgaagtttcaggatggttcacgttaatttttaccggaactatgggaagacattcaagaagcctcgacgtccatatgagaaggagcgattggatgctgagttgaagcttgttggtgagtatgggcttcgatgtaagagagagctctggagggttcaatatgctttgagccgtatccgtaatgctgctagaatgcttctcactcttgatgagaagaaccctcgtcgtatctttgagggtgaggctcttcttagaagaatgaacagatatgggcttttggatgagagccagaacaagcttgattatgtcctagctttgactgttgagaacttccttgaacgtcgtcttcagactcttgttttcaagtcgggtatggcaaagtccattcatcatgctcgtgtcctcattaggcaaaggcatatcagggttggaaggcaggtggtgaacatcccatctttcatggtgagggtagactcacagaaacacattgacttctctctcacaagtcctcttggaggtggacgagctggaagagtgaagcgaaggaaccaaaaagcagctagcaagaaggctgccggtggagatggcgatgaggaagacgaggattaagcttttatctccataggccaggtaatttcagtagtcgaaatgcttactttcatcattgagcgaaagaacagttcagaaagaattttggtcagccttttaatttaggacatttcgttggcggatcatgttatggggaagtaattttgttttgttatggattttttaggatttacattctcagttttcatgttggattatggatgatttcgtgtggtaattgaagagattttgaaaattaggttcaatttcta

SEQ ID NO: 2841 - DNA, 880 bp, Eschscholzia californica
ttagtaggagagcacagaactaaaccggcgacggtgaagtttcaggatggttcacgttaatttctaccggaactatgggaagacgttcaagaagcctcgacgtccatatgagaaggagcgattggatgctgagttgaagcttgttggtgagtatgggcttcgatgtaagagagagctctggagggttcaatatgctttgagccgtatccgtaatgctgctagaatgcttctcactcttgatgagaagaaccctcgtcgtatctttgagggtgaggcccttcttagaagaatgaacagatatgggcttttggatgagagccagaacaagcttgattatgtcctagctttgactgttgagaacttccttgaacgtcgtcttcagactcttgttttcaagtcgggtatggcaaagtccattcatcatgctcgtgtcctcattaggcaaaggcatatcagggttggaaggcaagtggtgaacatcccatctttcatggtgagggtagactcacagaagcacattgacttctctctcacaagtcctcttggaggtggacgagctggaagagtgaagcgaaggaaccaaaaagcagctagcaagaaggctgccggtggagatggcgatgaggaagacgaggattaagctttatctccataggccaggtaatttcagtagtcgaaatgcttactttcatcattgagcgaaagaacagttcagaaagaattttggtcagccttttactttaggacatttcgttggcggatcatgttatggggaagttaatttttgtttttgttatggattttttaggatttacaatctcagttttcatgttggattatgaatgaattcgtgtggtaattgaagagatttgaaaaaaaa

SEQ ID NO: 2842 - DNA, 756 bp, Eschscholzia californica
aaaagaaagccatggttcacgttaacttttacaggaattatggaaagactttcaaaaagcctcgtcgtccatatgagaaggagcgtctcgatgctgaactgaagctcgtcggagagtatggactccgatgtaaaagagaactctggagggttcagtatgctcttagtagcatccgtaatgctgctagaatgcttctaaccctagatgagaagaacccacgtcggatcttcgaaggtgaagctcttcttcgaagaatgaatcgatatgggcttttggatgagagtcagaacaaactcgattatgttttggccctaactgtcgagaacttcctcgagcgtcgactccagaccttagtgttcaagtctggtatggcgaagtctatccaccatgcacgtgttctcatcaggcagaggcacatcagggttggaaggcaggtggtaaacattccatcttttatggtgagagtcgactctcagaagcacattgacttctcactcactagtccccttggaggcggacgcgcaggaagagtgaagagaaggaaccagaaggcagctgccaagaaggctggtggtggagatggcgacgaggaagatgaggattgatctcttaattcacaggtgtttgaacattagagttgtattagtcttggacatggtggttttctcttctactgtttaattttgtagtgttttaacttttctgatttctttcttccagaagttagaagttattttgcttgccttatatcattat

SEQ ID NO: 2843 - DNA, 1082 bp, Eucalyptus grandis
ggggtacttagaaacccaaagagccataaagattgcatctttctcggggagaaggcttgattttccgccgccacgatcccggagggcagccgcagtgcttagcttcgccggagaggagccatggtgcacgtctccttctatcgcaactatgggaagacatttaagaagccccgtcgcccttatgagaaggagcgattggatgctgagctgaagctggtgggagaatatggccttagatgcaagagagaactctggagagttcagtatgttctgagccgtatccgcaacaacgcaaggatgcttttgactcttgatgagaagaacccccgtcgaatctttgagggtgaggctcttcttcggaggatgaatcgctatggtttgctggacgaaagtcagaacaagcttgattacgtcttagccttgactgttgaaaacttcctggagcgtcgcctgcagacacttgtcttcaagtctggaatggcaaaatcaatccaccatgccagggtgctcatcaggcagagacatatcagggttgggaggcaagtcgtgaacatcgcatctttcatggtgagggttgattcgcaaaagcacatcgacttctcacttacgagcccattcggaggagggcgacctggaagagtgaagcgaaagaacaccaaggctgctgctaagaaggcttctggtggcgatggagatgaagaggacgaggattagatcattggacgggttcttgttatccaatgctagctgtcattacatgggccaatttttattctttttcggtgttgacgttgcagtataatttaattttggaacttttcgcagttctactcgggtacggactcgcttgcattatgacagcatttcatccttttggaacatggtcagggtatttgtataatttggtttcgaggtgactattctcggccactggtcataacttcaagttttgaccaattgccgtagttgaattgataactcaggtgttcgtaaaagctcccaaacgcggctaaatattcgatcttgaccgtaaggtatcatgggattggaaatgctaaaactacccaatgacttttagtaaa

SEQ ID NO: 2844 - DNA, 1323 bp, Eucalyptus grandis
ccttttctaggcaggcccagcgagaatcggagccaataactaccattagggtttccgccagagcccccttccttccccttcattccgcggaggcagacgaaggtaccagacggaggaggcgccgccggcggagcagagcccgagccagagccagagccagagccatggttcacgtctctttctaccgcaactatgggaagacgttcaagaagcctcgccgtccgtacgagaaggagcggctggatgctgagctgaaacttgttggtgagtatgggttgaggtgcaagcgagagttgtggagggttcagtatgtgctgagtaggatccgtaacaacgccaggatgcttctgaccctcgacgagaagaaccctcgccggatctttgaaggcgaggcccttctccgtaggatgaaccgctatgggcttttggacgagagccagaataagcttgattatgtcttggccttgactgtggagaacttcctcgagcgccgccttcagacattggtgttcaagtcgggtatggccaaatccatccaccatgccagggtgctcattaggcagaggcatatcagggttggtaggcaagtggtgaacatcccgtccttcatggtgagggttgattcacagaaacatattgatttctcgctgactagtccattcggtggtggccgagctggaagagtaaagagaaagaaccttaagtcagctgccaagaaggcttctggtggcgatggcgatgaagaggatgaggattaaactaggggcttttctgttagaacgagtggagcttagtgaatcatctgttgcccatcctcgtccttctatttttattttgcttaaagtgctgttgctttagtttgagaaccttgagttttgttgacgtttggctgattactcatgtgacttcaagtgccgggtcatcttgtttcgagatcctacaccttatttgtggtctgaacttttgtactctggaaagatatttcaattattagaatagaggctgagaattttgattgggaaagtaccgtttggtccacttgtttttgggagatgagagcagttgaattgtggtgatgtctcctgagttccacaattaactaaggcctgtttgtggttaggaatctgatttaccatgttaagcagtgtgcatggatcacaacatggttgattgctgagtagtttgttgtgacttttagctgaagaacatgggaggattcgtttgtttactgcagacccctctctatgcaaaagacatgtacgggtgcaaagtactcactctgaagacattcccccacgctcccctccctccctccctccctcc

SEQ ID NO: 2845 - DNA, 817 bp, Fagopyrum esculentum
tgtccatcgtcggtcgagaggtttcaggcagtcatggtgcacgtttcctactatcgcaactatggcaaaacattcaagaagcctcgtcgtccttacgagaaggagaggctggatgcagagctgaagctggtgggagagtatggacttcgttgcaagagggagctgtggagggtgcagtatgcattgagccgtatccgtaacaatgcaaggcatcttcttactctcgatgagaaagacaccaaacgtatctttgagggtgaggctttgcttaggaggatgaatcgctatgggctgttggatgagagccagaacaagcttgattacgtcttgtcacttactgtcgagaacttcctcgagcgtcgcctccagactcttgttttcaagtctggtatggccaagtccattcaccatgcccgtgttctcatcaggcaaaagcatatcagggttggaagacaagtagtgaacatcccatcattcatggtgagggtggattcacaaaagcacatagatttctctctgaacagtccgtttggaggaggcagacccggaagagtaaagcgaaagaaccagaaggctgctgctaagaaggcctctggtggagatggtgaagacgaggatgaagagtgagcgttgcattaataggatcattacttttgctcgtggccttgtttcatgttttggtagttttggattgggctttccttgaaggagctgttgatggaactctttgtgggcttttatgcatattagaatcgttgatggttatgttatccccggctttttaaacagtttttatgaactttggtttatgacaagc

SEQ ID NO: 2846 - DNA, 756 bp, Fagopyrum esculentum
aggtttcacgcagtcatggttcacgtatcctactaccgcaactatggtaagacgttcaagaagccccgtcgtccttacgagaaggagagattggatgcagagctgaagctggtgggagagtatggacttcgttgcaagagggaactgtggagggtgcagtatgcattgagccgtatccgtaacaatgcaaggcatcttcttactctcgatgagaaagacaccaaacgtatctttgagggtgaggctttgcttaggaggatgaatcgttatgggctgttggatgagagccagaacaagcttgattacgtcttgtcactaactgttgagaacttcctcgagcgtcgcctccagacccttgttttcaagtccggtatggccaagtccattcaccatgcccgtgtcctcatcaggcaaaagcacatcagggttggaagacaagtagtgaacatcccatcattcatggtgagggtggattcacaaaagcacatagacttctcactgaacagtccgtttggaggaggcagacccggaagagtaaagcgaaagaaccagaaggctgctgctaagaaggcctctggtggagatggtgaagacgaggatgaagagtgagtgttgcattaataggatcatacttttgctcgcctagtttctcatgcttttggatgttttggattgagccttgcctaaaggagctgttgcgcgaactctttgggggctttttgcactttagaatcgttaatggtcatgctatcctgt

SEQ ID NO: 2847 - DNA, 818 bp, Fagopyrum esculentum
accgtcgtcgagagggagagggtttcgtgcagtcatggtgcacgtttcctactaccgcaactatggcaaaacattcaagaagccccgtcgtccttatgagaaggagagattggatgcagagctgaagctggtcggagagtatgggcttcgttgcaagagggagctgtggagggtgcagtatgcattgagccgtatccgtaacaatgcaaggcatcttcttacactagatgagaaagacaccaaacgtatctttgagggagaggctttgcttaggaggatgaatcgctatgggctgttggatgagagccagaacaagcttgattacgtcttgtcacttactgttgaaaacttcctcgagcgtcgtctccagacccttgttttcaagtccggtatggctaagtccattcaccatgcccgtgtcctcatcaggcaaaagcatatcagggttggaagacaggtagtgaacatcccatcattcatggtgagggtggattcacagaagcacatagacttctcactcaacagtccgtttggaggaggtagacccggaagagtaaagcgaaagaaccagaaggctgctgctaagaaggcctcaggtggagatggtgaagacgaggatgaagagtaagtgttgcattaataggatcatacttttgctcaccttgcttctcatgttttttgatgttttggaatgagccttgcctaaaggagctgttgcggcaaactctttgcgggcttttatgcactttagaatcgttaatggttatgctatcctgttcttttgaacagttttgaactcactttatgacaattatttc

SEQ ID NO: 2848 - DNA, 745 bp, Panax ginseng
gcggaggtagcaccggaaccatggttcacgtcaacttctaccgtaattacggtaagacattcaagaagcctcgtcgcccttatgagaaggaacgtttggatgctgaacttaagcttgttggagaatatggactccggtgtaagagggagctgtggagggttcagtatgcactgagtcgcatccgaaatgctgcgagaaatcttctcacactcgatgagaaagacccacgccgtatctttgagggtgaggctcttctccgcaggatgaataggtatggacttttggatgagagccagaacaaacttgattatgttctggctttgactgtggagaacttccttgagcgccgtcttcaaacactcgtgttcaaaactggcatggcaaagtcgattcaccatgctcgtgttctcattaggcaaaggcatatcagggttggaaggcaggtggttaatgtagcttcattcatggtgagggtggactcccagaagcacattgatttctctcttaccagtccatttggaggtgggcgtcctggaagagtgaagcgaaggaaccagaaggcagctgcaaagaaagcagctggccgagctggagatgaggaggaagaagattgagtagtaaatccagtgttaattatgagatttcatgtgtttgaattcctgctcataggttgctagttttatagcagactgccctttttctcttaaaagttgtgttacaaatagttttcctgtgataatggatt

SEQ ID NO: 2849 - DNA, 768 bp, Guizotia abyssinica
acctcatttttgttgcaggttgattccttacgccgtctcagttatcagctacagaagcaggtgggaaagcgcagcaagcaactgctgcattgaaacccgacaacaatggttcacgtcccattttatcggaactatggaaagactttcaagaagccccgtcgtccatacgagaaggagcgtttggatgcagagttaaaacttgtgggagaatacggtcttcgatgcaaaagagagctctggagagtgcagtatgctcttagccgaattagaaatgctgcaagaatgcttttgacccttgaagagaaggaccaacgtaggatatttgagggtgaagctcttatgaggagaatgaatcgttatgggcttttggatgagagccaaaataagctcgattatgtgctggctcttaccgttgagaactttctagagcgtcgtttgcagaccctcgtattcaaaactggaatggccaagtctattcatcatgctagagtgctcatcaagcagagacacatcagggttggaaggcaagtagtgaatgttccatctttcatggttagagttgactcccagaaacacattgacttctctctcacaagtccatttggcggtggccgacctggcagagtgaagcgaaagaaccagaaagctgctgcaaagaaagcagccggcggtgatgcagatgaggatgatgaagaataagctgtcaagtaagcttgctatatctaaggtttcatctctatctttgcagacaatgtttgtttttatcat

SEQ ID NO: 2850 - DNA, 633 bp, Ipomoea batatas
attgttctctgcatttctgcagatcgcggcaggcgaacatggtgcacgtttccttttaccgcaactatgggaaaacattcaaaaagcctcgacgtccatatgagaaagagcgtttggatgctgagctgaagcttgttggtgaatatgggcttaggtgcaagagggaactttggagagttcagtatgctttgagccgtatcaggaataatgcaagaatgcttctgactcttgatgagaaggatccacgccgtatttttgagggtgatgccctccttaggagaatgaacaggtatgggttgctggacgagagccagaacaagctcgattatgtccttgctctcactgtggaaaatttccttgaacgccgtctccaaactctagtattcaaggctggtatggcaaagtctatccatcatgcaagagttctcattaggcaaaggcacatcagggttggaaggcaggtggtgaatgttccatccttcatggtcagactggactcccagaagcacattgatttctcgctcaccagtccatttggcggtggtcgccctggtagagtgaaccgaaagaaccacaaggctgcagctaagaaggcagcaggtggtgatggagatgaagaagatgaacagtgag

SEQ ID NO: 2851 - DNA, 866 bp, Ipomoea nil
cgtggaaaccctagtctccactccagattgcaccttgagcaccggactgaggatcacaccgccgtgtgcggcggcttagcagcatggttcacgtcaacttttaccgcaattatggaaagacattcaagaagcctcgacgtccatatgagaaagagcgtttggatgcggagttgaaacttttgggtgagtatggtcttaggtgcaagagggagctttggagagtacagtatgctttgagccgaatcaggaataatgcaagaatgcttcttactcttgatgagaaggacccacgccgtatttttgagggcgatgccctcctgaggagaatgaacaggtatggtttgttggatgagagccagaacaagcttgattatgtccttgccctcactgtggagaacttccttgaacgccgtctccaaactctcgttttcaaggctggcatggcaaaatcaatccatcatgccagagttctaattaggcaaaagcatatcagggttggaaggcaggtggtgaatgttccctcatttttggttagaatggactcccagaaacacattgatttctctctctctagtcctttcggtggtggacgccctggcagagtgaagagaaagaaccagaaggctgccgcaaagaaggcttctgggggtgatggtgatgaagaggatgaagaatgaggtccttgacaccttgtctgacatccaaaataaaaatatcaaaaagtgaagaatgaggtgtggcttgtcactttggaaacagaaaacaattaatgatgttggagaacttcattttaaggattttgccagcttagaaagttagaatcatgttgcttaaacagtctgtttttctttgaagttagagaagtt

SEQ ID NO: 2852 - DNA, 646 bp, Actinidia deliciosa
  misc_feature (31)..(31): n is a, c, g, or t
  misc_feature (45)..(45): n is a, c, g, or t
  misc_feature (70)..(70): n is a, c, g, or t
  misc_feature (112)..(112): n is a, c, g, or t
  misc_feature (115)..(115): n is a, c, g, or t
  misc_feature (139)..(139): n is a, c, g, or t
  misc_feature (172)..(172): n is a, c, g, or t
  misc_feature (223)..(223): n is a, c, g, or t
  misc_feature (238)..(238): n is a, c, g, or t
  misc_feature (242)..(242): n is a, c, g, or t
  misc_feature (283)..(283): n is a, c, g, or t
  misc_feature (457)..(457): n is a, c, g, or t
  misc_feature (485)..(485): n is a, c, g, or t
  misc_feature (496)..(496): n is a, c, g, or t
  misc_feature (529)..(529): n is a, c, g, or t
  misc_feature (535)..(535): n is a, c, g, or t
  misc_feature (544)..(544): n is a, c, g, or t
  misc_feature (547)..(547): n is a, c, g, or t
  misc_feature (574)..(574): n is a, c, g, or t
cttgtgtacctgacggcgagccgacgcagcnatggttcacgtcantttctaccgcaactatgggaagacntttaagaagcctcgtcgtccatatgagaaggagcgtttggangcngagctgaagctcgtaggagagtangggcttcggtgtaagagggagttgtggagagtncagtatgctctgagccgtatccgtaatgccgcaaggatgcttctcaccctngatgagaaaaatccncgcnggatctttgagggtgaagctcttctgcgcaggatgaacagntacgggcttttggaagagaaccagaacaagcttgattatgtcttggctttgactgtggagaacttccttgaacgccgtcttcaaacacttgttttcaagacgggtatggctaagtcgattcaccatgctcgtgtgctcatcaggcagaagcatatcagggttgggaggcaggtngttaacattccctcatttatggtgaggntggactctcanaaacacattgatttctctcttacaagtcccctnggaggnggacgcccnggnagggtcaagcgaaagaaccaaaaggcngctgctaataaggctgctggtggggatggagacgaggaggatgaggagtgaatgagatagcgaatggtattg

SEQ ID NO: 2853 - DNA, 830 bp, Glycyrrhiza uralensis
actccatcagctccagctgcagaaacctagagcaccagatagtagaggagccgatagagaacagcagcaatggtgcacgtttccttttaccgaaactatgggaaaacctttaagaagcctcgtcgtccgtacgagaaggaacgtttggatgcagagttgaagctggtcggggagtacgggcttcggtgcaagagggagttgtggagggttcagtacgccctcagccgcatccgtaacaatgcgaggaatcttctcacgctggacgagaagaaccctcgccggatcttcgagggtgaagcacttctacggaggatgttccgttacggtctcctcgatgaaactcagaacaagctcgattacgtcttggctctcaccgttgagaacttcctcgagcgtcgccttcagacactcgtcttcaaatctggaatggccaagtccattcaccatgctagagtcctcattaggcagaggcacatcagggttgggaggcaggttgtgaacatcccatctttcatggtgagggttgattcacagaagcacattgacttttcactcacaagtccacttggtggtggtcgtcctggacgtgtgaagagaaagaacctcagggctgcggctaagaaggcttctggtggtgacggtgatgaggaggatgaagattaaattatgaatagcttgggcttagatcttgtgccagcattttattctgttcggtagactttttagatttttatcatgctcgactcttataatttttccatccttgtttcttgtgtgaggaaagtctttgcctgagatatcttgtttttgaactgtcctttttcgaagta

SEQ ID NO: 2854 - DNA, 947 bp, Tropaeolum majus
cttaggtttattcatcccttcgacgagtagcctaccgacggagctatggttcacgttaacttctacaggaactatggcaagacctttaagaaaccacgacgtccttatgagaaggaacgtttggatgctgagttgaaactcgtaggagagtacgggcttaggtgtaagagagagttgtggagggtgcaatatgctttgagtcgtatccgtaatgctgcaagggaacttctcactctggatgagaagaatccccgtcgtatctttgaaggtgaagcccttctaaggaggatgaacagatatggtcttttggatgagagccaaagcaagcttgattatgtattggctttgactgttgagaactttcttgagcgtagactccagactcttgtcttcaagtctggaatggccaagtcaatccaccatgctcgtgtcctcatcaggcaaaggcatatcagggttggaaggcaggttgtcaacattccatctttcatggtgaggatggattcccagaagcacattgacttctcactcactagtccattcggaggaggtcgcccaggaagagtgaagagaaggaacatgagggctgctagcaagaaggcgtctggtggagatggagatgaagaggatgaggaatgattaagttattgaaaatccaactagtttagggcttgttttagtccttaattatattcaagactactatgctcatacattggtgttgtcattttgtctcaactatcttaaattttgttttagacagaacaagtactcatcaatccaatttatgtttttgaaacacttaaattgtcttttggatcatccttctcctcagcttcaatacctttgtccaaagcaatgaagtcgacacaatgtcgaaagtaccagtaatggaggatcttgacctctgttcaatttgtttaaatgacctagataccgaaactgaa

SEQ ID NO: 2855 - DNA, 938 bp, Nicotiana benthamiana
  misc_feature (884)..(884): n is a, c, g, or t
gggggatcatattccaccttcccgttcccttcagcaaatcgccgacgaatcgcggacgacagcggcggtaaccggaaaacatggtccacgtcgccttttatcgtaactatgggaagacctttaagaagcctcgtcgtccctatgaaaaggagcgattggatgcagagttgaagctcgtaggagaatatggattgaggtgcaagagggagctttggagagttcagtatgctttgagccgtatcaggaatgctgcaagaatgcttctgacattagacgagaaggacccacgtcgtatttttgaaggcgaagcactcatgaggaggatgaacagatatgggttattggatgagagccagaacaagctcgattatgtcttgtctctcactgtggagaactttcttgagcgtcgtctccaaaccctcgtcttcaagactggcatggctaagtctatccatcatgcaagagtgctaattaggcaaaggcatatcagggttggaaggcaggtggtgaatgttccatccttcatggtgagactggactcccagaagcacattgacttctctctcactagtcctttcggtggtgggcgtcctggaagagtaaagagaaagaaccaaaaagctgctgcaaagaaggcttctggtggagatggagacgaggatgatgaagaatgagcgcttattttcatgtgtggaggtggagctttaattcaaaagaagtactgtctcgtatctgcaatttttttagttaattttgcactctaggcttttggactatatttacttcgaagctgttatcctggtaattaagagtgaactatgtctagttatgacaacaacataacccgtattatccgactatggggtttggggaggatagctagnctatctaggtatgcatttgatctgaattccaaagctcgacctatttttctatta

SEQ ID NO: 2856 - DNA, 935 bp, Elaeis guineensis
cgtgttaaagcagaaggcgaggtaaccagctatggtccacgttagcttctaccgcaactatgggaagacttttaagaagccccgtcgtccatatgagaaggagcgtttggacgcggagctgaagcttgttggagagtacgggctccggtgcaagcgggagctctggagggtccagtatgtcctgagtcgcatccgtaatgctgcaagggagctcctcaccctcgacgagaagaacccacggaggatatttgagggagaggcccttttgcgccggatgaaccggtttgggctccttgacgagaaccagaacaagcttgattatgttctggccctcaccgtggagaatttcctcgagcgccggctccagacacaggtgttcaagtctggaatggccaagtcgatccatcacgccagggtcctcatcaggcagcgccacatcagggtgggccgccagttggtgaacattccttcattcatggtgagggttgactcggctaagcacattgattttgctctcaatagcccatttggtggaggtcgccctggaagagtgaagcgaaagaaccagaaggcagcagccaagaaggcagcaggaggtgatggtgatgaggaagatgaagattaagtgctcgattatgatcctagtagcaaataattatcagtttagtttctcaattattgttatgaagagtcttggtagattcacctagagaacgctcttgttctttcttttctgactattggaatatgaaattgtgttgctctattgtctctgctcttatttggatgttatatatgttgatgttatattatgaactgagtatgctgaaaatggattgtatcacccaagtgatgcgttattgattccaaaaaaaaaactgagactagaccaaggacacaacaaggggagtaagggagacagacacagagacgag

SEQ ID NO: 2857 - DNA, 942 bp, Carica papaya
acaggacacaaacccattatcaggcccgtagtcgtggcccggccgcgcagcctgtaaacaaccctagaccctaatcacctccttctcgtacatctcgcaacacttcgtctgctactgagagagatcgactcttgcttgccgaaacacaatcatggtgaatgtttccttttatcgaaactatggaaagacgttcaagaagccccgccgcccttacgagaaggagcgtttggatgccgagctgaagctggtgggagagtacggcctgcgttgcaagcgagagttatggagggttcagtacgctcttagccgtatccgaaacgccgcgagggagctgcttaccttggatgagaagaatccgcgccggatctttgaaggtgaggctcttctccgtaggatgaaccgctatggacttttggatgagagccagaacaagctagattatgtcttggcgttgactgttgagaacttccttgagcgccgtttgcagacccttgtcttcaagtcgggtatggcgaagtccattcatcatgccagagtgcttattaggcagaagcatatcagggttggaagacaggttgtgaacattccctctttcattgtgagggttgattcacagaaacacattgatttctcactcacaagtccctttggcggtggtcgtcctggaagggtgaagagaaagaacatgagagcagctgctaagaaggctgctggtggtgatggagatgaagaagaggaggaatgagccaggttttgatgttttgctatagttagttggagtttgcccattcatttagttttcacaactctatcggtctagtttttttaaaaaaaaaaaaatttaattgtttggagaagtctttgttgatcttgaaatctttggagaagtttttgttgctaaatgttttggacaccatgcaatatgaagaaatctattatatt

SEQ ID NO: 2858 - DNA, 845 bp, Arachis hypogaea
ggggctccaacttcaaaccctaggctgcaaccagagccagagctcctgcagcaaccatggtgcacgtttcgttttaccgcaactatgggaagacgttcaagaagcctcgtcgtccgtacgagaaggagaggctggacgcggagctgaagctggttggagagtacggactcagatgcaagagggagctgtggagggtgcagtacgcactcagcaggatccgcaacaacgccagaactctccttactctcgacgagaagaaccctcgccggatcttcgaaggtgaggctctcctccgaaggatgttccgttacggcctcctcgacgagactcagaacaagctcgattacgtcctcgctctcaccgtcgagaacttcctcgagcgccgcctccagactctcgtcttcaagtccggcatggccaagtccatccaccacgccagggtcctcatccgccagcgccacattagggttggaaggcaggtggtgaacatcccttcattcatggtcagggttgattcccagaagcacattgacttctcgctcacaagtccgcttggcggtggccgtcctggaagagtgaagcgaaggaaccagagggctgctgctaagaaggcttctggtggagatggtgatgaggaagatgaagattaagttatatggatatatctgttctccctacttagatctttttcaagcatttcattttctgtttctctagacttgttagtttcctgccatggttaactcttataattttgcagtctctgtttttgtttgaggaaaagccgtgctgaaaaaggttgagacattttttttaaattgtttttattaatactatttaagttt

SEQ ID NO: 2859 - DNA, 922 bp, Arachis hypogaea
ggggacttctccaagttgaagaaaccctattgtgagtgtgagagagacagagagcgcgcgctgcagcagcaaccatggtgcacgtctcgttttatcgcaattatgggaagacgttcaagaagcctcgtcgtccgtacgagaaggagaggctggacgcggagctgaagctggtgggagagtacggactcagatgcaagagggagttgtggagggtgcagtacgcactcagcaggatccgcaacaacgccagaactctccttactctcgacgagaagaaccctcgccggatcttcgaaggtgaggctctcctccgaaggatgttccgttacggcctcctcgacgagactcagaacaagctcgattacgtcctcgctctcactgttgagaacttcctcgagcgccgcctccagactctcgtcttcaagtccggcatggccaagtccatccaccacgccagggtcctcatccgccagcgccacattagggttggaaggcaggtggtgaacatcccatcattcatggttagggttgattcccagaaacacattgatttctcgctcacaagtccgctcggtggtggccgtcctggaagagtgaagcgaaggaaccagagggctgctgccaagaaggcttctggtggagatggtgacgaggaagatgaagattaaactatatggatatatctcttctccctacttagaactttttcaagcatttcattttctgtttctctctagacttgttagttttctgccatgattaactcttataattttgcaatctatgtttttgtttgaggaaaagctttgctaagaaacgttcggacattttttgtttaaaattgttcttattaatacaaagttttgcgccaaatatctcctgtgttctttgattgtgggcgtttgcaaataataacaatctc

SEQ ID NO: 2860 - DNA, 737 bp, Pisum sativum
cagctatggttcacgtttcattttacagaaattatgggaaaaccttcaagaagcctcgtcgtccatacgagaaggagcgattggatgctgagttgaagctcgtcggagagtacggtcttcgctgcaagagagagctctggagggttcagtacgctctcagccgtatccgtaacaatgcgaggaatctgttgacgctggatgagaagaatcctcgtcggatctttgagggtgaagcacttttgaggagaatgtttcgttatggtcttcttgatgaaactcagaacaagctcgattatgttttggctcttactgtggagaactttctcgagcgccgccttcagacacttgttttcaaatctggcatggctaagtccattcatcacgctagggttcttatcaggcaaaggcacatcagggttgggagacaggtggtgaacattccatcattcatggtgagggttgattcacagaagcacattgacttttcactcaccagtcctcttggtggtggtcgtcctggtcgtgtgaagcgaaagaaccttaaggctgcagctaagaaggcttcaggtggtgatggagatgaggaggatgaagattaaacaattaatgtcttaatgttttgattctagcaactactttatttatgttgtagacattttagatttttaatcatgcatgagttttacaattttgctacccttatttccgtgcgaggaaatctttgtttgcgcatgctg

SEQ ID NO: 2861 - DNA, 799 bp, Lippia dulcis
ctagtttccaattaaaatttcgatcagcagatcggactgagggcgtccgcagcgggaagttatggtgcacgtctccttttaccgcaattatgggaagacttttaagaagccccgtcgtccatatgagaaggagcgactggatgctgagttgaaacttgttggagaatatggtctccgatgcaagagagagctgtggagagttcagtatgctttgagccgtatcaggaacaatgccagaaatctattgactcttgatgagaaggaccctcgtcgtatatttgaaggtgaagctctcttgaggaggatgaacagatatgggcttcttgatgagagccagaacaagcttgattatgtcttgtccctcactgttgagaactttcttgagcgccgtcttcaaacccttgtgtttaaggctggtatggccaagtccatccaccatgcgagagttcttatcaggcagaggcataccagagttggtaggcaagttgtaaatgtggcttcatttcttgtgagggttgattcccagaagcacattgatttctctctcacaagtccatttggcggtggccgacctggacgagtgaagcgaaagaaccagaaggcagctgcgaagaaggcctctggtggtgatggagatgaggatgatgaggagtaagattttatatcttctatgataatgttaggaagtactgttacaactttttcttgactgatcatgttgtgaactctctcctacaatctgtctttgttttatgcgttagatgtccagatttatggtaatctaagtttttggcgtgtg

SEQ ID NO: 2862 - DNA, 978 bp, Podocarpus macrophillus
gagccgctgagaggatttcttgctttggacaggggaggtagaggcagaggcagaggcagagtcaggagcagtcatggtacacgttagtttttaccgcaattatggaaagacattcaaaaagccgcgaaggccgtacgagaaggagcgactggacgcggagctgaagctggtgggagagtatgggcttcgcaacaagcgggagctttggagggtgcagtacactctcagccgcatccgaaacgccgcgagaatgcttctgacgctggatgagaaaaaccctaggcgtattttcgaaggggaggcgctcctccgccggatgaacaggtatggtcttcttgacgagagccaaaacaagttggattacgtccttgccctcaccgtcgagaattttctggagcgccgccttcaaaccctagttttcaaatctggcatggccaagtctatccaccatgccagagtcctcatcaggcaacgccacatcagggttggcaggcaggtggtaaacataccatctttcatggttagagttgattcccagaagcatattgatttttcacttaccagtcctcttggtggtggacgtcctggtcgtgtgaagcgaaagaacatgaaggcagcatcgaagaaggctgctggtggagatgcagaggaagaggatgaggaatgaggcatgtagtggatgcgtgatgcctaattttcttagacattaggattttgatgcttaaaaccactttctggattttttgatgcttatgaatatgactgtttttctctcataatgtttttgtaattcgctgtgctcttttcaagtgacctactgaagtaagtccaaaacattttctaagattttcgaagtcttttgaagtgaagaaccctgttttggttttataattttagaattccaaacttatgttggtttatgattttagaattggagtaaaacttttgtaaattaattggatctctattcataaaaat

SEQ ID NO: 2863 - DNA, 941 bp, Papaver somniferum
ccatatcctcctgcaagcagaagaaggtcgcaaagcttccagcgaccttgaagccatggtgcacgttaacgtctacagaaactatggcaagacatttaagaaacctagacgtccttatgagaaggagcgtttggatgctgaattgaaactagttggtgagtatggattaagatgtaaaagagaattgtggagggttcaatatgctttgagtcgtatccgtaatgctgctagagaactgcttacccgtgatgagaaggacccacgcaggatctttgagggtgaggctcttctccgtagaatgaataggtatggacttttggatgaaagtcagaacaaacttgattatgtcttggccttaactgtggagaatttccttgaacgtcgtcttcaaacacttgtgttcaagtctggtatggcaaaatccattcatcatgctcgtgttctcatcaggcagagacatatcagggttgggaggcaggttgtaaacattccatctttcatggttagagttgagtctcagaagcacattgacttctctctcacaagtcctcttggtggtgggcgtcctggtagagttaagagaaggaaccaaaaggcagctgccaagaaggctgctggtggggatggtgatgaggaggatgaggaatgagttttatgcccccagtagtgccatgattacagaaacagttgtttatttgactcgctttgtccagtttaggccttaagtactggattctctgcattcttcttctgttataagcatacgttggttgctctgatgcccttaacattagaagttatatttacaaaacctaactttttgatggaatttctttcctacacagttgtcttttgcaactaatacttcagtttagtcaatcttgtgacttagaaaagaatctcgcatattctaagattttgtgtttgcaacgtaaattctg

SEQ ID NO: 2864 - DNA, 814 bp, Salvia sclarea
ctactagaccttggctgtcactcagaggaggaggcccaaaacaatggtgcacgtctcgttttaccgcaactatgggaaaacgttcaagaagcctcgtcgtccttatgagaaggagcgacttgatgctgagctaaagcttgttggcgagtatggtctgaggtgcaagagagagctatggagggttcagtatgccttgagccgcattaggaacaatgctaggaatctattgacccttgatgagaaggatcctcgccgtattttcgagggtgaggcccttttgaggaggatgaacaagtatgctctgctggatgagagccagaacaagctcgattatgtcctgtccctcaccgtggagaacttcctcgagcgtcgcctccaaactttggtcttcaaggcaggcatggccaagtctattcaccatgctagagtgctgatcaggcaaaggcacattagggttgggaggcaggttgtgaacgtcccatccttcctcgttagagtcgactcccagaagcacattgacttctctctcacaagtcccttcggtggtggtcgcccaggtagagtgaagcgaaagaaccaaaaggcagctgcgaagaaggcttctggtggtgatggagacgaggatgacgaggagtgaagtataggttcacttagttgataatgttacttttgagcgcacgctgattgagtttttctctgctgctttgtagtgatgaaatcttcttttacattatcagtgggttttgttgagatattaagagttaggttgaagttgtttctctgacattgacgttaagttttgccatttatagac

SEQ ID NO: 2865 - DNA, 920 bp, Salvia sclarea
gctactagaccttggctgtcactcagagaattcaattgatatttcgatcagcagatcggagtgagggcgtcggcagcgggaaaccatggtgcacgtctccttttaccgcaactatgggaagacttttaagaagccccgtcgtccctatgagaaggagcgtttggatgctgagttgaaacttgttggtgaatatggtctcaggtgcaagagagagttgtggagggttcagtatgctttgagccgtatcaggaacaatgccagaaatctattgactcttgatgagaaggaccctcgtcgtatttttgaaggtgaagctcttctgaggaggatgaacaagtatgctctccttgatgagagccagaacaagcttgattatgtattgtctctcactgttgagaacttccttgagcgccgcctgcaaacccttgtgtttaaggcgggtatggccaagtccatccaccatgccagagttcttatcaggcaaaggcatatcagagttggaaggcaagttgttaatgtgccttcattccttgtgagggttgattcccagaagcacattgacttctcactcacaagtcccttcggtggtggccgtcccggtagagtgaagcgaaagaaccagaaggctgctgcaaagaaggcctctggtggtgatggagatgaggatgatgaggagtgagacctaatatcttatttgttttatgataatgttaggaagtgcctttacaagtttttcttaactgtttgtgttgtgaacttatgtccgaatagctcttttgcttgagatattcagatttactgttacctaagttttgggatgtttatctgattctcgccccattttcgggttcagttgagcccgttgatcttgttatacaagacaggtttcttgaaaattcggttgttttggtgtatgttca

SEQ ID NO: 2866 - DNA, 775 bp, Scabiosa columbaria
ttttagctttgtgactccattgcaggtgcgaggcgctcgtcttccattgatatctgacgacaaggaggagccatggttcacgtcaatttctatcgcaactatgggaagacattcaagaagcctcgtaggccatatgagaaggagcgtttggatgctgagttgaagctcgtaggggagtatggacttaggtgtaaaagagagctatggagggttcaatatgcattgagccgaatccgaaatgcagctagaatgcttctcactctagatgagaaagaccctcgtaggatctttgagggtgaagctcttcttcgtaggatgaaccgccatgggcttcttgatgaaagtcagaacaagctcgattatgtcttggctttgactgttgagaactttctcgagcgccgtcttcaaacccttgtgttcaagaccggtatggccaagtctattcaccatgctcgtgtccttattaggcagaggcatatcagggttgggaggcaggtggttaatgtgccatctttcatggtgagggttgattcacagaagcacattgatttctctctaactagcccctttggaggtggtcgacctggaagagtgaagcgaagaaaccagaaggctgctgccaagaaagcagctggtggtgatggagaggaggaagaagaggactgatgaatgtatgaattaccaaaaaccaaaaactgggttcattttcttatgattattgccaagtcagtctattccttttttgtatgtatgagatagtagtgtattgttttgc

SEQ ID NO: 2867 - DNA, 873 bp, Senecio madagascariensis
tggatcccccgggctgcaggttttggccgtcttcttagctatcaggaactgagagagatcaagtagtgatatttgcgttgacgtcaatcgacaatggtgcacgtcaatttctatcgaaactatggaaagactttcaagaaacccagacgtccatatgagaaggaacgtttggatgctgagttaaaacttgttggagagtacggtcttaggtgcaaacgtgagctttggagggtgcaatatgctcttagccgtatccgtaatgctgcaagaatgcttctaactcttgaggagaaggacccacgaagaatttttgagggtgaagcgcttatgaggagaatgaacagatatggtcttttagatgagagccagaacaagcttgattacgttcttgctcttactgttgagaactttctagaacgaagattgcagacactcgtgttcaaaactggtatggctaagtctattcaccatgctagagttctcatcaagcagaggcacatcagggttggaaggcaagttgtgaatgttgcatcgtttatggtgagagtcgactcccagaaacacattgacttttctctcacaagtccctttggaggtggccgacctggcagagtgaagcgaaagaaccagaaagccgctgcaaagaaggcatcaggtggtgatgctgatgaggatgacgaagagtgatctgttgatcattttgttttatgaaaaaggttttatcgtgttagcagacattgtttatcttatattttccgaaccttttgtcgtaaggaagttttggatgtttttattgtgttgttaagagttttataatggtttttgcgttgatatgttaaagtgttaaaacaacaaaacccgacattatggaaa

SEQ ID NO: 2868 - DNA, 921 bp, Senecio madagascariensis
agcgtggtcgcggccgaggtacgcgggcctttacatatctcaaattgtcgccacatatcaggaagcagcagagggagagagcaacaactgattgttgcattgacgttaggcaatcatggtgcatgtcaacttttaccggaactatgggaaaactttcaagaagcccagacgtccatacgagaaggagcgtttggatgctgagttaaaacttgttggagagtacggtctcaggtgcaaacgtgagctctggagggtgcaatacgctcttagccgtatccgtaatgccgcaagaatgcttctaactcttgaggagaaggacccacgtaggattttcgagggtgaagcccttatgaggagaatgaacagatacgggcttctagatgagagccagaacaaacttgattacgttcttgctcttactgtcgagaactttttagaacgacgtctgcagactcttgttttcaaaactggtatggctaagtctattcaccatgctagagttctcatcaagcagaggcacatcagggttggaaggcaagttgttaatgttgcatccttcatggtgagagttgactcacagaagcacattgacttttctctcaccagtcctttcggagggggcagacctggtagagtgaagcgaaagaaccagaaagctgctgcaaagaaagcatccggtggggatgccgacgaggatgatgaggaataagctgttagccatcgtgttctatgaaaaaggtttcatctttatcattttagcagacatcgtttgttttgtctattcagaaccttttgttggtaggaagttttggattttttgtctccgtgttatgaatttgataatggattttgcatcgatgtgttaaattgctaaaacaactaaactctacattaactatttgatggtgatggtgttttgac

SEQ ID NO: 2869 - DNA, 995 bp, Sequoia sempervirens
ggagtataaactggtgtaggaggagggtgtgatggtttggggggagtgtgggcgtgggaagagcgacgaggaagaggagcgggaggagctagacgcagagaagaggcatggtgcacgtcagtttttatcgcaactatggaaagacgtttaagaagccgaggaggccatacgagaaggagcggctggacgcagagctgaagctcgtgggagagtacgggctcagaaacaagagggagctgtggcgggtgcagtacgcgctcagccgcatccgcaacgctgccagaatgcttcttactctggacgagaagaactctcgccgactgttcgaaggggaggcgctgctaaggaggatgaacagatacggccttctcgatgagagccagaataagctcgattatgtcctcgccttgaccgtcgagaactttctggagcgccgtctccagacactcgtcttcaagtctggcatggccaagtccatccaccacgctcgcgtccttatcaggcaacgccacatcagggttggtaggcaggtggtgaatattccatctttcatggtgagaatggattctcaaaagcatattgatttctcacttacaagtccacttggtggggggcgccctggtcgtgttaaacggaagaacatgaaggcagcatcaaagaaggctgctggtggagatggggaagatgaggatgaggaatgattaatgtagtgatacttttgaccaaaaaaaactccgtagatttttttttcatgacattaagtctggtagattgaaaagatgtctgttcatcagagcatttttgttgctgtgagatggtgaaataagtggactttaattttaaatctgacacacctattattagaacaccgagcttcttttgttgctgcaaagatggcagtgaaatttggcataggttaggtggacatcaattttgaaatctgttaatacacatttgttaaacaatcagctattttgactattaataacttcaag

SEQ ID NO: 2870 - DNA, 898 bp, Glycine max
aaaaagatccagttgtcggaggcgcagagtagagcagcagagaagagagaaaacggcactgcagccgtagaaggaaaaccgaccatggtgcacgtctccttttacaggaactatggtaagacgtttaagaagccccgccgtccgtacgagaaggagcgtctagacgcggagctgaagctggtgggggagtacgggctgcggtgcaagagggagctgtggagggtgcagtacgcgctcagccgcatccgcaacaacgcgcggaatctccttaccctcgacgagaagaacccgcgccggatcttcgagggcgaggctcttctccgcagaatgttccgctacggactcctcgacgagactcagaacaagctcgattacgtcctcgccctcaccgtcgagaatttcctcgagcgccgccttcagacgctcgtcttcaaatccgggatggccaagtccattcaccacgccagggttctcatcaagcagagacatatcagggttgggaggcaagtggtgaacatcccatctttcttggtgagggttgactcacagaagcacattgacttctcacttacaagtccccttggtggcggacgccctggaagagtgaagagaagaaaccaaagggctgctgctaagaaggccgcaggtggagacggagacgaggaagacgaggattagactgttcattatgtctttctctagtgctattagatcttatgccaccttttactttgcctacctaatcgattttggttgttatacattttcatcctttggttcccttgtttgagaaaatattaagtggtgacatattatgtttttgtgaatttggatattttaaagtatcaagattttccattaaataatttttgatgatcattgattggtttcctctgtc

SEQ ID NO: 2871 - DNA, 902 bp, Glycine max
agggttttgcacatttaaaaagggcaaaactaagcaaagcagaaagatcccgtcgtcgcaggcgcagagtagagcagcacagaagagggaaaacggcaccgccgccgtagaagaaaacaaccatggtgcacgtctccttttacaggaactatgggaagacattcaagaagccgcgtcgtccgtacgagaaggagcgtctcgacgcggagttgaagctggttggtgagtacgggcttcggtgcaagagagagctgtggagggtgcagtacgcgctcagccgcatccgcaacaacgcgcggaacctcctcaccctcgacgagaagaacccgcgccggatcttcgagggagaggcgctgctccgaaggatgttccgttacggtctcctcgatgagacacagaacaagcttgattacgtcctcgccctcaccgtcgagaactttctcgagcgccgcctccagacccttgttttcaagtccggcatggccaagtccatccaccatgctagggttcttatcaagcagagacatatcagggttggtaggcaagtggtgaacatcccatctttcttggtaagggttgactcacagaagcacattgacttttcacttacaagtccccttggtggtggtcgccctggaagagtgaagagaagaaaccaaagggctgctgctaagaaggccgcaggtggagatggagatgaggaagacgaggattaaacttttaatcatgtctttttctagtgctattagaccttatgccaccttttactttgcgtacctagtttattgtttttttattgttatacattttcatccttccgttccttgtttgagataatattgagtgacattatgtttttgtgaacttagatattttaaagtatttaagattttcattaaata

SEQ ID NO: 2872 - DNA, 797 bp, Camellia sinensis
ttttgattcctcggagggagagaagagcaatggtgcacgtcaacttctaccgaaactatggaaagacatttaagaagcctcgtcgtccctatgagaaggagcgtttggatgcagagctgaagcttgtgggagagtatgggcttcgatgcaagagggagctgtggagggttcagtatgctctgagccgcattcgtaatgccgcgaggatgcttcttacacttgatgagaagaacccccgccgaatttttgagggtgaggctcttctccgaaggatgaaccgttatgggcttttggatgaaagtcagaataagcttgattatgtcttggccttgactgtcgagaactcccttgagcgtcgcctccaaacactagtgttcaagacgggtatggcaaagtccatccaccatgccagagtgctcatcagacagaggcatatcagggttggaaggcaggtggtgaacatcgcatctttcatggtgagagttgactctcagaagcacattgatttctcactgacaagtcctctgggaggagggcgccctggtagggtaaagagaaggaaccagaaggctgctgccaagaaggcttcaggtggagatggagatgaagaggatgaagaatgagcgctggtatcaacctttgcttttagtaaataataggttgtgtttaaacttgtatcagacaccaacctatttgagaatagtttaatttatatcactgcattattgttccagtttctggaccctcaaactctggttttggccaagttttgcttacattttgtgtatgcaatgact

SEQ ID NO: 2873 - DNA, 907 bp, Nicotiana tabacum
tcccgttcccttcagcagatcgccgacgacagcggcggtgacagggaaacatggtccacgtcgccttttatcgtaactatgggaagacctttaagaagcctcgtcgtccctatgaaaaggagcgattggatgcagagttgaagctcgtaggagaatatggattgaggtgcaagagggagctttggagagttcagtatgctttgagccgtatcaggaatgctgcaagaatgcttctgacattagacgagaaggacccacgtcgtatttttgaaggcgaagcactcatgaggaggatgaacagatatgggttattggatgagagccagaacaagctcgattatgtcttgtctctcactgtggagaactttcttgagcgtcgtctccaaaccctcgtcttcaagactggcatggctaagtctatccatcatgcaagagtgctaattaggcaaaggcatatcagggttggaaggcaggtggtgaatgttccgtcctttatggtgagactggactcccagaagcacattgacttctctctcactagtcctttcggtggtgggcgtcctggaagagtaaagagaaagaaccaaaaatctgctgcaaagaaggcttctggtggagatggagatgaggatgatgaagaatgatctcttattttcatatgtggagcttaattccaatgtagtactgtcttgtatctgcaatttttgagttaattttgctctctaggcttttggactacatttacgttgaagctgttatcctggtaattaagagagaactatgtctaggtatgaatttgatctaaattccaaagctcgacctatttttactacttaattggctgcctgcttgttttactcgttcatatacagtcaaatctctaatatctgtataacagtcttgtttg

SEQ ID NO: 2874 - DNA, 868 bp, Tripterygium wilfordii
cgtttcttccctgcatcagtgctctcgctacttgaggagaagcggacagagccatggtgcacgttaatttctacagaaactatgggaagacttttaagaagccacgtcgtccttatgagaaggaacgtctggatgcagagctgaagcttgttggagagtatgggcttcgttgtaagagggagttgtggagggtgcagtatgcactgagccgtatccgtaatgctgcaagaatgcttcttaccctggatgagaaaaatacacgccgtatctttgagggtgaagctcttcttcgcaggatgaacagatttgggctcctggatgaaagtcaaaacaagcttgattatgtcttggcccttactgttgagaacttccttgagcgccgccttcaaacacttgtgttcaagtctggcatggcaaagtcaattcaccatgcccgtgtgctcattaggcaacggcatatcagggtggggagacaggttgtcaacataccatctttcatggtcagggttgattcccagaagcacattgacttctctttgacaagtccatttggaggtggccgcgcaggtagagtgaagcgaaagaacatgaaggctgctgccaagaaagctgcgggaggagacggtgatgaagaggatgaggaataaacatgaaggctactgccaatcaaacattaggctagtaacaacaggcctagcaaaacatggttttattttaggcttgctatcactagaacaagtttttttgtttggttttgtggtgactgccattttaattttgtagtggatattatcacatatcatgtctgttttttatggatttggattaaaactctgctgtttgggccaagtatgctacctattgttga

SEQ ID NO: 2875 - DNA, 803 bp, Bupleurum chinense
gaagctcctcagccttcttcagatcccgacggcagcccggaagcagtagacatggttcacgtcaacttttaccgcaactatggtaagacatttaagaagcctcgtcgtccatatgagaaggagcgattggatgctgaacttaagcttgttggagaatatgggctccgatgcaagagggagctttggagggttcagtatgctctgagccgcattcgtaatgctgcaaggaatctcctaacccttgaggagaaagatccacgccgtatctttgagggcgaggctctcctccgcaggatgaatagatacgggttattggatgagagccagaacaagcttgattatgtcttggctttgactgtggaaaacttccttgagcgtcgtcttcagacccttgtgtttaagactggcatggcaaagtcaattcatcatgcccgtgttcttattaggcagaggcatatcagggttggaaggcaagtggttaatgtaccctcattcatggtgagggtcgactcacagaagcacattgacttctctcttaccagtccattttggaggcggccgtcccggccgagtgaagcgaaggaacatgaaggcagcttcaaagaagcaatccggtggtgatggtgacgaggatgatgaggaatgagtagttaatattggcatgaagtgtgtgatgttttctgttcaatttagatagtaaatcttttgcattctgttatcggatgttccatctttagattatcagtttaacttgcctcacaacaaaaacaaaccatgccgcccgttacggcccgggaggaatg

SEQ ID NO: 2876 - DNA, 840 bp, Epimedium sagittatum
ccgggggcaccgaggtttagggttttggtgacggagaagaggcagtcaccatggtgcacgtcagcttctaccgaaactatgggaagacgttcaagaagccgcgaagaccatacgagaaggagcgtttggacgctgagttgaagctagtaggagaatacggtctcagatgtaagagagagctgtggagagtccaatacgctttgagccgaatccgaaacaacgctcgtatgcttctcactctggatgagaagaattctcgtcggatatttgaaggtgaagcacttctccgaagaatgaataggtatgggcttttggatgagggtcagaacaagctcgattatgtcttggctttaactgttgagaacttccttgagcgtcgtctccaaactttggttttcaagtctggtatggccaagtccattcatcatgcccgtgttctcatcaggcagaggcatatcagggtggggaggacaggtcgtgaatatcccatccttcatggttagagtcgactcccaaaagcatatcgatttctcattgaccagtcctcttggtggtgggcgccctggtagagtgaagcgtaggaaccagaaagcagctgcaaagaaggctgctggtggagatggagatgaagaggaggaagattgagtgttgaaatccttttctggtagtatgagggatacgagtgttgtaatccgttcctggtagagtgtttaattaattgactgcagtttcccttatttaaatcatatgtagtgttaatggatggttttgatgtgttaaatgttataatctttttggaccttttcaattaagaatttttgcaatatcgttttgacatac

SEQ ID NO: 2877 - DNA, 782 bp, Guizotia abyssinica
gtatcaattcgtctcacctcacggctgttgcaggttcattcacacagctaaaccctagctgtcaggatcagctgaggaagaacaagcattgactgtttgttatcgttcgacaatgattcatgtgccattttaccgaaactatgggaagacttttaagaagcctcgccgtccgtatgaaaaggagcgtttggatgcagagttgaagcttgttggagaatacggtcttcgatgcaagagggagctatggagggtgcagtatgcgcttagccgaattagaaatgctgcaagaatgcttttgactcttgacgagaaggacccacgcaggatttttgaaggtgaagcccttatgagaagaatgaaccgttacgggcttttggatgagagtcaaaataagcttgattatgtgctggcgcttactgttgagaactttctagaacgtcggttgcagacacttgtgtttaaaactggtatggctaagtctatccaccatgctagagtcctcatcaagcagaggcacatcagggtgggaaggcaagtggtgaatgtggcatcattcatggtgagggtcgactcgcagaaacacattgacttttctctcactagtccctttggtggtggccgacctggcagagtgaagcgaaagaaccagaaagctgctgcaaagaagcggcaggtggtgatgctgacgaagacgacgaagaaaagctgtcacggacatcagggtatcagcagtttcatcttctcatcttatcagacgtggttatttaatcttttcagaacta

SEQ ID NO: 2878 - DNA, 851 bp, Lippia dulcis
cctagacttcaattgaaatttcgatcagcagatcggagtgagggtgtcggcagccggaaacgatggtgcacgtttccttttaccgcaactatggaaaaacttttaagaagccccgtcgtccctatgaaaaggagcggttggatgctgagttgaaacttgttggagaatatggtcttaggtgtaagagagagctgtggagggttcagtatgctttgagccgtatcaggaacaatgctagaaacctattgactcttgatgaaaaggaccctcgtcgtatatttgagggtgaagctcttctgaggaggatgaacagatatggcctcctcgatgagagccagaacaagcttgattatgttttgtccctcaccgtagagaactttcttgagcgccgcctgacaaactcttgtcttcaaggcgggtatggccaagtccatccaccacgccagagttctaatcaggcagaggcatataagagttggaaggcaagttgttaatgtggcttcattccttgtgagggtcgattcccagaagcacattgatttctctctcacaagtccttttggcggtggcagacctggaagagtgaagcgaaggaaccagaaggctgctgcaaagaaggcctctggcggtgatggagatgaggatgatgaggagtgagatttattatcttatttatattgcaaactccatctgtgttatttttgcatgagatattttcagatttacggttgctcaagttttgacatatttctatcttgttatagaagacatgttttctaaaccgctgttggggatctaatgccatttgaaatgctcctgtttgtttgaaaaaagaaaaagtaccgactgcg

SEQ ID NO: 2879 - DNA, 800 bp, Vaccinium corymbosum
cctcttcttccctggcaattgacggcaagccggcggagccatggttcacgtcaatttctatcgcaactatgggaagacttttaagaagcctcgccgtccttatgagaaggagcgttttggacgctgagctgaagcttgtgggagagtatggacttcgatgtaagagggagttgtggagggttcagtatgctctgagccgcattcgtaatgcagcgagaatgcttctcacccttgatgagaaaaatcctcgccggatctttgagggtgaggcacttctacgcaggatgtataggtatggacttttggatgagaaccagaacaagcttgattatgtcttggctttgactgtggagaacttccttgaacggcgtcttcaaacgcttgttttcaagaccggtatggctaagtccattcaccatgctcgtgtgctcattaggcagaggcatatcagggtgggaaggcaggtggtcaacatagcgtcattcatggtgcggctggactctcaaaaacacattgatttctctctcacaagtccccttggaggtggacgccccggaagagtcaagcgaaagaaccaaaaggcggccgctaagaaggctgctgggggagatggcgatgaggaggatgaggagtgaatagcacgatcaaattgagatatcaaacggtcttgttttgtcttttggattctctatttcagttgaaattctcttacctgaccgccattctcgaatcttcaatcaattaggagtttcccttgttttggttcaaaatttgatggttaattgattactctttgcttc

SEQ ID NO: 2880 - DNA, 1122 bp, Hordeum vulgare
cgagcacgggacagataggccatgagatggcccccccccctagcccctggagctgccagatttcggcacgagcgacgacccgagcgatcctgcggcggaggcggcagccatggtgcacgtcaacttctaccgcaactatggtaagaccttcaagaagccaaggcgtccgtatgagaaggagcgtcttgacgctgagctgaagctggttggggagtacggtctgcgggccaagcgtgagctctggcgcgtgcagtatgctctgagccgcatccggaatgctgccagggagctgctcaccctggatgagaagagcccccgccgcatctttgagggtgcagcgctgctccgccgcatgaaccgctatggtcttctcagtgaggaccaaaacaagcttgattacgtgcttgccctcactgttgagaacttcctccagcgccgtctccagaccatcgtgttcaagaatggcatggccaagtcaatccaccatgctcgtgtccttatccggcagcgccacatcagggttggaaagcagctcgtcaacattccttctttcatggtgagggttgacacagagaagcacgtcgacttctcactcaccagccccctgggtggtggccctgctggaagagtgaagcggaagaaccagaagaaggcctcaggaggtggtggtgacgagggcgaggaggaggaagactaaatgcttggcctcgcccctcgtaacttttgctgcagaaatgattcgaactttggctcgagcttagaaactaagtggtgcagagctttcgtttcttttactcagaatcttgcttttgctgtcagttctagaactaaacttgtgggtgtcggttttgctttgttagtaactaccggctgaactcagtgccgctgcttcatttttggtgacctaaacgtatctttctgcacgtggtgtcactgttgtttttgctatgtttatccttttgcctacaataccaaattctattagttttgctgtttggttatgcactagtgatatgaattagtgccaaattctagtgtctagcgttttcgaattttattataggggccacaagtttttatatagaagaaaatatcgttgtctacaaaaaaaaaaaaaaaaaa

SEQ ID NO: 2881 - DNA, 1189 bp, Hordeum vulgare
cctggccgcctctctccaccgatcccttcacccccaccggcggcgcgcagctcgacgacccgagcgatcctgcggcggaggcggcagccatggtgcacgtcaacttctaccgcaactatggtaagaccttcaagaagccaaggcgtccgtatgagaaggagcgtcttgacgctgagctgaagctggttggggagtacggtctgcgggccaagcgtgagctctggcgcgtgcagtatgctctgagccgcatccggaatgctgccagggagctgctcaccctggatgagaagagcccccgccgcatctttgagggtgcagcgctgctccgccgcatgaaccgctatggtcttctcagtgaggaccaaaacaagcttgattacgtgcttgccctcactgttgagaacttcctccagcgccgtctccagaccatcgtgttcaagaatggcatggccaagtcaatccaccatgctcgtgtccttatccggcagcgccacatcagggttggaaagcagctcgtcaacattccttctttcatggtgagggttgacacagagaagcacgtcgacttctcactcaccagccccctgggtggtggccctgctggaagagtgaagcggaagaaccagaagaaggcctcaggaggtggtggtgacgagggcgaggaggaggaagactaaatgcttggcctcgcccctcgtaacttttgctgcagaaatgattcgaactttggctcgagcttagaaactaagtggtgcagagctttcgtttcttttactcagaatcttgcttttgctgtcagttctagaactaaacttgtgggtgtcggttttgctttgttagtaactaccggctgaactcagtgccgctgcttcatttttggtgacctaaacgtatctttctgcacgtggtgtcactgttgtttttgctatgtttatccttttgcctacaataccaaattctattagttttgctgtttggttatgcactagtgatatgaattagtgccaaattctagtgtctagcgttttcgaattttattataggggccacaagtttttatatagaagaaaatatcgttgtctacaataccaagtgcagtactaaaccatggcatgccccttgtttcgtgaaaaagaattgtattgtggccgtttcatgttttacgttggtctatgaacttctttcaagc

SEQ ID NO: 2882 - DNA, 620 bp, Cirsium arvense
aagcagctgagggatagagttgcaagcgattactgcatcgacttcagacagcgatggtgcatgttccgttttaccgcaactatgggaagactttcaagaagccccgtcgtccttatgagaaggagcgactggatgctgagttgaaacttgttggagaatacggtcttcgatgcaaaagggagctttggagggtgcagtatgctctcagccgcattcgtaatgctgcaagaatgcttcttactcttgaagagaaggacccacgtaggatattcgagggtgaagcacttatgaggaggatgaacaggtacggactgttggatgagagtcagaacaagcttgattacgtgctggctttgactgttgagaactttcttgaacgccgcctccaaacactggtgttcaaaactggtatggccaaatctatccaccatgccagagtgctcatcaagcagaggcacatcagggtcgggaggcaagtagtaaatgttccatcattcatggtgagagtagactcacagaagcacattgatttctctcttacaagtccgtttggaggtggtcgacctggcagagtgaagcgaaagaaccagaaagcggctgcaaagaaggcatccggtggg

SEQ ID NO: 2883 - DNA, 866 bp, Leymus cinereus x Leymus triticoides
  misc_feature (5)..(7): n is a, c, g, or t
  misc_feature (9)..(9): n is a, c, g, or t
  misc_feature (740)..(740): n is a, c, g, or t
  misc_feature (770)..(770): n is a, c, g, or t
  misc_feature (780)..(780): n is a, c, g, or t
  misc_feature (790)..(790): n is a, c, g, or t
  misc_feature (799)..(799): n is a, c, g, or t
  misc_feature (804)..(804): n is a, c, g, or t
  misc_feature (808)..(808): n is a, c, g, or t
  misc_feature (811)..(811): n is a, c, g, or t
  misc_feature (816)..(816): n is a, c, g, or t
  misc_feature (833)..(833): n is a, c, g, or t
  misc_feature (843)..(843): n is a, c, g, or t
  misc_feature (845)..(845): n is a, c, g, or t
  misc_feature (852)..(852): n is a, c, g, or t
  misc_feature (856)..(856): n is a, c, g, or t
  misc_feature (858)..(858): n is a, c, g, or t
cccannncntcgccgccagcgcccagctcgacgacccgcgcgatcctgcggcggcggcagccatggtgcacgtcaacttctaccgcaactatgggaagactttcaagaagccaaggcgtccatatgagaaggagcgtcttgacgctgagctgaagctggttggggagtacggtctacgggccaagcgtgagctctggcgtgtgcagtacgccctgagccgtatccgaaatgctgcaagggagctgctcaccctggatgagaagaacccccgccgtatctttgagggtgcagcgctcctccgccgcatgaaccgctacggccttctcagtgaggaacagaacaagcttgattacgtgcttgccctcactgttgacaacttcctccagcgccgtctccagactatcgtcttcaagaatggcatggccaagtcaatccatcatgctcgtgttcttatcaggcagcgccacatcagggttggaaagcagctcgtcaacattccttctttcatggtgagggttgacaccgagaagcatgttgacttctcactcaccagccccctgggtggtggccctgctggaagagtgaagcggaagaaccagaagaaggcctcaggtgggggtggtgacgacggcgaggaggaggaagactaagaccttatagccttgccccgcataacttccgttgcagaaatgttgagatcgccttgtggaacttgcaacaggaaatttttggaactttgnttcgagcttagaaacttagtggtgcagagntttcgttgcntttacagtcntgctttggntgtcngttntanaactnaacttgtcggttttgcntggttagtancnaccgggngaanangtgaactc

SEQ ID NO: 2884 - DNA, 843 bp, Trifolium pratense
ccgccgcataccaccaacaccatggttcacgtctcgttttaccgcaactatggtaaaacatttaagaaacctcgtcgtccctacgaaaaggaacgattagatgctgaactgaaactcgtcggagagtacggactcaggtgtaagcgcgaattatggagagtacagtatgccctcagtcgaattcgaaacaatgctagaaatcttcttactcttgatgagaaaaatccaagaaggatttttgaaggtgaagcattgcttagaagaatgtttcgttatggattacttgatgaaactcagaataagcttgattatgttcttgctcttactgttgagaattttctagaacgtcgtcttcaaactcttgtttttaaatctggtatggctaagtctattcatcatgctagggttctcatcagacagaagcatattagggtcggaaggcaagttgtgaacatcccctctttcttggtgagggttgactctcagaagcatattgacttttcacttacaagtccatttggtggtggacgtcctggaagagtgaagcgaaagaacctcaacgctgctgccaagaaggcttccggtggtgcaggtgatgaggaggatgaggattaaactgttgttgtcatagttgcgcattctccgtgcattctctaatgatgttagaacttgtgttagcatctatgattttgtccctagtttattgttattgactgctatacttttttgtttttgttttttcatccttgattctgatttgagaatgtactttggctgagatatgttgttttttggaactaaattattatgatgaactttttgcctaagtaattctgattgtca

SEQ ID NO: 2885 - DNA, 874 bp, Aquilegia formosa
tagccgtcagttctcattttgcttcaaagctttcagcatctaatctctttcactctctcgtcaccgagaagttgaatccatcatggtgcacgttagcttctacagaaactatgggaaaacattcaagaaaccacgtcgtccatatgagaaggaacgattggatgctgagttgaaactggttggtgaatatggacttcgatgtaagagagaactatggagagttcaatatgctttaagtcgaattcgaaacaatgctagaaatcttctcactctggatgagaaaaaccctcgtcgtatctttgaaggtgaagctttattgagaagaatgaatagatatggacttcttgatgaaagtcagaacaagcttgattatgtcttggctttaactgttgagaactttctggaaagacgtcttcagactcttgtgtttaagtctggtatggcgaagtctattcatcatgctcgtgtgctcattaggcaaaggcacatcagggtcgggaggcaggttgtcaacattccatcttttatggttagggttgactcacagaaacacatcgacttctctctcactagcccacttggaggtggacgacctggtagagttaagcgaaggaacatgaaggcagctgccaagaaggcctctggaggagatggagatgaggaggaagaggattgagtctttaaatcttcgtgagtgctgcagatagggaggaatatgaattgtgttttgtcatttctgtagtcttaaaattttcacttgctgctcaactctctagagtttatttccttgggacctggtagattttaaactagaatgatttgcgttatgtcataaataccctctggatcttatattaaggagttttgattactt

SEQ ID NO: 2886 - DNA, 810 bp, Aquilegia formosa
ggcggagtagcaggtgaggtagtaatcatggtgcacgtcagcttctatcggaactatggaaagacattcaagaaaccacgtcgtccatatgagaaagaacgattagatgctgagttgaaacttgttggtgaatatggtttacgatgtaagagagaattatggagagttcaatatgctttaagtcgaattcgtaacaatgcaagaaatcttcttacacttgatgagaagaatcctcgtcggatctttgaaggtgaagctttattaagaagaatgaatagatatggattgcttgatgagagtcagaacaaacttgattatgtcttagctttgactgttgagaactttcttgaacgtcgtcttcagactcttgtgtttaagtctggtatggctaagtctattcatcatgctcgtgtgctcattcgacaaaggcacatcagggttgggaggcaggtggtcaacattccatctttcatggtgagggttgactcccagaagcatattgacttctctcttaccagcccacttggtggtggacgcccaggtagagtaaagagaaggaacatgaaggcagctgctaagaaggcctctggaggagatggagacgaggaagaagaggattaagtcattgcatcaaattaaagtgccagaaataggtagcatgggttgagtttttccatctttggaaatttttatcttgcaactgctgtttaactttttaatgtttgttactgggacctgagttatctatatgtagacctaaatattttgcaggcttgatttgtcatatatacctccttgacggttttggtt

SEQ ID NO: 2887 - DNA, 786 bp, Aquilegia formosa
gaaggagtagcagcaggtagtctgtcatggtgcacgtcagcttctaccgaaattatgggaaaacattcaagaaaccacgtcgtccttatgagaaagaacgattggatgctgagttgaaattagttggtgaatatggtttaagatgtaagagagagttatggagagttcaatatgctttgagtcgaattcgtaacaatgctagaaatcttcttactcttgatgagaaaaatcctcgtcggatctttgaaggtgaagctttattgagaagaatgaataggtatggattgcttgatgagagtcagaacaaacttgattatgtcttggctttaactgttgagaactttctcgaacgtcgtcttcagactcttgttttcaagtctggtatggccaagtctattcatcatgctcgtgtgctcattagacaaaggcacatcagggttgggaggcaggtcgtcaacattccatctttcatggttagggttgactcacagaaacacattgacttctctcttactagcccacttggtggaggacgccctggtagagtaaagcgaaggaacatgaaggcagctgccaagaaggcctctggaggagatggagatgaggaggaagaggattgagccatcaaatcgtcgtgagtgctgcagatagggacgcctatgaattgtgtcttgtcattttgtagtattattgctgctcaacgctagtgtttttttttctctttgggacatcgtagattggtttgcattatgtcatacataccctctggaaattttgtttcttttt

SEQ ID NO: 2888 - DNA, 701 bp, Ambrosia trifida
tttcatttctcacggcctctgtatttgcagctaaggaagaaggttagaaaagcagcaggttatcgctgcgttgaattcggacaaccatggtgcatgtgccattttatcgaaactatggaaagactttcaagaagccccgccgtccatacgagaaggaacgtttggatgcagagctaaaacttgtgggagaatacggtcttcgatgcaaaagggagctctggagggtgcaatatgctcttagccgaattagaaatgctgcaagaatgcttctgacccttgaagaaaaggacccacgtaggatatttgagggtgaagctcttatgaggagaatgaaccgttatggacttttggatgagagtcaaaacaagcttgattacgtgttggcccttactgttgagaactttctagagcgtcgtttgcagacactcgtgttcaagactggtatggctaagtctattcatcatgctagagtgctcatcaagcagaggcacatcagggttggaaggcaagtagtgaatgttgcatcattcatggtgagagtagactcacagaagcacatcgacttctctcttacaagtccatttggcggtggccgacctggcagagttaagcgaaggaaccagaaagcagcggcaaagaaggcagcaggcggtgatgctgatgaggacgatgaagaatgagctgtcactcgatctttgtta

SEQ ID NO: 2889 - DNA, 830 bp, Aquilegia formosa
gtctttcactctctcgtcaccgagaagttgaatccatcatggtgcacgttagcttctacagaaactatgggaaaacattcaagaaaccacgtcgtccatatgagaaggaacgattggatgctgagttgaaactggttggtgaatatggacttcgatgtaagagagaactatggagagttcaatatgctttaagtcgaattcgaaacaatgctagaaatcttctcactctggatgagaaaaaccctcgtcgtatctttgaaggtgaagctttattgagaagaatgaatagatatggactacttgatgaaagtcagaacaagcttgattatgtcttggctttaactgttgagaactttctggaaagacgtcttcagactcttgtgtttaagtctggtatggcgaagtctattcatcatgctcgtgtgctcattaggcaaaggcacatcagggtcgggaggcaggttgtcaacattccatcttttatggttagggtcgactcacagaaacacattgacttctctctcactagcccacttggaggtggacgacctggtagagttaagcgaaggaacatgaaggcagctgccaagaaggcctctggaggagatggagatgaggaggaagaggactgagtctttaaatcttcgtgagtgctgcagatagggaggaatatgaattgtgttttgtcatttctgtagtcttaaaattttcacttgctgctcaactctctagagtttatttccttgggacctggtagattttaaactagagtgatttgcgttatgtcataaatacccactggatcttatattaaggagttttgattactt

SEQ ID NO: 2890 - DNA, 776 bp, Aquilegia formosa
ggcggagtagcaggtgaggtagtaatcatggtgcacgtcagcttctatcggaactatggaaagacattcaagaaaccacgtcgtccatacgagaaagaacgattagatgctgagttgaaacttgttggtgaatatggtttacgatgtaagagagaattatggagagttcaatatgctttaagtcgaattcgtaacaatgcaagaaatcttcttacacttgatgagaagaatcctcgtcggatctttgaaggtgaagctttattaagaagaatgaatagatatggattgcttgatgagagtcagaacaaacttgattatgtcttagctttgactgttgagaactttcttgaacgtcgtcttcagactcttgtgtttaagtctggtatggctaagtctattcatcatgctcgtgtgctcattcgacaaaggcacatcagggttgggaggcaggtggtcaacattccatctttcatggtgagggttgactcccagaagcatattgacttctctcttaccagcccacttggtggtggacgcccaggtagagtaaagagaaggaacatgaaggcagctgctaagaaggcctctggaggagatggagacgaggaagaagaggattaagtcattgcatcaaattaaagtgccagaaataggtagcatgggttgagtttttccatctttggaaatttttatcttgcaactgctgtttaactttttaatgtttgttactgggacctgagttatctatatgtagacctaaatattttgcaggcttg

SEQ ID NO: 2891 - DNA, 781 bp, Aquilegia formosa
gaaggagtagcagcaggtagtctgtcatggtgcacgtcagcttctaccgaaattatggtaaaacattcaagaaaccacgtcgtccttatgagaaagaacgattggatgctgagttgaaattagttggtgaatatggtttaagatgtaagagagagttatggagagttcaatatgctttgagtcgaattcgtaacaatgctagaaatcttcttactcttgatgagaaaaatcctcgtcggatctttgaaggtgaagctttattgagaagaatgaataggtatggattacttgatgagagtcagaacaaacttgattatgtcttggctttaactgttgagaactttctcgaacgtcgtcttcagactcttgttttcaagtctggtatggccaagtctattcatcatgctcgtgtgctcattagacaaaggcacatcagggttgggaggcaggtcgtcaacattccatctttcatggttagggttgactcacagaaacacattgacttctctcttactagcccacttggtggaggacgccctggtagagtaaagcgaaggaacatgaaggcagctgccaagaaggcctctggaggagatggagatgaggaggaagaggattgagccatcaaatcgtcgtgagtgctgcagatagggacgcctatgaattgtgtcttgtcattttgtagtattattgctgctcaactctagtgtttttttttctctttgggacatcgtagattggtttgcattatgtcatacataccctctggaaattttgtttc

SEQ ID NO: 2892 - DNA, 1034 bp, Cedrus atlantica
gggggctctctgtattgttgtttaagacggagccaagcagacagagggagtagctgttgtagccatggtgcacgttagcttctatcgcaactatggcaagacttttaagaaacctcgccgtccttatgagaaggagcggctggatgctgagctgaagttggttggagagtatggtctccgcaataagagagaactttggagggttcagtatacactgagtcgcattcgaaatgctgcaagaatgcttctcactcttgatgagaagaatccacgacgaatttttgagggcgaggccctgttgcgtcgcatgaataggtatggactccttgatgagactcaaaacaagctcgattatgtcctggccttgacagttgagaatttccttgagcgacgacttcagactctggtgtttaaatctgggatggctaagtcaatccaccatgctcgtgtactcatcagacaacgtcacattagggttggtcgtcaggtggtgaatattccatctttcatggtcagagttgactcacagaagcatattgacttttctctaactagtcctcttggaggtgggcgacctggacgagtgaagcgaaagaatatgaaagcagcctcaaagaaggcaggaggtgaagacggagaggaagaggatgatgattgagtataagcaaatatcattggctgattatagatcagttttaactgcaccactgtagagtgtttttatcagctgttgttcgaaacttgtctattagagatgagtgttagggggtgacaatataaattagcacatctttgatatgcactgcacggcaattttgctctgcctttacttctgatcctaaagaggcttaagtggaacattaaagttttgttattgttattgagcaactatatttaattttcctcgaagcagttggatttaatgttggtcataattcttatttgtccatatttatacctagttttcttaatttaaaatttactcagtaggcaaagtaaaattagcctagcaagggaaaccgtgattgttctac

SEQ ID NO: 2893 - DNA, 912 bp, Centaurea maculosa
  misc_feature (3)..(4): n is a, c, g, or t
  misc_feature (10)..(10): n is a, c, g, or t
  misc_feature (65)..(65): n is a, c, g, or t
  misc_feature (123)..(123): n is a, c, g, or t
  misc_feature (129)..(129): n is a, c, g, or t
  misc_feature (135)..(135): n is a, c, g, or t
  misc_feature (144)..(144): n is a, c, g, or t
  misc_feature (147)..(147): n is a, c, g, or t
  misc_feature (153)..(153): n is a, c, g, or t
  misc_feature (156)..(156): n is a, c, g, or t
  misc_feature (177)..(177): n is a, c, g, or t
  misc_feature (243)..(243): n is a, c, g, or t
  misc_feature (258)..(258): n is a, c, g, or t
  misc_feature (318)..(318): n is a, c, g, or t
  misc_feature (321)..(321): n is a, c, g, or t
  misc_feature (331)..(331): n is a, c, g, or t
  misc_feature (351)..(351): n is a, c, g, or t
  misc_feature (396)..(396): n is a, c, g, or t
  misc_feature (444)..(444): n is a, c, g, or t
  misc_feature (483)..(483): n is a, c, g, or t
  misc_feature (498)..(498): n is a, c, g, or t
  misc_feature (525)..(525): n is a, c, g, or t
  misc_feature (582)..(582): n is a, c, g, or t
  misc_feature (608)..(608): n is a, c, g, or t
  misc_feature (612)..(612): n is a, c, g, or t
  misc_feature (634)..(634): n is a, c, g, or t
  misc_feature (668)..(668): n is a, c, g, or t
  misc_feature (700)..(700): n is a, c, g, or t
tcnncttagnaagcagctgagagatagatagagagttgcaagcgatcacggcattgacttcgganagcgatggtgcatgttccgttttaccgcaactatgggaagacattcaagaagccccgncgtccntatganaaggagcgnctngatgcnganttgaagcttgttggagagtanggtcttcgatgcaaaagggagctttggagggtgcaatacgctctcagccgcattcgtaatgctgcnagaatgcttcttacnctcgaagagaaggacccacgtaggatattcgagggtgaagcacttatgaggaggatgaanagntacgggctgntggatgagagccaaaacaancttgattacgtgctcgccttgaccgttgagaactttctagaacgncgcctccaaacactggtgtttaaaaccggtatggccaaatctatccancatgctagagtgctcatcaagcagaggcacatcagggtnggaaggcaagtagtnaatgttccatcattcatggtgagattngactcacagaagcacattgatttctctctcacgagtccgtttggaggtgggcgaccnggcagagtgaagcgaaagaaccaganagcngctgcaaagaaggcatcgggtngagatgctgatgaggatgatgaagaatgaggttngtcagccgtatttattatcttagggaattcgntatttaaacttttgcagatctcatcatctgaaattttggtctttatatcacttatataagaatagaccgagcatttatgcatcgaggtcttgaaatgttacgtaattgggtaagtttgagatataacggatcgttgtggcatctggtttacttgaaaacttaacggatcaactaaactcgcataattagttttttttgagaaatgaaaattt

SEQ ID NO: 2894 - DNA, 815 bp, Chelidonium majus
agagcgcagaggtcgcgagagctaccggagatcgtgaagccatggttcacgtcaatgtctacagaaactatgggaaaacttttaagaaacctcgacgtccttatgagaaggagcgtttggacgctgagctgaagcttgttggagaatatggtctccgatgtaaaagagaattgtggagggttcagtatgctctgagccgaatcagaaatgctgctagaatgcttcttacccttgatgagaagaacccacgtaggatttttgagggtgaagctcttcttcgcagaatgaataggtatgggcttttggatgagagccagaacaagctcgattacgtcttggctttgactgtggagaacttccttgaacgacgacttcagaccctagtgttcaagtctggtatggcaaagtctattcatcatgctcgtgtgctcatcaggcagaggcatatcagagttggaaggcaggtggttaacattccatcttttatggtgaggttggactcacaaaagcacatagatttctcccttaccagtccccttggaggtggtcgcccaggaagagtgaagagaaggaaccagaaggcagctgccaagaaggctgctggtggagatggcgatgaagaggatgaggattaatcattgcggtgttgaaagtttcgccagtagaagtaaggatggtagtaaagttatattagtttttggctggattttgccttacctttgtcaagttgtttacacctttttaccttagttttagaagttgggaattgttatgcttgcattacatcactgtaccttcttttaatgtcgaccttg

SEQ ID NO: 2895 - DNA, 1121 bp, Cicer arietinum
tacaaaaaatcagataataataagagaaacataaccttctaactctaactttcagcaaaaccctagggcggcggcaacaagagcaaccggcggcagcggaagggaagaacatggtgcacgtttccttttaccgaaactatgggaaaacattcaagaagcctcgtcgtccatacgagaaggaacgtttggatgctgagttgaagcttgtgggagagtacggtcttcggtgcaaaagggagctttggagggtacagtacgctcttagccgtatccgtaacaatgcaaggaatcttcttacattggacgagaagaatcctcgtcggatctttgagggtgaagcacttttaaggagaatgtttcgttacggtctcctcgatgaaactcagaacaagctcgattatgttttggctcttactgttgaaaactttcttgagcgccgccttcagactcttgtcttcaaatctggaatggctaagtctattcatcatgctagggttcttattaggcaaaggcacattagggttggaaggcaggtggtcaacatcccatcgttcatggtgagagttgattcacagaagcacattgacttctcactcacaagtcctcttggtggtggtcgtcctggtcgcgtgaagcgaaggaacctcaaggctgctgctaagaaggctgctggtggtgatggagatgaggaggatgaagattagattatgaatttcttttgtttagatccttctaccaacctttttatctgtcgtagatttttttgtctatcatatgcatgactcgtgtaatttttctatccttgtttctcgtgtgaggaattatatcctgagatatgttgtttttaaactttccttttcccaaatatgaagttttgccgcaatacctgtgatcatctctgggtttaggcttaatgttatttcacataatatttcatagcactctaaatgcattgagtatccaagtttttgatccaactatacttcgtagagcaggtcctgctagttgtttttatgataacacatgcttgtgaactgaattggaaactttttattcttcatacaagttagctggatgataaatagttggtaatttgtagcctaactccccacatttaacgc

SEQ ID NO: 2896 - DNA, 910 bp, Cicer arietinum
ccctaggtcggcatcaatcagagaagcccccggcgacaggaagaatcatggtgcacgtttccttttaccgaaactatgggaaaacattcaagaagcctcgtcgtccatacgagaaggaacgtttggatgctgagttgaagcttgtgggagagtacggtcttcggtgcaaaagggagctttggagggtacagtacgctcttagccgtatccgtaacaatgcaaggaatcttcttacattggatgagaagaatcctcgtcggatctttgagggtgaagcacttttaaggagaatgtttcgttacggtctcctcgatgaaactcagaacaagctcgattatgttttggctctcactgttgaaaactttcttgagcgccgccttcagactcttgtcttcaaatctggaatggccaagtctattcatcatgctagggttcttattaggcaaaggcacatcagggttggaaggcaggtggtcaacatcccatcattcatggtcagagttgattcacagaagcacattgacttctcactcacaagtcctcttggtggtggtcgtcctggtcgtgtgaagcgaaggaacctcaaggctgccgctaagaaggccgctggtggtgatggagatgaggaggatgaagattagattatgaatttcttttgtttaaatccttgcaccagcctttttatccttagtatattttttttgtctatcatgcatgactcttgtaatttttcgatccttgtttcttgtgtgaggaaatctttgcttgagagatgttgttttttaactttccttttctcgaatatgaagttttgctccatttcctgtgataatctctgggattaggcttaatggtatttctcataatgtttcatagcagtttgaatgaatcgatatattgttttttgatc

SEQ ID NO: 2897 - DNA, 885 bp, Cycas rumphii
  misc_feature (774)..(774): n is a, c, g, or t
ggggtcgacggcgctgcccaggaggaagaaatcaggcaagcaggggaaggcggcagggcgaacgtgtgagccatggtgcacgttagtttctaccgcaactatggtaagacgttcaagaaacctcggcgtccttacgagaaggaacgtctggacgccgagctgaaattggtcggggaatatggtctccgtaacaagagagagctctggagggtccagtattcgttgagtcgcattcgtaatgccgcgagaatgcttcttactctcgatgagaagaaccctcggcgaatttttgagggcgaggcactgctgcgtcgcatgaaccgttatggtcttctcgacgaaagccagaacaagctcgattatgtcctggcattgaccgtggagaatttccttgagcgccggctgcagaccctagtgttcaagtctggtatggcaaagtcaatccatcatgctcgagtgctcatcagacagcgacacatcagggttggcaggcaggtggttaatattccatcctttttggtcagagttgactctcagaagcacattgacttctcattgacaagcccacttggtggtggacgacctggccgtgtgaagcgcaagaacttgaaggcagcttcaaagaaggcatcgggtggagatggagaggaagaggatgaagactgatcttttgccatataactggcttagagcagtacatgagagctgcactattgtgtagggcttagctctaaagttgttaattagagaactatttgtgagattacgtgactncattttaacagatatgctttcaaattttgttcaagtccttcactcttgttccctaagagctgaagtgaagtgatattgtttattaatattgaatgttcctaatgcgttttt

SEQ ID NO: 2898 - DNA, 752 bp, Panax ginseng
ttacggccggggacagcgaattgatcatttatcccccttcattgtttgcctcccacagatcgcggcggctctgacaaccgcatagacggcgaagaaagatggtgcacgtcaatttttatcgcaattatgggaagacttttaagaagcctcgtcgtccttatgagaaggaacgattggatgctgagctgaagctggttggggaatatgggctacgatgcaaaagggagctgtggagggttcagtatgcccttagccgtattcgtaatgctgctagaaatcttctcacccttgatgagaaggacccacgtcgaatttttgagggtgaagctcttctgaggaggatgaacaggtatgggctgttggacgagagccagaataagcttgattacgtgctagccctcactgtggagaactttcttgagcgccgccttcaaacacttgtttttaagactggtatggccaagtcaatccaccatgccagagtcctgattaggcaaaggcatatcagggttggaaggcaggtggtcaacgtggcctcattcatggtaagggtggactcacagaaacatatcgacttctcgcttacaagtccttttggtggtggccgtcctggtagagtgaagcgaaggaaccagaaagctgctgcgaagaaagctgctggtggagatgggggatgaagaaaacgaagattgaggccattgtttctaattttagttgttaaagaatcttgtttgaaccatgttcctacgtgt

SEQ ID NO: 2899 - DNA, 799 bp, Gnetum gnemon
cgagaagaagcaccagcagaggaagaggaaaatggtgcacgtaagtttttacaggaactacggcaagacattcaagaagccgcggcgtccgtacgagaaggagcggctagacgctgagctcaaactggtgggcgagtatggtctgcgcaacaagcgcgagctgtggagggtgcaatacactctgagccgcatccgaaatgcagcgaggacgcttctgactctggatgagaagaaccctaagcgcatcttcgaaggtgaggccctcctccgaaggatgaatcgctacggtctcctcgatgagacgcagaacaagctcgattacgtgcttgctctcactgttgagaacttcctcgagcgccgcctccagacgctcgttttcaagtccggtatggccaagtccatccatcatgcccgtgttctcatccgccagaggcacatcagggttggcagacaggtggtgaatatcccttcctttatggttagagttgattcccagaagcacattgacttctccctcaccagtcctctgggtggaggccgtcctggtcgtgttaagagaaagaacatgaaggcagcttctaagaaggctgctggtggagatggagaagaagaggatgacgagtgaactaaagtttgacctgtatctttcatagggttgaaagaatggaggttgattctggagttttgtttggaggacataaatcttgcattcaaatgtttccttgcgtttttgatagacgatgactgagaatttttcaaattacagttttagttttggtatctcttgttaagatcacag

SEQ ID NO: 2900 - DNA, 1256 bp, Vitis vinifera
gttttagggttctcttataagcggctcattcgatcagtacccacgtctagagggagagggagagggagagagacagagagagggagcagccatggtccacgtctccttctatcgcaactatgggaagacttttaagaagccccgccgtccatacgagaaggagcggttggatgctgagctgaagctggtgggagagtatgggctccggtgcaaaagagagctgtggagggttcagtatgttttgagccgaatccgtaataatgctaggatgcttttgacccttgatgagaagaaccctcgtcggatctttgagggtgaagcacttcttcgccgtatgaaccggtatgggcttttggatgagagtcagaataagcttgattatgtcttggcattgaccgtggagaacttccttgagcgccgccttcaaactcttgtgttcaaatccggtatggcaaagtccattcaccacgcccgagtgctcatcaggcagaggcatatcagggtggggaggcaggttgtgaacattccctctttccttgtgaggatggattcacagaagcatattgacttctcacttacaagtccactcggaggtgggcgtcccggaagggtgaagcgaaagaaccagaaggcagctgcaaagaaggctgctggtggcgatggagatgaagaagatgaggattgagctcttggttggggatctttgcgattagtaatttaaaaggcacatgtcttgtcttgtgtttatcacccttttatatttaggctaattttgatgcaagactgctcaatgtttcggtttggtttctagattctgaattttgattttaaggtttcaaaaaaattttgcttgcattttgttgtatgacttggagggcaatttgaaatatttattttgggtatttagaccaggacagattgactcgttatttgcatagagtttttatgccttcgatctgtttagagaagcagtccttgcctctcattgtctgagacacgattgattgtttattttcaaggtcaaatttttaccaaacccggccacctatttaaatgctgggtacagagacagaaatggaaggcttcctgactgcctagttaaccctgcctcagccctcacccccaagtggagatccctcaataccagttagttttccctgcaacatgtttttagtcttttaatccaggcactcccataatctcttaccatttcttgtaaaatttgttctttgtgtttcaagggttcaattcatatg

SEQ ID NO: 2901 - DNA, 1208 bp, Vitis vinifera
tttagggcttgcctatataagcaaacatcgtttctgaccttcgtcttctcccattttgccttcattttgcaggtgtccaagcagaggccgacggaaccatggttcacgtcagtttctaccggaactatgggaagacattcaagaagccccgtcgtccctacgagaaggagcgtctggatgcagagctgaagcttgtaggagagtatggcctccgatgtaagagagagttgtggagggttcagtatgtactgagccgcatccgtaataatgctaggatgcttctcactctcgatgagaaaaatccccgccgcatctttgagggtgaggctcttctaaggaggatgaacaggtatgggcttttggatgagagccagaacaagctggattatgtgttggccctgactgtggagaacttcctcgagcgccgtctccagacacttgtgttcaagtcgggtatggctaagtcaattcaccatgctcgtgtcctcattcggcagaggcatatcagggttgggagacaggtggtcaacataccctcattcttggtgaggatggactctcagaagcatatcgatttctccctcacaagtccccttggaggtggtcgcccaggaagagtgaagcgaaagaaccagaaggccgctgccaagaaggctgcaggcggagacggagatgaggaggatgaggattgaattcattttatgccacatctttttcagttccttgacgtttcagttactagttttcttgtctggatgcttctgttcagtctctcctctattttagtgaatcccggaaccaattttgcatgttttggttaattgcttagagcatgactattgtcaaggatggtttttccccttttttgttatggttgataaaagagtgaaacctgttaaattctaccaatcttttttttgggtggcaggtagtctatacgttcatccatgtctgatctctctttctccctaaaaatcatgcctaacccttaattaggtttgatggcagattttatggtcctacccccgcatgaacctcacatgcttttgcctaaacgcaaaaaactctcctccctcagattttatcgttctccttcaacataagcctcacatgcagcacctaatagaatgtgcagcctgtctagggtttgtttcctgtccctttcacttgttacatatcctttcccaaaaggaaatgcaaaatgccac

SEQ ID NO: 2902 - DNA, 877 bp, Lotus japonicus
atacagctgcaaaacctagaagcaaaccagagaggaggagcagccatggttcacgtctccttctacagaaactatgggaaaaccttcaagaagcctcgtcgcccctacgagaaggagcgtttggatgcagagctgaagctcgtcggagagtacgggctccgctgcaagagggagctctggagggtgcagtacgctctcagccgcatccgcaacaatgctaggaacctgctgacgcttgacgagaagaaccctcgccggatcttcgagggtgaggctcttctcaggaggatgttccgttatgggcttcttgatgagacccagaacaagcttgattatgtgctcgctcttactgttgagaactttctcgagcgccgcctgcaaaccctggttttcaagtctggtatggctaagtctattcatcatgctagggttctcatcaggcagaggcacatcagggttgggaggcaggttgtgaacatcccatcattcatggtgaggatggattcacagaaacacattgacttttcactcacaagtcctcttggtggtggtcgcccaggacgtgtgaagcgaaagaacatgaaggctgctgccaagaaggctgctggtggcgacggtgatgaggaggatgaagattaaattataagttgctagtgcgctgatacagtgttccagctttttatttcagttgctagacttttttagattttttgtcgtgcttgactcttataaattttccatccttgttcctgtttgatgaaaatcttcacccgagagatgttgcttttgaactgttcttttcaaagtatgaagttttgttccaatggctgtgatggtctttggtattaaattaaattgatggttttagccttctttg

SEQ ID NO: 2903 - DNA, 1054 bp, Pinus pinaster
gattttagggttttatggtaagcgatagggtttttcatattggatacaattcatcagcgggaggttttgtttcgtttgtgcgagagtccgggagaggaggaagagcagcggcaagggaggaaagatggtgcacgtcaatttttaccgtaactatgggaagacgttcaagaagccccggcggccctacgagaaggagaggctggatgcagaactgaaattggttggagaatacgggctgcgaaacaagagagaactctggagggttcaatacacgttgagccgcatacgaaatgcagcgcgtatgcttctgacgctggacgagaaaaaccctcgccgtatattcgaaggagaagccctgctgcggcgtatgaacaggtatggtctactggacgagactcaaagcaagctcgattacgtcctcgctctcaccgttgagaacttcctcgagcgccgccttcagactctcgtcttcaaatcaggcatggccaagtccatccatcatgctcgtgttctcatccggcaacgtcacattagggttggtaggcaagttgtgaatattccgtctttcatggtaagagttgattcacaaaagcacattgatttctcacttacaagtcctcttggtgggggacgtcctggtcgtgtgaaacgaaagaacttgaaggcagcgtcaaagaaggctgctggtggagatggtgaggaagaggacgaggaatgaggcgtagcagcattagcagccaagaaaagttatctgcacaatctcttcttctgtgtgaagcttttaaattttgttaaaagaatgttttagctggattttctggttgctacaactggttgtgaaactttgttgataggtttgcataaattataaatttggcaatagtgagcatgcatttaaattttgtcggattactggctggtgcaacatgtttggtttgttaaacattcgtagtaggttagaatacacttcaaaatttgctggagtttgatcactgtctagagctctgtggcagtaaacaacaaatgttgatttatttcattccggttaccgaaa

SEQ ID NO: 2904 - DNA, 777 bp, Tropaeolum majus
cgactgatattgtcgcccacttcgacgggatggtgcacgtcaatttctatcgcaattatggcaagacctttaagaagccacggcgtccttatgagaaggaacgtcttgatgctgagttaaagctcgttggtgagtacggacttagggctaagagagagttgtggagggttcaatatgctttgagtcgtatccgtaatgctgcaagggagcttcttactctggatgagaagaatccacgtcgtattttcgaaggtgaggctcttcttcgaagaatgaacaggtatggacttctggacgagagtcagagcaagctggattatgtccttgccttgaccgtggagaatttccttgaacgccgtctccagacacttgtgttcaagtctggaatggctaagtccattcatcacgcccgtgttctcatcaggcaaaggcacatcagggttgggaggcaggttgttaatataccatctttcatggtgaggatggattcacaaaaacatattgacttctcattgactagtccctttggtggaggccgtcccggaagagtgaagagaaggaacatgagggctgcttccaagaaggcatctggtggtgatggtgatgaagaagatgaagagtaaagggttatagtgtcttgattaggcctcggaactttcactttaagtactttttgtgtccaattctaaacgtttattgtagtggatgttttttatgctttcttgctgtttaactaaatcaaaacaacgtgatttcgttttgatattggaaatttga

SEQ ID NO: 2905 - DNA, 950 bp, Carica papaya
gccgtctcggaatatcctagcagcactaagaaactgccggaatcagaagcatcgacggctaagaaatctcacggaacaccgcgtgcagctccaatctcggcaaacaaggactgagattgtgaggagagtggcttttgcttgctgaaggacaagtatggtgaatgtttcctcttaccgcaactgtggaaagacattcaagaagccacgccgcccttatgagaaggagcggttggatgctgagctgaagctggtgggtgagtatggattgcgatgcaagagagagttgtggaggattcagtatgctctaagccgcatccgaaatgctgcaagggagttgctcaccttggatgagaagaacccacgccggatctttgaaggtgaggctctgctacggaggatgaaccgctatgggcttttggatgagagccagaacaagcttgattatgtcttagcattgaccgtggagaacttccttgagcgtcgcttgcagacccttgttttcaagtcgggtatggcaaagtccattcatcatgccagagtgctcattagacagaagcatatcagggttgggagacaggttgtgaacattccatctttcatggtgagggttgactcacagaagcacattgatttctcactcacaagtccatttggcggtggtcgtcccggaagagtgaagaggaagaacatgagagcagctgctaagaaagctggtggtggtgatggagatgaagaagaggaagaatgaaggccaggggttttgatgtttttgcttatactgagtttctttagttctattaatggcagctcttatcagtcaagttttgttatttgttaactttttttttttggattttaattgcctggttgttgatcttgaaatgttttaatgaagtttttcttgctgcataatgtttacactcatttttttaatattaactccttatact

SEQ ID NO: 2906 - DNA, 816 bp, Pisum sativum
cagaacgtaacacaattcttctactcacaggcgcgagatcaacgaagagcaaccctctgcttggccgaacagcaccatggttcacgtctccttctaccgcaactatgggaaaacattcaagaaacctcgtcgtccatacgagaaggagcgtttaaacgctgagttgaagctcgtcggagagtacggactcaggtgcaaacgtgaactctggagagtgcagtacgctctcagtcgaatcaggaacaatgctagaaaccttctcactcttgatgagaagaatcctcgtaggatttttgaaggtgaagctttgctccgaagaatgtttcgttatgggttacttgatgagacacagaataagcttgattatgttcttgctttaactgttgagaattttctggaacgtcgccttcagacacttgtttttaaatctggtatggcgaaatctattcatcatgctagggttctcatcagacagaggcacatcagggttggaagacaggttgttaacatcccatctttcatggtgagagttgactcacagaagcatattgacttttcactaacaagtccccttggtggtggacgtcccggaagggtgaagcgaaagaacctcaaggctgctgccaagaaggcctctggtggtgatggtgatgaggaggatgaagattaaactactgttgtcttagttgaattctctagttaagttaaattttgtttttgcgttaatgattatgtccctagtttatcattattgactgctatacttttttgttttgttcatgcttggttctgttttgagaatatgtactttgtctg

SEQ ID NO: 2907 - DNA, 1208 bp, Pinus taeda
tcggccattatggccgggggacggacatttttagccatatttcataggttttaagatcgagtttccctatggaaaaggattttagggttttgtggtaagcgatagggtttttcatattggatacaattcatccgcgggaggttttgtttcgtttgtgcgagagtccggtagaggaggaagagcagcagaggaggaaagatggtgcacgtcaatttttaccgtaactatgggaagacgttcaagaagccccggcggccctacgagaaggagaggctggatgcagaactgaaattggttggagaatacgggttgcgaaacaagagagaactctggagggttcaatacacgttgagccgcatacgaaatgcagcgcgtatgcttctgacgctggacgagaaaaaccctcgccgtatattcgaaggagaagccctgctgcggcgtatgaacaggtatggtctactggacgagactcaaagcaagctcgattacgtcctcgctctcaccgttgagaacttcctcgagcgccgccttcagactctcgtcttcaaatcaggcatggccaagtccatccatcatgctcgtgttctcatccggcaacgccacattagggttggtaggcaagttgtgaatattccatctttcatggtaagagttgattcacaaaagcacattgatttctcacttacaagtcctcttggtgggggacgtcctggtcgtgtgaaacgaaagaacttgaaggcagcgtcaaagaaggctgctggtggagatggtgaggaagaggacgaggaatgaggcgtagcagcattagcggccaagaaaagttatctgcacaatctcttcttctgtgtgaagcttttaaattttgttaaaagaatgtttttagctggattttctggttgctacaacaactggttgtgaaactttgttgataggtttgcataaattataaatttggcaatagtgagcatgcatttaaattttgtcggattactggctggtgcaagatgtttggtttgttaaacattcgtagtaggttagaatacacttcaaaatttgctggagtttgatcacagtccaggcagtaaacaacaaatgttgatttatttcattccggttaccgaaaattcaaaattttgcacatttaattatgttgtagtaatgtcatgtgttgcttgtgtattttaaatttggcaatagtcaagcatgca

SEQ ID NO: 2908 - DNA, 1193 bp, Pseudotsuga menziesii
ttttagggtttgtgtatgaagcggtagggtttgtcacattcaatacaatgctttaggggaagaggctttgttggtgcttgatcgtgagtccggcggagcaggaagagcagcggaggagagatggtgcacgtcgttttttaccgcaactatgggaagacgttcaagaagccccgccgcccctacgagaaggagcggctggacgcagagctgaaattggtcggagaatacgggctgcgaaacaagagagagctctggagggttcaatacacattgagccgcatacgaaatgcggcgcgtatgcttctgacgttggatgagaaaaaccctcgtcggattttcgaaggagaagccctgctgcggcgaatgaacagatatggcctcctggacgaaacccaaagcaagcttgattacgtcctcgctcttactgtcgagaacttccttgagcgccgtcttcagaccctcgttttcaaatccggcatggccaagtccatccatcacgctcgtgttctcataaggcaacgacatatcagggttggtaggcaggttgtgaatattccgtctttcatggtaagagtggattcacaaaagcacattgatttctcacttacgagtccacttggagggggacgtcccggtcgtgtgaaacgaaagaacatgaaggcagcatcaaagaaggctgctggtggagatggagaggaagaggatgaggaatgaggcgtagcagcattattgaacaagaaaagttagctggacaatatcttctttagtgtgaagcttttagattttgttaagaagcttttagattttgttaagagtgttactattcggatttttctggctgctgcaacaactggttgtgaaacttcggaaataggtttggataaatcttaaatttggcaacagtcatccgacattttaaatcttgtcaatttactggcttttgcaagatgtttggtttgttaaacattggcaatagattagattacacttcaaaatttgctggactttgattactgtccagagttctgtttcagtaaacggcaaatgtcctattaatgttatctattttttatgtattttaaatttgacattagtcggcagacatttttaaattttgtcagtttagtaatttgctgcaagatgtactggtttgttaaacattggtcattatgttagaatacactttaaaattg

SEQ ID NO: 2909 - DNA, 1269 bp, Picea glauca
atatacaatacaatacatcggggggaggtgttgtttgtgtgagagtccgggggagcaggaagagcagcagcagcagaggaggaaagatggtgcacgtcgttttttaccgcaactatgggaagacgttcaagaagccccggcggccctacgagaaggagcggctggacgcagagctgaaattggtgggagaatacgggctgcgaaacaagagagaactctggagggttcaatatacgctgagccgcatacgaaatgcagcgcgtatgcttctgacgctggacgagaaaaaccctcgccggatattcgaaggagaagccctgctgcggcgtatgaacaggtatggcctcctagacgaaacccaaagcaagctcgattacgtcctcgctctcaccgtcgagaacttcctcgagcgccgccttcagactcttgtcttcaaatccggcatggccaagtccatccatcacgcccgtgtcctcatcaggcaacgccacatcagggttggtaggcaagtcgtgaatattccgtctttcatggtaagagttgattcacaaaagcacattgatttctcacttacaagtccacttggtggtggacgtcctggtcgtgtgaaacgaaagaacttgaaggcagcatcaaagaaggctgctggtggagatggagaggaagaggatgaggaatgaggcatagcagtgttagtggccaagaaaagttagctgcacaattcttctttagtgtgaagcttttagattttgttaaaagaatgcttttagttgggtttttctggctgctgcaacaactggctggtaaactttggtaataggtttgcatacattataaatttggcaatagttgacgtacagtttgaattttgtcagtttactggttgctgcaagatgtttggtttgttaaacattcataataggttagaatacacttaaaatttgctggattttgatcacagtccagagctctgtggcagtagacagcaaatgttgatttattcattacagttactgaaaatttaaattttgcacatttaattatgctgtagtaattttatattctctttatgtattttaaatttggcaatagtcagcatacatttttagattttgtcactggatactgcaagatgtttggtttgttaaactattggcaataggttggattacacttcaaaatttgctggactttgatcatggtccagcgctttgggacagtaaacagaaaaaatagttgataatgtttcattccagttattgaaaattt

SEQ ID NO: 2910 - DNA, 1112 bp, Picea glauca
ataatttataggttttaagatcgagtttcccatgacactccattgaaaaggattttagggttttgtaggaagcggtagggtttttcatatacaatacaatacatcggggggaggtgttgtttgtgtgagagtccgggggagcaggaagagcagcagcagcagaggaggaaagatggtgcacgtcgttttttaccgcaactatgggaagacgttcaagaagccccggcggccctacgagaaggagcggctggacgcagagctgaaattggtgggagaatacgggctgcgaaacaagagagaactctggagggttcaatatacgctgagccgcatacgaaatgcagcgcgtatgcttctgacgctggacgagaaaaaccctcgccggatattcgaaggagaagccctgctgcggcgtatgaacaggtatggcctcctagacgaaacccaaagcaagctcgattacgtcctcgctctcaccgtcgagaacttcctcgagcgccgccttcagactcttgtcttcaaatccggcatggccaagtccatccatcacgcccgtgtcctcatcaggcaacgccacatcagggttggtaggcaagtcgtgaatattccgtcttttatggtaagagttgattcacaaaagcacattgatttctcacttacaagtccacttggaggtggacgtcctggtcgtgtgaaacgaaagaacttgaaggcagcatcaaagaaggctgctggtggagatggagaggaagaggatgaggaatgaggcatagcagtgttagtagccaagaaaagttagctgcacaattcttctttagtgtgaagcttttagattttgttaaaagaatgcttttagttgggtttttctggctgctgcaacaactggctggtaaactttggtaataggtttgcatacattataaatttggcaatagttgacgtacagtttgaattttgtcagtttactggttgctgcaagatgtttggtttgttaaacattcataataggttagaatacacttaaaatttgctggattttgatcacagtccagagctctgtggcagtagacagcaaatgttgatttattcattacagttactgaaaatttaaa

SEQ ID NO: 2911 - DNA, 968 bp, Picea glauca
taggaagcggtagggtttttcatatacaatacaatacatcggggtgaggtgttgtttgtgtgagagtccgggggagcaggaagagcagcagcagcagaggaggaaagatggtgcacgtcgttttttaccgcaactatgggaagacgttcaagaagccccggcggccctacgagaaggagcggctggacgcagagctgaaattggtgggagaatacgggctgcgaaacaagagagaactctggagggttcaatatacgctgagccgcatacgaaatgcagcgcgtatgcttctgacgctggacgagaaaaaccctcgccggatattcgaaggagaagccctgctgcggcgtatgaacaggtatggcctcctagacgaaacccaaagcaagctcgattacgtcctcgctctcaccgtcgagaactttctcgagcgccgccttcagactcttgtcttcaaatccggcatggccaagtccatccatcacgcccgtgtcctcatcaggcaacgccacatcagggttggtaggcaagtcgtgaatattccgtctttcatggtaagagttgattcacaaaagcacattgatttctcacttacaagtccacttggtggtggacgtcctggtcgtgtgaaacgaaagaacttgaaggcagcatcaaagaaggctgctggtggagatggagaggaagaggatgaggaatgaggcatagcagtgttagtggccaagaaaagttagctgcacaattcttcttttagtgtgaagcttttagattttgttaaaagaatgcttttagttgggtttttctggctgctgcaacaactggctggtaaactattggtaataggtttgcatacattataaatttggtcaatagttgacgtacagtttgaattttgttcagtttactggttgctgcaagatgtttggtttgttaaacattcataataggttagaatacacttaaaattt

SEQ ID NO: 2912 - DNA, 1047 bp, Fragaria vesca
gaaagtcgggaggcaaaggcccaactcagctacaactctagtggcaaaatagtcattgcgggcgaatacgctaaaccctaattgcatataaacatcgcgccgtgttgtcttgcttcattctctctcgcctcctttcactctctgcagctcgctcgcttcactcagatctctgagacctaaggaggaaccgagccatggttcacgtcgtcttctaccgcaattatggaaagactttcaagaagccaagacgtccttatgagaaggaacgtttggatgctgagctgaagcttgttggagagtatgggcttcggtgcaagagggagttgtggagggttcagtatgctttgagccgtatccgtaatgctgccagggaacttcttaccctggatgagaagaaccctcgccgtatctttgagggagaggctcttctgcgaaggatgaacaggtatgggcttctggaagagagccagaacaagctcgattatgttcttgctttgactgtcgagaacttcctcgagaggcgtcttcagacccaggtgttcaaatctggtatggccaaatccatccaccacgccagggttctcatcaggcagaggcatatcagggttggaaggcaggttgtcaacatcccatccttcatggtgagaattgactctgagaagcacatcgactttgccatcacaagtccccttggaggtggccgccctggaagagtgaagagaaggaaccagaaggccgctgctaagaaggcagctggtggtgatggcgatgaggaagatgaggaatgagcaattaagcgtcctgtcgctaaaaactcattttaattttatgccccttttgggttttttgctagttatcttcccagacttgagtttattattgtagtgaatgtttgtcaaactatcttgctctggttttaattcgcattagaactccatgttttcctttgaacatcccccatatagttggttcttaaggtaatgaattttgtcgtaatcttatcccttattgtttctttcgttcgggttctctattcccatcatttca

SEQ ID NO: 2913 - DNA, 938 bp, Taxus baccata
agggcaaaacaggcagaggcaggggagcttcagcagcagccatggtgcacgttagcttttaccgcaactatggtaaaacttttaagaagccccgtcgtccttatgagaaagagcgtttggatgccgagctgaagttggtcggagagtatggtctgcgtaacaagagagaactttggagggttcagtataccctaagccgtattcgtaaggctgcaagaatgcttcttactcttgatgagaagaatccccgtcgaatttttgagggtgaggccctgctgcgtcgcatgaataggtatggacttctcgacgagagtcagaacaagcttgattatgtcttggcattgacggttgagaactttctcgagcgccgactccaaacccttgtgttcaaggctgggatggccaagtcaatccaccatgcccgtgttctcatcagacaacgacatatcagggttggccggcaggtggtgaatattccatctttcatggtcagagttgattcacagaaacacattgacttctctctaactagtcctcttggtggcgggcgacctggccgtgtgaagcgaaagaacatgaaggcagcctcaaagaaggctgcaggtggagatgaagaggaggatgaggaatgagtgattgcaattttatctggatgaaagtagatagcttttaattttctaatgtagagatttaattgctatgctccaatgccttggattggagtttgtgcctattccagaaatatgatgtaggacatgtttaatatatactgcattctatttttgttttgagccttaagtgatgtttgtatgcaacaaagatatttgtttctgttattggttcgagctgattcttggccatttttttgttgattcaacaaaccatggcagggaaagctggtttttaatcttgcttgttttgtttgaaactgaagtgca

SEQ ID NO: 2914 - DNA, 749 bp, Thalictrum flavum
gaagaaggaagaggagttgcaggtagtctatcatggtgcacgttagcttctaccggaactatgggaagacattcaagaagccacgtcgtccatatgagaaagaaagattggatgctgagttgaaacttgttggtgaatatggtcttcgatgtaagagagaactttggagagttcagtatgctttaagtcgaattcgaaacaatgctaggaatctactcactcttgatgagaaaaatcctcgtcggatctttgaaggtgaagctttattgagaagaatgaatagatatggtcttcttgatgagagtcagaacaagcttgattatgtcttggctttaactgttgagaactttcttgaacgtcgtcttcagactcttgtgtttaagtctggtatggctaagtccattcatcatgctcgtgtgctcattagacaaaggcacatcagggttgggaggcaggttgtcaacattccatctttcatggttagggttgactcgcagaaacacattgacttctctctcaccagcccacttggtggtggacgccctggaagagtaaagcgaaggaacatgaaggcagctgccaagaaggcgtctggaggagatggagatgaggaggaagaggattgagtcatcaaatctttgtgagtcctgcagataaggaggaggaatatcaaatgcgcttcatttctgtagtcctaaaatttttacttggtgctctctagtgtttttttttgcttgggacgtggtagt

SEQ ID NO: 2915 - DNA, 885 bp, Vaccinium corymbosum
ctcctcttcttccctggcaattgacggcaagccggcggagccatggttcacgtcaatttctatcgcaactatgggaagacttttaagaagcctcgccgtccttatgagaaggagcgtttggacgctgagctgaagcttgtgggagagtatggacttcgatgtaagagggagttgtggagggttcagtatgctctgagccgcattcgtaatgcagcgagaatgcttctcacccttgatgagaaaatcctcgccggatctttgagggtgaggcgcttctacgcaggatgtataggtatggacttttggatgagaaccagaacaagcttgattatgtcttggctttgaccgtggagaacttccttgaacggcgtcttcaaacacttgttttcaagaccggtatggctaagtccattcaccatgctcgtgtgctcattaggcagaggcatataagggtgggaaggcaggtggtcaacatagcctcattcatggtgaggctggactctcaaaaacacattgatttctctctcacaagtcctcttggaggtggacgccccggaagagtcaagcgaaagaaccagaaggcggctgctaagaaggctgctgggggagatggcgatgaggaggatgaggagtgaatagcacgatcaaattgagatatcaaacggtcttgttttgtcttttggattctctatttcggttgaaattctcttgcctgactgccattctcgattcttcaatcaattaggagttttccttgttttggttcacaaatttgatgattcaaattgattactctttgcttctgtttccggtatgattggatgctgttcatgttttgaaaaacaagtgttctttcactcatcttatctgtaggctttctaagct

SEQ ID NO: 2916 - DNA, 733 bp, Fagopyrum esculentum
atcgtcggtcgagaggtttcaggcagtcatggtgcacgtttcctactatcgcaactatggcaaacattcaagaagcctcgtcgtccttacgagaaggagaggctggatgcagagctgaagctggtgggagagtatggacttcgttgcaagagggagctgtggagggtgcagtatgcattgagccgtatccgtaacaatgcaaggcatcttcttactctcgatgagaaagacaccaaacgtatctttgagggtgaggctttgcttaggaggatgaatcgttatgggctgttggatgagagccagaacaagcttgattacgtcttgtcactaactgttgagaacttcctcgagcgtcgcctccagacccttgttttcaagtccggtatggccaagtccattcaccatgcccgtgtcctcatcaggcaaaagcacataagggttggaagacaagtagtgaacatcccatcattcatggtgagggtggattcacaaaagcacatagatttctctctgaacagtccgtttggaggaggcagacccggaagagtaaagcgaaagaaccagaaggctgctgctaagaaggcctctggtggagatggtgaagacgaggatgaagagtgaatgttgcattaataggatcattacgtttgcttgtcgccttgtttcatgtttttggatgttttggattgaaaggatctgttgagggaactctctgtgggcttttatttatgca

SEQ ID NO: 2917 - DNA, 805 bp, Juglans hindsii x Juglans regia
gtaacggactcccatgatcccatctctctccaaaaacatggcaaactggtaatttcgttcatggactcggggtttagggtttgcgtattttgcagcaactgtcgccttctcgttcctccgcactctcttcccttcgccgcatcttattggaagccgacggagatatggtccacgtcagtttctaccataactatgggaagactttcaaaaagccacgccgtccatatgagaaggaacgattggatcatgagctgaagcttgtgggagagtatgggctccgatgtaagagagagctgtggagggttcaatatgctttgagctgcatccgtaatgctgccagggaacttctcactctggatgagaagaatcctcgtaggatattcgagggtgaggcccttctccgtagaatgaacaggtatgggctcttggatgagagccagaacaagcttgattatgtcctggctctgactgtggagaacttccttgagcgctgactccaaacccttgcattcaagtcgggtatggccaagtcgattcaccatgcccgtgtgcttattaggcagaggcatatcagggttggaaggcaggtagttaacataccatctttcatggtgagagttgattctcagaaacatattgatttctctctcactagtccatttggaggtggacgcccaggttgagtgaagcgaaagaaccagaaggcagctgccaagaaggctgctggtggggatggagatgaagaggatgaagaatgaagcctaggctagctccaaccgtacccccggaagcattcgagtctttt

SEQ ID NO: 2918 - DNA, 923 bp, Secale cereale
cccccaccggcggcgcgcagctcgacgatccgagcgatcctgcggaggcggcagccatggtgcacgtcaacttctaccgcaactatgggaagaccttcaagaagccaaggcgtccgtatgagaaggagcgtcttgacgctgagctgaagctggttggggagtacggtctgcgggccaagcgtgagctctaccgtgtgcagtacgccctcagccgcatccgaaatgctgccagggagctgctcaccctggatgagaagaacccccgccgtatcttcgagggtgcagcgctcctccgccgcatgaaccgctatggtcttctcactgaggaacagaacaagcttgattacgtgcttgccctcactgttgacaacttcctccagcgccgtctccagaccattgtattcaagaatggcatggccaagtcaatccatcatgctcgcgtccttatcagacagcgccacatcagggttggaaagcagctcgtcaacattccttctttcatggtgagggtggacactgagaaacacgtcgacttctcgctcaccagccccctgggtggtggccaacctggaagagtgaagcggaagaaccagaagaaggccgcaggtggtggtggtgacgacggcgaggaggaggaagactaagcgctcagccttgaccaccataactttcgttgcagaaatgttgagattgccttctgcaacttgcaacgggaaatgataaaaactttggttcattcttagaaacttagtggtgcagagctttcgttgcttcagaatattttggctgtcagttctaaaattaaacttatgcgtgttggttttgcttggtcagtgaccaccaggcggacaagttgcttcaatttttgtgaactagacgaatcttgttctgagttattttactctgcgtgaagtgtcttttgc

SEQ ID NO: 2919 - DNA, 924 bp, Secale cereale
ctcaccccaccggcggcgcacagctcgacgacccgcgcgatcctgcggaggcggcagccatggtgcacgtcaacttctaccgcaactatgggaagaccttcaagaagccaaggcgtccgtatgagaaggagcgtcttgacgctgagctgaagctggttggggagtacggtctgcgggccaagcgtgagctctaccgtgtgcagtacgccctcagccgcatccgaaatgctgccagggagctgctcaccctggatgagaagaacccccgccgtatcttcgagggtgcagcgctcctccgccgcatgaaccgctatggtcttctcactgaggaacagaacaagcttgattacgtgcttgccctcactgttgacaacttcctccagcgccgtctccagaccattgtattcaagaatggcatggccaagtcaatccatcatgctcgcgtccttatcagacagcgccacatcagggttggaaagcagctcgtcaacattccttctttcatggttagggtggacactgagaaacacgtcgacttctcgctcaccagccccctgggtggtggccaacctggaagagtgaagcggaagaaccagaagaaggccgcaggtggtggtggtgacgacggcgaggaggaggaagactaagcgctcagcctcgaccaccataactttcgttgcagaaatgttgagattgccttgtggaacttgcaacgggaaatgataaaaactttggttcgttcttagaaacttagtggtcagagctttcgttgcttcagaatattttggctgtcagttctaaaattaaacttatggttgttggttttgcttggttagtgaccaccaggcggacaagttgcttcattttttgtgaactagacagaatcttgttctgagttattttactctgcgtgaagtgtctttt

SEQ ID NO: 2920 - DNA, 798 bp, Zingiber officinale
  misc_feature (43)..(46): n is a, c, g, or t
  misc_feature (84)..(84): n is a, c, g, or t
  misc_feature (86)..(87): n is a, c, g, or t
  misc_feature (161)..(161): n is a, c, g, or t
  misc_feature (731)..(731): n is a, c, g, or t
  misc_feature (752)..(752): n is a, c, g, or t
ctagaaccagccatggttcatgtcagtttctaccgaaactacnnnnagacattcaagaagccccgccgtccctacgagaaggancnncttgatgccgaactgaagctggtcggcgagtatgggcttcgctgcaagcgggagctgtggagggtgcaatacgngctgagccggattcgcaatgctgcaagggaacttctcacgctagacgaaaagaaccctcgccggatttttgaaggagaggccctgcttcgccggatgaaccgatatggcctcctcggggaaggacagaacaagcttgattacgtcctcgccctcaccgtggagaacttcttggagcggcgtctgcagactatcgtcttcaagtcggggatggcaaagtccatccaccatgcgagggtcctcatcagacagcgtcacataagagttggtaggcaggtggtaaatatcccatcatttatggtgagggtcgactccgcaaagcacatcgacttctccttgaccagtccatttggcggtggccgtcctggaagggtgaagagaaagaaccaaaaggcagcagcaaagaaggctgccggcggcgaggaggaggatgaggaatgagctatgtgcatctcgttatgttttgaattttgctagtagcttgtttaatcagtttattctgattttcttgttaaattatgaaggttgaacgttttgtgttagcaccttatcatctttttggtacacccttnagctttattcaaacttggatnatgcaaaaagtattaaaatgtttactcaaacttgaataatggtgca

SEQ ID NO: 2921 - DNA, 937 bp, Triticum aestivum
caccggcggcgcacagctcgacgacccgggcgatcctgcggaggcggcagccatggtgcacgtcaacttctaccgcaactatgggaagaccttcaagaagccaaggcgtccgtatgagaaggagcgtcttgacgctgagctgaagctggttggggagtacggtctgcgggccaagcgtgagctctatcgtgtgcagtacgccctcagccgcatccgaaatgctgccagggagctgctcaccctggatgagaagaacccccgccgtatctttgagggtgcagcgctcctccgccgcatgaaccgctacggtcttctcactgaggaacagaacaagcttgattatgtgcttgccctcactgttgacaacttcctccagcgccgtctccagaccatcgtcttcaagaatggcatggccaagtcaatccatcatgctcgtgtccttatcagacagcgccacatcagggttggaaagcagctcgtcaacattccttctttcatggtgagggtggacactgagaagcacgtcgacttctcgctcaccagccccctgggtggtggccaacctggaagagtgaagcgcaagaaccagaagaaggcctcaggtggtggtggtgatgacggcgaggaggaggaagactaagcgctcagcctcgacccacataactttcgttgcagaaatgttgagattgccttgtggaactcgcaacgggaaatgattcaaactttcgttcttagaaacttagtggtgtagagctttcgttgcttcagaatcttttggctgtcatttctaaaattaaacttatgtgtgtcggttttgcttggttactgaccgccgagcagaagtgaactcgtgaggctgcttcgttttttgtgaaccaaacgtatcttgtttatcgatttgacaggcctggttctgagttattttactctgcatgaa

SEQ ID NO: 2922 - DNA, 955 bp, Triticum aestivum
ctccaccgatcccctcacccccaccggcggcgcacagctcgacgacccgcgcgatcctgcggaggcggcagtcatggtgcacgtcaacttctaccgcaactatgggaagaccttcaagaagccaaggcgtccgtatgagaaggagcgtcttgacgctgagctgaagctggttggggagtacggtctgcgggccaagcgtgagctctatcgtgtgcagtacgccctcagccgcatccgaaatgctgccagggagctgctcaccctggatgagaagaacccccgccgtatctttgagggtgcagcgctcctgcgccgcatgaaccgctacggtcttctcactgaggaacagaacaagcttgattacgtgcttgccctcactgttgacaacttcctccagcgccgtctccagaccatcgtcttcaagaatggcatggccaagtcaatccatcatgctcgtgtcctcatcagacagcgccacatcagggttggaaagcagctcgtcaacattccttctttcatggtgagggtggacactgagaaacacgtcgacttctcgctcaccagccccctgggtggtggccaacctggaagagtgaagcggaagaaccagaagaaggcctcaggtggtggtggtgacgacggcgaggaggaggaagactaagcgctcagcctcgacccgcataacttccgttgcagaaatgttgagattgccttgtggaacttgcaacgtgaaatgattcaaactttggttcgttcttagaaacttagtggtgtagagctttcgttgcttcagctatcgattctaaaattaaacttatggttgtcagttttgcttggttagtgaccaccgagcataagaagtgaactcagtgaggctgcttcgttttttgtgaaccaaacgtatcttgttatcggtttgacagccctggttctgagttattttactctgcatgaa

SEQ ID NO: 2923 - DNA, 960 bp, Triticum aestivum
ccgatcccctcacccccaccggcggcgcacagcccgacgacccgagcgatcctgcggaggcggcagccatggtgcacgtcaacttctaccgcaactatgggaagaccttcaagaagccaaggcgtccgtatgagaaggagcgtcttgacgctgagctgaagctggttggggagtacggtctgcgggccaagcgtgagctctatcgtgtgcagtatgccctcagccgcatccgaaatgctgccagggagctgctcactctggatgagaagaacccccgccgtatctttgagggtgcggctctcctccgccgcatgaaccgctacggtcttctcactgaggaacagaacaagcttgattacgtgcttgccctcactgttgacaacttcctccagcgccgtctccagaccatcgtcttcaagaatggcatggccaagtcaatccatcatgctcgtgtccttatcagacagcgccacatcagggttggaaagcagctcgtcaacattccttctttcatggtgagggtggacactgagaaacacgtcgacttctcgctcaccagcccccttggtggtggccaacctggaagagtgaagcggaagaaccagaagaaggcctcaggtggtggtggtgatgacggcgaggaggaggaagactaagcgctcagcctcgacccgcataacttccgttgcagaaatgttgagattgccttgtggatcttgcaacgggaaatgattcaaactttggttcgttcttagaaacttagtggtgtagagctttcgttgcttcagaatcatttggctatcgattctaaaattaaacttatgtttgttggttttgcttggttagtgactaccgagcagaagaagtgaactcagtgatgctgcttcgttttttgtgaaccaaacgtatcttgttattgattttacaggcctggttctgagttagtttactctgcatgaa

SEQ ID NO: 2924 - DNA, 941 bp, Triticum aestivum
cctcaccccagcaccggcggcgcacagctcgacgacccgagcgatcctgaggaggcggcagccatggtgcacgtcaacttctaccgcaactatgggaagaccttcaagaagccaaggcgtccgtatgagaaggagcgtcttgacgctgagctgaagctggttggggagtacggtctgcgggccaagcgtgagctctaccgtgtgcagtacgccctcagccgcatccgaaatgctgccagggagctgctcaccctggatgagaagaacccccgccgtatctttgagggtgcagcgctcctccgccgcatgaaccgctacggtcttctcactgaggaacagaacaagcttgattatgtgcttgccctcactgttgacaacttcctccagcgccgtctccagaccatcgtcttcaagaatggcatggccaagtcaatccatcatgctcgtgtccttatcagacagcgccacatcagggttggaaagcagcttgtcaacattccttctttcatggtgagggtggacactgagaagcacgtcgacttctctctcaccagccccctgggtggtggccaacctggaagagtgaagcggaagaaccagaagaaggcctcaggtggtggtggtgatgacggcgaggaggaggaagactaagcgcccagcctcacccgcataactttcgttgcagaaatgttgagattgccttgtggaactcggaaatgattcaaactttccttcttagaaacttagtggtgtagagctttcgttggttcagaatcttttggctgtcggttctaaaattaaacttatgtgtgtcggttttgcttggttagtgaccaccgagcagaagtgaactcttgaggctgcttcgttttttgtgaaccaaacgtatcttgtttatcgatttgacaagcctggttctgagttattttactctgcatgaa

SEQ ID NO: 2925 - DNA, 1206 bp, Triticum aestivum
tcatcgctgtctggaacagcgatgactctccaccgatcccctcaccccagcaccggcggcgcacagctcgacgacccgagcgatcctgcggaggcggcagccatggtgcacgtcaacttctaccgcaactatgggaagaccttcaagaagccaaggcgtccgtatgagaaggagcgtcttgacgctgagctgaagctggttggggagtacggtctgcgggccaagcgtgagctctatcgtgtgcagtacgccctcagccgcatccgaaatgctgccagggagctgctcaccctggatgagaagaacccccgccgtatctttgagggtgcagcgctcctccgccgcatgaaccgctacggtcttctcactgaggaacagaacaagcttgattacgtgcttgccctcactgttgacaacttcctccagcgccgtctccagaccatcgtcttcaagaatggcatggccaagtcaatccatcatgctcgtgtccttatcagacagcgccacatcagggttggaaagcagctcgtcaacattccttctttcatggtgagggtggacactgagaaacacgtcgacttctcgctcaccagccccctgggtggtggccaacctggaagagtgaagcggaagaaccagaagaaggcctcaggtggtggtggtgatgacggcgaggaggaggaagactaagcgctcagcctcgacccgcataacttccgttgcagaaatgttgagattgccttgtggaacttgcaacgggaaatgattcaaactttggttcgttcttagaaacttagtggtgtagagctttcgttgcttcagaatcatttggctatcgattctaaaattaaacttatgtttgtcggttttgcttggttagtgaccaccgagcagaagaagtgaactcagtgaggctgcttcgttttttgtgaaccaaacgtatcttgttatcgatttgacaggcctggttctgagttattttactctgcatgaagtgttactgttgtccttgctatccttctcttttgtctgattggctaggttggtgtgtcgaccgaatgatcagaataagtgctatatagtactctttccaaggctataattccaattgtagtattaataacaattttgtactgtattgtggacgtttattgaaactgctaccaagtgtccatgaccaagccgccttaaagcacaaaactatat

SEQ ID NO: 2926 - DNA, 861 bp, Vinca minor
caagtcgtatataagcaaaaaactcctcatcctacggctttcttcttcgtcttcctcggctcactgacggtgattaaccctaaccctagtcagccatggtgcacgtcagtttctaccggaactatgggaagactttcaaaaagcctcgtcgtccatatgagaaggaacgattggacgcagaattgaagcttgttggagagtttgggctgcgatgcaagagggaactgtggagggtgcaatatgcacttagcagaattcgtaacaatgcaagaatgcttctcactcttgatgagaaagaccctcgccgtatctttgaaggtgaagcccttctgcgtaggatgaaaaggtatgggcttttggaagaaggtcaggacaagcttgattatgtgttggctctgtctgtggagaatttccttgaacgtcgccttcaaacacttgtgttcaaggcaggaatggccaaatctatccaccatgcccgtgtgctcattagacagaggcacatcagggttggaaagcaggtggtgaatgtcccatccttcatggttaggttggactctcagaaacacattgacttttcaattacaagtccatttggtggcggcagacctggaagagtgaagcgaaagaacacaaaagccgctgccaagaaagcttctggtggtggtggtgatgaagaggacgaggaatgagcagttcatgttcgatatatgctttataactcttccaatatcaactatctcatgtgactgctagttggaattttatcatgttagatgtgttttttttttttttttttatggaaaaccatgtaagatgtgctacctttacttgtttgcagatatgaatagtaattttggttta

SEQ ID NO: 2927 - DNA, 1095 bp, Medicago truncatula
ggaattgtatgcacatttgagcagcttcaccaacaacaacaacagcataccggcggcgaaggaagagagaacagagatcaataatggttcacgttgcgttttaccgaaactatggcaaaactttcaagaagccacgtcgtccttatgagaaggagcgtttagatgctgagttgaagctcgtcggagagtacggtcttcgctgcaagcgcgagctttggagggttcaatatgctcttagccgtatccgtaacaatgctaggacacttttgacactggatgagaagaaccctcgtcggatctttgaaggtgaagcacttttgaggagaatgttcaaacatggtcttcttgatgaaacacagaacaagctcgattatgtgttggctctcactgttgagaattttcttgaacgtcgtcttcagactcttgtgttcaaatctggcatggctaagtctattcatcatgctagggttcttatcaggcagaggcacatcagggttgggaggcaggtggtgaacatcccatccttcatggtgagggttgattcacagaagcacattgacttttcactcacaagtcctttcggcggtggtcttcctggtcgtgtgaagcgaaagaacttaaaggctgcagccaagaaggcttccggtggtgatggtgatgaggaggatgaagattaaatttatgattttcttttgcttagatccttgctctagcctttttatatctgccctagactttagattttctgtcatgcaaatgacttttaccattttcccatccctgtttattgtgtgaggaaatctttgctcgagacatgttgtttttgatcttttcttttctaagtattaagttttgctccaatacatttgatgatctttgtgatgattgaaccttttacttgatgctctgtgtaagagaatattatttagctgtttgatattgcttgttttgatggtatacccgtgtatccaaccgaaactttgatccaactatgcttcattgattgaagcatagttgattttgaatattagtttgattctgtgtgtaagagaataacaacaataacaataataataataataatattttgattct

SEQ ID NO: 2928 - DNA, 952 bp, Medicago truncatula
acattttaccatattcttcttctttcacttcatcaaaaacctattaggggcggaggcataccggcggtgagcaaacatggttcacgttgcgttttaccgtaactatggcaaaactttcaagaagccacgtcgtccatatgagaaggaacgtttggatgctgagttgaagctcgtcggagagtacggtcttcgctgcaagcgcgagctttggagggttcaatatgctcttagccgtatccgtaacaatgctaggacacttttgacactggatgagaagaaccctcgtcggatctttgaaggtgaagcacttttgaggagaatgttcaaacatggtcttcttgatgaaacacagaacaagctcgattatgtgttggctctcactgttgagaattttcttgaacgtcgtcttcagactcttgtgttcaaatctggcatggctaagtctattcaccatgctagggttctaatcaggcagaggcacatcagggttgggaggcaggttgtgaacatcccatccttcatggtaagggttgattcacagaagcacattgacttttcactcacaagtccattcggtggtggtcttcctggtcgtgtgaagcgtaagaaccttaaggctgcagccaagaaggcttccggtggtgatggtgatgaggaggatgaagattaaattatgattttcattttcttagatccttgctctagcctttttatatctgtcctagactttagattttctatcatgcaaatgacttttaccgttttcccatccctgtttattgtgtgaggaaatctttgcttgagacatgttgtttttgatcttttcttttccaagtattaagttttgctccaatacatttaaatgatctttgttataattgaaccttttacttgatggtgtgtgtaagagaatattatttagcagtttgatattgcatgttttgatggtata

SEQ ID NO: 2929 - DNA, 872 bp, Medicago truncatula
cttctttcacttcatcaaaaacctattaggggcggtgagcaaatataaacatggttcacgttgccttttaccgaaactatggcaaaactttcaagaagcctcgtcgtccttatgagaaggagcgtttagatgctgagttgaagctcgtcggagagtacggtcttcgctgcaagcgcgagctttggagggttcaatatgctcttagccgtatccgtaacaacgctaggacgcttttgacactggatgagaagaatcctcgtcggatctttgagggtgaagcacttttgaggagaatgttcaaacatggtcttcttgatgaaacacagaacaagctcgattatgtgttggctctcactgttgagaattttcttgaacgtcgtcttcagactctcgtgttcaaatctggaatggccaagtccattcatcacgctagggttcttatcagacagaggcacatcagagttgggaggcaggttgttaacatcccatccttcatggtaagggttgattcacagaagcacattgacttttcactcacaagtccattcggtggtggtcttcctggtcgtgtgaagcgtaagaaccttaaggctgcagccaagaaggcttccggtggtgatggtgatgaggaggatgaagattaaattatgattttcattttcttagatccttgctctcgcctttttatatctgtcctagactttagattttctatcatgcttcgagacatgttgtttttgatcttttcttttccaagtattaagttttgctccaatacatttgaattatctttgttataattgaaccttttacctgatggtgtgtgtaagagaatattatttagcagtttgatattgcatgttttgatggta

SEQ ID NO: 2930 - DNA, 816 bp, Rosa hybrid cultivar
tcctctcactccttggcagctcgcgcttaccctcttctcggagatctgaaggaggaacccaaccatggttcacgtcgtcttctaccgcaattatggaaagactttcaagaagccaagacgtccctatgagaaggaacgtttggatgctgagctgaagcttgtaggagaatatgggcttcggtgcaagagggagttgtggagggttcagtatgctttgagccgcatccgtaatgctgccagggaacttcttaccctggatgagaagaatcctcgccgtatctttgagggtgaggctcttctgcgcaggatgaacaggtttgggcttctggaagagagccagaacaagctcgattacgtccttgcactcactgttgagaacttccttgagaggcgtcttcagacccaagtgttcaaatctggtatggccaagtccatccatcacgccagggttctcatcaggcaaaggcacatcagggttggaaggcaggtggtgaacattccatcattcatggtgagaattgattccgagaagcacatcgactttgccatcacaagtccccttggaggaggccgccccggaagagtgaagagaaggaaccagaaggccgctgccaagaaggcagctggtggtgatggagatgaggaagatgaggaatgagcaatgaattgacctgtcatttgaatctcatttaagtttatgctccttttggcttcttgctagttaccttcccagacttgagtttattattgtagtgaatgtttgtcaaactatcctgttctggttttaattcgcgttagaactccatgttttgcttt

SEQ ID NO: 2931 - DNA, 775 bp, Antirrhinum majus
ggcggagcagatcatcggagtgaaggcaccagcggcggcaaaagagaaccatggtgcacgttgttttctatcgcaactatggaaagacatttaagaaacctcgtcgtccttatgagaaggaacgactggatgctgagctgaggctcgttggcgagtatggtctgaggtgtaagagagagctctggagggtgcagtatgctctgagtcgcatcaggaatgctgcgaggaatcttttgactcttgaggagaaggatcctcgtcgtatttttgagggtgacgcccttatgaggaggatgaacaggtacggactgcttgacgagagccagaacaagctcgattatgtgttggctctcaccgtggagaacttccttgagcgccgtctccagactctcgtgtttaaggctggtatggctaagtcgatccatcatgccagagtgttaatcaggcaaaagcatatcagagttggaagacaagttgtcaatgtgccctctttcatggtgagggttgactcccagaaacatattgatttctctctgacaagcccatttggtggtggtcgccctggtagagtgaagagaaggaaccaaaagtcagctgcaaagaaggcatctggtggtgacggagacgaggatgatgaagagtaaggtgcagtagtttatatttctgttgatgggtattgctagggaagcagcaatttgagcttactctgctgcttatttagtggtgatgttttccgtcaaattatctactgttttgctgaaatattgaattatag

SEQ ID NO: 2932 - DNA, 728 bp, Antirrhinum majus
  misc_feature (470)..(470): n is a, c, g, or t
gcggcggcaaaagcaaatcatggtgcacgttgttttctaccgcaactatggaaagacatttaagaagcctcgacgtccgtatgagaaggaacgtctggatgctgagctgaggcttgttggcgagtatggtctgaggtgtaagagggagctctggagggtgcagtatgcgctgagtcgcatcaggaatgctgcgagaaatcttttgacccttgaggagaaggatcctcgtcgtatttttgagggtgacgcccttatgaggaggatgaacaggtatggactgcttgacgagagccagaacaagcttgattacgtgttggctctcactgtggagaacttccttgagcgccgtctccagactctcgtgttcaaggctggtatggctaagtcaatccatcatgccagagtgttaatcaggcaaaagcatatcagggttgggaggcaagttgtcaatgtaccctctttcatggtgngggttgactcccagaaacacattgacttctctctgacaagcccattcggtggtggtcgccccggtagagtgaagagaaggaaccagaagtcagctgcaaagaaggcttctggtggtgatggagacgaggaggacgaagagtgaggcgtagtagttttatttcactaatggtattgctagttgagagtattttgagtttatctctgttgctcgtttagtggtatgtttctacagactatctatcgtatttttggaatat

SEQ ID NO: 2933 - DNA, 953 bp, Malus domestica
tcagaactcggcagcgcgagcctcccgctcacccacccactctctcactctcctttctggatctgacctagggctagccagccatggtgcacgtcgtccattaccgcaactatgggaagactttcaagaagccgcgtcgtccttatgagaaggaacgtttggatgctgagctgaagcttgttggagaatatggactccgtgcaaagagggaactgtggagggttcagtattctctgagccgtatccgtaatgctgccagggaacttcttaccctggatgagaaaaatcctcgccgtatctttgagggtgaggctcttcttcgcaggatgaacaggtatggccttctggatgagagccagaacaagctcgattatgtgttggctttgactgtggagaactttttggagcgtcgtcttcaaacccttgtgttcaaaactggtatggccaagtccattcaccacgccagagttctcatcaggcaaaggcacatcagggtcggaaggcaggtggtcaacatcccatctttcatggtgagggtggactcccagaagcacattgacttctctctcactagtcccctcggaggtgggcgccctggaagggtgaagagaaggaaccagaaggccgctgccaagaaggctgctggtggtgatggcgacgaagaggaagaagaatgaagtggaggcctctcaatttagaagcgtttcgatatcatgagccttgattttaccgacctttacagtttattttagcggatgttataagcgtttcttgctcgtgttttgttgcgactagagctcaaatgttttgctttaaataccctaagtaatgaattttgtgttagcttattaaaactttggatctatgtctctaattccattgcgctgtttgctttgatttgatgaatcgtcctgtgttttttttttatttaaacttttttttgttctcctgca

SEQ ID NO: 2934 - DNA, 868 bp, Malus domestica
tcagaactcggccgcgcgagcctccctctctccctcgctctcctttcttgatctgacctagggctacccagccatggtgcacgtcgtccattaccgcaactatgggaagactttcaagaagccacgtcgtccttatgagaaagaacgtttggatgctgagctgaagctggttggggaatatggactccgcgcaaagagggaactgtggagggttcagtattctctgagccgtatccgtaatgctgccagggaactccttaccctggatgagaaaaatcctcgccgtatctttgagggtgaggctcttcttcgcaggatgaacagatatgggcttctggatgagagccagaacaagctcgattatgtgttggctctgactgtggagaactttttggagcgtcgtcttcaaacccttgtgttcaaaagtggtatggccaagtccatccaccacgccagagttctcatcaggcaaaggcacatcagggtcggaaggcagttggtcaacatcccatctttcatggtgagggtcgactcccagaagcacattgacttctctctcaccagtcccctcggaggtgggcgccctggaagagtgaagagaaggaaccagaaggccgctgccaagaaggctgctggtggtgatggcgacgaagaggaagaagaatgaagtggaggcctctcaatttagaactgttttgatatcatgagccgtaattttatcgttagtttcttttgccgactttacagtccgtattgtagtggatgttactaagcgtttcttgctttgttgcgactagaactcaaattttttgctttaaatactcttttaagtaatgaattttgcgttaccttgcggaagctttgggca

SEQ ID NO: 2935 - DNA, 1015 bp, Castanea mollissima
ccttcactttcctcctagctagctcatccgagagagagcgagagagagcgagagagcagccatggttcacgttgttttctatcgcaactatgggaagacctttaagaagcctcgccgcccatatgagaaggagcggttggatgctgagttgaggcttgtgggagagtatgggctgcgatgcaagagagagttgtggagggttcagtatgctcttagccgtattcgtaacaatgcaaggatgcttctgaccctcgatgagaagaactctcgtcgaatctttgagggtgaggctcttctccgaaggatgaatcggtatgggcttttggatgagagtcagaacaagcttgattatgtgttggccttgactgtggagaacttccttgagcgccgtcttcagacacttgtcttcaagtcgggaatggccaagtccatccaccatgcccgagtgctcattaggcagaagcatattagggttgggaggcaggttgtgaatattccatctttcatggtgagggttgattcacagaagcacattgatttctcacttaccagtccatttggtggtggacgacctggaagagtgaagagaaggaatcagaaggcagctgctaagaaggctgctggtggagatgcagatgaagaggatgaagaatgagtgatgggttagacctttactagtaatactaccagtaggactgaggtctcaacttttttgaacttccaatgctttgcttgcaatgtttagtatcactttaagtgagaatagaaatagcttgttgttatttatatgtacaatgtgtgttttcttggcttaaaaatgtgtgtcgaacccaatggcagaggaaattcattatggaggattgctagctagagtttcaactgtcatttatgagccttctaggcctgttaaattatacatgggatgtgcttattggatatgttagtgtgtgataaatcggttgcctgtgttcacagcctttgggtcaagggtaaaacttatgtacaattcctaagg

SEQ ID NO: 2936 - DNA, 685 bp, Cirsium arvense
gttctcccagtttgcagcttaggaagcagctgagaggaagagagatagagagaattgcaagcgatcgcggcattgacttcagaaaacgatggtgcatgttccgttttaccgcaactatgggaagacattcaagaagccacgtcgtccttatgagaaggagcgactggatgccgaattgaagcttgttggagagtatggtcttcgatgcaaaagggagctttggagggtgcaatatgctctcagttgcattcgtaatgctgcaagaatgcttcttacccttgaagagaaggacccacgtaggatattcgagggtgaagcacttatgaggaggatgaacagatacgggctgttggatgagagccaaaacaagcttgattacgtgctcgccttgaccgtggagaactttcttgaacgacgtctccaaaccctggtgtttaaaaccggtatggccaaatctatccaccatgctagagtgctcatcaagcagaggcacatcagggtgggaaggcaagtagtgaatgttccatcattcatggtgagattggactcacaaaagcacattgatttctctctcacgagtccgtttggaggtgggcgacctggcagagtgaagcgaaagaaccagaaagcggctgcaaagaaggcatcggctggagatgttgatgaggatgacgaagaatgaggt

SEQ ID NO: 2937 - DNA, 920 bp, Citrus sinensis
ggagacacggcctctttacgccatttgcttaggctttttcgaagatcgcagagagagagtgagggtagcaccagcggcgcgcaaagatggtgcacgtttcattctaccgcaactatgggaaaaccttcaagaagccaagacgtccctatgagaaggagcgattggatgctgagttgaggcttgtgggagagtatgggcttcgctgcaagagggaactctggagggttcaatatgcactgagccgcatccgaaatgctgcgagggatcttctcactctcgatgagaagaacccacgtcgtattttcgagggtgaggcccttctcaggaggatgcacaggtacggcttcttggaagagagccagaacaagcttgattatgtgttggccctcactgtggagaactttcttgagcgtcgtctccagacccttgtgttcaagagtggcatggctaagtcaattcaccatgctcgagtgctcatcaggcagaggcacattagggttggaaggcagcttgtcaacattccctcatttgtagtgagggttgattcccagaagcacattgaattctcactgacaagtccattcggaggtgggcgccctggaagagtgaagagaaggaacatcaaggctgctgccaagaaggccgcaggtggagatggagatgaagaggatgaagaataaattacctgtgtgaacagatagtttttttatggttacagtaggaattctggctgaactttgcaagtggacttatcttctctaagttttatgtttttgtttgcgaattttcttgctataataggaggttttgcttgctttgtgttttacagactactcattgagagagttgtttttgttttttgggatgtactctttgatctttaagctattttatgcctaaattaaatctccgtgtagtta

SEQ ID NO: 2938 - DNA, 952 bp, Citrus sinensis
ggcctcttcacgccgtttgcttaggcttttacaaagatcgcacagggggagagagtgagggtagcaccagcggcgcgcaaagatggtgcacgtttcattctaccgcaactatgggaaaaccttcaagaagccaagacgtccctatgagaaggagcgattggatgctgagttgagacttgtgggagagtatgggcttcgctgcaagagggaactctggagggttcaatacgcactgagccgcatccgaaatgctgcgagggatcttctcactctcgatgagaagaacccacgacgtatttttgagggtgaggcccttctcaggaggatgcacaggtatggcttcttggaagagagccagaacaagcttgattatgtgttggccctcactgtggagaactttcttgagcgtcgtcttcagacccttgtgttcaagagtggcatggctaagtcaattcaccatgctcgagtgctcatcaggcagaggcacattagggttggaaggcagcttgtcaacattccctcatttgtagtgagggttgattcccagaagcacattgaattctcactcacaagtccatttggaggcgggcgccccggaagagtgaagagaaggaacattaaggctgctgccaagaaggccgcaggtggagatggagatgaagaggatgaagaataaattaccttgtgtgagcagatagtttttttatggttacagtaggaactctggctgaactttgcaaatcgacttatcttctcttaagttttatgtttttgctaattttcttcctataataggaggttttgcttgctttgtgctttacagactactcattgagagaattgtttttgttttttgggatgtactctttgatccttaagcttttttatgcctaaattaaatctccgtgtagttagcttttttgtgcgcatatatatatattagatttaatgg

SEQ ID NO: 2939 - DNA, 1130 bp, Citrus clementina
cgttataagaagacacggcctctttacgccatttgcttaggctttttcgaagatcgcagagagagagtgagggtagcaccagcggcgcgcaaagatggtgcacgtttcattctaccgcaactatgggaaaaccttcaagaagccaagacgtccctatgagaaggagcgattggatgctgagttgagacttgtgggagagtatgggcttcgctgcaagagggaactctggagggttcaatatgcactgagccgcatccgaaatgctgcgagggatcttctcactctcgatgagaagaacccacgccgtattttcgagggtgaggctcttctcaggaggatgcacaggtacggcttcttggaagagagccagaacaagcttgattatgtgttggccctcactgtggagaactttcttgagcgtcgtctccagacccttgtgttcaagagtggcatggctaagtcaattcaccatgctcgagtgctcatcaggcagaggcacattagggttggaaggcagcttgtcaacattccctcatttgtagtgagggttgattcccagaagcacattgaattctcactgacaagtccattcggaggtggccgccctggaagagtgaagagaaggaacatcaaggctgctgccaagaaggccgcaggtggagatggagatgaagaggatgaagaataaattacctgtgtgaacagatagtttttttatggttacagtaggaattctggctgaactttgcaagtggacttatcttctctaagttttatgtttttgtttgcgaattttcttgctataataggaggttttgcttgctttgtgtcgcatatctatagatagatagatagataggtagtttctgctcctggagagtttcatttatcgagaataagcttgggctttagatgggtttgtaatcagctctctcattgggtgcgactcgtgcttgggcttcacgtgggctgttcacacgagattagaatattttgcggtgctcgcacacacgtgtgaaaagcgtagcataagcatgtgttcctttcacctcttaatattcttttaaaatctcagtttgtaaaattacgtcaaagtacaaatataaatttaattaaactaaaacttaatg

SEQ ID NO: 2940 - DNA, 789 bp, Cleome spinosa
actctctgtttcccggtttcctccatccgagtctgcgagagacggagacgaagagatggtgaacgtcagctactaccgcaattatggaaagaccttcaagaagccccgtcgcccttacgagaaggagcgtttggatgctgaactgaagctggttggagagtatggtctccgtaacaagcgtgagctctggagagtgcaatatgctcttagccgcatccgtaatgcggctagagatcttctcactctcgacgaaaagaatcccaagaggatttttgagggagaggccctccttcgtcgtatgaacagatacggtcttctggatgagagccagaacaagcttgattacgtcctggctttgactgttgagaacttccttgagcgccggcttcagactctcgtcttcaagtctggtatggcgaagtccatccaccatgcccgtgtcctcatcagacagaggcatatcagggttgggaagcaactggtgaacataccatcgttcatggtgagagtggattctcagaagcacatagactttgctttgacaagtccctttggcggtggccgtcccggtagggtcaggagaaagaatgagaaggctgcctccaagaaggcctctggcggcgacggagacgatgaggatgaagagtaatttaggccttcggttcagccaaaccggttctggtattgaagatttcggttcatctgctatggttacattgcacttggttatgctcattcgcattgttgttaaattttgacgtgtttcttgcaagattgttctcctctttt

SEQ ID NO: 2941 - DNA, 1036 bp, Vitis vinifera
tccacagccctcttctcaatctccatcgcctccccaactttgcttaacgacgacaccaccggcggggaagaaccatggtccacgtctccttctaccggaactatggaaagacatttaagaagcctcgacggccatatgagaaggaacgtttggatgctgagctgaagcttgttggagaatatgggctccgatgcaagagggaactgtggagggtccagtatgttcttagccgcattcgcaacaatgcaagaatgcttctcacccttgatgagaagaatccacggcggattttcgagggtgaagcccttttgaggaggatgaacaagtatgggctgttggatgagagccagaacaagcttgattatgtgttggcccttactgtggagaactttcttgaacgtcgcctccaaactctagtattcaagtcaggcatggcaaagtcaatccaccatgccagagtgctcatcaggcagaggcatatcagggtgggcaggcaggtggtcaatattccctcattcatggtgagggtggagtcacagaagcacattgatttcgctaacacaagtccccttggtggtggtcgccctgggagagtgaagagaaagaacttgaaggcagctgccaagaaggctgctggtggagatggagatgaagaagatgaagattgaacccttgcacccaaaagtagtcaatagctatgagattagaaaacatggaccagaggttttaatatcagcgcatatttgatggatatgttaaattttaatagggagttttgtttgctttttatatcacatcattccaaatgtcatgaagtaatagtttgttaattattttttggggggtgggggtattgtgacctattgtgaaagacagaaggtacgtggattctataaatgataaggcatattcttccttctctatttttgttttttgccactgattgaggtgtcgtgtactgtctgggtgtggtcgttaatatgaaagagatgatgaaaattttctggcatttctgctatatatgttaggcttggag

SEQ ID NO: 2942 - DNA, 886 bp, Pinus pinaster
gttgtttaggacagagccaagcggaccaagggggagctgttgcagccatggtccacgttaacttctatcgcaactatggaaagacttttaagaaacctcgccgtccttatgagaaggaacggctggatgctgagctgaagttggttggagagtatggactccgcaacaagagagaactttggagggttcagtatacactgagtcgcattcgaaatgcagcaagaatgcttcttactcttgatgagaagaatccacgaaggatttttgagggtgaggccttgttgcgtcggatgaataggtatggacttcttgatgagactcagagcaagcttgattatgtcttggccttgacagtcgagaatttccttgagcgacgacttcagaccctggtgtttaagtctgggatggctaagtcaatccaccatgctcgtgttcttatcaggcaacgtcacatcagagttggtaggcaggtggtgaatattccatctttcatggttagagttgactcacaaaagcatattgacttttctttaacaagccctcttggagggggccgacctggacgagtgaagcggaagaacatgaaggcagcctcaaagaaggcaggaggtgaagacggagaggaagaggacgacgaatgagaatataagcaatatcatttgcgactatagatcagaattaaatgcagtactttagagtgttttgttagctgttggtccaaacttgtctattagagatgaatgctttgggcagattataaattgacatatctttgatatgatatgcgctgcactgcaattttgttctgagcctttacttttgtcacaaaagaggcttaagtggaacatccaagttttattattgtcattaagcaactaaatttaat

SEQ ID NO: 2943 - DNA, 914 bp, Mimulus guttatus
cttcttcatttcctctgcattttctctctctgcttcagccgacggtagcctgacacaatggttcacgtttgcttctaccgcaactatgggaagacattcaagaagcctcgacgcccgtacgaaaaggagcgtctggatgcagagcttaagctcgttggagaatacgggctccgttgtaagagggagctatggagggtgcaatacgcactgagccgtatccgtaacaatgcaaggatgcttctcactctagatgagaaagacccaaaaagaatcttcgagggtgaggcccttcttcgaaggatgaacaagtacgctcttttggacgagagccagaacaagctcgattacgtgttggcactcactgttgagaactttctagaacgccgccttcagacacttgtgttcaaggccggcatggctaaatcgattcaccatgctcgtgttctcatcaggcagaggcacattagggttggaaggcaggtggtgaatgtcccgtctttcatggttagagttgactctcagaaacacattgacttttctctcactagcccgttcggtggtggtcgtcccggtagagtgaagcgaaagaaccagaaagctgcttccaagaaatctggcggtggtggtgaagaagaagaggacgaggattaagcatttcctttcagttattaaaaaaatcgttttaacttgttttgccaatttcatgtttgaagctccgtggagtatcggttgtgtcgacttttatcccgttcttttttttaatctcttgttttagcctttttgttggtatgagatgacagttagcaaagaattttgttgtttgagttgcaatatcaatgactatttataggttctgatatattttgattatgcatttaatcattttataatatatctaaatggcattaatcact

SEQ ID NO: 2944 - DNA, 1268 bp, Quercus alba
cgtgtctctaaattcccgggatttgtatatccaattctaacattagggttttagggttcccttataaagcacaaagtcgctcacaccttcactttcctcctagctagctcatccgagagagagagagagagagcagccatggttcacgttgttttctatcgcaactatgggaagacctttaagaagcctcgccgcccatatgagaaggagcggttggatgctgagttgaggcttgtgggagagtatgggctgcgatgcaagagagagttgtggagggttcagtatgctcttagccgtattcgtaacaatgcaaggatgcttctgaccctcgatgagaagaactctcgtcgaatctttgagggtgaggctcttctccgaaggatgaatcggtatgggcttttggatgagagtcagaacaagcttgattatgtcttggccctgactgtggagaacttccttgagcgtcgtcttcagacacttgtcttcaagtcaggaatggccaagtccatccaccatgctcgagtgctcattaggcagaagcatatcagggttgggaggcaggttgtgaatattccatctttcatggtgagggttgattcacagaagcacattgatttctcgcttaccagtccatttggtggtggacgacctggaagagtgaagagaaggaatcagaaggcagctgctaagaaggctgctggtggagatgcagatgaagaggatgaagaataagtgatgggttaggacctttactagtaatactaccagtaggactgaggtctcaactgtgttgaactttcaacgttttgcttgcaatgtttagtatcactttaagtgagaatagaaatagcttgttgttatttatatgtacaatgtgtgttttcttggcttaaaaatgtgtgtcgaacccaatggcagaggaaattcattatggatgattgctagctagagtttcagctgtcatttatgagccttctaggcctgttaaattatacatgggatgtgcttattggatatgttagtgtgtgataaatcagttgccagtgttcacagccttttgggtcgtgcagttctttaggcgtagtacattgagttccttaattaaattcaaatgcaaaattgtattaaatttaattgtcttttggaaagataaaattgtttgtgtttcattagtttatgtaaccatgtgcttgaatatagttagagagctgtacctaagttttaagttttgctcattagaccaaaaaaaaaaagttaagctgatacta

SEQ ID NO: 2945 - DNA, 662 bp, Lippia dulcis
tcagcgactcaggcatggtgcacgtcaatttttaccgcaactatgggaagaccttcaagaagcctcgccgaccctacgagaaggagcgtctggatgctgagctaaagcttgttggagaatatgggcttagggccaagagggagctgtggagggtgcaatatgcattgagtagaatccgaaacaatgctagaatgcttctcactcttgacgagaaagatcctcgtcgtatctttgaaggtgaagcccttctcagaaggatgaataggtttggattactggatgagagccagagcaagcttgattatgttttggctctcactgtagagaactttcttgagcgccgccttcaaacacttgtgtttaaagctggaatggccaagtctattcaccatgctcgtgtgcttatcaggcagagacacattagggttggaagacaggttgtgaatgttccatctttcatggtgagggttgactcacagaaacacattgacttctctctcacaagtccgtttggcgggggccgccctggaagagtgaagagaaggaaccagaaagccgccgcaaagaaagctggtggtggcggcgatgaagaagaggatgaggattaagctcttctttcatagaacacataaaacgttgtttccattgtgtttctttagttt

SEQ ID NO: 2946 - DNA, 832 bp, Lippia dulcis
acctaattgtattatacacatctctgcgaaatttccgacttcttcagccgcgtagcttcttacaatggtgcacgtcaatttctaccgcaactatggtaagacgttcaagaagcctcgtcggccttatgagaaggagcggttggatgcggagctcaagcttgttggagagtatgggctcaggtgcaagagggagctttggagggtgcaatacgctctgagtcgcatcagaaacaatgctaggaaccttctcacccttgatgagaaggatccccggcgtatctttgaaggcgagtcccttcttcgtaggatgaacaggtatgggcttttggatgaaagccaaaataagctcgattacgtgctgtccctcactgtggagaactttcttgaacgccgccttcagacccttgtgttcaaggctggaatggccaagtcgattcatcatgctcgtgtgctcatcagacagaggcatattagggtgggaaggcaagtagttaatgtggcgtcctttctggtgagagtcgattcacagaaacatatagacttctcgcttactagtccctttggtggtggtcgtgctggtagagtcatgcgaaagaatcagaaagccgcagcaaagaaggctggtggtggtgatgatgaagaggatgaagaataagcgtattgtgagatacttcagttgtaacgtttcattgctctttatgaattcctcttgttttctttttgatgctctgtcttgctgtttgtcacttcttttcttagtatgagattttaactaacgttttgttacttaaattacaagaatgaaatgaactggatatttccagttctggta

SEQ ID NO: 2947 - DNA, 1231 bp, Pinus taeda
ggccaaattacacacttctaaactctttgaaagcttaaccctccgtctcacctcaaattaggttttaggttttagggtttgtgagaaggcatcatattttaacttcgaccagttttcgtcaaatcctttggctatctgtattgttgtttaggacagagccaagcggaccaaggaggagctgttgcagccatggtccacgttaacttctatcgcaactatggaaagacttttaagaaacctcgccgtccttatgagaaggaacggctggatgctgagctgaagttggttggagagtatggactccgcaacaagagagaactatggagggttcagtatacactgagtcgcattcgaaatgcagcaagaatgcttcttactcttgatgagaagaatccacgaaggatttttgagggtgaggccttgttgcgtcggatgaataggtatggacttcttgatgagactcagagcaagctcgattatgtcttggccttgacagtcgagaatttccttgagcgacgacttcagaccctggtatttaagtctgggatggctaagtcaatccaccatgctcgtgttcttatcaggcaacgtcacatcagagttggtcggcaggtggtgaatattccatctttcatggttagagttgactcacaaaagcatattgacttttctctaacaagtcctcttggaggaggccgacctggaagagtgaagcggaagaacatgaaggcagcctcaaagaaggcaggaggtgaagacggagaggaagaggatgacgaatgagaatataagcaatatcatttgcgactgtagatcagaattaaatgcagtactttagagtgtttttgtagctgttggtccaaacttgtctattagagagtgttgggcagattataaattgacatatctttgatatgataagcgctgcactgcaattttaatctgagcctttacttttgtcacaaaagaggcttaagtggaacatccaggttttattattgtcattaagaaactatatttaattttcctcctttaagcaattggttttactgttggtcatatttttcattttctgtctctaccaagtttttttaaattaatatttttcctgtagggcaaagttaaattgccaaagcaagggaagccgttattgttctgtgatgctgattgattctgttgttgcaacttaagaaattggatagtgtaaaagacacctcatgttctattgcta

SEQ ID NO: 2948 - DNA, 925 bp, Papaver somniferum
ttagttttctattctgggggtcgtttagggtagggtaaggagggaagaagaagaaagaccagagagaaaccggcgtagcaaagatggtacactttgccgtctacaggaactatggtaagactttcaagaagccaagacgtccttatgagaaggagcgtttggatgctgagttgaagcttgttggtgagtatgggttgaggtgtaagagagagctctggagggtccagtatgctttgagccgtatccgtaatgcagctagaaatcttcttactcttgatgagaaggacccacgccgtatctttgagggagaagctcttcttcgaaggatgaacaggtatgggcttttggaggagagccagaacaagctcgattatgtcttggccttgactgttgagaacttccttgagcgtcgtcttcagacactagtcttcaagtctggaatggcaaaatccattcatcacgcccgtgtccttatcaggcagagacacatcagggttggaaggcaggtggtgaacatcccatctttcatggtgagggtcgactcacaaaagcacatcgacttctcactcaccagtcctcttggaggtggacgtccaggaagagtgaagagaaggaaccaaaaggcagctgccaagaaggctgctggaggagatggggacgaggaggatgaggattaagctttgaaatataacccttgctaaaggaccaacaatatatttattatgtggagggtttcctttgatagataggccatgtcagacgttttgcttgtgttgtagttgcagttgttgggcatctactatttggacatccaattttaggccgaatatgtttagagtctttagacgaagttttgctcatttctttttaaatttagtaagacttgaaatgtgttcatgttatgaaagattttgagtttcttatc

SEQ ID NO: 2949 - DNA, 904 bp, Papaver somniferum
aggcggctttttggaagaacagaccagagagcaaacgaaaccggcgacgcagagtttggaaggatggttcattttgctgtttacaggaactacgggaagactttcaagaagccacgtcgtccttatgagaaggagcgtttggatgctgagttgaagcttgttggtgagtatggtctcaggtgtaagagagagctttggagagttcagtatgctctgagccgcatccgtaatgcagctagaatgcttctcactcttgatgagaagaattcacgccgtatctttgagggtgaagcccttcttcgcaggatgaacaggtatggtcttttggatgagagccagaacaaacttgattacgtcttggccttgactgttgagaactttcttgagcgccgtctccagacactcgtcttcaagtcgggcatggcaaaatccattcaccacgcccgtgtcctcattaggcagaggcacatcagggttggaagacaggtggtgaacatcccatcttttatggtgagagtcgaatcacagaagcacattgatttctcactcaccagtcccctcggaggtggacggccaggaagagttaagagaaggaaccagaaagcagctgccaaaaaggctgctggaggagacggagacgagcaggatgaagattaagttttgatttttatcttaaaacctcaatagcatttactatagatagaggctgtctcagactttttgtttgtgtgtagttgcagatgttgggcatgttatggaagattttgtttttgtttttggattcattgtttagtttcatgatcaatagcgagatatttgcctaataggacagcctcctatgtgtagttctctcatctcatgggtgtaccccattgaggaaaacatttagtagacaaatgattga

SEQ ID NO: 2950 - DNA, 931 bp, Papaver somniferum
taggtaggttagtaggtaagtaagtaagaaagaccagagagaaaccggcgtagcaaagatggtacactttgctgtctacaggaactatggtaagactttcaagaagccaagacgtccttatgagaaggagcgtttggatgctgagttgaagcttgttggtgagtatgggttgaggtgtaagagagagctctggagagttcagtatgctttgagccgcatccgtaatgcagctagaaatcttcttactcttgatgagaaggacccacgccgtatctttgagggagaagctcttcttcgaaggatgaacaggtatgggcttttggaagagagccagaacaagctcgattatgtcttggccttgactgttgagaacttccttgagcgtcgtcttcagacactagtcttcaagtctggaatggcaaaatccattcatcacgcccgtgttcttatcaggcagagacacatcagggttggaaggcaggtggtgaacatcccatctttcatggtgagggtcgactcacaaaagcacattgacttctcactcaccagtcctcttggaggtggacgtccaggaagagtgaagagaaggaaccaaaaggcagctgccaagaaggctgctggaggagatggagacgaggaggatgaggattaagctttgaaatgtaacccttgctaaaggaccaacaatatatttattatgtggagggtttcctttgatagatagggcatggcagactttttgcttgtgttgtagttgcagttgttgggcatctactatttggacatccaattttaggctgaatatgttcagagtctttagacaaagttttgttcatttctttttaaatttagtaagacttaaaatgtgttcatgttatgaaagattttgagtttctcatctgattcacttttttaccaccatgttcacttt

SEQ ID NO: 2951 - DNA, 801 bp, Papaver somniferum
cagagagcaaacgaaaccggcgacgcggaatttggaaggatggttcattttgctgtttacaggaactacgggaagactttcaagaagccacgtcgtccgtatgagaaggagcgtttggatgctgagttgaagcttgttggtgagtatggtctcaggtgtaagagagagctttggagagttcagtatgctctgagccgcatccgtaatgcagctagaatgcttctcactcttgatgagaagaattcacgccgtatctttgagggtgaagcccttcttcgcaggatgaacaggtatggtcttttggatgagagccagaacaaacttgattacgtcttggccttgactgttgagaactttcttgagcgccgtctccagacactcgtcttcaagtcgggtatggcaaaatccattcaccacgcccgtgtcctcattaggcagaggcacatcagggttggaagacaggtggtgaacatcccatcttttatggtgagagtcgactcacagaagcacattgatttctcactcaccagtcccctcggaggtggacgaccgggaagagttaagagaaggaaccagaaggcagctgccaagaaggctgctggaggagacggagacgaggaagatgaagattaagttctgattttatatctttgttaaaacctcaatagtatatactatagatggaggctgtctcagactttttgtttgtgttgtagttgcagatgttgggcatgttgtggaagattttttggttttgtttttggattcattgtttagtttcatgatcaatagagagatatt

SEQ ID NO: 2952 - DNA, 784 bp, Papaver somniferum
tttaggaggtagaggcagaagaagaaagactagagagaaaccggcgtagcaaagatggtacacttcgctgtctacaggaactatggtaagactttcaagaagccacgacgtccttatgagaaggagcgtttggatgctgagttgaagcttgttggtgagtatgggttgaggtgtaagagagagctctggagagtccagtatgctttgagccgtatccgtaatgcagctagaaatcttcttactcttgatgagaaggacccacgtcgtattttcgagggagaagctcttcttcgaaggatgaacaggtatggtcttttggaagaaagccagaacaagcttgattatgtcttggccttgactgttgagaacttccttgagcgtcgtcttcagacactagtcttcaagtctggaatggcaaaatccattcatcacgcccgtgtcctgatcaggcagagacacatcagggttggaaggcaggtggtgaacatcccatctttcatggtgagagtggactcacaaaagcacattgacttctcactcaccagtcctcttggaggtggacgtccaggaagagtgaagagaaggaaccaaaaggtagctgccaagaaggctgctggaggggacggtgacgaggaggatgaggattaagcattgaaatgtaatccttgctagaggaccaacaataatatatattgtggagggtttcctttgatagataggccatgtcagactttatgcttgtgttgtagttgggcatctactatttggacatccatttttaggc

SEQ ID NO: 2953 - DNA, 973 bp, Sequoia sempervirens
aagaacaggcggaggcagaggagcttctgcggcagccatggtgcacgttagcttttatcgcaactatggtaagacttttaagaaacctcgtcgtccttatgagaaagaacggttggatgctgagctaaagttggttggagagtatggtctccgaaacaagagagaactctggagggttcagtatgccctgagccgtattcgtaatgcagcaagaatgcttcttactcttgatgagaagaattcccgtcgactttttgagggtgaggctctgctgcgtcgcatgaacaggtatggacttcttgatgaaagtcagaacaagcttgattatgttttggcattgacagtcgagaacttccttgagcgccggctccagacccttgtgttcaagtctgggatggccaagtcaatccaccatgctcgtgtgctcatcagacaacgacatataagggttggccggcaggtggtgaacataccatctttcatggtcagagttgattcacagaagcacatagacttctctttaactagtcctcttggtggaggaaggcctggccgtgtgaagcgaaagaacatgaaggcagcatcaaagaaggctgcaggcggagatgaagaggaggatgaggattgagtgattgcaaaatagatagcttttacttagctgtgagatttgtttgatgctccaattccttggagcttgtgccgttgctagaaatataatgtagggacttatttaaatatatactgcagtcaagttttgttttgagcattcattcctcttcctaagagctgaagtgagagatgtttttaaaagtaaatttaacaaggatcttttgctccttatattatttgattctatggttggttgtaatttgcacttggttgcttcacaccagcttgtgttaatttctacatgtcaaggcaggggaaaataggttcttaatcttgttttgttttgggcttttggatctcttac

SEQ ID NO: 2954 - DNA, 984 bp, Trigonella foenum-graecum
aagacagatcagcatggtgcacgttgcgttttaccgaaactatggcaaaaccttcaagaaacctcgtcgtccttacgagaaggagcgtttggacgctgagttgaaactcgtcggagagtatggtcttcggtgcaagagagagctttggagggttcaatacgcgctcagccgtatccgtaacaatgcaagaactctgttgacactggatgagaagaatcctcgccggatcttcgagggtgaagcgcttttgaggagaatgtttaagcatggtttgcttgatgaaacacaaaataagctggattatgtgttggctcttactgttgagaattttctcgagcgccgccttcagacacttgtgttcaaatctgggatggctaagtctattcatcatgctagggttctcatcaggcagaggcacatcagggttgggaggcaggtggttaacatcccatccttcatggtgagggttgattcacagaagcacattgacttttcactcacaagtccattcggtggtggtcttcctggtcgtgtgaagcgaaagaaccttaaggctgcagccaagaaggcttccggtggtgatggagatgaggaggatgaagattaaataattaattcacaaatcctcttggttgtggtcatcctggtcgcgtgaactgaaagaaccttaaggctgctgcttagaaggtgtccggtggtgatgaagacgaggaggatgaagatgaaataattaatatctgctgctttcaatcttgcaatcttgcacctacctttttatttatgtctagactatttagatttttttttatcatgcatgacttttacaattttgttactgttgtttctttggtgagttaaaactatgcctgatatattttgtttttaaaacttcttttccaagtattaagttttgcttcctttgatgttctctaagatttaattgaaggctatacgtttaatggcatttctgagataatattactt

SEQ ID NO: 2955 - DNA, 839 bp, Trigonella foenum-graecum
cggcaagtagcggcggtaaaggcagatcaagatggtgcacgttgcattttaccgaaactatggcaaaaccttcaagaaaccgcgtcgtccatacgagaaggagcgtttggatgctgaattgaaactcgtcggagagtatggtcttcggtgcaagagagagctttggagggttcaatacgctctcagccgtattcgtaacaacgcaaggactctgttgacactggatgagaagaatcctcgtcggatctttgagggtgaagcgcttttgaggagaatgtttaagcatggtcttcttgatgaaactcagaacaagcttgattatgttttggctctcactgttgagaattttctcgagcgccgccttcagacacttgtcttcaaatctgggatggctaagtctatccatcatgctagggttcttatcaggcagaggcacatcagggttgggagacaggtggtgaacatcccatccttcatggtgagggttgattcacaaaagcacattgacttttcactcacaagtcctttcggtggtggtcttcctggtcgtgtcaagcgaaagaaccttaaggctgcagccaagaaggcttccggtggtgatggagatgaggaggatgaagattaaattgtgattttcttttgcttagatctgtgctctagtcttctagactttagattttctattatgcatatgacttttaccattttcctattcttgtctatcgtgtgaggaaatcctttcctgagatatgttgttttgaacttttctttccaagttttgctccattacatttgatgatttgggataattgaagattactttatggtcttattacttg

SEQ ID NO: 2956 - DNA, 926 bp, Tripterygium wilfordii
gcggtgcatcatcaagttccgcgttctggcttttcttccgttcattcctgctctcgctaattgaggagaagcggacgcagccatggtgcacgttgttttctacagaaactatgggaagacttttaagaagccgcgtcgtccttatgagaaggaacgtctggatgcggagctgaagcttgttggagaatatgggctccgttgtaagagggagttgtggagggttcagtatgcactgagccgtatccgtaatgctgcaagaatgcttcttaccctagatgagaaaaactcacgccgtatctttgagggtgaagctcttcttcgcaggatgaacagatatgggctcctggatgaaagtcagaacaagcttgattatgtcttggcccttactgttgagagcttccttgagcgccgccttcaaacacttgtgttcaagtctggcatggcaaagtcaattcaccatgcccgtgtgctcattaggcaacgacatatcagggtggggagacaggttgtcaacataccatctttcatggtgaggcttgattcccagaagcacattgacttctctctgacaagtccattcggaggtggccgcgcaggtagagtgaagagaaagaacatgaaggctgcagccaagaaagcttctggaggagacggcgatgaagatgacgaggagtaaacatgaaggctactgccaatcaagggtgatatgggatagagacggatcatgatatgatgagagtgaacattaggctagtaacaggcctagaaacatggtttcattttggtttttatggtgactgccattttaattttgtagtggatattttatgcgtcttcttttgtttgtcaattgtggattgaattaccaactatatgctgtttgagccaagtatgctatctatcttttttaatgaagagatttgatg

SEQ ID NO: 2957 - DNA, 879 bp, Vinca minor
atcaccgcagcggcgggcggcggcggaaacactcaatatggttcacgtctccttttatcgcaactatggtaagaccttcaagaagcctcgtaggccctatgagaaggagcgcttggatgctgaattgaagcttgtgggagagtatgggttaaggtgcaagagggagctttggagggttcaatatgctttgagtcgcatcagaaatgctgcaagaaatcttttgacactggatgagaaggactcgcgtcgtatctttgaaggtgaagcccttttgaggaggatgcacaggtatggtttgctggaggagtcacaaaacaaactcgattacgttttggctctgactgtagagaacttcctggagcgacgccttcagactcttgttttcaagggcgggatggccaagtcaatccaccatgctagagtgctcattaggcaaaggcacatcagggtcggaaagcaggttgtcaatgttccttccttcatggttagagtggactctcagaagcacattgacttctcaattacaagtacttttggtggtggccgcccaggtagagtgaagagaaggaacatgaaggcagctgcaaaaaaggctacaggtggtgacggagatgaagaggatgaagaatgagccctcctttttattttagtcgtcgatgatgatactggagtatgtcagtccgaccttgtcacttttgtccatgtaataccagcccctaagatttttgcagtttcaagacttttcatatatgtaggaagttttggatgattttcgaggctttcttgacaccgttaccagaatttattgtctttaagcattctaatttttcaacttctgaggaattcaaaaagcattttgagttggatgaacttatttca

SEQ ID NO: 2958 - DNA, 855 bp, Vinca minor
agcaaccctaccctaatccaccatggtgcacgtcagtttctaccggaactacgggaagacattcaaaaagcctcgccgtccatatgagaaggaacgtttggatgcagaattgaagcttgttggagagtttggactgcggtgcaagagggaactatggagggtacaatatgcacttagcaggattcgtaacaatgcaagaatgcttctcactcttgatgagaaagaccctcgccgtatatttgaaggtgaagcccttctgcgtaggatgaaaaggtatgggcttctggaagaaggtcaggacaagcttgattatgtgttggctctttctgtggagaatttccttgagcgtcgccttcaaacacttgtgttcaaggcaggaatggccaaatctatccatcatgcccgtgtgctcattaggcagaggcacatcagagttggaaagcaggtggtgaatgtcccatccttcatggttaggttggactctcagaaacacattgacttttcaattacaagtccattcggtggcggccgacctggaagagttaagcgaaagaacacgaaggctgctgccaagaaagcttctggtggtgacggtgatgaagaggatgaggaatgagcagttcatgttcagtatttgctttataactcttccaatatcagctatcttatgcgactgctagttgaaattttactatggtagatgtgctgcttttgcttgttttcttggagatatgaatagtcattttggttatgatgcgaggataataatttatatttgcttttagttgtcataacaactgctcatctccccttttttggtatctttagtatttgctttgtcactccactttacca

SEQ ID NO: 2959 - DNA, 866 bp, Vinca minor
tcgtctacctcagttcactgacggcgatcaaccctaccctaatcagccatggtgcacgtcagtttctaccggaactatgggaagactttcaaaaagcctcgtcgtccatatgagaaggaacgattggacgcagagttgaagctcgttggagagtttgggctgcgatgcaagagggaactctggagggtacaatatgcacttagcagaattcgtaacaatgcaagaatgcttctcactcttgatgagaaagaccctcgccgtatatttgaaggtgaagcccttctacgtaggatgaagaggtatgggcttttggaagaaggtcaggacaagcttgattatgtgttggctctctctgtggagaatttccttgaacgtcgccttcaaacgcttgtgttcaaggcaggaatggccaaatctatccaccatgcccgtgtgctcattagacagaggcacatcagggttggaaagcaggtggtgaatgtcccatccttcatggttaggttggactctcagaaacacattgacttttcaattacaagtccattcggaggcggccgacctggaagagtaaagcgaaagaacacgaaagctgctgccaagaaagcttctggtggtgatggggatgaagaggatgaggaatgaggagttcacgttcaatatttgctttataacaattccaatgtcagctattgtatgtgactgctagttgaaactttatcaaggtaggtgttctacttttgcttgttttttggatatatgaatagtatctttggtttatgatgtgtgaggataataatttaaatttgcttttagttgtcataccatctgtgctcattggtatctttattagtagttgctttgtcacc

SEQ ID NO: 2960 - DNA, 953 bp, Vinca minor
ttcttctttttctgagccgagcgaagcagagcagatcaccggagctgaaaatcaccgcagtggagggcggcagcagcaacaacaaccaagatggtgcacgtctcgttttatcgcaactatggtaagacctttaagaagccacgtaggccgtatgagaaggagcgtttagatgctgaattgaagcttgtgggagaatatgggttgaggtgcaaaagagagctttggagggttcaatatgctttgagccgtatcagaaatgctgcaagaaatctgttgactctggacgagaaggactcgcgtcgtatctttgaaggcgaagcccttttgaggaggatgcacaggtatggtttgctggaggagtcccaaaacaaactcgattatgtcctggctctgactgtggagaatttccttgagcgccgccttcaaactcttgttttcaagggcggcatggccaagtcaatccaccatgctagggtgctcattaggcaaaggcatatcagggtcgggaagcaggttgtcaatgttccttccttcatggttagagtggactctcagaagcacattgacttctccattacaagtacttttggtggtggccgccctggtagagtgaagagaaggaacatgaaggcagctgcaaagaaggcttcaggtggtgacggagatgaagaggatgaagaatgaggcctcttttttaattttagtcattgatatgataatactggaatatgtcagccagacctcgtctcttttgtccatgtaataccggcccctaagatatttgcagttactttcaaggcctttcatatttgtaggaagtttttgatgattttttggctttcctgacatcgattaccagaatttattatctttaagcgttctattgtatcaacttctgaggaattcgaatttcatttttgagttttaaggaactatttcatctgtcgaaattc

SEQ ID NO: 2961 - DNA, 968 bp, Zamia vazquezii
  misc_feature (905)..(905): n is a, c, g, or t
cttcttctttctgtattattgttcgtgggcaacggcgcaggccggaccgcagacaaggtggaggcggcagaggcagcgtagaaatcatggtgcacgttagtttctaccgtaactatggtaagacgttcaagaaacctaggcgtccttacgagaaggagcgcctggacgccgagctgaaactggttggagaatatggcctccgtaataaaagagagctctggagggttcagtattcgttgagccgcatccgtaatgccgccagaatgcttctgaccctggacgagaagaacccccggcgaatttttgaaggcgaggcgctgctgcgtcgcatgaaccgatacggtcttcttgatgaaagccagagcaagcttgattatgttctggcattgaccgtggagaatttcctggagcgccgactgcagactttagtgttcaagtctggcatggcgaagtcgatccatcacgctcgagttcttatcaggcaacggcacatcagggttggtaggcaggtggtgaatatcccgtcttttttggtcagagttgactctcagaagcacattgacttctcattaacaagtccacttggtggtggacgacctggccgtgtgaagcgcaagaacttgaaggcagcttcaaagaaggcatcaggtggagatggagaggaggaggatgaggattgagttttttgcttgagaactgcagtattggagtgtgtagttccaaagccgtcaattagagaacagtttttggcattgggtgactacattttaacaaatatttaatacactgctttgaagttttgtttgagttcccactcttgtttcctaagagacaaagtgaaacataattgttctttaataatatttaacaatgtatttaatgcattttaattcaaaatttaactnaaagattgaataccacagaggtaccagttggcaacaatcactttacttctggggaagcatcct

SEQ ID NO: 2962 - DNA, 633 bp, Ambrosia trifida
caacaatggttaaagtctccttgtaccgtaactatggttaaaacattttagaagccacgtcgtccttacgagaaggaacggttggatgccgagttgaagcttgtgggagagtatggtcttagatgcaagagagagctttggagggtgcagtatgcattgagccgcattcgtaatgccgcaagaatgcttttgacacttgaggagaaggacccgcgtaggatttttgagggtgaggctcttatgaggagaatgaataggtatggtttgttggacgagagtcagaacaagcttgattacgtgcttgcgcttactgtggagaactttcttgaacgtcggcttcagacacttgtgttcaagactggtatggctaagtctattcaccatgctagagttctcatcaagcagagacacatcagggttggaaggcaggtggtgaatgtgccatctttcatggtgagagttgactcacagaagcacattgacttttcacttacaagtccgtttggcggtggccgacctggaagagtgaagcgaaggaaccagaaggctgcagctaagaaggcagcgggtggtgatgcagatgaggatgatgaagaatgagctcactcttttggttccaaatgttgattattt

SEQ ID NO: 2963 - DNA, 1125 bp, Pteridium aquilinum
aatttagggttgtagtcttccccagaagggtcttttgcttacaaggccggtgctttcgcgggggctgtagcgaaggtcgagctatggtgcacgtcagtttctatcgtaattatggcaaaaccttcaagaagcctcgtaggccatatgagaaggaacgtttggatgcagagctgaagctggtgggagagtatggtctgcgaaacaagcgagagctttggagagtgcaatatgctctcagccggatacgcaacaatgcgcgtatgcttcttactctggatgagaaaaattcacgccgcatttttgaaggagaggcccttcttcgacgcatgttcagatatgggctccttgaagagagtcagaacaagctggattatgtcttggctttgacagtggaaaatttcttggagcgtcgcttgcaaacgttggttttcaaatcaggcatggcaaagtccattcaccatgcgcgtgtacttatcaagcagaggcacatcagggttgggaagcaagttgtcaatgttgcctcttttcttgtaagagtggattcacagaagcacatcgattttgcgctttccagtccctttggcgggggtaggcctggacgtgtgaagagaaggaacatgaaggctgcttcaaagaaggctgcaggcggtgacgaggaagaggaggagtagactgccaggctgaggtgaaaagattaatggagagttgtctgtagaaaggttgtcttgaattaaggccatctttactacagttcgaatctgagacctaacagttttgcaggatttagctaaaagctcttttttgttagattgagacgaggtgtgcttggatctggtacctgaatttgacaagttgctcaaggctattctagacttatctttggtctgagacaagttgtgcttgagcatgaatttcacgagtggtttaaggcttgttgctactttttgtatctgctctgtatgtttgatgtgttgtgaaggttctggcttgctgttgatgataatgtagtttggctggagaaggctgaaagtttacggtacatgcactctgtttttcccttttttatctagaagagaacttgcataatgatatgtgagtagagggttgtagttgcgtgaaaaagaa

SEQ ID NO: 2964 - DNA, 775 bp, Gnetum gnemon
agccgaggagagcgaaaacagggcaataaaaatttacgtccagccatggtacacgttagtttttatcgcaactatggaaagacatttaagaagcctcgtcgtccttatgagaaggagcgtttggatgctgagctgaagctggttggggagtatggtctgcgcaataagcgggagctttggagggtgcaatatagcctgagtcgtattcgtaatgctgcaaggatgcttctcacgcttgatgagaaaaacccacgtcaaattttcgagggagaagctctgcttcgtagaatgaacaggtatggcttgctggatgaaacccagaacaagctggattatgttctggctttaacagttgagaattttcttgagcgccgcctgcaactttggtctttaagtctggaatggcaaatcaatacatcatgcccgtgtccttattaggcaacgacatatcagaattgggagacaggtagttaacatcccatctttcatggtgagggttgattcccaaaagcacattgacttctctctgacaagtcctttgggaggtggacgcccggacgtgtgaagcgaaagaacatgaaggcagcagccaagaaggcctctggaggggatgaggatgaggatgaagaatgatctactatagaaacatcactgttagaaagttattctttgcaacccttttgcattccagtttcaagggatgttttgttagtttttgtaggcattatgtgcaacttccttttgttagctagacttgtaagaaccttagtttttc

SEQ ID NO: 2965 - DNA, 983 bp, Abies balsamea
aaaacaaaaccctccatattatatcaaagtaggttttagattttagggtttgtgagagggtcatgatatttatacccacctgttgtctcagtcgttcttttggctctgtgtattgttgtttcagacggagcttagcagaccaaaggagtagctgttacagccatggtgcacgttagcttctaccgcaactatggtaagacttttaagaaacctcgccgtccttatgagaaggaacggctggatgctgagctgaagttggtcggagaatatggtctccgcaacaagagagaactttggagggttcagtatacactaagtcgcattcgaaatgctgcaagaatgcttctcacacttgatgagaagaatccacgacggatttttgagggtgaggcccttttgcgtcgcatgaataggtatggacttcttgatgagacccaaaccaagctcgattatgtcttggccttgacagttgagaatttccttgagcgacgactccagaccctggtttttaagtctggtatggctaagtcaatccaccatgctcgtgtactcatcaggcaacgtcacatcagggttggtcgtcaggtggtgaatattccatcgttcatggtcagagttgactcacaaaagcatattgacttctctctaacaagtcctcttggaggtgggcgacctggacgagtgaagcgaaagaacatgaaggcagcctcaaagaaggcaggaggtgaagacgcagaggaagaggatgatgattgagtataggcaatatcattcgatgacattagatcaatttaagctgcatcactgtagaattttttttccagctgttgttcgaaacttgtctattagagatgagtgtttggggatgacaatataaagtagcacatctttgatatgcactgcactgcaattttgttctgagcctttaacctttgatcctaaagaggcttgagtggaacataaaagttttgttattgttattg

SEQ ID NO: 2966 - DNA, 913 bp, Arabidopsis lyrata
agcagcagcagctatggtaaacgtcagattctaccgcaactatgggaaaacattcaagaagccacgtcgtccttatgagaaagagcgtcttgatgctgagctaaagcttgtaggagaatacggtcttcgttgtaagagagagctttggagagttcaatatacacttagccgaatccgtaatgctgcaagagaacttttaacacttgatgagaagaaccctcgtcgtatctttgaaggtgaagctcttcttaggagaatgaatcgatatggtcttcttgatgaaagccagaacaagcttgattatgttcttgctttgactgttgagaatttccttgaacgtcgtcttcaaactattgtctttaagtctggtatggctaagtctattcaccacgctcgtgtccttatccgacaaaggcacatcagggttgggaggcaacttgtgaacattccatcgttcatggtgagagtagagtcgcagaagcacgtagacttctctctaacaagtccattcggtggtggtcgacctggaagagtgaagagaaggaacgagagagccggagctaagaaagctgctggtggtgatggagatgaggatgatgaagagtgaaaagtaccaaacccctaaaaaatcctcaagctaaaatactaccgaaacctacaaatatgcttttagttaataatagtttggtcttgttacctctttttgtgagatctttggtttcttagttttctttcttagtagaagaagtgaagtgtgttggtttggtgatgcgtttaggttttatgttgtggacctttgtgttcttaaaccatgtcactttcgaatcttgcttcttacaacatagtagtagttgatatttttatgtccggtgactttgcttacaagcaaaaagcttaatctataaagtagttt

SEQ ID NO: 2967 - DNA, 930 bp, Arabidopsis thaliana
aactctgtcttagttttgagcagcagcagctatggttaacgtcagattctaccgaaactatgggaaaacattcaagaagccacgtcgtccttatgagaaagagcgtcttgatgctgagctaaagcttgttggagaatacggtcttcgttgtaagagagagctttggagagttcaatatacacttagcagaatccgtaatgctgcaagagaactcttaactcttgatgagaagaatcctcgtcgtatctttgaaggtgaagctcttcttaggagaatgaatcgatatggtcttcttgatgaaacccagaacaagcttgattatgttcttgctttgactgttgagaatttccttgaacgtcgtctccaaactattgtctttaagtctggtatggctaagtccattcaccacgctcgtgtccttatccgacaaaggcatatcagggttgggaggcaacttgtgaacattccatcgtttatggtgagagtagagtcacagaagcacgtagacttttctctaaccagtccattcggtggtggtcgacctggaagagtgaagagaaggaacgagagagccggagctaagaaagcttctggtggtgatggagatgaggatgatgaagagtgaaaagtaccaaacccttaaaaaaatccctaagatgaaacactacctagctaaacctatcaaaatgcttttagttgataatagtttggttttgttacctctttttgtgagatatttggtttgttagtgttcttaattagtagtagaagtgaagtgtttttttttttttttataatgttttggaccttgtgttcttgaaccatgtcactttcgaatcttgcttcttataagatactagtagttgatattattatgtccggtcactttgcttacaagcaaaacgcttaaacaataaagtagtttaatat

SEQ ID NO: 2968 - DNA, 839 bp, Distylium racemosum
agaggaggagcggcagcagcagcttcggcagcaatggtgcacgtaagcttttaccgtaactatgggaagacttttaagaaacctcgtcgtccatatgagaaagagcgtttggatgccgagctgaagttggtaggggagtacggtctccgcaataagagagagctttggagggttcagtacgctcttagccgaattcgcaatgcagcaagaatgcttttgactcttgaagagaagaattcccgccgaatttttgagggtgaggctctgctccgccgcatgaacaggtatggacttctggatgagagtcagaacaagctcgactatgtcttggcattgacggttgagaatttccttgagcgtcgtctccagacccttgtgtttaagtctgggatggccaagtcaatccaccatgcccgtgtgctcatcaggcaaagacatatcagggttggtcgtcaggtagtaaatattccatctttcttggtcagagttgactcacagaagcacattgacttctctctaaccagtcctcttggaggtggacgacctggccgtgtgaagcgaaagaatatgaaggctgcctcaaagaaggctgcaggtggagatgaagaagaggatgaggattaagtgatttgctaagagaagataggttcagctttgctgatgtagggatcttatgtttttgtctagtgctccaatgctttgaattggagtttgtgtttttggtagcaatgtgattcagggcgtatttaagcctataattggagtttctttttatatactgcattcaaagtttgtttcgagttgtgacttgtgtttctaagagcctaagtggaaccaat

SEQ ID NO: 2969 - DNA, 855 bp, Zingiber officinale
  misc_feature (310)..(310): n is a, c, g, or t
  misc_feature (349)..(351): n is a, c, g, or t
acgtcagtttctacaggaactatgggaaaaccttcaggaagccacgtcgcccctatgagaaagagcggctggatgccgagctgaagctggtgggcgagtatgggctccggtgcaagcgagagctctggagggtccagtacgctctgagccgtatccgtaatgcggccagagaacttctcacgcttgatgagaagaaccctcgtcgaatttttgagggggaggcccttctccgccggatgaatcggtatgggctcctcgaggaagggcagaacaagctcgactatgtgctggctctcacagtggagaactntttggagcggcgtctgcagactctggtcttcaagtctgnnntggctaagtccatccaccacgctagggtcctcatcaggcagcgccacatcagagtaggaaggcaagtagtaaacatcccctcttttatggtgaggatggattcagctaagcatattgacttctccctcacaagtcctttcggtggtgggcgcccaggacgggtgaaaagaagaaatcagaaggctgcaacgaagaaggccgcaggaggggatggagatgaagatgatgaggaatgagcaacaatgtgctgccggaggtgatggagatgaagatgatgaggaatgagcaacaatgtgctgtggtagcctccacatcgttgcattttagtatatgtttctagtttgttacttttcttaaagtggcgactcataaacttattctcaaaacatgtctctgaagtttgggttttatgtattcgacatctgtgtctttaatttggcctcgagcctttcattcaattgtctgttttaaccctcgtgccgaattcggcacgaggcctcgtgc

SEQ ID NO: 2970 - DNA, 961 bp, Mimulus guttatus
gaaaccctcgtcttccatttctacggcgatcagcaacagatcggcgggagtgaaggtagcggcggcagaacaccatggtgcacgtctgtgtttatcgcaactatggcaagacttttaagaagccacgacgcccttacgagaaggagcgtcttgatgctgagttgaagctcgttggagaatacggtcttaggtgtaagagagagctgtggagggttcagtacgcactgagccgtatcagaaacaacgcaaggatgcttttgactcttgatgagaaggacccgaaacgtattttcgagggtgaagctcttctaaggaggatgaataggtatggtttgctggacgagagccaaagcaagctcgattacgtcttggcactcactgtcgagaacttcctcgagcgtcgcctccaaacccttgtgttcaaggcgggtatggctaagtctattcaccatgccagagtactcatcaggcaaaagcatatcagggttgggaggcaggttgtgaacgtgccgtcatttatggtgagaatggactcgcagaagcacattgacttctctctgacaagcccgttcggaggtggccgcccaggtagggtgaagagaaggaaccagaaatcggcatccaagaaggcgtctggcggtgatggagacgaagatgatgaagaatgagtgagtgaggtgtaagtgttcgatttatttacttgtttaatgttactttcgagaagcagcattttctcattccatttcatctgctgcttatgtagtgactgtgtcatgttttgaaactatcggtgctttttttcttagataatttatggattatgatgaattcttatgctctgtttctttatatgtgttgtttttgttgagagacttgtattgaagttaagagttttttatggattatgatgaattcttatgctctgtttctttatatgtgtcgtttttgttgagacacttga

SEQ ID NO: 2971 - DNA, 983 bp, Nuphar advena
  misc_feature (669)..(669): n is a, c, g, or t
  misc_feature (683)..(683): n is a, c, g, or t
  misc_feature (701)..(701): n is a, c, g, or t
  misc_feature (703)..(703): n is a, c, g, or t
  misc_feature (705)..(705): n is a, c, g, or t
  misc_feature (721)..(721): n is a, c, g, or t
  misc_feature (744)..(745): n is a, c, g, or t
  misc_feature (747)..(747): n is a, c, g, or t
  misc_feature (765)..(765): n is a, c, g, or t
  misc_feature (787)..(787): n is a, c, g, or t
  misc_feature (790)..(790): n is a, c, g, or t
  misc_feature (800)..(800): n is a, c, g, or t
  misc_feature (803)..(803): n is a, c, g, or t
  misc_feature (805)..(805): n is a, c, g, or t
  misc_feature (813)..(815): n is a, c, g, or t
  misc_feature (819)..(819): n is a, c, g, or t
  misc_feature (823)..(823): n is a, c, g, or t
  misc_feature (826)..(826): n is a, c, g, or t
  misc_feature (830)..(830): n is a, c, g, or t
ggcagacagagagagcgtcctgttgctgcttctgttggggctctccttcaccatcggccatggtgcacgttagcttctaccgcaactatgggaaaacgttcaagaagccccggcgtccctacgagaaggagcgtctggacgccgagctgaagctggtcggagagtacgggctccggtgcaagagggagctctggagggttcagtacgcactcagccgtatcagaaatgctgccagggagctcctcactctagatgaaaagaacgagcgcaggatcttcgagggtgacgccctgctgcggcggatgaaccagtatgggcttctggacgagagccagaacaagctcgattacgttctggccctaaccgtcgagaacttccttgagcgccgtctccaaacacttgtgttcaagtcagggatggccaagtcgattcaccatgcccgagtcctcatcaggcagaggcatatcagggttggtaggcaggtggtgaacattccatcgtttctagtgcgtgtagattcacagaaacacattgacttctcactgacaagcccactgggtggaggacgccctggtcgtctgaagcgaaagaatctcaaggctgcatccaagaaggctgctggtggtgatggagacgaagaggatgaggattgagaaattaagcttctcnttcccctatacttngaaacaatcttttttaancntngactattattccttcncatatttccatcttcctaccganngnttctgtctggtagctttntagctttttctttttggtgatnctncagtaacttngcntntgttggannntttntttnttntttntctggcatcaatttttgcttcctgctggaggatatattcacagttcatggcagtgaatttgaatttttgttgagtatattagcggttttctattgctgtgctgaaatgtattttattgtaattcaatatttggcagaagacgaagaacatgcc

SEQ ID NO: 2972 - DNA, 897 bp, Raphanus sativus
ggagagatcactctcctctctgttttgtgtctgcagccatggtgcaagtcaggttctaccgcaactatggcaagaccttcaagaagccgcgacgtccttacgagaaggagcgtcttgacgccgagctgaagcttgtcggagaatacggtcttcgttgcaagagagagctgtggagggttcagtacgcgcttagccgtatccgcaacgctgccagagagcttctcaccctcgacgagaaaaaccctcgtcggatctttcaaggtgaagctcttcttaggaggatgaacacgaatgggcttcttgatgaatcccagaacaagctcgactacgttcttgctttgactgttgagaatttcctcgagcgccgtctccagactcttgtcttcaagtccggtatggccaagtccattcaccacgcccgtgtccttatccgacaaagacacatcagggttgggaggcaactggtgaacattccatcgttcatggtgaaagtagactcgcagaaacacattgacttttctctgaccagtccatttggtggtggtcgacctggaagagtgaagagaaggaacgagagagctggagccaagaaagccggtggtggtggtgatggagatgaggatgatgaagagtgaaagtaccaaaccttttaaaaccctccattgttagataaataatgtatttggagttgttttcttgaactagatgaagtcaagtgtgttggtttgtaatggatttagccttttatgtggtgtgtgttttgcaataatgtggtagtggacctctatgttcttgcttgaacaatgatgccactttcagatcttgtttttttagtaatgtatgttgtggtcgaaaatgcaaatcgtaacacgatagggatgcttggccacttgattg

SEQ ID NO: 2973 - DNA, 706 bp, Rosa hybrid cultivar
gattccctcgcctcctctcactccttggcagctcgcgcttaccctcttctcggagatctgaaggaggaacccaaccatggttcacgtcgtcttctaccgcaattatggaaagactttcaagaagccaagacgtccctatgagaaggaacgcttggatgctgagctgaagcttgtaggagaatatgggcttcggtgcaagagggagttgtggagggttcagtatgctttgagccgcatccgtaatgctgccagggaacttcttaccctggatgagaagaatcctcgccgtatctttgagggtgaggctcttctgcgcaggatgaacaggtttgggcttctggaagagagccagaacaagctcgattacgtccttgcactcactgttgagaacttccttgagaggcgtcttcagacccaagtgtttaaatctggtatggccaagtccatccatcgcgccagggttctcatcaggcaaaggcacatcagggttggaaggcaggtggtgaacattccatcattcatggtgagaattgattctgagaagcacatcgactttgccatcacaagtccccttggaggaggccgccccggaagagtgaagagaaggaaccagaaggccgctgccaagaaggcagctggtggtgatggagacgaggaagatgaggaatgagcaatgaattgacctgtcatttgaatctcatttaag

SEQ ID NO: 2974 - DNA, 1022 bp, Sciadopitys verticillata
tggaaccaagccctaacttatgtcagttcgagatcgacttcccaattagggttttgtttgaggcgctagggttttgacttaatctgagattgctgttcttcgtagttttgctactccggtcgcgcggagaagtagtagaggaggaagaggaggaggaggaggaggaggatcaactgcaggaaggaagcaagcagacccagaggaggcatggtgcacgtcaatttttaccgtaactatgggaagacattcaagaagccgaggaggccgtacgagaaggagcggctggatgcagagctgaaactggtgggagagtacggactgaggaacaagagggagctgtggagggtgcagtacacactcagccgcatccgtaacgccgctagaatgcttctgactttggacgagaagaaccacaggcgtatattcgaaggggaggctctgttgcggaggatgaacaggtatgggctgctggacgagagccagaacaagctcgattatgtcttggctctcaccgtcgagaactttctggaacgccgcctgcagactctggttttcaagtctggcatggccaaatccatccaccacgcccgcgttctcatcaggcaaaggcacatcagggttggtaggcaggtggtgaatattccatctttcatggttagagttgattcacaaaagcatattgatttctcacttacaagtccacttggtgggggacgacatggtcgtgtgaaacgaaagaacacgaaggcagcatcaaagaaggctgctggtggagatgcagaagaagaggacgaggaatgaggcatataagggtgctttcagccaaaaaacgtttgctagatctctcttttttttaacattacacctgtcagattcaaaggatgaatgttgatcagagtattttggttgctattagatgatggcgaactttggtaaaagttgtagacatcaaattaaaatttgtctcacatttattaaaatgcagagctattttgacaataactacaaattgtgatattttc

SEQ ID NO: 2975 - DNA, 932 bp, Selaginella moellendorffii
gctgatcgtagggcttagagcgaacctagggtttagggctctagggtttagatcttgccggcgggcgagcgggagcgctggaggatcggcgatggtgaacgtcagcttctaccgcaactatgggaaaactttcaagaagccacggcggccattcgagaaggagcgcctggacgcggagctcaagctggtgggcgagtatggcctgcgcaacaagcgcgagctgtggcgactccagtacgtgctgagtcgcatccgcaacgccgcgcgccacttgctcacgctggacgagaagaacccgcgccggatcttcgagggcgacgcgctcctccgccggatgcatcgctatgggctgctcgaggagggccagaacaagctggattacgtgctggcgctcaccgtggagaacttcctcgagcgccggctccagactctggtgttcaaggcgggcatggccaagtcgatccatcacgcgcgcgttctcgtcaggcaaaggcacatcagggtcgggaagcaaatggtgaacgttccatccttccttgtccgcgtcgagtcccagaagcacatcgattttgcactgacgagcccgttcggaggtggcggcccggggcgcgtcaagaggaagaacatgaaggcggcatcgaagaaggcctctggcggtggcgacggagacgaagaagaagaggagtgagcgagcgtgcttccgtttccattttccagcggagatcttcctcgcagctaagtctagttattaaaatctaatcgtttgaagagaacaatataacgcgatttcttgcgagggctctacactccacaaagatcatgaaggtcgaagagattgagcgcctcatgcttgagccgctatccccaactccaagctgcttcctttctctctcccactttgatatgaaatacatcttccatccctatatgca

SEQ ID NO: 2976 - DNA, 727 bp, Selaginella moellendorffii
gcaggctctagggttcttgcgcgcggcggagggggcgaggaggaggatcgatcagcaatggtccatgtctgcgtctaccgcaactatgggaaaactttcaagaagccgcggcggccattcgagaaggagcgcctggacgcggagctcaagctggtgggcgagtatgggctccggaacaagcgagagctgtggcgcgtccagtatgtcttgagccggatccgcaatgcgtcgcgacacttgctcacgctggacgagaagaacccacgccggatctttgagggagaggcgctgctgcggcggatgcatcgctatgggctgctcgaggaggggcagaacaagctcgattacgtcctggctctcactgtggagaacttccttgagcgccggctgcaaactctggtcttcaaggcgggcatggccaagtcgatccatcacgctcgcgttctcgtcaggcaaaggcacatcagggtcgggaagcaaatggtgaatgttccatcgtttctggttcgtgtggaatctcagaagcacatcgatttcgcactgacaagcccgtttggaggcggcggtccagggcgtgtcaagaggaagaacacgaaggccgcgtctaagaaggctgcagggggtggcgatggagacgaagaagaagaggagtaacaatgtgaatcttcttttaactaagagttttggtttatcctttctcgcaaattaaattttccagttgagcttc

SEQ ID NO: 2977 - DNA, 1273 bp, Picea glauca
attgcaaattacacagggcgaaccacttcgaaaacaaaatccttcgtgtgacatcaaattaggttttaggttttagggtttgtgacaagccatgatatttaaacttagcagctctctttaactcctttggctctctgtttttttgtctaagacggagccaagcagaccaaaggagcagctgttgcagccatggtccacgttaacttctatcgtaactatggtaagacttttaagaagcctcgccgtccttatgagaaggaacggctggatgccgagctgaagttggttggagagtatggcctccgcaacaagagagaactttggagggttcagtatacactgagtcgcattcgaaatgctgcaagaatgcttctcactcttgatgagaagaatccacgacggatttttgagggtgaggccttgttgcgtcggatgaataggtatggacttcttgatgagtctcagagcaagctcgattatgtcctggctttgacagtcgagaatttccttgagcgaagactccaaaccctggtgtttaagtctgggatggctaagtcaatccaccatgctcgtgttcttatcaggcaacgtcacatcagggttggtcgtcaggtggtgaatattccatcttttatggtcagagttgactcacaaaagcatattgacttttctctaacaagtcctcttggaggggggcgacctggacgagtgaagcggaagaacatgaaggcagcctcaaagaaggcaggaggtgaagatggagaggaagaggatgatgattgagtataagcaaaatatcatttgcggacaatagatcagatttaactgcagtactgtagagttctttttagctgttagtccaaacttgtctattagagatgagtgttttgggatgattataaattagcacatctttgatatgcactgcactgcaattttgttctgagcctttatttttgttctgaaagaggcttaagtggaacataaaagttttattattgtcattgagcaactatatttgacttgcctcctttaagcaattggttttaatgttagtcataattttcattgcccgtttttatacctagctttgttaagtttaaaattttgctggagggcaaagtaaaattgccaagcaaggggagctgttagtgttctctgatgttgattgactctcttgttacaactttcagaaactggatagtgtaaacctaaagaggatttggctgaagacgttttgcatgatatgataggacccctcatgttctattgc

SEQ ID NO: 2978 - DNA, 1285 bp, Picea glauca
aatgccttgtctaacctctaaatcattaaagaccttgctacgacaaccttttatattctgtccctttggcatcgattagcgttttaatatcattgcaaattacacagggcgaaccacttcgaaaacaaaatccttcgtgtgacatcaaattaggttttaggttttagggtttgtgacaagccatgatatttaaacttagcagctctctttaactcctttggctctctgtttttttgtctaagacggagccaagcagaccaaaggagcagctgttgcagccatggtccacgttaacttctatcgtaactatggtaagacttttaagaagcctcgccgtccttatgagaaggaacggctggatgccgagctgaagttggttggagagtatggcctccgcaacaagagagaactttggagggttcagtatacactgagtcgcattcgaaatgctgcaagaatgcttctcactcttgatgagaagaatccacgacggatttttgagggtgaggccttgttgcgtcggatgaataggtatggacttcttgatgagtctcagagcaagctcgattatgtcctggctttgacagtcgagaatttccttgagcgaagactccaaaccctggtgtttaagtctgggatggctaagtcaatccaccatgctcgtgttcttatcaggcaacgtcacatcagggttggtcgtcaggtggtgaatattccatcttttatggtcagagttgactcacaaaagcatattgacttttctctaacaagtcctcttggaggggggcgacctggacgagtgaagcggaagaacatgaaggcagcctcaaagaaggcaggaggtgaagatggagaggaagaggatgatgattgagtataagcaaaatatcatttgcggacaatagatcagatttaactgcagtactgtagagttctttttagctgttagtccaaacttgtctattagagatgagtgttttgggatgattataaattagcacatctttgatatgcactgcactgcaattttgttctgagcctttatttttgttctgaaagaggcttaagtggaacataaaagttttattattgtcattgaacaactatatttgacttgcctcctttaagcaattggttttaatgttagtcataattttcattgcccggttttattacctagctttgtttaagtttaaaattttgcgtggagggcaaagtaaaattgccaagcaaggggagctgttagtgttctctgatgttgattgactctcttgttacaactttc

SEQ ID NO: 2979 - DNA, 839 bp, Fragaria vesca
tttcagaggatagagagaaagagaggcaccaatcgccgccgtgacggagtgaagcagccatggttcacgtcgtgttctatcgcaactatggcaagacattcaagaagcctcgtcgtccttatgagaaggagcgtttggatgctgagctgaagctggtgggagagtatgggctgcgttgcaagagagagctctggagggttcagtatgccctgagccgaatccgtaacaatgcaaggatgcttttgacccttgacgagaagaacccccgtcggatctttgagggtgaggcgcttctccggaggatgaaccgttatgggcttttggaggagggtcagaacaagcttgattatgttttggctttgactgtggagaatttccttgagcgtcgcctgcagacagttgtgtttaagaagggtttggcaaagtccattcatcatgcccgtgtgctcatcaggcagaggcatatcagagttggaaggcaagtggtgaacattccatccttcatggtcagatgtgattccgagaagcacattgattttgccattacaagtccattgggtggcggaggtcccggtagagtcaagagaaggaacttgaaggcagctgccaagaaggcttctggtggaggagatggagatgaagaggatgaggaatgaacatctgagttgaaactattttcttctaggacgtgcttctcaataactcctacataggtttagtctcctacaggtttttgaattagggagtgaaactcctctttgcgtgcaagaaattttttgtttcttttaagattaattttataccagtggagattatactactgaatttttcagttttca

SEQ ID NO: 2980 - DNA, 921 bp, Tamarix hispida
  misc_feature (5)..(6): n is a, c, g, or t
  misc_feature (14)..(14): n is a, c, g, or t
  misc_feature (240)..(240): n is a, c, g, or t
ggggnntccgtttngcagaactccagagatacagagcagaggcggcggagctgtagaacagagcaatggttcacgtcgcattctaccgcaactatgggaagacatttaagaagcctcgtcgtccttatgaaaaggaacgtttggatgctgagttgaaactggttggagaatatggtcttcgttgtaagagggagctctggagggttcaatatcatctgagccgtatccgtaacaatgcanggcatcttcttacacttgatgagaagaatccccgcaggatctttgagggtgaggcccttatgcgtagaatggttcgttatgggctactggaggagagtcaaaacaagcttgattatgtcttggctttgactgttgagaactttttggagcgtcgtctccaaacacttgtcttcaagtctggaatggccaagtccattcaccatgcccgtgtcctcatcaggcagaggcacattagggtcggcaggcaggttgtgaatgtgccatccttccttgtgagggttgactcagcaaagcacatcgacttctcactcactagtccttatggaggaggtcgtcctggaagagttaagagaaggaacatgaaggctgctgctaagaaagctgctggtggagatggtgatgaagaggatgaagaatgagttcatgcagcagtagcgtatgctggtatggatggtgatgaagcagagcagtagtagtcaattagctgctctaaaatcttaatttttgtttcattattatcataagcgttgttagttccgttacctggcttgttttgtctaaaaactgaagtgaattttcatttagggttttgtcatttgatgtttctatacgccataacaatcttgctgttcgttctggatgcaactgacgctcttttcttttctgtttctgcaaaaaaaa

SEQ ID NO: 2981 - DNA, 871 bp, Eutrema halophilum
cgaaacacactcgtcttttgtttgtgcagcagccatggtgcaagtcagattctaccgcaactatgggaaaacattcaagaagccacgtcgtccttacgagaaggagcgtctcgatgctgagctaaagctcgttggagaatacggtctccgttgtaagagagagctgtggagggttcaatacgcgcttagccgtatccgtaacgccgcgagagatcttctcaccctcgacgagaagaaccctcgtcgtatctttgaaggtgaagctcttctcaggaggatgaaccgttctgggcttcttgatgagagccagaacaagctcgattacgttcttgctttgactgttgagaatttccttgaacgtcgtctccaaaccattgtcttcaagtccggtatggccaagtccattcaccatgctcgtgtccttatccgacaaaggcacattagggttgggaggcagctggtgaacattccatctttcatggtgaaagtagactcacagaaacacattgacttttctctaaccagtccatttggtggtggtcgacccggaagagtgaagagaaggaacgagagagctggagccaagaaggctagcggcggtggtgatggagatgaggatgatgaagagtgaaagtacctaaaccctaccctttattagataaatcactacctaaaacctaccaagatggtattaagttatttaataatctattgctcttgtcactttcttttttgagatgtttggtttatgaagttatctttaactagtagaagaagtgaagtgtgctggtattttggtgatggatttagtttttatgttattgtgtttttgcaataatgcttttttatagtggaccgttctgttcttgtt

SEQ ID NO: 2982 - DNA, 882 bp, Thellungiella halophila
  misc_feature (38)..(38): n is a, c, g, or t
  misc_feature (297)..(297): n is a, c, g, or t
tcggccatcacgaaacacactcgtcttttgtttgtgcngcagccatggtgcaagtcagattctaccgcaactatgggaaaacattcaagaagccacgtcgtccttacgagaaggagcgtctcgatgctgagctaaagctcgttggagaatacggtctccgttgtaagagagagctgtggagggttcaatacgcgcttagccgtatccgtaacgccgcgagagatcttctcaccctcgacgagaagaaccctcgtcgtatctttgaaggtgaagctcttctcaggaggatgaaccgtnctgggcttcttgatgagagccagaacaagctcgattacgttcttgctttgactgttgagaatttccttgaacgtcgtctccaaaccattgtcttcaagtccggtatggccaagtccattcaccatgctcgtgtccttatccgacaaaggcacattagggttgggaggcagctggtgaacattccatctttcatggtgaaagtagactcacagaaacacattgacttttctctaaccagtccatttggtggtggtcgacccggaagagtgaagagaaggaacgagagagctggagccaagaaggctagcggcggtggtgatggagatgaggatgatgaagagtgaaagtacctaaaccctaccctttattagataaatcactacctaaaacctaccaagatggtattaagttatttaataatctattgctcttgtcactttcttttttgagatgtttggtttatgaagttatctttaactagtagaagaagtgaagtgtgctggtattttggtgatggatttagtttttatgttattgtgtttttgcaataatgcttttttatagtggaccgttctgttcttgtta

SEQ ID NO: 2983 - DNA, 980 bp, Vinca minor
atcatttgaatcggctcgtagcggagaagatcggcggagctgaaaatacaccgtagcgttgggcgggcggcggaagcagcaacaacactcaggatggtgcacgtctcgttttatcgcaactatggtaagaccttcaagaagcctcgtaggccctatgagaaggagcgtttggatgctgaattgaagcttgtgggggaatatgggttgaggtgcaagagggagctttggagggttcaatatgccttgagccgtatcagaaatgctgctagaaatctgttgactttggatgagaaggactcacgtcgtatctttgaaggtgaagcccttttgaggaggatgcacaggtatggtttactggaggatgcccaaaacaaacttgattacgtcctggctctgactgttgagaacttcctagagcgccgccttcagactcttgttttcaagggcgggatggcaaagtcaatccaccatgctagagtgctcattaggcaaaggcatatcagggtcggaaagcaggttgtcaatgttccttccttcatggttagagtggactctcagaaacacattgacttctcgattacaagtacctttggtggtggccggcctggtagagtgaagagaaggaacatgaaggcagctgcaaagaaggctgcaggtggggatggagaggaagaggatgaagaatgagagccctctcttttaatttagtcgtcgatgataataccggcccccaagatttttgcagttactttcaagacttttcatgtatgtaggaagttttgaatgctttttatggctttcctgacatcattaccagaatttattgttcatttagcgttttaatgtagtaacttctgaggaattcaaatgccatttaagtttgaggaactattttcacaattcaaaattttgcccaattttctggtgctagtttttgttttatgccctattccctcaaccccttctagcatttcatgtct

SEQ ID NO: 2984 - DNA, 812 bp, Helianthus annuus
gcaaaggtgtaggccgccggaagccagagggagatatcactctattaccgccggggttgacgtcggacaaacatggttcacgtctctctctaccgaaactatggaaaaaacctttaagaagccccgtcgtccatatgataaggagcgattagatgctcgagttgaaactcgttggagagtacggccttcgctgcaaaagggagcgatggagggtgcaatacgctctgagccgaatccgtaatgcagcaagaatgctcttaacccttgaagaaaaagatccacgcaggatcgtcgagggagaagccctaatgaggagaatgaacagatacgatctgttggatgagagccaaaacaagctcgattatgttcttgccctcactgttgaaaacttccttgaacgtcgccttcaaacccttgtcttcaaaactggtatggccaagtctatccaccatgctagagtcctcatcaagcaaagacacatcagggtgggaaggcaggtggtgaatgtgccatctttcatggtgagagttgactcacagaagcatattgacttttcactcaccagtccatttggaggtgggcgacctggaagggtgaagagaaagaaccagaaggcggctgctaagaaggcttctggtggtgatgctgacgaggatgatgaagagtgaggttaatgatgtttatgagtacttttgttatcttggtaataactttatgtaggaagttttgaatatcttgggaagaattttgggttttctttacatgatttctgtggattcagttaatgatagattatggatttcagttagatc

SEQ ID NO: 2985 - DNA, 767 bp, Euphorbia peplus
ggcacgaggtagagatcaagagccagagagccatggttcacgtttccttctatcgcaactatgggaagacattcaagaagccccgtcgcccctacaagaaggaaaggttagatgcaaaactgaagttggtgggagaatacggacttcggtgcaagaaagaattgtggagggtccaatatgcattgagtcgcattaaaaatgcagcgagaatgcttttgactttagatgagaagaacccgcgccgcatctttgagggggaggcccttctccgaaggatgaaccgttatggtctattaaatgagtctcaaaacaagcttgattatgtgttggccttgactgttgaaaacttcctcgagcgtcgcctccagactcttgttttcaagtctggtatggcaaagtctatccaccatgctcgtgtcctcatccgccagaggcatatcagggtcggaaggcaagcggtgaacataccatctttcatggtgagggtggattcccaaaagcatattgacttttaattgaccagtccactcggcccgggacgacctggaagagtaaagagaaggaaccagagggctgctagcaaaaaggcttctggaggagatggtgatgaagaggatgaggagtgattccttctcataggaaatttaaacctacttttggtaagtaatgttacttggttaaatttgtgactgccaacatttttcttaggaaaagctttcggattgatatgtttaattttagacttgtgtaattgtatttttgtttgg

SEQ ID NO: 2986 - DNA, 807 bp, Helianthus annuus
gcaaaggtgtaggccgccggaagccagagggagatatcactctattaccgccggggttgacgtcggacaaacatggttcacgtctctctctaccgaaactatggaaaaaacctttaagaagccccgtcgtccatatgataaggagcgattagatgctcgagttgaaactcgttggagagtacggccttcgctgcaaaagggagcgatggagggtgcaatacgctctgagccgaatccgtaatgcagcaagaatgctcttaacccttgaagaaaaagatccacgcaggatcgtcgagggagaagccctaatgaggagaatgaacagatacgatctgttggatgagagccaaaacaagctcgattatgttcttgccctcactgttgaaaacttccttgaacgtcgccttcaaacccttgtcttcaaaactggtatggccaagtctatccaccatgctagagtcctcatcaagcaaagacacatcagggtgggaaggcaggtggtgaatgtgccatctttcatggtgagagttgactcacagaagcatattgacttttcactcaccagtccatttggaggtgggcgacctggaagggtgaagagaaagaaccagaaggcggctgctaagaaggcttctggtggtgatgctgacgaggatgatgaagagtgaggttaatgatgtttatgagtacttttgttatcttggtaataactttatgtaggaagttttgaatatcttgggaagatttttgggttttctttacatgatttctgtggattcagttaatgatagattatggatttcggtt

SEQ ID NO: 2987 - DNA, 773 bp, Thalictrum flavum
gaggagtagcggcagactagtaggtaaccatggtgcacgtcagcttctatcggaactatgggaagacattcaagaaaccacgtcgtccatatgagaaggaacgattatatgctgagttgaaactcgttggtgagtatggtttacgatgtaagagagaactatggagggttcaatatgctttgagtcgaattcgtaacaatgcaagaaatcttcttactcttgatgagaagaatcctcgtcggatctttgaaggtgaagtctttattgagaagaatgaatagatatggattgcttgacgagagtcagaacaagcttgattatgtcttagctttgactgttgagaacttccttgaacgtcgtcttcagactcttgtgttcaaatctggtatggctaagtctattcatcatgctcgtgttctcattcgtcaaaggcacatcagggttgggaggcaggtggtcaacattccatctttcatggtgagggttgactcccagaagcatattgacttctctctcactagcccacttggtggtggacgcccaggtagagtgaagcgaaggaacatgaaggcagctgccaagaaggcttctggaggagatggggatgaagaagaggaggattaagtaatcacatcttttaaattgccagaagtaggtactgtgggttgagtttttccttctttggaaagtttatatctttcaactgctgtttaactttgtattgtttgtttttgggacctgtgttttctatttgtagacctaaacattttgct

SEQ ID NO: 2988 - DNA, 927 bp, Allium cepa
attttcaggcggctaaaagagagatagagaggaggaagaagaagccgcaataatggtgcacgtctagtttttatcgcaactatggaaagacattcaagaagccccgtcgtccatatgagaaggaacgtctcgatgctgaattgaagctcgtgggagagtatggactccgttgcaagcgtgagctttggagagttcagtatgctttgagccgtatccgtaatgctgccagagaactcttaactctggatgagaaaaatcctaagcgtatttttgaaggagaggctcttttgcgacgtatgcatcgctatgggcttcttgatgatgaacaaaacaagctcgattatgtgcttgcattgactgttgaaaactttcttgagagaagacttcaaactcttgtttttaagtctggcatggctaagtctatacatcatgctagagtgctcattcgccaacgccatatcagtgttggaaagcaagtagtcaacattccatcgttcatggtgagggttgaaagtgcaaaacacatagacttttcacgtaacagtccattgggtggtggtagagatggaagagttaagagaaggaacaagaaagctgctgccaaaaaggacggaggagacgaagaggaagaagaggattaaaccatcaatcttatctgtcttgttaaatgaagaaccctttttgctagttttatctgaatttcaagtatggactccttttcatgtactgtgtttttgttgttgttgatgtccttgtgtttttatggttggcttgaattttatttattataacagttgcattttatatttccctattagtgcttctttgccttaattgggtgcaatggttgatgattatttttgcattgagttgcatctgtgttgaaggattgaattatttgagcaataattattgcatccttggtaa

SEQ ID NO: 2989 - DNA, 641 bp, Ambrosia trifida
tttgattcagccttctatacccttatcatcagcagtcagagggataagcagttgctgcattgacagtcctgttcaagaatggttcatgtgccattttaccgaaactatgggaagacttttaagaagcctcgacgtccgtatgagaaggagcgtttggatgcggagttaaagctcgttggagaatacgggctgcgatgcaagagggagctatggagggtgcagtatgctcttagtaggattaggaatgctgcaagaatgcttttgactcttgaagagaaggacccgcgtaggatttttgagggggaagcgcttatgcgaaggatgaaccgttatgggcttttggatgagagtcagaataagcttgattatgtgctggctcttactgttgagaactttttagaacgtcggttgcagacgcttgtgtttaagactggtatggctaagtctattcatcatgctagagtccttatcaagcaaaggcacatcagggtcgggaggcaagtggtgaatgtaccatcattcatggtgagggttgactcacagaaacacatcgacttttctctcactagtccatttggtggcggccgacctggcagagtgaagcgaaagaaccagaaggccgctgcaaagaaggctgcagg

SEQ ID NO: 2990 - DNA, 681 bp, Fagus grandifolia
ccacaccgccactcctcgccatttgcatcacctctacaggcgcgtagcccaccatggtgcacgtctccttttatcgaaactatgggaaaaccttcaagaagccgaggcgtccatacgagaaggagcgtctggacgcagagttgaagctcgtgggagagtacgggctgaggtgtaagagagagctgtggagagtgcaatatgcgttgagtcgtattcgtaacaatgcgagaatgcttttgacattggacgagaagaactcacgtcggattttcgaaggtgaagcacttctgagaaggatgaacaggtatggactactcgatgagagccagaacaagctcgattacgtgttggcactcactgtcgagaactttctagagcgacgcttgcagacactggtgttcaagtctggcatggctaagtccattcaccacgccagagtgcttatcaggcagaggcacattagggttggtagacaggtggtcaatattccctcattcatggttagggtggactcacagaagcacattgatttttcactcacaagtcctttcggtggtggacgccctgggagagtgaagcgcaggaatcaaaaggcagctacaaagaggctccggtgagatggagatgaaaaagatgaagagtaagcttagcttagatataactataagacaataatggtaa

SEQ ID NO: 2991 - DNA, 583 bp, Petunia hybrida
taataagtttacttgagcaggtaagctgatctaagggcggcgcaaacatggtacacgtctccttttaccgcaactatgggaagacctttaagaagcctcgacgtccctatgagaaggagaggttggatgcagagttgaagcttgttggagagtatggacttaggtgcaagagggagctgtggagagttcagtatgctttgagccgtatcaggaatgcagcaagaatgcttctgaccctcgatgagaaagatccacgtcgtatttttgaaggtgaagctctcttgaggaggatgaacaggtatgggctgttggatgagagccagaacaagctcgattatgtcttggcactcactgttgaaaacttccttgaacgtcgtctgcaaacacttgttttcaagactggcatggccaagtcgatccaccatgctagagtgctcattaggcaaaggcatatcagggttggaaggcaagtggtgaatgttccttcatttatggtgagagtagactcacagaagcacattgacttctctttaaccagtcctttcggtggtgggcgccctggaagagtgaagcgaaagaacca

SEQ ID NO: 2992 - DNA, 818 bp, Trifolium pratense
  misc_feature (59)..(59): n is a, c, g, or t
  misc_feature (127)..(127): n is a, c, g, or t
cgcgaacctcagcagcatggtgcacgtttcatactatcgcaattatgggaaaaccttcnagaagccacgtcgtccatacgagaaggagcgtttggatgctgagttgaaactcgtcggagagtacggncttcggtgcaagagagagttatggagagttcaatacgctcttagccgtatccgtaacaatgcaaggaatctgttgacattggatgagaagaatcctcgtcggatctttgagggtgaagcacttctaaggagaatgtttaagcatggtcttcttgatgaaactcagaacaagcttgattatgtcttggctcttactgttgagaattttcttgaacgccgtcttcagacccttgtgttcaaatctggaatggctaagtctattcatcatgctagggttcttattaggcagaggcacatcagggttggaaggcaagtggtgaacattccatcattcatggtgagggttgattcacagaagcacattgacttttcacttacaagtccttttggtggtggtcttcctggtcgtgtgaagagaaagaacgccaaggctgctgctaagaaggcttctggtggtagtggagacgaggaggatgaagattagattatgtgtttctgatacttaaatcctttgcatcaggcttttaatctgtcttttcctaaaatgttatttttgtacttttcatctccaagtattaagttttgttcaaatacctttaatgatctcttagatttaattcaagactctatgcttaatggtttttttgagaatttagaattgtgaaacttgaatcaagttttttcaaataaaa

SEQ ID NO: 2993 - DNA, 964 bp, Linum usitatissimum
actcccaactcttgacggcgagagagacagagagcagtcaaggcaaaacctcggagcgcaaccatggtgcacgtctccttctaccgcaactatggtaagacattcaagaagccacgtcgtccttacgagaaggagcgtctggattctgagctgaagctagtgggagagtatggtctccgtgccaagagagagctgtggagggtccagtacgcattgagccgtatccgtaacgccgctagaatgcttttgaccctggatgagaagaacccgcgtaggatctttgagggtgaagctcttctccgaaggatgaaccgttatggactcttggatgagtctcagaataagctcgattatgtgctggctctgaccgtggagaatttccttgagcgccggctgcagactcttgttttcaagtctggaatggccaagtctatccaccatgcccgtgttctcatcagacagaaacacatcagggttggaaggcaggtggtgaacataccttcattcatggtaagactggattcacagaagcacattgatttctcgatcagcagcccgttcggtggtggccgtgctggaagagtgaagaggaagaacatggctgcatcatccaagaagcaagccggcggtggtagcgacgacgagggagcagagtaaaccaaattggtcaacatcctatcttatgtcgtagaaatagtctctggagttgatctagatttactgtttttctttttgttgaaagatcttcagcttgccgcctgttcttgatggtactctttacgagagtcatttgggttgtttctgttattatttaagaaccgagcagattttgggtatgaagaatttttgcctaatcctaattaaatgctaaataattagtccatgggtttgtctcagtgtctgtggattgtaaaaaaacaggtaaaatatttataaaaatgataatctatgggtaatatttacc

SEQ ID NO: 2994 - DNA, 879 bp, Linum usitatissimum
gacggcgagagagacagagagcagtcaaggcaaaacctcggagcgcaaccatggtgcacgtctccttctaccgcaactatgggaagacattcaagaagcctcgtcgtccttacgagaaggagcgtttggattctgagctgaagctagtgggagagtatggtctccgtgccaagagagagctgtggagggtccagtacgcattgagccgtatccgtaatgcagctagaatgcttttgaccttggatgagaagaacccgcgtaggatctttgagggtgaggctcttctacgaaggatgaaccgctatggactcttggatgagtctcagaacaagctcgattatgtgctggctctgactgttgagaacttccttgagcgccggctgcagactcttgttttcaagtctggaatggccaagtctatccaccatgctcgtgttctcatcaggcagaaacacatcagggtcggaaggcaggtggtgaacataccgtcattcatggtaagactggattctcagaagcacatcgatttctcaatcagcagcccgttcggtggtggccgtgctggaagagtgaagaggaagaacatggctgcatcatccaagaagcaagctggcggcggtagcgacgatgagggagcggagtaaaccgaattggtcaacatcctatcttatgtcgtagaaatagtctccggagttgatctagatttattgtttgcttttgttgaaagatcttcagcttgccgcctgttctcgatggtactctttacgagtcatttcggttgttttttgacttttccttattcaaggaccaagcagatgttcgatatgaagaattactcttaagatttttgctaatcctaattaaatactaaataattag

SEQ ID NO: 2995 - DNA, 792 bp, Medicago truncatula
gagcaaacatggttcacgttgccttttaccgtaactatggcaaaactttcaagaagccacgtcgtccatatgagaaggagcgtttagatgctgagttgaagctcgtccgagagtacggtcttcgctgcaagcgcgagctttggagggttcaatatgctcttagccgtatccgtaacaattctaggacacttttgacactggatgagaagaatcctcgtcggatctttgagggtgaagcacttttgaggagaatgttcaaacatggtcttcttgatgaaacacaaaacaagcttgattatgtgttggctctcactgttgagaattttcttgaacgtcgtcttcagactcttgtgttcaaatctggcatggctaagtctattcatcatgctagggttctaatcaggcagaggcacatcagggttgggaggcaggttgtgaacatcccatccttcatggtaagggttgattcacagaagcacattgacttttcactcacaagtccattcggtggtggtcttcctggtcgtgtgaagcgtaagaaccttaaggctgcagccaagaaggcttccggtggtgatggtgatgaggaggatgaagattaaattatgattttcattttcttagatccttgctctagcctttttatatctgtcctagactttagattttctatcatgcaaatgacttttaccgttttcccatccctgtttattgtgtgaggaaatctttgctcaaaacatgttgtttttgatcttttcttttccaagtattaagttttgctccaatacattt

SEQ ID NO: 2996 - DNA, 1098 bp, Medicago truncatula
atgggggtttataatagaaaaccggtggtgaaacgattagcatcaccttcttcgaaaatctacctgtgttccggcggcgtgatggttaaagttgctttctacaggaactatgggaaaacattcaagaagccgcgtcgtccatacgagaaggagcgattggatgctgagttgaaactggtcggagagtacggtcttaggtgcaagagggagctttggagggttcagtacgctttgagccgtatccgtaacaatgcaaggaatctgttgaccttggatgagaagaatcctcgtcgtatctttgagggtgaagcgctgttgagaaggatgtttaagcatggtcttcttgatgaaactcagaacaaactcgattatgtcttggctctcactgttgagaattttcttgaacgccgtcttcagacacttgcattcaaatctggtatggccaagtccattcatcatgctagggttcttatcaggcagagacacatcagggttgggaggcaggttgtgaacatcccatcattcatggtgagggttgattcacagaagcacattgacttttcactcacaagtccttttggtggtggtcttcccggtcgcgtgaagcgaaagaaccttaaggctgcagccaagaaggcttctggtggtgatggtgatgaggaggatgaagattaaatttaaattatgattttcttttgcttagatccttgctctagcctcttgatatctgtcctagactttagattttctatcatgcatatgacttttaccattttcctatccttgtttattgtgcgagtaaatctttgctcgagagatgttctttttgagcttttcttttccaagtatagagttttgctccaatacatttgatgatctttatgataattgaaccttttacttaatggagtttgtatgagtatattatttagcagtttgattttgcatattttgatggggtgtgcctgtgtatcgaaccaaccaaaacttcaattcaactatgcttcatatggtgtagcctctgccttttgagaacttgtaattctgaaacttgtattgaagacctttttattgttcatacaagttagttgaatgata

SEQ ID NO: 2997 - DNA, 828 bp, Brassica oleracea
  misc_feature (805)..(807): n is a, c, g, or t
ggggagatcactctcctctctgttttgtgacagcagccatggtgcaagtcaggttctaccgcaactatggcaagaccttcaagaagccgcgacgtccttatgagaaggagcgtcttgatgccgagctgaagcttgtcggagaatatggtcttcgttgtaagagagagctgtggagggttcagtacacgcttagccgtatccgtaacgctgccagagagcttctcactctcgatgagaagaaccctcgtcggatctttcaaggtgaagctcttcttaggaggatgaacaagaatgggcttcttgatgaatcccagaacaagctcgactacgttcttgctttgactgttgagaatttcctcgagcgccgtctccagactattgtcttcaagtccggtatggccaagtccattcaccacgcccgtgtccttatccgacaaaggcacatcagggttgggaggcaacttgtgaacattccatcgttcatggttaaagtagagtcacagaaacacattgacttttctctgaccagtccatttggtggtggtcgacctggaagagtgaagagaaggaacgagagagctggtgctaagaaagctggtggtggtggtggagatgaggatgatgaagagtaaaagtaccaaacctttaaaacccctttgttggataaataatgttttttttttgtttaatagttttcttgaactacaagaagtcaagtgtgttggtttgtaatggtgtgttttgcaataatgtggttgtgcccctttgtgttgttgaacaatgatgccactttcggatcttgctnnntacaagacagtagtagtagtt

SEQ ID NO: 2998 - DNA, 849 bp, Brassica rapa
cttcctcttcttcgagatcactctcctctctgttttgtgcaagcacagcagccatggtgcaagtcaggttctaccgcaactacggcaagaccttcaagaagccgcgacgtccttacgagaaggagcgtcttgacgccgagctgaagcttgtcggagaatacggtcttcgttgtaagagagagctgtggagggttcagtacacgcttagccgtatccgtaacgctgccagagagcttctcactctcgacgagaagaaccctcgtcggatctttcaaggtgaagctcttcttaggaggatgaacaagaatgggcttcttgatgaatcccagaacaagctcgactacgttcttgctttgactgttgagaatttcctcgagcgccgtctccagactattgtcttcaagtccggtatggccaagtccattcaccacgcccgtgtccttatccgacaaaggcacatcagggttgggaggcaacttgtgaacattccatcgttcatggttaaagtagagtcacagaaacacattgacttttctctgaccagtccatttggtggtggtcgacctggaagagtgaagagaaggaacgagagagctggtgctaagaaagctggtggtggtggtggagatgaggatgatgaagagtaaaagtaccaaacccctttaaaacccctttgttggataaataatgttttttttttgtttaatagttttcttgaactacaagaagtcaagtgtgttggtttgtaatggttttagcctttatgtgtgttttgcaataatgtggtagtgtacctttgtgttgttgaacaatgatgccactttcggatcttgcttcttaccaggcccg

SEQ ID NO: 2999 - DNA, 664 bp, Brassica napus
agcagccatggtgcaagtcaggttctaccgcaactatggcaagaccttcaagaagccgcgacgtccttatgagaaggagcgtcttgatgccgagctgaagcttgtcggagaatatggtcttcgttgtaagagagagctgtggagggttcagtacacgcttagccgtatccgtaacgctgccagagagcttctcactctcgatgagaagaaccctcgtcggatctttcaaggtgaagctcttcttaggaggatgaacaagaatgggcttcttgatgaatcccagaacaagctcgactacgttcttgctttgactgttgagaatttcctcgagcgccgtctccagactattgtcttcaagtccggtatggccaagtccattcaccacgcccgtgtccttatccgacaaaggcacatcagggttgggaggcaacttgtgaacattccatcgttcatggttaaagtagagtcacagaaacacattgacttttctctgaccagtccatttggtggtggtcgacctggaagagtgaagagaaggaacgagagagctggtgctaagaaagctggtggtggtggtggagatgaggatgatgaagagtaaaagtaccaaacctttaaaacccctttgttggataaataatgttttttttttgtttaatagttt

SEQ ID NO: 3000 - DNA, 670 bp, Brassica napus
ggagatcactctcctctctgttttgtgacagcacagcagccatggtgcaagtcaggttctaccgcaactacggcaagaccttcaagaagccgcgacgtccttacgagaaggagcgtcttgacgccgagttgaagcttgtcggagaatacggtcttcgttgtaagagagagctgtggagggttcagtacacgcttagccgtatccgcaacgctgccagagagcttctcactctcgacgagaagaaccctcgtcggatctttcaaggtgaagctcttcttaggaggatgaacaagaatgggcttcttgatgaatcccagaacaagctcgactacgttcttgctttgactgttgagaatttcctcgagcgccgtctccagactattgtcttcaagtccggtatggccaagtccattcaccacgcccgtgtccttatccgacaaaggcacatcagggttgggaggcaacttgtgaacattccatcgttcatggttaaagtagagtcacagaaacacattgacttttctctgaccagtccatttggtggtggtcgacctggaagagtgaagagaaggaacgagagagctggtgctaagaaagctggtggtggtggtggagatgaggatgatgaagagtaaaagtaccaaacctttaaacccttgttggataataa

SEQ ID NO: 3001 - DNA, 749 bp, Brassica napus
actctcctctctgttttgtgcaagcacagcagccatggtgcaagtcaggttctaccgcaactacggcaagaccttcaagaagccgcgacgtccttacgagaaggagcgtcttgacgccgagctgaagcttgtcggagaatacggtcttcgttgtaagagagagctgtggagggttcagtacacgcttagccgtatccgtaacgctgccagagagcttctcactctcgacgagaagaaccctcgtcggatctttcaaggtgaagctcttctgaggaggatgaacaagaatgggcttcttgatgagtcccagaacaagctcgactacgttcttgctttgactgttgagaatttcctcgagcgccgtctccagactattgtcttcaagtccggtatggccaagtccattcaccacgcccgtgtccttatccgacaaaggcacatcagggttgggaggcaacttgtgaacattccatcgttcatggttaaagtagagtcacagaaacacattgacttttctctgaccagtccatttggtggtggtcgacctggaagagtgaagagaaggaacgagagagctggtgctaagaaagctggtggtgttggtggtgatgaggatgatgaagagtaaaagtaccaaacccctttgttggataaataatgttttttttgtttaatagttttcttgaactacaagaagtcaagtgtgttggtttgtaatggatttagcctttatgtgtgttttgcaataa

SEQ ID NO: 3002 - DNA, 864 bp, Brassica napus
cagccatggtgcaagtcaggttctaccgcaactatggcaagaccttcaagaagccgcgacgtccttatgagaaggagcgtcttgatgccgagctgaagcttgtcggagaatatggtcttcgttgtaagagagagctgtggagggttcagtacacgcttagccgtatccgtaacgctgccagagagcttctcactctcgatgagaagaaccctcgtcggatctttcaaggtgaagctcttcttaggaggatgaacaagaatgggcttcttgatgaatcccagaacaagctcgactacgttcttgctttgactgttgagaatttcctcgagcgccgtctccagactattgtcttcaagtccggtatggccaagtccattcaccacgcccgtgtccttatccgacaaaggcacatcagggttgggaggcaacttgtgaacattccatcgttcatggttaaagtagagtcacagaaacacattgacttttctctgaccagtccatttggtggtggtcgacctggaagagtgaagagaaggaacgagagagctggtgctaagaaagctggtggtgttggtggtgatgaggatgatgaagagtaaaagtaccaaaccctttgttggataaataatgtttttttgttaatagttttcttgaactacaagaagtcaagtgtgttggtttgtaatggatttagcctttatgtgtgttttgcaataatgtggtagtgtaccctttgtgttgttgaacaatgatgccactttcggatcttgcttcttaggttctttctagacagtagtagtagttatattcgtaaaaactaaacagatagcaggacgacgaccagggaggtaagggagccccccc

SEQ ID NO: 3003 - DNA, 993 bp, Cephalotaxus harringtonia
ggagccggaagggcaggtctagggcaaaagaaggcagaggcagggaaggttacgcggcagccatggtgcacgttagcttttaccacaactatggcaagacttttaagaagcctcgtcgtccttatgagaaagagcgtttggatgccgagctgaagttggttggagagtatggtcttcgcaacaagagagaactctggagggttcaatataccctgagccgtattcgtaatgctgcaagaatgcttcttactcttgaagagaagaattcccgccgaatttttgagggtgaggccctgttgcgtcgtatgaataggtatggacttcttgatgagagtcagaacaagcttgattatgtcttggcgttaacggttgaaaatttccttgagcgacgtcttcagacccttgtgtttaagtctgggatggctaagtcaatccaccatgcccgtgttctcatcagacaacgacatatcagggttggccggcaagtggtcaatattccatctttcatggttagagttgattcacaaaagcacattgacttctctctaactagtcctcttggtggtggacgacctggccgtgtgaagcgaaagaacatgaaggcagcctcaaagaaggctgcaggtggagatgaagaggaggatgaagaatgagagattgcaatttcatctggatggaagcatatggattttactttgcagttgtagaaatttatttgctactgctagcaatatgatgtaggatgtgctttctatagactgcattaaagttttgctttgagccttcagtcctttcctaagaactgaagtgagaaggatggttttaagaatatgccaaaacaatagtattattttttgttatttggttttgggctggtgtagcttcacaccagtttttgttgaatttaccaagtcaaggcaggggaaactggtttcttaatcttgtttttattttgggcctttactaagaactgaaatgatatagatgctttct

SEQ ID NO: 3004 - DNA, 832 bp, Chelidonium majus
cttttttcagtctaggacttagggcacacaaggagggaacaggcgacgctgaagttgcaaaaatggtgcactttgctgtttatcggaactatgggaagactttcaagaagccccgtcgtccatatgagaaggaacgtttggatgctgagctgaagcttgttggtgagtatggtcttcgatgtaagagagagctctggagggttcagtatgctttgagccgtatccgtaacgctgctagaatgcttctcacccttgaggagaagaaccctcgccgtatctttgagggtgatgcccttcttcgcaggatgaacaggtatgggcttttggatgagagccagaacaagcttgattacgtcttggctttgactgtggagaactttcttgagcgacgtctccagactcttgtgttcaagtcgggtatggcaaagtcaattcaccatgcccgtgtcttgattaggcagagacacatcagggttggaaggcaggtggtgaacgtcccatcattcatggtgagacttgattcacagaagcacattgacttctcactcacaagtcccctcggaggtggacgccctggaagagtgaagagaaggaaccagaaggcagctgccaagaaggccgctggaggaggagatgcagatgaggaggatgaggattaagctctatctttaaaccctttcttaatggcacaatattaggaaatagtttggaggtttttcttagtgataagcctccatcctctaccttttgtttgtgttgtagttgcagatgctttactctatttggacatccagtctttaggccaaagaagttttgctcagccttttatttt

SEQ ID NO: 3005 - DNA, 778 bp, Cleome spinosa
tcgggggaagctgttcagggtggagaagacagaggcggagccatggtgaacgtcaactactaccgcaattatgggaagaccttcaagaaaccaagacgtccgtacgagaaggagcgtttggatgcagaactgaagctggtcggagagtacggtctccgtaacaagcgtgagctctggagagtgcaatacgcacttagccgtatccgaaatgcggcgagagatttactcaccctcgacgagaagaatccgaagaggatcttcgagggcgaggctctcctccgtaggatgaaccgtttcggtcttcttgacgagagccagaacaagctcgattatgtcttggctttgaccgtcgaaaacttccttgaacgccgcctccagactctcgtcttcaagtccggtatggcaaagtccatccaccatgcccgtgtcctcatcagacagaggcatatcagggtcggtaagcaattggtaaacataccgtcgttcatggtgagagtggattctcagaaacacattgactttgcgttgactagtccgtttggcggcggccgccccggcagggtcaggcgaaagaatgagaaggctgcctccaagaaagcctctggtggagacggagacgatgaggacgaagagtaaagctcttcttcttaaacaaccccggattttgtaatccggttcaatcgaaccggtttcggtttcgaaattttcggtttattttatatgtttgtcttggactcggtttttgcccattccagactttcgtcttcttcgtaggccg

SEQ ID NO: 3006 - DNA, 845 bp, Cleome spinosa
tctcttctccgagtctgtttcttcgttaatcccggtcggtgtcggtgaaaagacggggacgaagagatggtgaacgtcagttactaccgcaattatgggaagactttcaagaaaccgcgtcgtccgtatgagaaggaacgtttggatgctgaattgaagctggtcggagagtacggtctccgtaacaagcgtgagctctggagagtacagtatgcgcttagccgtatccgtaatgcggctagagatctactcaccctcgacgagaagaatccaaagaggatctttgagggtgaggctctcctccggagaatgaaccgttatggtcttctggatgagagccagaacaagctcgattatgtcttggctctgactgtggaaaacttccttgaacgccggctccagactctcgtcttcaagtcgggtatggcaaagtcaatccaccatgctcgcgtgctcattagacaaaggcatatcagggttggaaagcagttagtgaacataccgtcgttcatggtgagagtcgattcacagaaacacatagactttgctttgactagtccctttggcggtggccgtcctggtagggttaggagaaagaatgagaaagctgcttccaagaaagcctctggtggcgacggagatgaggacgacgaagagtaaaatgttttcgttttccgccttcggttcaatctatctggttttggttttgaaacttatggtttatttgaaatggttgcattggatttggtttttcatactcacaagaattgctaaactctgagatgttcatcttttattacttgttcatttatatatgggaatgaatcatacatcttatcaaaaaa

SEQ ID NO: 3007 - DNA, 774 bp, Adiantum capillus-veneris
ctcattagggtttttcagagagtgcatcttcttctggcgaaggaggcggcagcatggtgcacgtcagtttctaccgcaactatggaaagacgttcaagaagccccgccgtccttatgagaaggagcggctcgatgcagaactgaagctcgtaggggaatatggactccgtaacaagagagaactgtggagagttcaatatgcattgagccgtatccgcaacaatgcccgaatgttgcttacactcgatgagaagaacccacgcagaatcttcgagggagaggctcttctacgtcgcatgttcagatatggtcttctagatgaaagccaaaacaagctcgattatgttttggcattgacagttgagaacttcttggaacgccgtctgcagactcttgtcttcaagtcgggcatggccaaatcgattcatcatgcccgagtgcttatcaagcagaggcatattagggttggcaagcaagttgtcaatgttgcctcttttctggtgagagtggattcacagaagcatattgattttgcactgtcgagtcccttcggtggcggtagacctggccgtgtgaagagaaggaacatgaaggctgcctctaagaaggctgctggtggtgaagaggaggaggatgaagattaaagtgacagagcttctgttgtttgaagtcaagaaacaaagagagagactagacatttttgactgttaactttttgaatgaaggcctgctagcatcaggcgctttttgctaacaattttgttatagaaattg

SEQ ID NO: 3008 - DNA, 847 bp, Papaver somniferum
acacaaaggaggaaccggcgacgccgaagttgcaaaaatggtgcactttgctgtttatcggaactatgggaagactttcaagaagccccgtcgtccttatgagaaggaacgtttggatgctgagctgaagcttgttggtgagtatggtcttcgatgtaagagagagctctggagggttcagtatgctttgagccgtatccgtaatgctgctagaatgcttctcacccttgaggagaagaaccctcgccgtatctttgagggtgatgcccttcttcgcaggatgaacaggtatgggcttttggatgagagccagaacaagcttgattatgtcttggctttgactgtggagaactttcttgagcgacgtctccagactctcgtgttcaagtcgggtatggcaaagtcaattcaccacgcccgtgtcttgattaggcagagacacatcagggttggaaggcaggtggtgaacgtcccatcattcatggtgagacttgattcacagaagcacattgacttctcactcacaagtccccttggaggtggacgccctggaagagtgaagagaaggaaccagaaggcagctgccaagaaggctgctggaggaggagatgcagatgaggaggatgaggattaagctttaaatcctttcttaatggcacaatattaggaaatagtatggaggtttttcttagggataagcctccatctctaccttttgtttgtgttgtagttgcagttgcagttgctttaatctatttggacatccagtctttaggccaaagaagttttgctcagcctttattttaatttagaaaacctttttaagacttggttcttgttatgaaga

SEQ ID NO: 3009 - DNA, 1897 bp, Prunus persica
gttttcatcgaagcagaggggacgtgtggtcttgacggagaacaaccatggttcacgtctccttctaccgcaactatggaaagacgttcaagaagccgcgtcgcccctatgagaaggagcgtttggatgctgagctgaagcttgttggagagtatgggctccggtgcaagagagagctgtggagggttcagtatgctctgagccgtatcaggaacaatgcaaggatgcttctgaccctggatgagaagaaccctcgtcgtatcttcgagggcgaggctctcctccggaggatgaaccggtacgggctcttggaagagggtcagaacaagcttgattatgttttggctttgactgtggagaacttccttgaacgtcgcctgcagacaattgtgttcaagactggtatggcaaagtccatccatcatgcccgtgtgcttatcaggcagaggcatatcagagttgggaggcaagtggtgaacatctcttccttcctggtgagatgtgattcagagaagcacattgatttctcactcacaagcccattaggcgctggacgtcccggcagagtgaagagaagaaacatgaaggcagctgccaagaaggctgctggtggagatgcagatgaagaggatgaagattgaacaaagagttttgaccattagtttctcctagccctactaggctttacttctcagttactatatcccatatggcttgcaaataatttttgttccgaacttcatttctgcttcactctgaacaattttgcatttgattagtttgaaatgattcaatttttctataaaatataatctattttgcatctctgttggcttggcttcaacagagggttataccactgacttggtccaaaacctcacgttgcataggtcatattttattctattcttaattaaatgattaaatatttatcatttgtcaacaacccataaaaccattcttcttcaaacttcacccagccctcccaaaaacagagtgcagccatggaatctatcaacatcttcaaaggctatggcaaagtaaacccagaccaacttgaagatcaaactcaaacctcaaacccaaaatcccccaaaccccaaaagcccatcttttccattctcaccatctcagccctcatctgcttgaccttggtgatcggcctcctgctcgcagctctcatccacgtgtccaactccgagtccccttctctctccaactccaactcggccgagtcagccatcaaaaccatctgcaacgtgactcggtaccccaactcgtgcttcacctccatctcctccctcaacacctctccaaagcccgacccagaaaccattttcaagctctctctcgaaatctccgtcgccgagctctcaaacgtctcgtctctgttgaatacgatgaactccgatcccgcgacgcgggactgcgtggatcagctcgaggacgcgctgagtcggctcaacgactcggtttcggcgatgggacagaaggcgttgaccgtggctaaagtcaacgacatacagacgtggataagcagcgctgtgacagatcaagagacgtgcttggatgggttggaagagatgggatcaacggctgtggataaagtgaagagcaagatgaagaggtccatggagtgcaccagcaacagcttagccattgtggctaatttcaaggccattcttgacaaattccacatacccctccactaattattattagattaattgaataaaaggaaaagaaaaaaatagttttgggctttgttttttgttcgggtttgactgtttttatgtatcatttttgttcttgaattataagtggtgtttgtttgttgttggtgatttgtgtccttcattgatatctttgcactttgtaagttgtgaaagttgaagat

SEQ ID NO: 3010 - DNA, 828 bp, Pteridium aquilinum
cttttttacattagggttcttcacagcgttcacctcttggcggggaggagacgcaggcggcagcatggtgcacgtcagcttctaccggaactatgggaagacattcaagaagcctcgccgtccttacgagaaggagcgtcttgatgcggagctgaagcttgtgggtgagtatggtctccgcaacaaacgtgaactgtggagagttcaatatgcccttagccgtatccgcaacaatgcccgtatgttgcttacccttgatgaaaagaattctcgccgtatctttgagggagaggcgcttcttcgccggatgttcagatacggtcttttggaagaaagccagaacaagcttgattacgttttggcgttaacagttgagaattttttggagcgtcgcctgcaaaccctcgtcttcaaatcaggaatggccaagtcaattcatcatgctcgtgtcctcatcaagcagaggcatatcagggttggcaagcaagttgtcaatgttgcgtctttcctggtcagagttgattcgcaaaagcatattgattttgcactatctagtccctttggtggtggtagaccaggacgcgtgaagaggaggaatatgaaggccgcaactaagaaggctggtggtggtgaagaagaggaggatgaagattaagcgacttaaaatgtgaatgtgctttttaaagctaagcaatggacaagtatattgcaacacttttgaatagccctaacttttcaaacatacgtctggcagttcaggcggtcgtgttagagttttctattagatgttttgatatcttttagtcaatgccatattttatgttgttt

SEQ ID NO: 3011 - DNA, 953 bp, Sciadopitys verticillata
gcgaaacctagcagaggggaaggaggaggcgttgccgcagttatggtgcacgtaaacttttaccgcaactatggtaagacttttaagaaaccccgtcgtccttatgagaaagaacgtttggatgctgagctcaagttggttggagagtatggtctccgcaacaagagagaactttggagggttcagtatacactgagccgcattcgtaatgcagcaagaatgcttctcactcttgatgagaagaatcaccgtcgaatttttgagggtgaggcccttctccgtcgcatgaacaggtatggacttcttgatgagagtcagaacaagctcgattatgtgttggcattaacagttgagaattttcttgagcgccgactccagactcttgtgtttaagtctggaatggccaagtcaatccaccatgcccgtgtgcttattagacaacgacatatcagggttggtaggcaggtagtcaatattccatctttcctggtcagagttgattcacaaaagcatatagacttctcactaaccagtcctcttggtggtggacgacctggccgtgtgaagcgaaagaacatgaaggcggcttcaaagaaggctgcaggtggagatgaagaggaggatgaggattgagtaatttagaaattggttggtcaaagtagataggcttaactatgctcttgtagagatttgtttgctatgctccaatgctttgaattggattttgttctcttgctagtaatatgatgcgtaggacttgcttaattttatactgcattcaaattttgttttgagccttcagtcctgttcctaagagctgaagtgaaacgatgcttgctgagtatgcaacaaagatattattcttcgtacattatttggttttaggttggagttaatttgtactgtgtatcttcacaccattttttgttgatttcaaaaagtcatggcagggg

SEQ ID NO: 3012 - DNA, 835 bp, Cyamopsis tetragonoloba
ggctagggcggagagcagagagggggggaaagagagggggcatggtgcacgtctccttttagggaaactatgggaaaacttttaagaagcctcgtggtccatacgagaaggaacgttgggatgcagagttgaagttggttggagagtacgggcttcggtgcaagagggaactgtggagggttcagtacgccctcagtcgcatccgtaacaatgcgaggaatctgctgacactcgacgagaagaatccccgtcgtatcttcgaaggtgaggctcttctccggaggatgttccgttacggacttctggatgaaactcagaacaagctcgattatgtgttggctctcaccgtcgagaacttccttgagcgccgccttcaaacccttgtcttcaaaactggtatggccaagtccattcaccatgccagagtcctcatcaggcagaggcacatcagggttgggaggcaggtggtgaacatcccatcattcatggtgagagttgattcacagaagcacattgacttctcactcacaagtccacttggtggtggtcgtcctggacgtgtgaagagaaagaatctcagggctgctgctaagaaggctgctggtggagatggagatgaggaggatgaggattgaactatgaatagcaagtgcttttaaatcttgtgccagcttttatttgtgtccgtagacttgttacatttttgtcatgcttgacttatataaattttccatccttttttttttcttgttttaagaaaagctttgcctgagatatgacatttttgaactgttcttttttaagtacaattatgaagctttgttccaatgcctgg

SEQ ID NO: 3013 - DNA, 888 bp, Brassica napus
gccccgggggagatcactctccttctcgtgttttggtggcaagcacacagcagccatggtgcaagtcaggtttaccgcaactacggcaagaccttcaagaagccgcgacgtccttacgagaaggagcgtcttgacgccgagctgaagcttgtcggagaatacggtcttcgttgtaagagagagctgtgagggttcagtacacgcttagccgtatccgtaacgctgccagagagcttctcactctcgacgagaagaaccctcgtcggatctttcaaggtgaagctcttctgaggaggatgaacagaatgggcttcttgatgagtcccagaacaagctcgactacgttcttgctttgactgttgagaatttcctcgagcgccgtctccagactattgtcttcaagtccggtatggccaagtccattcaccacgcccgtgtccttatccgacaaaggcacatcagggttgggaggcaacttgtgaacattccatcgttcatggttaaagtagagtcacagaaacacattgacttttctctgaccagtccatttggtggtggtcgacctggaagagtgaagagaaggaacgagagagctggtgctaagaaagctggtggtggtggtggagatgaggatgatgaagagtaaaagtaccaaaccttaaaacccttgttggataataatgtttttttttgtttaatagttttcttgaactacaagaagtcaagtgtgttggtttgtaatggtgtgttttgcaataatgtggttgtgcccctttgtgttgttgaacaatgatgccactttcggatcttgcttcttacaagacagtagtagtagttaatatttgggaaaattgcataaacaacactcaaatcggcattcactaacat

SEQ ID NO: 3014 - DNA, 841 bp, Secale cereale
gagaggagagagctccagccatggtgcacgtcaacttctaccgcaattatggcaagacattcaagaaaccaaggcgtccttatgagaaggagcgtcttgatgcagaactaaagctggttggtgagtatggactgaggtgcaagcgtgagctctggagggttcagtatgcattgagcaggatccgtaatgctgcaaggcactggggatacgctgatgagagatcccgcgtatcttgaggcgctgctcttctccgtcgcatgaaccgctatggtctccttgctgagggccaggataagcttgattacgtccttgcctgctgctgagacttccttgcaaggcgcttcagctcttgtcttcaaggctggcatggcaaaatccatccaccatgcccgtgtcttaatcaggcaacgccacatcagggttggcgaggcagattgtcaatgtcccctccattcatggtgagggtggaatacggagaagcacatcgatttctcactgacaagtccattcggtggaggccctgcaggcagggtgaagagaaagaaccagaagaaggcaagtggtggcggtgacgctggtggtgatgaggaagaggaatgaggaactatcaccttatatttatcaaatgctggtgttatgagtactttagctgagaggcctgagacttacatgggttatcctcttgtcgttttttttcacattatctctgttgttagcatgtatgcactttatgtttggatctatttggccgtgatgaaagttatctaaaaaagttttacaaagtttaaaaaaaaaaaaaaaaaaaaaaaaaaaaaaaaaaaaaaaaaaacaaaaaaaaaaa

SEQ ID NO: 3015 - DNA, 606 bp, Gerbera hybrid cultivar
ggtttgcagtgcaggaggaggcagctgggagagagcaacaagtgaactaaacaacaatggttcacgttaacttctatcgcaactacgggaagactttcaagaaacctcgtcgcccttacgaaaaggaacgactagatgccgagctaaaacttgtcggagaatacggtcttcgatgcaaacgtgagctctggagggtgcaatatgctttaagccggatccgtaatgctgcaagaatgcttcttacccttgaagaaaaggacccacgaaggatatttgagggtgaggcccttatgcgaaggatgaaccggtacggtctattggatgagagccaaaacaagctcgattatgtgctggctctaaccgtcgagaattttcttgaacgccggctccagacccttgtgttcaaaaccggcatggctaagtccatccaccatgcccgagttatcatcaagcagaggcacatcagggtcggaaggcaagtggtgaatgttccgtcattcatggtgagagttgactcacagaaacacattgacttttctctcacaagcccctttggaggcggccggcccggcagagtgaagcgaaagaaccaaaaggcggctgcta

SEQ ID NO: 3016 - DNA, 947 bp, Epimedium sagittatum
acagtaaaatgctttggggttttcattatatatatactaaggggaatcgcagcggcgggggatacaggagtagccatggttcatgtaagctactaccggaactatggaaaaacgttcaagaagcctcgacgtccatacgagaaggagcgattggacgccgagttgaagctagttggagaatacggactgcgatgtaagagagagctgtggagagtccaatacgcactgagccgaatccgtaacaatgctcggatgcttctcactctggatgagaagaaccctcgtcggatctttgaaggtgaagctcttctaaggaggatgtttaggtatgggcttcttgatgagagccagagcaagcttgattatgtgttggctctaactgttgagaacttcctcgagcgtcgtcttcagactcttgtgtttaagtctggtatggccaaatccattcaccacgcccgtgtcctcatcaggcagaggcatatcagggttggaagacaggttgttaatatcccgtctttcatggtgagaatggactcacagaagcacattgacttctcactgacaagtcctcttggtggtgggcgtcccggaagagtgaagagaagaaaccaaaaggcagctgcaaagaaggctgcaggtggagctggagatgaggaagaagaggattaagtttgtgctcatcatgttttagttccatcggtatgaactatgaagtgtccctagtcttttgcagtgtttttcatgtcccggatttttgtttttgcttattattactctgccacaaacagtatgtggacctaagtttgtaggtttagaggttggatggtgatcttgatctctttggtataccttcttagccttttatgaagaattttgtttaatttgacgtttcttgtggacgataacaatgttataaacgagttcctttttaggcgggtattgtgaac

SEQ ID NO: 3017 - DNA, 683 bp, Arnica chamissonis
tagtatgccgatttctctgtaattctcagtttctcacggcgtctccgttatctgataaacttttcagcaccagcagaaagagcagcaagcaatcactgcattgacctcagccaacaatggtcaatgtgccattttaccgaaactatgggaagacttttaagaagccccgacgtccatacgaaaaagagcgcttggatgcagagttaaagcttgttggagaatacggtcttcgatgcaaaagggaactctggagggtgcagtatgctcttagccgaattagaaatgctgcaagaatgcttttgacccttgaagagaaggacccacgtaggatttttgagggtgaagcacttatgagaagaatgaaccggtacgggcttttggatgagagtcaaaacaagctcgattatgtgctggcccttaccgttgagaacttcctagaacgccgtttgcagacacttgtgttcaaaaccggtatggctaagtctattcatcacgctagagtcctcattaagcaaaggcacatcagggtggggaggcaagtggtgaatgtaccatcattcatggtgagggttgactcacagaaacacattgacttttctctcactagtccttttggcggtggccgacctggcagagtgaagcgaaaaaaccagaaagccgctgcaaagaaggcggcaggtggt

SEQ ID NO: 3018 - DNA, 822 bp, Pteridium aquilinum
ggatggtgcacgtcagcttctaccgcaattatggcaagactttcaagaagcctcgtagaccttatgagaaggaacgtctggatgccgagctgaagctagtaggggagtatggcctccgcaacaagcgtgagctctggagagtgcagtatgccctgagcagaattcgcaataatgcccggatgcttttaacattagatgagaagaactcacgccgaattttcgagggagaggctttgctacggcgcatgtttcggtacggtcttctcgaggaaagccagaacaagctagattatgtgttagctcttacagtagagaacttcttagagcgtcgcttacagacactggtgttcaaatctggcatggcaaagtctattcaccatgctcgggttcttatcaagcaaagacacatcagggttggcaagcaagttgttaatgtggcatctttccttgttagagtggattcacaaaaacatattgactttgcgttgtcaagcccctttggtggtggtcgacctggtcgcgtgaagagaagaaacctcaaggctgcatccaagaaagcctcaggtggtggggaagaagaggaggatgaggattagaccaactcttaaacagcagcacagagtttgtttttgaccttgtagtgcattcgagctatacataatgcacaaggcttttcttttattagattgggtgtcttcacccccaaaacatacattctaatctaaattactgatgcatttttgttcaaaggtaattgattttctaattatgttgtttaggatgattgttagtgtctgtcaatgaatgttggtaatctataag

SEQ ID NO: 3019 - DNA, 669 bp, Cleome spinosa
gcctctctctcccgtcaccgagcttctgccctccatttatccaatctctgtctgtgaggagacggggacgaagagatggtgaacgttagctactaccgcaactatgggaagaccttcaagaaaccacgtcgtccatatgagaaggagcgtttggatgctgaattgaagctcgtcggagagtatggtctccgtaacaagcgtgagctctggagagtacaatatgcgcttagccgcatccgtaatgctgcaagagatctactcactctcgacgagaagaatccaaagaggatctttgagggtgaggctctcctccgtagaatgaaccgttttggtctccttgacgagagccagaacaagctcgattatgtcttggctttgactgttgaaaacttccttgaacgccggctccagaccctcgtcttcaagtccggtatggcaaagtccatccaccatgctcgtgttctcattagacagaggcatatcagggttggtaagcagttggtgaacataccgtcgttcatggtgagagtcgattcacagaaacacatagactttgcattgaccagtccctttggcggtggccgtcccggtcgggtaagaagaaagaatgagaaagctgcctccaagaaaacctcgggtggtgatggagacgaggacgacgaagagtaa

SEQ ID NO: 3020 - DNA, 912 bp, Pteridium aquilinum
agcaaccagccaagtaataaatgctcagttgaaagtctgggttagggcttgcagtgaagtggtgcttcgcggccaaggaggagaagctctgaagacgtggaagaatggtgcacgtgagcttttaccgcaactatggcaagactttcaagaagcctcgcaggccctatgagaaggagcggcttgatgctgagctcaagcttgttggtgagtatggtcttcgcaacaagcgtgagctttggagagttcaatatgccctgagccgcatccgcaacaatgctcgtatgctgctgaccctggatgagaagaattcacggcgcatcttcgaaggagaggcacttttgcgacgcatgtttagatacgggctcctggaagagagccaaaacaagcttgattatgtcttggccttaactgtggagaactttctggagcgccgtctgcaaactctcgtctttaagtcaggaatggcgaagtctatccatcacgctcgggttctcattaagcagagacacatacgggtaggcaagcaagtggtcaacgttgcctcgttcctggtcagagttgattcacagaaacatattgactttgctttgtctagccccttcggtggtggtagacctggtcgtgtgaagaggaggaacatgaaggctgcatccaagaaagctgcaggtggtgaagaggaggaggatgaagattaactagtttgaataggggagctcttctgatttatcataaaagatttttgctggatagaacagctagacaccaccagccttcattagctgccttagagtcagtctgactgagtgtatgagcattctacgaatagttgttggttgtgcttgctaagcagttatgatatctttttggccactgtttttttaatagtatattgacatgagattatggggtgaa

SEQ ID NO: 3021 - DNA, 844 bp, Zostera marina
tcctcgttcattttgcgctgcagaagaagacgacgagatggtgcacgtcagcttctaccgcaactatgggaagacgttcaagaagcctcgccgtccatatgagaaggaaaggcttgatgctgaattgaagcttgtcggagagtacggtcttcgttgcaaaagagagctctggcgtgtgcagtatgcacttagccggatccgtaatgctgcaaaggaacttcttaaattggatgataagaatgagaaacgtatctttgaaggtgaagctcttctccgccgtatgcatcggtatgggcttcttgaagagactcagaataagctcgattatgtcttggctttaaccgtagagaacttccttgagcgtcgtctacagactcttgtgttcaagtctggtatggccaaatctattcaccatgcccgtgtgcttatcaggcagcgtcacatcagggttggcaggcaagttgtcaacattccatctttcatggtgagaatggattctcaaaagcacattgacttctcacttatcagtcctttcggtggcggtcgacctggtagggtgaagagaaggaaccagaaggctgctgcaaagaaagcatctggtggtggtgatgctgaagaagatgaagattgagttaaaataaattatctgttcccttcatcatcttttactttcagaacttcctatatatctatcttaatcttattccatctagttgttatgtttacttatttgagaattttgaggatctaaacaatcagttgttttcttatttttttccaagttctattattttcgtttgttagattttgtaatgaattgaattttttcatcaatgataaattc

SEQ ID NO: 3022 - DNA, 904 bp, Zostera marina
ccaccaccttccctacaaatatacaagtgagttttgtccgccgtcctcgttcattttccgctgcagaagaagacgacgagatggtgcacgtcagcttctatcgcaactatgggaagactttcaagaagcctcgccgtccatatgagaaggaaaggcttgacgccgaattgaagctcgtcggagagtatggtcttcgttgcaaaagagagctttggagggtccagtacgcgctcagccggatccgtaatgctgctaaggaacttcttaagctcgatgataagaatgagaaacgtatctttgaaggtgaagctcttctccgccgtatgcatcggtatggacttcttgaagagacccagaataagctcgattatgtcttggctttaaccgtcgagaatttcctcgagcgtcgtctacaaactcttgtgttcaagtctggtatggccaaatctatccaccatgctcgtgtccttatcaggcagcgtcacatcagggttggaaggcaggttgtgaacattccatctttcatggtacgaatggattcacagaagcatattgacttctctctcatcagtcctttcggaggtggccgacctggaagagtgaagagaaggaatcagaaggctgcggcgaagaaagcatcaggtggtggtgatgctgaagaagatgaagattaagtaaaaaaaaaaattatctattcccatcgtgatcgtatttttactatctgagtttcctatatgtttatcttaatcttattccacctagttattatgtctacttatttaaattttttgagaatctgaactatcagttgtgttttcttatttctttgcgagttttattgttgtttttgattattagatttctgaacgaattgaacttttagattaagaaagataattttttg

SEQ ID NO: 3023 - DNA, 897 bp, Brassica juncea
ctcctctctgttttgtgacagcagccatggtgcaagtcaggttctaccgcaactatggcaagaccttcaagaagccgcgacgtccttacgagaaggagcgtctcgacgccgagctgaagcttgtcggagaatacggtcttcgttgcaagagagagctctggagggttcagtacacgcttagccgtatccgtaacgcggccagagagcttctcactctcgacgagaagaaccctcgtcggatctttcaaggtgaggctcttcttaggaggatgaacaagaatgggcttcttgatgaatcccagaacaagctcgactacgttcttgctttgaccgttgagaatttcctcgagcgccgtctccagactattgtcttcaagtccggtatggccaagtccattcaccatgcccgtgttcttatccgacaaaggcacatcagggttgggaggcaactggtgaacattccatcgttcatggtgaaagtagactcgcagaaacacatagacttttctctgaccagtccatttggtggtggtcgacctggaagagtgaagagaaggaacgagagagctggagccaagaaagccggtggtggtggtgatggagatgaggatgatgaagagtgaaaataccaaacctttaaaacccctttgttagataaataatggtcttctttttttgtttaatagttctcttgaactagaagaagtcaagtgtgttggtttgtaatggatctagcctttgtgtgttttgcaataatgtggtaatggacctttgtgttcttgaacagtgatgccactttcggatcttgcttcttacaagacagtagtagtagttacgttgtcttttcatacaagcataaagctcttcttcaatctacaaagtacaaacctcttttag

SEQ ID NO: 3024 - DNA, 941 bp, Medicago truncatula
catttcatcattttcacaaaaacctacaccggcggcagcagcaagcagcggcggcaaatcggagaacaaacatggttcacgttgcgttttaccgaaactatggcaaaactttcaagaagccccgtcgtccatacgagaaggagcgtttggatgctgagttgaagctcgtcggagagtatggtcttcgctgtaagagagagctgtggagggttcaatacgctcttagccgtatccgtaacaatgctagaacacttttgacactggatgaaaagaaccctcgtcggatcttcgagggtgaagctcttttgaggaggatgtttaagcatggcttgcttgatgaaactcagaacaagctcgattatgtcttggctctcactgttgagaattttctcgagtgtcgtcttcagactctttgtgtttaaatctggcatggctaagggtccattcaccatgctagggttcttatctgacagaggcacattgggttgggaggcaggttgttaacatcccatccttcatggtgagggttgattcacagaagcacattgacttttccctcacaagtccctttggtggtggtcttcctggtcgcgtgaagtgaaagaaccttaaggctgcagccaagaaggcttccggtggtgatggagatgaggaggatgaagattaaataattaacttacaaattctcttgattttggtcatcctggtcgcgtgaagttaaagaaccttaaggctgctacttagaaggcgtccggtggtgatgaagacaaggaggatgaagataaaatatataatttctgctgctttcaatcttgcaccttccttcttatttatgtctagactatttagattatttatcatggatgatttttacaattttgctaccgtttcttgggtgagttaaaactttagctgatatattttgtttttacaacttcttt

SEQ ID NO: 3025 - DNA, 897 bp, Euonymus alatus
gataaatcatcatctcgccttgtcgcagttcttccttgcgtcattgctctcgctacttgaggagaagaggacggcgccatggtgcacgttaatttctatagaaactatgggaagacttttaagaagccgcgtcgtccatatgagaaggaacgtctggatgcagagctgacgcttgttggagagtatgggctccgttgtaagagggagttgtggagggttcagtatgcactgagccgtatccgtaataatgcaagaatgcttcttaccctagatgagaaaaatacacgccgtttatttgagggtgaagctcttcttcgcaggatgaacacatatgggctcctggatgaaggcaaaaacaagcttgatcacgtcttggctcttactgttgagaagttccttgagcggcgccttcaaacgcttgtgttcaagtctggcatggccaagtcaattcaccatgcccgtgtgctcattaggcaacgacatatcagggtggggagacaggttgtcaacataccatctttcatggtgaaggttgattcccagaagcacattgacttctctctgacaagtccttttggaggtggccgcccaggtagagtgaagagaaagaacctgaaggccgctgccaagaaagcatctggaggagccggtgatgaagaggatgaggagtaaacatgaaaggccactgccaatcaaggtgatggggtttgagacgaccgtgacggggaatgaacattaggctagcaatatggttttatttagattaaagacttgtttgcttatcttttgaacaagttttttttgtttggtgctatggtgactgccatttttttggattggattactcttttttgatgatgacatttgggaatttgatttctgcatgagaaaaccatt

SEQ ID NO: 3026 - DNA, 946 bp, Euonymus alatus
agttcttccttgcgttattgctctcgctactttgaggagaagaggacggcgccatggtgcacgttaatttctatagaaactatgggaagacttttaagaagccgcgtcgtccatatgagaaggaacgtctggatgcagagctgacgcttgttggagagtatgggctccgttgtaagagggagttgtggagggttcagtatgcactgagccgtatccgtaataatgcaagaatgcttcttaccctggatgagaaaaatacacgccgtatgtttgagggtgaagctcttcttcgcaggatgaacacatatgggctcctggatgaaggcaaaaacaagcttgatcacgtcttggctcttactgttgagaagttccttgagcggcgccttcaaacgcttgtgttcaagtctggcatggccaagtcaattcaccatgcccgtgtgctcattaggcaacgacatatcagggtggggagacaggttgtcaacataccatctttcatggtgaaggttgattcccagaagcacattgacttctctctgacaagtccttttggaggtggccgcccaggtagagtgaagagaaagaacctgaaggccgctgccaagaaagcatctggaggagccggtgatgaagaggatgaggagtaaacatgaaggctactgccaatcaaggtgatggggttggatacgactgtgacggggaatgaacattaggctagtaacaggcctagcaaaatatggttttatttagattaaagacttgtttgcttatcttttgaacaagttttttgggtttggtgctatggtgactgccatttttggattggattactcttttttgatgatgaaatttgggaatttgatttctgcatgagaaaaccatttgggcaagttacgaattgacgaggttgtgtagtgctctaatgtcaagttggacgagttacgac

SEQ ID NO: 3027 - DNA, 824 bp, Brassica juncea
gtgcaagtcaggttctaccgcaactatggcaagaccttcaagaagccgcgacgtccttacgagaaggagcgtctcgacgccgagctgaagcttgtcggagaatacggtcttcgttgcaagagagagctctggagggttcagtacacgcttagccgtatccgtaacgctgccagagagcttctcactctcgacgagaagaaccctcgtcggatctttcaaggtgaggctcttcttaggaggatgaacaagaatgggcttcttgatgaatcccagaacaagctcgactacgttcttgctttgaccgttgagaatttcctcgagcgccgtctccagactattgtcttcaagtccggtatggccaagtccattcaccatgcccgtgttcttatccgacaaaggcacatcagggttgggaggcaactggtgaacattccatcgttcatggtgaaagtagactcgcagaaacacatagacttttctctgaccagtccatttggtggtggtcgacctggaagagtgaagagaaggaacgagagagctggtgctaagaaagctggtggtggtggtgatggagatgaggatgatgaagagtgaaaataccaaacctttaaaacccctttgttagataaataatggtcttctttttttgtttaatagttctcttgaactagaagaagtcaagtgtgttggtttgtaatggatctagcctttgtgtgttttgcaataatgtggtaatggacctttgtgttcttgaacagtgatgccactttcggatcttgcttcttacaagacagtagtagtagttacgttgtcttttcatacaa

SEQ ID NO: 3028 - DNA, 1061 bp, Cannabis sativa
aattataggagaagaagatttccttaatttgatttgtgttgtgtagatggtaaaaccttcaagaagcctagacgtccttacgagaaggagcgtttggacgctgagttgaagctcgtcggagagtatggtctccggtgtaagagagagttgtggagggttcagtatgtgctgagccgaatccgtaacaacgctagaatgcttctgaccctcgacgagaaaaacccacgtcggatttttgagggagaggcccttctgaggaggatgaacagatacggattgttggatgagagccagaacaagctcgattacgttcttgctctaactgtcgagaactttttggagcgtcgtcttcagacccttgtcttcaagtccggtatggctaagtcaatccaccatgctcgagttcttatcaggcaaaggcacattagagttggaaggcaggtagtcaacatcccctcattcatggtgagggttgactctcagaagcacattgatttctccctcacaagtcccttcggaggtggtcgccctggccgtgtgaagcgaaagaaccaaaaggcagctgccaagaaggcttcaggtggagatggagatgaagaagacgaagaatgaagatcataggggtcctaagtgagtcttttttgtccaggaatttctttctctgttagattttgtggtttttgtcaactccaccatggaatatcaatatgttataatcataggaagttttgcttgctatgctctaaatctgatctgtttttatttggtttgaaattatataactagatggcttattattatatcaagatgagacactatttccctttaatttttccctgggtaatattgatgtgtttggtggtttagttgggattcactgcctaggtgactgaaatattattactgctttattatgaatcgccttattatttggtttaccaaagatgttaccaaataagtaaagcaaatagtacaccaaatggagttacttcatcacactatgtctttttgcttagattttctttcctagttaacatctttatttttttattgtattataa

SEQ ID NO: 3029 - DNA, 1110 bp, Amorphophallus konjac
cgagccacttgccttcttgaactggttataaacgagagggtttttagataggcgtcgccgctcttcacacctctccctccgatcgccgcggccgtagctgccaccatcactgctaccaccaccacctcaaggaggcagaagaggcggcggaggagccggccgctatggtgcacgtctccttctaccgcaactatgggaagacttttaagaagccacgtcgcccttatgagaaggagcgtcttgaccaggagctaaaacttgttggagaatatggtctgcgttgcaagagggagctctggagggtgcagtatgcactgagccgcatccgtaatgctgccaaggagcttctcaagcttgatgagaaggatgagaagcgtatctttgaaggcgaggcccttcttcgtcggatgaacagatatgggtttttggacgagagccagaacaagcttgattatgttctggcattgacaccagagcactttcttgagcgccgtctccaaactcttgtgttcaaatctggaatggcaaagtcaatccaccatgcccgagtgcttatcaggcagcgccatattagggttgggaggcaggtcgtgaacatcccatccttcatggttagggttgactcccaaaagcacattgacttctctctgaccagtcccttgggcggtggtcgtcccggaagggtgaagcggaagaacatgaaggctgctgctaagaaggctgctggaggtgacgacgatgaggaagatgaggaatgagcatcttgagctgtgagcggtggaattactactattctggctgttttctatctttaatttgtctcctgtctaccaacagtctatcctaagatgtcctggtggttttatttctgttgttgccaagtgaatcatctgataggcatatgtttcttgaggtgtcagacaaccttctttgcctttggctgtgtttatataggtatacacaaggatttctcctgttgctgtctacaatgcatcctttttggatcttactagatctaggaaaatatatttacaactgtttcgttgaaatttctgtgcctgcgaggcagcattcgccatcgattctcgtttcatatatatagcagcattt

SEQ ID NO: 3030 - DNA, 1247 bp, Amorphophallus konjac
cttcttctcctccgctcatcagctgccacagcggagccatcgccatcggcactcgcaggaggaagcagcagctgggtagcgggagcctccagtcatggtgcacgtctcgttctaccgcaactatgggaagactttcaagaaaccacgtcgcccttacgagaaggagcgtctggatcaagagctgaagcttgttggggagtatgggctgcgggccaagagggagctttggagagtgcagtatacacttagccgcattcgtaatgctgccaaggagctcctcaagcttgatgagaaggatgaaaagcggatcttcgagggtgaggctctcttgcgcaggatgaacaggtatgggctcttggacgagagccaaaacaagctcgattacgtcctgtccctgactccggaaaactttcttgagcgccggctccagacacttgtgttcaaggctggaatggccaagtcaatccaccatgctcgtgtcctcatcaggcagcgtcatatcagggtagggaggcaggtggtgaacattccatccttcatggtgagagtagattcccagaagcacatagacttctctcttaccagtccacttggtggtggtcgccctggcagggtgaagcggaagaacgcgaaagctgccgccaagaaggcggctggaggcgacgatgacgaggaggatgaggagtgaacatcatcgttagatattatagtcgaaaatgcctctactattactactcttactttttttttaattttcccgtaattttgtttctagtctttgagctttccttcttgagacattcattttttttcctctcctgccctcaaagtggatcttcaaggggacttcgttgtttactatcctagaaacctgaattttgttgcacgtccgtggggttgctctaattgctgtctttgcaggattttaaacagtggaccatccaactaagttatctcctggcaagcagttctcgttatccttatcatgtgattacggggtttgaacgataccagtggaattggacgagacagataggtggtctcccttgaatgtttgttgttttaacccggtggatggtggatcagaacatttgagacgttttgtttgggtgtggatttggtctaagattttgccgactgggtgggtcggatcgaccgacacttgacctggtattgtacgatttggccgactgaagttgagtcgctcacttgagtcgtcttggagacgtaacagtttttgtgtgtgt

SEQ ID NO: 3031 - DNA, 1130 bp, Amorphophallus konjac
aaggattagggtttccggcccgtcttccactccctcttcttgcccgagcagccgcggccgcagagcaggcgaggcggcggggcaggaagccgaggaggaggaaccaggaggagcagccatggtgcacgtctcattttaccggaactatggaaagacttttaagaaaccacggcgtccgtatgagaaggagcgtctcgaccaggagcttaagcttgttggggagtatgggctgaggtgcaagagggaactctggagggtgcagtacgcactgagccgaatccgtaacgctgccaaggagctcctcaaactggatgagaaggatgagaagaggatatttgagggtgaggcccttctccgtcggatgaacaggtacgggctgctggatgagagccagaacaagctcgactacgtacttgccttgacaccggagcacttcctggagcggcgtctccagacacttgtgttcaagtctgggatggccaagtctatccaccatgctcgcgtgctcatcaggcagcgccatatcagggttgggaggcaggtggtgaacatcgcatcgtttatggtgagagttgattcccagaagcacatcgacttctctcttaccagtcctctcggcggcggtcgccctggaagggtgaagcggaagaaccagaaggctgctgcgaagaaggctgccggaggcgatgacgatgaggatgatgaggaatgaacatcgtgacagatagagcagaaaagcaagccttttggatccgttaattgttgcactttaccttaattattgtttccattttatgaactatcttcgcaagggtattccagtggttgtcatttgttttttcggaccatcaagtggaattttgtgatccctaaactgtaggtggatgttgagataccggatatcctgctttttcttgagtgcaatgcttggatttctccgattccttaccctccctgtctctgaagtatttttggttatgtactccatcgactgctggggtggttgataacttgatatccgtatactatgtgaggtgacagtcagatgcctgattcacttttgcctttgatgaaaaatgagcagaattgtgatttgaatgtggccctcttatgctaaaagggctaaactt

SEQ ID NO: 3032 - DNA, 612 bp, Vaccinium corymbosum
  misc_feature (581)..(581): n is a, c, g, or t
  misc_feature (608)..(608): n is a, c, g, or t
ggcaattgacggcaagccggcggagccatggttcacgtcaatttctatcgcaactatgggaagacttttaagaagcctcgccgtccttatgagaaggagcgtttggacgctgagctgaagcttgtgggagagtatggacttcgatgtaagagggagttgtggagggttcagtatgctctgagccgcattcgtaatgcagcgagaatgcttctcacccttgatgagaaaaatcctcgccggatctttgagggtgaggcacttctacgcaggatgtataggtatggacttttggatgagaaccagaacaagcttgattatgtcttggctttgactgtggagaacttccttgaacggcgtcttcaaacgcttgttttcaagaccggtatggctaagtccattcaccatgctcgtgtgctcattaggcagaggcatatcagggtgggaaggcaggtggtcaacatagcgtcattcatggtgcggctggactctcaaaaacacattgatttctctctcacaagtccccttggaggtggacgccccggaagagtcaagcgaaagaaccaaaaggcggccgctaaaangctgctgggggagatggcgatgaggangatg

SEQ ID NO: 3033 - DNA, 679 bp, Petunia hybrida
aagaatttcacaaaaaatctcaggacacttgagcagatcggcgacggcaacccggtgaccggaaattatggtgcacgtctccttttatcgcaactatgggaagacctttaagaagccccgacgcccatatgagaaggagcgattggatgcagagttgaagcttgtgggagaatatggattgaggtgcaagagggagctttggagagttcagtatgctttgagccgtatcaggaatgctgcaagaatgcttctgaccttggatgagaaagacccacgccgtatttttgaaggtgaagcactcctgagaaggatgaacagatatggattattggaagagaaccagaacaagctcgattatgtcttggctctcactgtggagaactttcttgagcgtcgtctccaaacccttgtcttcaagactggaatggccaagtcaatccaccatgctagagtgctaattaggcaaaggcatatcaaggtcggaaggcaggtggtgaatgttccatcgtttatggttagagtcgactcccagaagcacattgacttctctctcacaagtgctttgggtgtgggcgtcctggaggaatgagagacgaacaaaaatctgctgcaaacaagctgctgatggggatgagaattatgaggatatgagtatctctctattatgtgtgaggtgtcc

SEQ ID NO: 3034 - DNA, 619 bp, Utricularia gibba
gggttggtgctcgcagccatggtgcacgtcgccttctaccgaaattacggcaagactttcaagaagccacgtcgccctttcgagaaggagcgtttggatgctgagttgaagttggtgggtgaatatgggctgagatcgaagagagagctgtggcgtgtgcagtacgctctctccaggatcagaaacaacgcaagagagcttctcaccatggacgaaaagtccactcgtcgtatttttgagggagaggcgcttttgaggagaatgaacagatacgggctccttgatgagacgcagaacaagctcgatttcgtgcttgctctcaccgtggagaactttctggaaagaaggctgcagaccttggtgttcaagactggcctcgccaagtctattcaccacgctcgtgttctcatcagacaacgccacatcagagtgggaaagcaaatcgtgaacattccttccttcctggtaaggcttgacagccagaagcacattgattttgctacctcgtctccctttggaggaggcccaccaggacgtgtcaagagaaagaaccagaagtccaagaagggtggaggaggaggtgatgacgatggtgagggagatgaggaagaagaggagt

SEQ ID NO: 3035 - DNA, 1029 bp, Ceratodon purpureus
ctcttttcagctcgcgtttcgtcgccagaggtcgaagcccgcaagcttcacactcttcaccatggtgcacgtggcccacttccgcaattatgggaagacttttaagaagccccgtaggccgttcgagaaggagcggttggatgctgagctgaagttggtcggagagtacggcctgcgaaacaagcgtgagctgtggagggtgcagtatgctctgagccgtatccgtaacaatgcccgtatgttgttgaccttggatgagaagaacacccgtcgtatcttcgagggagaggctcttttgaggcgcatgaacaggtatggtcttctcgatgagagccagaacaagctcgattacgtgctggcacttaccgtggagaactttttggagcgacggctgcagactcttgtgttcaagtctggcatggccaagtccatccatcacgcccgtgtgctcatcaggcagcgtcacatcagggtgggcaggcagatggttgatgtaccttcattcatggtccgcgttgacagtcagaagcacatcgacttctctctgaccagtaccttcggtggcggtagacccggaagagtgaagcgcaagaacaccaaggctgcgtccaagaaggcgtccggtggtgatgatgatgaggaagaagatgacgagtagattttgacttctaattactcctaacagagggcacattggagtattttgttatcgatgaacaaattaagaaaagcagttacatactcctccctgtggacaatattgcattagactcaaaacgtgtctaatttctcgtgtttgttggtatctttttcgaactactccaggaatcattatcgtctcgcgtttggtaaattgtattttttagtccgtgccccgccttaaaggtcaccaattcatcagatagtgttcctgtttaattctgggaccatagcacttcgaagttttagtggactacctgttgtgtgaggcagatagtgtcgaagatggtggtcagcttgtcgctgtttctgtagatgggcactgaggag

SEQ ID NO: 3036 - DNA, 892 bp, Ceratodon purpureus
cccttttcacgcctgcgtctattgcaaggtggaagctccgccagcttcatcgcccccgccaacatggtgcacgtcgcttccttccgcaattatggaaagactttcaagaagccccgcaggcccttcgagaaggagcgtctcgatgctgagctgaagttggtcggagagtacggtctccgcaacaagcgcgagttgtggagggtgcagtacgctctgagccgtatccgcaacaatgctcgtatgttgctcaccctggacgagaagaacactcgtcgtatctttgagggagaggctttgttgcgtcgcatgaaccgatatggacttctcgatgagagccagaacaagctcgattacgtgctggctttgaccgtggagaacttcttggagagacgtctccagactcttgtgttcaagtctggcatggctaaatccatccatcatgcccgtgtcctcatcaagcagcgtcacatcagggttggaaagcagattgtggatgtagcatcattcatggtccgcgtcgacagccagaagcatgttgacttctccttgtcgagcccacttggtggcggtagacctggaagagtgaagcgcaaaaacatgaaggctgcgtccaagaaggcctccggcggtgacgacgatgaggaagaggatgacgagtagatcttgacctttgattactcctagcagaggctttatcggagtgattcttatgattattggctactttttaaaaaacggttgaatactcctttctgtgatatacttatgtgtcaggtcttgtgtcgtctgtgtgcttgttcatttcttattctgttttcgaagatatcatcttgaataagtaacgcattttcttcacggatctgaattagtctttcattaatatgtatacccc

SEQ ID NO: 3037 - DNA, 955 bp, Euonymus alatus
gacgtactgatgtggccactagggttttatcctctagggttccgcctttatatcgggacatcatctcaattagcctagtcgcatctcttcacttactgctcttgctgcttgaggagaagccggcggagctatggtgcacgttaatttctacagaaactatgggaagacttttaagaagccgcgtcgtccttatgagaaggaacgtctggagtcggagctgaagcttgttggagagtatgggctccgttgtaagagggagttgttgagggttcagtatgcgctgagccgaatccgtaatgctgcaagaatgcttcttaccctggatgaaaaaaatagccgccgtatctttgagggtgaagctcttctacgcaggatgcacaaatatgggctcctggatgagagtctgaacaagcttgatcacgtcttggcccttaccgttgagaacttccttgagcgtcgccttcagacacttgtgttcaaatccggcatggcaaagtcgattcaccatgcccgtgtgctcatccggcaacgacatatcagggtggggagacaggttgtcaacataccatctttcatggtgatggttgattcccagaagcacattgacttctctctgacaagtccatttggaggtggccgccctggtagagtgaagagaaagaacttgaaggctgctgccaagaaagctgctggaggagccggtgatgaagaagatgaggagtgaaacattaggcgagagtaacaagcctagcaacatgtttttattttagactttgccatctctagaataagttctttgtttggtcatatggttactgccattttaattttgtagttgatattattgcatgttttatgtgtctgtcatggattggattacgactatgctgctgtttgagccaagtttgcttccttttgctgatgacatttgtgaatttgatttctctgtgcacta

SEQ ID NO: 3038 - DNA, 910 bp, Euonymus alatus
gggttttatcctctagggttccgcctttatatcgggacatcatctcaattagcctagtcgcatctcttcactaactgctcttgctgcttgaggagaagccggcggagctatggtgcacgttaatttctacagaaactatgggaagacttttaagaagccacgtcgtccttatgagaaggaacgtctggagtctgagctgaagctcgttggagagtatgggctccgttgtaagagggagttgttgagggttcagtatgcactgagccgaatccgtaatgctgcaagaatgcttcttaccctggatgaaaaaaatagccgccgtatctttgagggtgaagctcttctacgcaggatgcacaaatatgggctcctcgatgagagtctgaacaagcttgatcacgtcttggcccttacagttgagaactttcttgagcgtcgccttcagacacttgtgttcaagtctggcatggcaaagtcgattcaccatgcccgcgtgctcatccggcaacgacatatcagggtggggagacaggttgtcaacataccatctttcatggtgatggttgattcccagaagcacattgacttctctctgacaagtccatttggaggtggccgccctggtagagtgaagagaaagaacttgaaggctgctgccaagaaagctgctggaggagccggtgatgaagaagatgaggagtgagaacgttaggcgagtagcaagcctagcaacatgtttttattttagactttgccatctctagaataagttctttgtttggtgatatggttactgccattttaattttgtagttgatattattattgcatgttttgtgtctgtcatggattggattacgactatgctgctgtttgagccaagtttgcttccttttgctgatgacatttg

SEQ ID NO: 3039 - DNA, 1126 bp, Physcomitrella patens
gagcttcttcgcctctctctctttgtagcttgcgcttctcttgctcgtcggaagctgcgcaggcttcaacaccaagatggtgcacgttgcttcctttcgcaattatgggaagactttcaagaagccccgcaggcccttcgaaaaggagcgtcttgatgctgagctgaagttggttggagagtatggactccggaacaagcgcgagctttggagggtgcagtatgctcttagccgtatccgcaacaatgcccgtatgttgcttaccttggatgagaagaacactcgtcgtatcttcgagggtgaggcccttctgcgtcggatgaaccgatacggtcttcttgatgagaaccagagcaagcttgattatgtgctggctctcactgtggagaacttcttggaacgacgccttcagacccttgtgttcaagtctggcatggctaaatccatccatcacgctcgtgttcttatcaagcaacgtcacatcagggtcggcaagcagattgtcgatgtaccatcgttcatggttcgtgttgacagccagaagcacgttgacttcgccctgtcgagtcctcttggtggtggacgacctggaagagtgaagcgcaagaacatgaaggctgcatccaagaaggcgtccggtggagacgatgatgaggacgaggatgacgagtagatcttgtatacgctactagtaaatggggttgttttgtgagtaattctgttatcgatgaacgtcttagaggaacagtaaagtactccgccctgtggatacttctgcatttgactatccatgttgcttcgaatcttctcaacttatggcgtttcaatatgcattttaagaatatggtttcgcagtcaagacgcatgtggaactgcaatctcatcatctttcgcgttccatctttgggatccatcgtagttgagtttgaatcccacaccctttactcctctatctactggtgattattagatcaggctcttgcaccgttataatttgatttcattattttggggtgggactttgtctctaatttagaaatgcacttaagtacatcatacgaacactgcatgtacaaattgatttttaagctgatcggaactttggacatcaggacagttacgaatt

SEQ ID NO: 3040 - DNA, 854 bp, Cannabis sativa
ttcttcttctttgttttgatctgaatcgtgtttttgtgtagatgggaagacgtttaagaagcccagacgcccttacgagaaggagcgtttggacgctgagctgaaacttgtcggagagtacggtctccggtgcaaaagagagctttggagggttcagtatgtgttgagccgaatccgtaacaatgctagaatgcttctcactcttgatgagaaaaacccacgtcgtattttcgaaggggaagcccttttgaggaggatgaacagatatgggttgttggatgagagccagaacaagctcgattacgttcttgctcttactgttgagaactttttggagcgtcgtcttcagacccttgtcttcaagtctggtatggctaagtccatccaccatgctcgagttctcatcaggcaaaggcacattagggttgggaggcaggtagtcaatatcccatcatttatggtgagagttgactctcagaagcacattgacttctctctcacaagtcccttcggaggtggccgccctggccgagtgaagcgaaagaaccagaaggcagctgccaagaaggcttctggtggagatggagatgaggaagaagaagaatgaagtacttcccattgagttttttagtctagccttttcctatcatttgcagattttttgttttttttttttgggttccaactctaattttgttttttgccaactctatcatggattttgttatgagactttagttttaagatatgtgtgatatgtacccttctgaacacatttcacatctccaaatcattttttctggtttacaagtatgatacaatcacattgaaatcttagtatagttttacataat

SEQ ID NO: 3041 - DNA, 746 bp, Physcomitrella patens
gacaagagatcctcttttccagtttttgttctcttgcggtggaagctccgcaagcttcaacaccaagatggtgcacgttgcttccttccgcaattatgggaagacatttaagaagccccgtaggcccttcgagaaggaacgtctcgatgctgagctgaagttggtgggagagtatggtctccgcaacaagcgcgagctctggagggtgcagtatgcccttagccgtatccgcaacaatgcccgtatgttgcttaccttggatgagaagaacactcgtcgtatcttcgagggagaggcccttctgagacgcatgaatcggtatggtcttctcgatgaaaatcagagcaagctcgattatgtgctggctcttaccgtggagaactttctggagcgacgcctccagactcttgtgttcaagtctggcatggccaagtccatccaccacgcccgtgttctcatcaagcaacgccacatcagggtcggcaaacaaatcgtcgatgtcccctcttttatggttcgcgttgacagtcagaagcacgttgactttgctctgtcaagcccacttggtggcggaagacctggcagagtgaagcgcaagaacatgaaggctgcatccaagaaggcatccggtggtgacgatgatgaggaagaggatgacgagtagatcttgaatttaccagtagcggagggggttcaccaggctatttctgtgattgatgaataacctaagaaaagcagttgattcc

SEQ ID NO: 3042 - DNA, 933 bp, Physcomitrella patens
ctctttccacgcttgcgattgtagttggttggaagctctgttggcttcaacgcaaaaatggtgcacgtcgcttcgttccgcaattatggcaagacttttaagaagccccgcaggcccttcgagaaggagcgccttgatgctgagctgaagttggtcggagagtatggtctccgcaacaagcgtgagctctggagagtacagtacgctctgagccgtatccgaaacaatgcgcgtatgttgcttaccctggacgagaagaacacccgtcggatcttcgagggagaggcacttcttcgacgtatgaacaggtacggtcttctcgatgagaatcagagcaagcttgattacgtgctggctctgaccgtggagaactttttggagcgccggcttcagactctcgtgttcaaatctgggatggccaagtccatccatcatgcccgagttttgatcaagcagcgtcacatcagggtcggaaagcagattgttgatgtgccgtcattcatggtccgcgttgacagccaaaagcatgttgatttcgccctatccagtccacttggtggtggaagacctggtagagtgaagcgcaaaaacatgaaggctgcgtccaagaaggcctccggcggagatgacgatgaggaggaggatgatgagtagatcgattgctgttcattcctagcagagggttcagtgaaatcttttgcttcttatagacattaaagaaatcgttgccgcacgatgcattataccatgggactaatgcatcaatcatcgatcttttgaacttcggatttcgaaagtaaacagtgtcgtgatcacattttttcgccaattcagtagcttgcttttttcgtctgctgattttgagcaggtgatgttgattgtaccgaagacaacgaagtgtttcgatgtttctttaatagtgagcaactaccc

SEQ ID NO: 3043 - DNA, 800 bp, Ambrosia trifida
atggtaagacatttaagaagccgcgtcgtccttacgagaaggaacggttggacgccgagttgaagcttgtgggagagtatggtcttcgatgcaagagagagctttggagggtgcagtatgcattgagccgcattcgtaatgccgcaagaatgcttttgacacttgaggagaaggacccgcgtaggatttttgagggtgaggctcttatgaggagaatgaataggtatggtttgttggatgagagtcagaacaagctcgattacgtgcttgcgcttactgtggagaactttcttgaacgtcgtcttcagacacttgtgttcaagactggtatggctaagtctattcaccatgctagagttctcatcaagcagagacatgtcagggttggaaggcaggtggtgaatgtgccatctttcatggttagagttgactcacagaagcacattgacttttcactcacaagtccgtttggcggtggccgacctggaagagtgaagcgaaagaaccagaaggctgcaactaagaatgcagttggtggtgatgcagatgaggatgatgaagaatgagctcactcttttggttccaagtattgattatttcttggctagggtgaggtctttgtaccaaaaaattttccctgaagggattattattccaccatcatatgctcaatgcagcagccaaggagcaattgtgatggccgacaagagaaatccaaaggaacaaaacaaggagatgggaagtatgactaacgcacataattgaaagagagtaactttttcttgtcttatatacacatt

SEQ ID NO: 3044 - DNA, 817 bp, Manihot esculenta
tttaagaagccccgtcgcccctatgagaaagagcgattggatgcagagctaaagttggtgggagagtatggtttgcggtgcaagagagagctatggagagtccagtatgcactgagccgaattcgtaatgctgctagaatgcttttgactcttgatgagaagaaccctcgtcggatctttgagggtgaagctcttctccgcaggatgaaccgttatggtctattggatgagagtcagaacaagcttgattatgtattggccttgactgtggagaacttccttgagcgccgtctgcaaacacttgtcttcaagtctggtatggcaaagtccatccaccatgcccgtgtgcttatcaggcagaggcatatcagggttggaaggcaggtggtgaacattccatcttttatggtgagggttgattcacagaagcacattgatttctccttgacaagtccatttgggggtgggcgtcctggaagagtgaagagaaagaaccagagagcagctagcaagaaggcttctggtggagatggtgatgaggaggacgaggagtgagctttgagtttagcaccatgctattagagcctgtgctactttcttggctagttttattgttactcttaagggctaggcttgttttttctttccttttttagagtttacatattgctgcataaatggtttgcttcctgaagtttgatattggttttgttttgttatgaattatgtagctatgacctgtgctgaggattattataattttttcccaccaagtgacaatattgctttctgcttatagagtatttgtgttaaaccc

SEQ ID NO: 3045 - DNA, 900 bp, Orobanche aegyptiaca
caatttcagatagggggagtgacgatcccggcggagaaacaccatggtgcacgtatcgcattaccgcaactttgggaagacttttaagaaaccccgtcgtccctatgagaaggaacgacttgatgctgagctgagacttgtcggagaatacggtctgaggtgcaagagagagctttggagggttcagtatgctctgagtcgtattaggaacaatgcaagggaactcttgactcttgacgagaaggaccctcgtcgtattttcgaaggtgaagcccttttaaggaggatgaacaggtacggacttctggaagagagccagaacaagctcgactatgtcttgtcactcagtgtggagaacttccttgagcgtcgactccaaactattgtctttaaggcgggtttggctaagtccattcaccatgctcgtgtgatgatcaggcaaaggcatatcagggtctcgaagcaagttgtcaatgtaccatctttcatggtgaaagtcgactcccagaagcatatcgactattctcttacgagtccgtttggcggtggccgccccggtagagtgaagagaaagaatctaaaggcagcggcaaagaaggctaccggtggtgatggagacgaggaggatgaagagtgatgaggtgttttgaagttttatcttattgagacttatgaatgttttttttctttttttggttaagatgttgagaattaaaatgaagcttctgagctttggcttgtgctcctttgtggatccattttgagtgttgccatttatgttaaaatttggagtttcctttttttgtttgtatctttgttatacaaattgagtttcattgaatttgatctttttgaaaggattcgtttcataatatctttcgtgttaaatacaaaatttaa

SEQ ID NO: 3046 - DNA, 952 bp, Carica papaya
atgggaagacgttcaagaagccccgtcgcccttatgagaaggaacgtttggatgccgagttgaagctggttggagagtacgggctgcgatgcaagagagagctgtggagggttcagtatgctctgagccgcatccggaatgctgcaagagagcttctcaccttggatgagaagaacccacgccggatctttgaaggtgaggcacttcttcggaggatgaaccgctatgggcttttggatgagagccagaacaagcttgattacgtcttggcattgactgtggagaacttccttgagcgccgcttgcaaacccttgttttcaagtctggtatggctaagtccattcatcatgcccgagttctcatcaggcagaagcatatcagggttgggagacaggttgtgaacgtcccatcttttctggtgaggattgattcacagaagcatattgatttctcactcactagtccatttggtggtgggcgccctggaagggtgaagagaaagaacatgagagcagctgccaagaaggctgctggtggtgatggagatgaagaggacgaggaatgagtgagtagttttgatgttttgctgatgagtaataggactgtgctcataattagttttcaaaacaattctatcaacctagttctggaatgtgttcactgcattttaattttcttggttttgatgttgaaatgttttagagaaattttctttgttatatgatatggacatgatatgaagaattctattacattgagctccaaatgaggctgttacctgctggtcttttgttgttttgtttacacattcacactggtgttagtagtaaaggggtggattaaatgtttgctcactttcctataaagtgagaaattaagaatgcactcagaaggatttaccacttttagagttcatgagaattgatggatgatgaattgactgatctgtat

SEQ ID NO: 3047 - DNA, 767 bp, Physcomitrella patens
cttttcgcgcctgcgtttcctgcgaggtggaagctccgttagtttcaacaccaaaatggtgcacgtcgcttccttccgcaattatggaaaaacttttaagaagccccgtaggcccttcgagaaagagcgtcttgatgcggagctgaagttggtcggagagtacggtctccgcaacaagcgtgagctgtggagggttcagtatgccctaagccgtattcgtaacaatgcccgtatgttgcttactttggatgagaaaaacacccgtcgtatcttcgagggagaggccctgctacgacgcatgaacaggtatggacttctcgatgagaaccagagcaagctcgattatgtactcgcgctcaccgtggagaacttcttggagcgacggctgcagaccatcgttttcaagtctggcatggcgaagtctattcatcatgctcgagttttgatcaagcagcgtcacatcagggttgggaagcagatcgtcgatgtgccatcatttatggttcgtgttgacagccaaaagcacgttgatttcgccctatcgagtccacttggtggaggtaggccgggaagggtgaagcgtaagaacatgaaggctgcatctaagaaggcgtccgggggagatgacgaggaggaggatgatgagtagatgatgatttcgataatctcgcatggaggatttaattagatgtttttttttatggacatattaaacgaaattcatgtggatatccttatgagtctattattcatgtcttcttgctcct

SEQ ID NO: 3048 - DNA, 991 bp, Plantago ovata
tatttttccagctagagaagagaccttgtagccgatcgccatggttcacgtcgtgttttaccgcaactatggaaaaacgtttaagaagcctcgacgcccgtacgagaaggagcgtttggacgctgagttgaggctcgtgggagagtacggtctcaggtgcaagagagagctctggagggtgcagtatgcgttgagccgaatccgaaatgctgctaggcatcttctcaccctagatgagaaggacccacgccgtatctttgaaggagaggctcttctccgtaggatgaacaagtttggtctcctggaggaaagcaagctcaatcttgattttgtgctggctcttactgtcgagagcttccttgagcgtcgcctccagactattgtgttcaaggctggcatggccaagtctattcaccatgctcgtgtgcttatcaggcagaagcacattagggttggaagacaggttgtgaatgtgccatctttcatggtgagagttgactcccagaagcacgtagacttttcacttaccagccccttcggtggtggtcgtgctggaagagttaagcgaaagaaccagaaggctgctgccaagaaatctggtggtggagatgaagaagaggatgaggattaagctgtttctaggcgtggactggggggttcagctgcttttacataaactccagcttttaagtttcatattaggagaagtggttttatgtttaaaccttcagttttgttcttgtgacttcaatgctttctctgtttcgtttccttttgaagtataagacattacattagaatatttctgctttactatcggtcttgttttggtgattttgtgtccttttgagccgtgttatgttcacattttgtggtgaatctagtagtgtaacctctcttgtgccttttttaggaaaaagctacatagaatgcagtatgttcgaagatatagttcatgctgtgtgatggcatggcggttgaagctttttgt

SEQ ID NO: 3049 - DNA, 583 bp, Euphorbia peplus
tctgctctgcggtatacacaagaagatcgcagaggtaagtaccggcagctaaatcatggtccacgtttcgttctatcgcaactataggaaaacctttaagaaaccaagacgtccctatgagaaggagcgtttggatgctgagctaaagcttgttggagaatatggactacgttgtaagagagagctttggagggttcagtatgcattgagtcgcattcgtaatgcagcaagaatgcttctgacccttgatgagaaaaacccgcgacgaatttttgagggtgaagctcttctgagaaggatgaataggtatggacttttggatgaaagccaaaacaagctggattatgttttggccctaactgtggaaaactttctcgagcgccgtcttcaaactcttgttttcaagtctggtatggccaagtcgattcaccatgccaggatgcttattaggcaaaggcacattagggttgggagacaggtggtgaacattccttcattcatggtgagggtggactcacaaaagcacattgatttttcgcttacaagtccattcggaagtggccgacctggaagagtgaagaga

SEQ ID NO: 3050 - DNA, 814 bp, Sorghum bicolor
ggtggcggcgaccaataccgtcggcgggcggcggaggcagcgtcagccatggtgcacgtgagcttctatcgcaactatggtaagactttcaagaagccaaggcgtccgtatgagaaggagcgccttgatgctgagctcaaattggtgggtgagtatggcttgaggtgcaagcgtgagctgtggcgtgtgcagtatgccctcagccgcatccgaaatgctgcaagggagctgctcacccttgatgagaagaacccccgccgtatctttgagggcgagaacaagcttgattatgtgcttgcgcttactgttgagaacttcctgcagcgccgccttcagaccattgtcttcaagaatggcatggcaaagtccattcatcatgctcgtgtgctcatcaggcaacgccacattagagttgggaggcaacttgtcaacattccctctttcatggtgagagttgactctgagaagcacattgacttctcccttaccagcccacttgttggtggtgaacctggaagggtgaagagaaagaactcaaagaaggcatctggtggaggcggtgatgatgaggaggaagagtgattatgtgatgctagctccttgttagggcctaattttgctggctttgttaggacctaattttgttacattaaaacaaaagttggctgctgaggattgtctgaaattgcaatttaaattcgtgagaactgtaattgctgagactcttcattgctgaagttgtttgtcctatgaacatgttaattcagtgagaattcaaaggaatgtttgctctgttgcttaaatgagctccata

SEQ ID NO: 3051 - DNA, 853 bp, Sorghum bicolor
ttccccacccctcagaagtcacagcacacctcgtggtggcggcgaccaataccgtcggcgggcggcggaggcagcgtcagccatggtgcacgtgagcttctatcgcaactatggtaagactttcaagaagccaaggcgtccgtatgagaaggagcgccttgatgctgagctcaaattggtgggtgagtatggcttgaggtgcaagcgtgagctgtggcgtgtgcagtatgccctcagccgcatccgaaatgctgcaagggagctgctcacccttgatgagaagaacccccgccgtatctttgagggcgagaacaagcttgattatgtgcttgcgcttactgttgagaacttcctgcagcgccgccttcagaccattgtcttcaagaatggcatggcaaagtccattcatcatgctcgtgtgctcatcaggcaacgccacattagagttgggaggcaacttgtcaacattccctctttcatggtgagagttgactctgagaagcacattgacttctcccttaccagcccacttgttggtggtgaacctggaagggtgaagagaaagaactcaaagaaggcatctggtggaggcggtgatgatgaggaggaagagtgattatgtgatgctagctccttgttagggcctaattttgctggctttgttaggacctaattttgttacattaaaacaaaagttggctgctgaggattgtctgaaattgcaatttaaattcgtgagaactgtaattgctgagactcttcattgctgaagttgtttgtcctatgaacatgttaattcagtgagaattcaaaggaatgtttgctctgttgcttaaatgagctccatacactt

SEQ ID NO: 3052 - DNA, 694 bp, Secale cereale
gactgagagctccagccatggtgcacgtcaacttctaccgcaattatggcaagacattcaagaaaccaaggcgtccttatgagaaggagcgtcttgatgcagaactaaagctggttggtgagtatggactgaggtgcaagcgtgagctctggagggttcagtatgcattgagcaggatccgtaatgctgcaaggcactggggtactacggatgatgagagatcccgcgtatcttgaggcgctgctcttctccgtcgcatgaaccgctatggtctccttgctgagggccaggataagcttgattcgtccttgcctgactgctgatacttctgcaaggcgcttcagactcttgtcttcaaggctggcatggcaaaatccatccaccatgcccgtgtcttaatcaggcaacgccacatcagggttggcaggcagattgtcaatgtcccctcattcatggtgagggtggaatcggagaagcacatcgatttctcactgacaagtccattcggtggaggccctgcaggcagggtgaagagaaagaaccagaagaaggcaagtggtggcggtgacgctggtggtgatgaggaagaggaatgaggaactatcaccttatatttatcaaatgctggtgttatgagtactttagctgagaggcctgagacttacatgggttatcctcttgttcgtttttgtca

SEQ ID NO: 3053 - DNA, 1081 bp, Distylium racemosum
gtttcggcgggcggagaagaagttataaggtaggaggaggaaaaaccagaggtagaagtagaggcagcgccaggcagatccggagggatggtgcacgttagtttctatcggaactatgggaagactttcaagaagccgcggcggccgtacgagaaggagcggcttgacgcggagctgaagctggtgggagagtatgggctgcgcaacaagagggagctgtggagggtgcagtatacgctgagccgcatcagaaacgcggcgagaatgcttcttaccctcgaggagaagaatccccgccgtatattcgagggagaggccctccttcgccgcatgaaccggtatggcctcctcgacgagagccagaacaagctcgattacgtcctcgccctcaccgtcgaaaactttttggagcgccgcctgcaaaccctagttttcaagtccggcatggccaagtctatccaccatgctagggttctcatcaggcaaaggcacatcagggttggcaggcaagtggtgaacattccgtctttcttggttagggttgattcacagaagcatattgatttctcacttacaagtccacttggtggtgggcgtcctggtcgtgtcaagcgaaagaacatgaaggcagcatcaaagaaggcttcgtggtggagatgcggaagaggaggatgaggaatgaggcatgtagtggcactttttctcaagaagagtccattagatttttttttgccctaacacaaggtttctatttgattcagagttgtctgttaaatcaggctgttcttgttactagatgaccatgcattttggcaataggtaaaagacatcagttttaaggcctgtcacatgtttattgttgttgaaatcgggatctattttgactataagctacaaattgaggttttcttctaatctgcggatgattaaaccttttaaataatattcatgtataacaatctgtatttatagtactcttatattcttcctacattgatagtagatgtggtttcattcatacgtattggtgaacagacaaattcaatatttctgcattgcttaacacttgtgtagtgagttg

SEQ ID NO: 3054 - DNA, 920 bp, Primula obconica
gaaccgaccgtcctacgtcgtactacggtaccgtaacgtaactctctctctctctctctctactctctactctctctcgtctactccagtttactgtaaaggcgagagcaaacatggttcacgttccctactatcgcaactatggaaagactttcaagaagccacgtcgtccctacgagaaggagcgtctcgatgccgagctgaagtttttgggagagtacggtctgcggtgcaaaagggagctgtggagggttcaatacgcactgagccgtatccgtaacaacgctagaatgcttctgaccctcgatgaaaagaaccctcgtaggatctttgaaggagaagctcttctgaggagaatgaacagatatggtcttctcaaagaggatcagaacaagctcgattatgtcttagcactcactgtcgagagctttcttgagcgtcgccttcaaactcaagtgttcaagactggcatggccaagtctatccaccacgccagagtgctcatcaagcagaagcacatcagggtcggaaggcaggtggttaatgttccatccttcatggtgaggttggacagccagaaacacattgacttctccctcactagtcctcttggaggcgggcgtcctggcagagtgaaacgaaggaacgtaaagaacgcttctaagaagccttctggtggcgatgctgatgaagaagaagaaggagacagttaaattagcaattttcctgtttttgaaaaagtgtactactcatgctggtttatcattttcttttgaagaagtacaatcgtttggactagtggtttccattgacttcgttgtcgtgttttctgacttgttttttattttcgccatagctatgttcctgaaatatttgtgatgtttggtctttggtaatctttgatatatgtttgttatctc

SEQ ID NO: 3055 - DNA, 767 bp, Physcomitrella patens
accccgttctctttcaagctcgagctcttggaagcagctttgcaagctttttctcaacatggtgcacgtcgccagcttccggaactatggaaagaccttcaagaagccgcgcaggccgttcgagaaggagcgtcttgacgctgagctgaagctcgtgggggagtatggtctccgcaacaagcgtgagctgtggagggttcagtacgctttgagccgtatccgcaacaatgcacgtatgttgcttactctcgatgagaaaaatactcgtcgtatttttgagggagaggcccttctgcgacgcatgaaccgatatggtttgttggacgagagtcaatgcaagctcgattacgtgcttgccctcaccgttgagaacttcttggagcgtcgcctgcagactttggtgttcaagtctggtatggccaagtccatccaccatgcccgtgtgctaatcaagcaaagacacatcagagttggcaagcagatagtggacgtgccttctttcatggtccgcttggacagccagaaacacgtagattttgccctctctagcccacttggaggtggcagacctggaagagtgaagcgaaagaacatgaaggctgcgtcgaagaaggcctcaggcggtgatgacgatgaagaggaagacgatgagtaggttattataaatctctcaccgtgggattctacattctggtgatgggctctgttactagttttgatgagtaaaaactagtgttttcatcaagtaaataatcttgtcgaatgca

SEQ ID NO: 3056 - DNA, 875 bp, Marchantia polymorpha
cgagctctcgagctctcacaggattttgcgcggtgttactgttttgaatctccgcgagttgaaaaccgaggggagtcacaatggtgcacgttgcggtctaccgaaattatggaaagaccttcaagaagcctcgcaggccgttcgagaaggaacgtctcgatgctgagctgaagctcgtcggagagtatggtctccgaaacaagcgcgagctgtggcgcgtgcagtacgcattgagcaaaatccgcaacaatgctcgtacacttctgaccttggacgagaaaaatacaaggcgaattttcgagggagaggccctcctacgaagaatgaaccgatacggtctcctagatgagagtcaaaccaagctcgattatgtgttggctcttactgtggagaactttcttgagaggcgcctgcagacactcgtgttcaagtctggtatggccaagtccattcaccacgcccgagtgttgatcaagcaacgccacatcagggttggcaagcaaattgtcgacgtaccttcattcctggttcgtgtggatagccaaaagcacatcgatttcgctctatctagccccctcggtggaggcagaccaggccgtgtgaagagaagaaacatgaaggccgcatccaagaaggccgccggtggagacggtgatgaagaggaggaagacgaataggttttaacacccctttgtaagatgagaaattatttttgttcctgagccttttgctatcaatagattgccacaatcttcctggcaatgcaatgattaaaaggtcaaatctgaattatgtgctgttctttgtctacattttattgaatgacaaacctaccaaacagcgacagttcgcgctttcgttgtcaaaaaaaaaaa

SEQ ID NO: 3057 - DNA, 948 bp, Cajanus cajan
cgacaccgactggatgggccgcgaggtctacggaggaacggttggggagggcaaggcctatgataggggcgtgcgcgcgggtgccttgggccgttgatttcttactttttttttgtttcgtttgacagatgggaaaacattcaagaagcctcggcgtccgtgtgagaaggagcgtcttgatgcggagctgaagcttgtcggagagtacgggctccggtgcaagcgagagctgtggagggtacagtacgccctcagccgcatccgcaacaacgccaggaaccttctgacactcgacgagaagaaccctcgcaggatcttcgagggcgaggctctacttcgcaggatgttccgctacggtctcctcgacgagacccagaacaagctcgattacgttctcgctctcactgtcgagaacttcctcgagcgccgcctccaaacccttgttttcaagtccggcatggccaagtccattcaccacgctagggttctcatcaggcagaggcatatcagggttggtaggcaagtggtgaacattccatctttcatggtgagggttgactctcagaagcacattgacttctcacttactagtcctcttggtggtggacgccccggaagagtgaagagaaagaaccaaagggctgctgctaagaaggctgccggtggtgatggggatgaggaagatgaggattagactgttaattttgtctttctctagtggtattagaccttgtgccaccttttaccttgcttccctagtttatgcttattgattgttatactttttccgttcttggttccttgtttgagaatataatttgcgtgatatattatgttttttgaacttaaatattttaaagtatcaagattttcccttaataactttggtggtgattgattggtttactggcatctacttatgaacttgtagtgtcccctgagtatttt

SEQ ID NO: 3058 - DNA, 889 bp, Linum usitatissimum
gtctctgagggttttttgttcatctgaaggtaagagagatcgcttcagctgagatcggaaaaatctgctgagcgaagatggtgcacgttgcttatttccgcaactatgggaaaacctttaagaagccaagacgtccttatgagaaggagcgtttggatgctgagctgaagctagttggagagtacggtctcagggccaagagggaactctggagggtgcagtatgctctgagccgcatccgtaatgccgcaagaatgcttctgaccctcgatgagaagaaccctcgtcgtatctttgaaggtgaagcccttctgaggaggatgaacaagtatgggctgttggacgagagccagaacaagctcgattatgtcctggccctgactgttgagaacttccttgagcgccgcctccagactcttgtgttcaagtctggtatggccaagtctatccatcatgccagagttctcatcaggcagaagcacatcagggtcgggaggcaggttgtgaacatcccttccttcatggtgaggctggattctcagaagcacatcgacttctcactcaccagcccattcggcaactctgacatccaaggtagagtgaagaggaagaatatgaaggctgcttcttccaagaaggacgatgccgccgacgaggattaaaagatctagtcttttgctatgtattcggagttgaacggttttgttatgtactcggagtagaatggttttcctgtttgatgtttttgtttctccgttatagattttgttctttctgcacttcattttgttcgaattctcttatggttgatggaatttgaatcgttatgaatttcaaagcttggttgttgttccttaccttcataatccacgaatcttgatattggacc

SEQ ID NO: 3059 - DNA, 610 bp, Castanea mollissima
tcggcgccatcgtcctccacctctcttcatttgaattcagatcgtttaaccagaggactaacagtacggcttaactcacaccatggtccacgttgccttttaccgaaactatggaaaaacctttaagaagccgagacgtccctatgagaaggagcgtctggatgcggagttgaagctggtgggagagtatgggctgaggtgtaagagagagctgtggagagtacagtatgctctgagtcgaattcgtaacaatgctagaatgcttttgaccctggatgagaagaactcacgtcgtatttttgagggtgaagcccttctgaggaggatgaacaggtacgggttactggatgagagccagaacaagcttgattacgtgttggcactcactgtcgagaactttctggagcgacgtttacagaccctggtgttcaagtctggtatggccaagtccattcaccacgccagagtgcttatcagacagaagcatattagggtcgggagacaggtggtcaatattccctcatttatggttagggtggactcacagaagcacattgatttttcattgaatagtcctttcggtggtggacgccctgggagagtgaagcgc

SEQ ID NO: 3060 - DNA, 582 bp, Euphorbia peplus
aaaggattgtggagtggggggaggccgtcgatcgatcggaggcatggtgcacgtttccttctatcgcaactatgggaagacattcaaaaagccgcgtaggccgtacgagaaggaaaggttagatgcaaaactgaagctggtgggagaatacggactacggtgcaagagagaattgtggagggtgcagtacgcattgagtcgcataaaaaatgcagcgagaatgcttttgactctagacgagaagaacccacgccgcatcttcgagggggaggcccttctccgaaggatgaaccgttacggtcttttggacgagtctcaaaacaagctcgattatgtgttggccttgactgttgagaacttcctcgagcgtcgcctccaaactcttgttttcaagtctggtatggctaagtccatccaccatgctcgtgtcctcatccgccagaggcatatccgggttggaaggcaagccgtgaacattccatctttcatggtcagggtggactcccagaaacatatcgacttctcgttgacaagtccactcggccctggacgacctggaagagtcaagaaaaaggaaccaga

SEQ ID NO: 3061 - DNA, 620 bp, Parthenium argentatum
ggttcattcagacctctaaatcctagctttcagaatcagcagtaagaggaacaagtgatcaccgatcgctgcattgacagtttgaaattgttcaacaatggttcatgtgccattttaccggaactatgggaaaacttttaagaagcctcgacgtccttatgagaaggagcgtttggatgcggagttaaagcttgttggagaatacggccttcgatgcaaaagggagctttggagggtgcaatatgctcttagcaggattcgaaatgctgcaagaatgcttttgactcttgaagagaaggatccacgtaggatttttgagggtgaagcacttatgcgaagaatgaaccgttatgggcttttggatgagagtcaaaataagctcgattatgtgctggcccttactgttgagaactttctagaacgccgtctgcagacacttgtgtttaaaactggtatggctaaatctattcaccatgctagagtcctcatcaagcagaggcacatcagggtcgggaggcaagtggtgaatgtaccatcattcatggtgagggttgattcacagaaacacatcgacttttctctcactagtccttttggcggtggccgacctggcagagtga

SEQ ID NO: 3062 - DNA, 1111 bp, Physcomitrella patens
acgtttagctaaccattctacagtatagggatgcgtttccactgattctttagtcaactttaaagagtatttgcagcatcaaatctgcaagatagacaccctggctgcagaatacaagaagcaaagatggggattctgaggattataacagaaggccccttcatgggtacctttgctgtaatcaataggccctgtttataactgatcgcacggtcagatgacagtgggtctgacagacgagggtggcccagggttttagggtttggagatcctctgaagtacgagctctgtacccaaggcctagtttctgtggaagtttgtgttacttttgtgttgcggaagctcctcacacaagcttcaccatcatggtgcacgtcgcgtcgtttcgtaactatgggaagaccttcaagaagccacgcaggccatttgaaaaagaacgtctagacgctgagctgaagctcgtaggagaatacggtctccgcaacaagcgtgagctgtggagggtccagtacgtgttgagccgtatccgcaataatgcgcgtatgctgcttactcttgatgagaaaaacacccgccgcattttcgaaggagaggctctcctgcgacgcatgaatcgatatggacttctcgatgagagccagtgcaagctcgattacgttcttgctctcactgttgaaaatttcttggagcgacgcctgcagactcttgttttcaaatctggcatggccaagtccatccaccacgcccgggtgttgatcaagcagaggcacattagagttggaaagcaaattgttgatgttccatcatttatggtccgacttgagagccaaaaacatgtagactttgctctgtctagtcctcttggtggtggcagacctggaagagtgaaacgaaagtacatgaaggctgcatccaagaaagcctcaggtggtgatgacgaggacgaggaggacgatgagtagatacaaggacacttcacgcttacccggggactcagttctgttgtgaaggcatattttcagaggttttaagaagtaaaagtagtgttcgcaacgtgtatataactctctgcaactgacctgatagtaaaatttgatttttcgattctgta

SEQ ID NO: 3063 - DNA, 884 bp, Eutrema halophilum
cgtctcattggaagctctctgcgtgccctagttttccagatcgccgattatcgttaaggagacgaagatatggtgcacgtttgctactaccgcaactatggaaagaccttcaagggacctcgtcgtccatacgagaaggagcgtctcgactctgaattgaaactcgtcggtgagtatggtctccgtaacaagcgtgagctctggagagtgcagtatgctcttagccgtatccgtaacgctgctagagatcttctgactcttgacgagaagaaccccaaacggatctttgaaggtgaggcactcctccgtaggatgaaccgttatgggcttcttgacgagagccagaacaagctcgattacgtcttggctttgactgttgagaatttccttgagcgtcgtcttcagactattgtcttcaagtctggtatggctaagtctatccatcactcccgtgtcctcatcaggcagaggcatatcagggttgggaagcaattggtgaacattccatcattcatggtgagacttgattcacagaagcacatcgactttgctttgaccagtcccttcggtggtggccgtcccggtagagtgaagagaaggaatgagaagtctgcctccaagaaagcctctggtggtggcgacgcagacgctgatgatgaagagtaaatctaaactctcacctgttttagctgtgaagcaatctgctttttgatattttgtagtcttgcaactttgttctttgtttttcaaaggattgttttatgatgatttctttatatttctccaaagattttgtttgagctcaactcgcttatttatctctcacattttcttttaattgttgtcttatttcgtaagctttcattatatcaagtagtcttatt

SEQ ID NO: 3064 - DNA, 785 bp, Thellungiella halophila
ggtgcgccctagttttccagatcgccgattatcgttaaggagacgaagatatggtgcacgtttgctactaccgcaactatggaaagaccttcaagggacctcgtcgtccatacgagaaggagcgtctcgactctgaattgaaactcgtcggtgagtatggtctccgtaacaagcgtgagctctggagagtgcagtatgctcttagccgtatccgtaacgctgctagagatcttctgactcttgacgagaagaaccccaaacggatctttgaaggtgaggcactcctccgtaggatgaaccgttatgggcttcttgacgagagccagaacaagctcgattacgtcttggctttgactgttgagaatttccttgagcgtcgtcttcagactattgtcttcaagtctggtatggctaagtctatccatcactcccgtgtcctcatcaggcagaggcatatcagggttgggaagcaattggtgaacattccatcattcatggtgagacttgattcacagaagcacatcgactttgctttgaccagtcccttcggtggtggccgtcccggtagagtgaagagaaggaatgagaagtctgcctccaagaaagcctctggtggtggcgacgcagacgctgatgatgaagagtaaatctaaactctcacctgttttagctgtgaagcaatctgctttttgatattttgtagtcttgcaactttgttctttgtttttcaaaggattgttttatgatgatttctttatatttctccaaagattttgtttgagctc

SEQ ID NO: 3065 - DNA, 1397 bp, Oryza sativa
cgcctccactgcctccctaaccccacaatccatctcgccgcggcggcggcggcggccgagaccggcggcgagcggcgggggcgggggcggcgtcagccatggtgcgcgttagcttctatcgcaactatggcaagactttcaagaaaccaaggcgtccatacgagaaagagcgtcctgatgctgagctgaagctgtatggtgagtatggcctcaggtccaagtgtgagctgtggcgtgtgcagtaagccctaagccctatccgcaatgctgcaagggagctgctcacccttgatgagaagaacccccgacgtatctttgagggcgaggctctcctgcgccacatgaaccgctatggtctccttggtgagggccagaacaagcttgattacgtgcttgcgctcaccgttgagaacttccttcagtgccgcctccagaccattgtcttcaagaacggcacggtgaaatccattcatcatgatcatgtactcatcaggcaacaccacatcagagtgggaaggcagcttgtcaacatccccttattcatggtgagacttgattagagaagcacatcgacttctcccttaccagcccactggcggtgagcctggaagggtcaaagagaaagaaccagaaggaggcctctggtggtgatggtgatggtgatggtgatgaagaggaagagtgaatatgtgatgtcagctcggttttgttataggacctaattttgcgggaacttgtcttattagggacctaatttttgttacatgagtagaaaacaaaaattagccaccgagggttgtcaaaaattgttgtttgcgctgttgaaattttgatttgaagtttatctcctcatgaacatgtgaattcagtgtacccaggaaatatatcccaggtctcacaagctaatactgttgggaatatttgaagtgttgggtaccttgtcttttgaaaactggctttgattatactaaagcggatactaaatctggcctcaaaattgttctaataaatctggaattcgaactcgcaaataatttgttgtcacgcaggcatgtatattctagggatcttttgagtttgttggtgcatatgcgaaaagtggaaaccgctactgctgttgtgaagcgcttcagaattacccgttactgctgttgcgaagcactccagcattacacgttatcgcacgacgaaacgtcctaatttcagcttgttgccttcgttcctctgccttgccgaaccctctctgtcttcttcacttttattttttctatgatggattaaaactgcctctacaccacaaccaactctcttacggtgccatgcgatgtgttatcgttcattcgtgttattctaccatctaccgcctcctaatcactttcccagggattcccctagcg

SEQ ID NO: 3066 - DNA, 694 bp, Triticum aestivum
tgatgcagagctgaagctagtgggtgagtatggactgaggtgcaagcgtgagctgtggcgtgttcagtatgctttgagccgtatccgtaacaatgcaaggcacctgctcacacttgatgagaagaatccacgccgcatctttgagggtgaggcactgcttcgccgcatgaaccgttatgggctccttgctgatgggcagaacaagcttgattatgtcctcgccctcactgttgagaacttcctcgcaaggcgttttcagactcttgtcttcaaggctggcatggccaagtccatccaccatgctcgtgtcctgatcaggcaacgccacatcagggtcggcaggcaaattgtcaacatcccgtcgttcatggtgagggttgagtctgagaagcacattgacttttcactgacaagcccattcggtggaggcccccctggtagggtgaagaggaagaaccagaagaaggcaagtggcggtggcggtgacggtgaggaggaagatgaggaatgagaaaagaagtttgcaactagttgtttccgtaatgatcataaaactctgtgctgagtaactaggcccaaattctgtagcttgcctatctgggattcagaattcaagccaggttgtgcttacaggtgttggtttatgttagccctttttggcattatgttaggtatagacttgtggttaatgctg

SEQ ID NO: 3067 - DNA, 697 bp, Triticum aestivum
tgatgcagagctgaagctagtgggtgagtatggactgaggtgcaagcgtgagctgtggcgtgttcagtatgctttgagccgtatccgtaacaatgcaaggcacctgctcacacttgatgagaagaatccacgccgcatctttgagggtgaggcactgcttcgccgcatgaaccgttatgggctccttgctgatgggcagaacaagcttgattatgtcctcgccctcactgttgagaacttcctcgcaaggcgttttcagactcttgtcttcaaggctggcatggccaagtccatccaccatgctcgtgtcctgatcaggcaacgccacatcagggtcggcaggcaaattgtcaacatcccgtcgttcatggtgagggttgagtctgagaagcacattgacttttcactgacaagcccattcggtggaggcccccctggtagggtgaagaggaagaaccagaagaaggcaagtggcggtggcggtgacggtgaggaggaagatgaggaatgagaaaagaagtttgcaactagttgtttccgtaatgatcataaaactctgtgctgagtaactaggcccaaattctgtagcttgcctatctgggattcagaattcaagccaggttgtgcttacaggtgttggtttatgttagccctttttggcattatgttaggtatagacttgtggttaatgctgttt

SEQ ID NO: 3068 - DNA, 590 bp, Brassica napus
tgcaagcacagcagccatggtgcaagtcaggttctaccgcaactacggcaagaccttcaagaagccgcgacgtccttacgagaaggagcgtcttgacgccgagctgaagcttgtcggagaatacggtcttcgttgtaagagagagctgtggagggttcagtacacgcttagccgtatccgtaacgctgccagagagcttctcactctcgacgagaagaaccctcgtcggatctttcaaggtgaagctcttctgaggaggatgaacaagaatgggcttcttgatgaatcccagaacagctcgactacgttcttgctttgactgttgagaatttcctcgagcgccgtctccagactattgtcttcaagtccggtatggccaagtccattcaccacgcccgtgtccttatccgacaaaggcacatcgagggttgggaggcaacttgtgaacattccatcgttcattggttaaagtagagtcacagaaacacattgacttttctctgaccagtccatttggtggtggtcgacctggaagagtgaagagaaggaacgagagagctggtgctaagaaagctggtggtggtggtgga

SEQ ID NO: 3069 - DNA, 925 bp, Arabidopsis thaliana
cattcgtctctttcgttcctctctgcgtgccctagttattcagatcgccgaatttgcagtaaggagacgaaaatatggtgcacgtttgctactaccgcaactatggaaagaccttcaagggaccacgtcgtccttacgagaaggagcgtcttgattctgaattgaagctggttggtgagtatggtctgcgtaacaagcgtgagctctggagagtgcagtactctcttagccgtatccgtaatgctgctagagatcttttgactcttgatgagaagagtccaagaaggatctttgaaggtgaggctttgctccgtaggatgaaccgttacgggcttcttgatgagagccagaacaagctcgattacgtcttggctttgactgttgagaactttcttgagcgtcgtcttcagactattgtgttcaagtctggtatggctaagtctatccatcactctcgtgtcctcatcaggcagaggcatatcagggttggaaagcaattggtgaacattccatcattcatggtgagacttgattcacagaagcacattgactttgccctcaccagtcccttcggtggtggccgtccaggaagagtgaagagaaggaacgagaagtctgcctccaagaaagcctcaggtggcggtgatgcagacggtgatgacgaagagtaaatctgaagtcgcaccgttttagctatgaatcaatctgctttttgatattttgtagtaagcaactttgttgttcgttttcagaggattgttttatggtttctttcttttactctcgagattgctaaacctttgggttatcatctatttctcacaattatcttttaaagttttgccttatctctctagttatctttatatttatgctaaaaaagataattatactaagcgaaattgattgtctagtttcgtatggc

SEQ ID NO: 3070 - DNA, 1075 bp, Marchantia polymorpha
gctttcgatcgggctcatcgggacgcgcaggtactgatcgataaccggaccagaaaatcgtatgagcaattgaggattgctgtgaagagtcgcgatggtgcacgttgccgtataccgcaactatgggaagacattcaaaaagccccgcaggccttttgagaaggaacgactcgacgcagagttgaagctcgtcggagagtacggtctcaggaacaagcgtgagctctggagagtgcagtatgcattgagcaagattcgcaacaatgctagacagcttctgactttggacgagaagaacacccgtcgtatttttgagggagaggctcttctgcgtcgtatgaacagatatggtcttcttgacgagagccagagcaagctcgattacgtgctggctcttactgtagagaacttcctcgagaggcgtttgcagactctcgtttttaagagtggtatggctaagtccattcaccacgcccgcgttttgatcaagcagcgccacatcagggttggcaagcaaattgtcgatgtcccttcctttttagtacgtgtcgacagccaaaagcacgtcgacttcgctctctccagtcctcttggagccggtagacccggaagagtgaagagaaggaacatgaaggctgcttcgaagaaggctgccggcggtgatggtgacgaagaggaggacgaagagtagggtttaggttagtcccatttgcctcccttgagagtatagattttgtcctgtacgggacgaagaggccattccgtgtcacttttacacatcattggcagaaactcaatgtcaattatcggcatatctttctgcctttcaagctccgtattgatgtttcttgatgagaaactattggcgtagtgaccagtgctgcaaaccgcccagcgaactgtgagtgagatcaatacacatttcagttttgtaagtttcatgtcaaagaacgtgcgagtcgagtcaatcatcggaggctatggctttacccccggttacagttttttaaagtaccccgatgcacccaaagcatgagtgaattggccttactttgcagatttttcaaaaaaaaaa

SEQ ID NO: 3071 - DNA, 886 bp, Eutrema parvulum
gttttgaaaattttgatattgagtgttgagtttgattttgcagatggcaaaacattcaagaagccacgacgtccatacgagaaggagcgtcttgacgctgagctaaagcttgttggagaatacggtcttcgttgcaagagagagctctggagggttcagtacgcgctcagccgtatccgtaacgccgcgagagagcttctcactctcgatgagaagaaccctcgtcggatctttcaaggtgaagctcttcttaggaggatgaacaagaatggtcttcttgatgaaagccaaaacaagctcgattacgttcttgccttgactgttgagaatttcctcgaacgccgtctccagacaattgtcttcaagtccggtatggccaagtccattcaccacgcccgtgtccttatccgacaaaggcacatcagggttgggagacaactggtgaacattccatcgttcatggtgaaagtagactcgcagaaacacattgacttttctctgaccagtccattcggtggtggtcgacctggaagagtgaagagaaggaacgagagagctggagccaagaaagctggtggtggtgatggagatgaggatgatgaagagtgaaagtaccaaaccctaaaacccctttactagattaaaaaaaaatactacttaaatcaaatccactaagatgcttaaaagttaaataatcttttgttcgtatcactttttttttgtgtgggtttaatagttttctttggctagaagttaatgtgtgttggtttgttgatggatctagtttttatgttattgtgtttttgcaataatggaccattgtgttggtcctgaaccatgatgtcactttcggatcttgcttcttacaagacagtaatgatatttt

SEQ ID NO: 3072 - DNA, 921 bp, Orobanche aegyptiaca
catttcccactgcgatataagcgcagatcggactgactgaggacgttggcggcggagaatcatggtgcacgtctctgtttaccgcaactatgggaaaactttcaagaagcctcgtcgtccatatgaaaaggaacgacttgatgctgagctaagactcgtcggtgaatatggtctaaggtgcaagagggagctttggagggttcagtatgcacttagccgtattaggaacaatgctagggagcttttgaccctcgatgagaaggatcctcgtcgtatttttgaaggtgaagcccttctaaggaggatgaacaaatacggtctgcttgatgagagtcagaagaaactcgattatgtcctgtccattactgtcgagaacttccttgaacgccgtctccagactattgtgtttaaggccggtttggctaagtccattcatcatgctagagtgatgatcaggcacaggcatatcagggtgtcgaggcaagttgtgaatgtgccctcgttcatggtgagagtggactcacagaagcacattgattatgctctgacaagtccgcttggtggggggcgtcctggtagagtgaagagaaagaatctgaaggcagctgctaagaaggcctctggtggtgatggagatgaggatgacgaggagtgagataatctgttgaactaatgctcgtcaacttttagttttttttttggttatttatgttgcaagttgaacttgttttgcatcttattgttgaggacagtgtagggcacaaaccgaaatgggatgttcttgattgttacatctgtttttttctctcagttgtttaatatcttgtctcgacatagatattgatgtgcggtgagggaagtatggtagagtaattgtctgctactaaatctattacataagatcataatgatgactttaca

SEQ ID NO: 3073 - DNA, 566 bp, Ambrosia trifida
agcagtaagagggataagcagttgctgcatagacagtctgttctaagaatggttcatgtgccgttttaccgaaactatgggaagacttttaagaagcctcgacgtccgtatgagaaggagcgtttggatgcggagttaaagcttgttggagagtacggtttgcgatgtaaacgggagctatggagggtgcagtatgctcttagtaggattaggaatgctgcaagaatgcttttgactcttgaagagaaggacccgcgtaggatttttgagggggaagcgcttatgcgaaggatgaaccgttatgggcttttggatgagagtcagaataagcttgattatgtgctggctcttactgttgagaactttttagaacgtcggttgcagacacttgtgtttaagactggtatggctaagtctattcatcatgctagagtccttatcaagcagaggcacatcagggttgggaggcaagtggtgaatgtaccatcattcatggtgagggttgactcacagaaacacatcgacttttctctcactagtccatttggtggcggccgacctggcag

SEQ ID NO: 3074 - DNA, 581 bp, Salvia sclarea
ctactagaccttggctgtcactcaggacttcttcagccgcgtagcttctcacaatggtgcacgttagtttctaccgcaattatggtaagacattcaagaagcctcgcaggccttacgagaaggagcgattggatgcagagctgaagcttgttggagagtatgggctgaggtgcaagagggagctgtggagggtgcaatacgcgttgagtcgcatccgtaataatgctaggaatcttctcactctcgatgagaaggatccccgcagaatctttgaaggcgaggcccttcttcgcaggatgaataagtacgccctgttggatgagagccaaaacaagctcgattatgtgctgtccctcactgtggagaactttctcgaacgccgcctgcagacccttgtgttcaaggctgggatggccaagtcgattcaccatgcccgtgtgctcatcagacagaggcatattagggtgggaagacaggtggtgaacgtgccatccttccttgtgagggtcgactcgcagaagcatatcgacttctcgcttactagtcccttcggtggcggtcgtgctggtagagtgaaaacg

SEQ ID NO: 3075 - DNA, 557 bp, Euphorbia esula
  misc_feature (118)..(118): n is a, c, g, or t
  misc_feature (197)..(197): n is a, c, g, or t
tggagtgggggaggccgtcgatcgatcggaggcatggtgcacgtttccttctatcgcaactatgggaagacattcaagaagccgcgtaggccgtacgagaaggaaaggttagatgcanaactgaagctggtgggagaatacggactacggtgcaagagagaattgtggagggtgcagtacgcattgagtcgcataanaaatgcagcgagaatgcttttgactctagacgagaagaacccacgccgcatcttcgagggggaggcccttctccgaaggatgaaccgttacggtcttttggacgagtctcaaaacaagctcgattatgtgttggccttgactgttgagaacttcctcgagcgtcgcctccaaactcttgttttcaagtctggtatggctaagtccatccaccatgctcgtgtcctcatccgccagaggcatatccgggttggaaggcaagccgtgaacattccatctttcatggtcagggtggactcccagaaacatatcgacttctcgttgacaagtccactcggccctggacgacctggaagagtcaa

SEQ ID NO: 3076 - DNA, 854 bp, Arabidopsis lyrata
cattcgtctccttcgttcctctctgcgtgccctagtttttcagatcgccgattttgcagtaaggagacgaagatatggtgcacgtttgctactaccgcaactatggaaagaccttcaagggaccacgtcgtccttatgagaaggagcgtcttgactctgaattgaagcttgttggtgagtatggtctgcgtaacaagcgtgagctctggagagtgcagtattctcttagccgtatccgtaatgctgctagggatcttttgactcttgatgagaagagtccaaaaaggatctttgagggtgaggctcttctccgtaggatgaaccgttacgggcttcttgatgagagtcagaacaagctcgattacgtcttggctttgactgttgagaactttcttgaacgtcgtcttcagactattgtgttcaagtctggtatggctaagtctatccatcactctcgtgtcctcatcaggcagaggcatatcagggttggaaagcaattggtgaacattccatcattcatggtgagacttgattcacagaagcacatcgactttgctctgaccagtcccttcggtggtggccgtccaggaagagtgaagagaaggaacgagaagtctgcctccaagaaagcctctggtggtggtgatgcagacggtgatgacgaggagtaaatctaaagccccaccgttttagctatgaagcaatctgctttttgatattttgtagtatgcaactgtgttgttcgttttcagaggattgttttatggtttctttcttttactctcgagattgctgaacctttgggttatctatttctcatatttttcttttcaagttttggcttattcctctag

SEQ ID NO: 3077 - DNA, 789 bp, Brassica juncea
gcgtgacctagttctccacaccgccgtttctcactaagaagacgaagctatggtgcacgtttgctactaccgcaactatgggaagaccttcaagggcccgagacgtcctttcgagaaggagcgtctcgactccgagctgaagctcgtcggcgagtacggtctccgcaacaagcgtgagctctggagggtccagtactccctgagccgcatccgtaacgcggctagggatcttctgacgctcgacgagaagaatcccaagaggatcttcgaaggagaggcgcttctccgtaagatgaacaggtacgggcttctcgacgagagccagaacaagctcgattacgtcttggcgttgaccgtggagaattttctcgagcgtcgtcttcagactattgtgttcaagtctggtatggcgaagtcgattcatcactcccgtgtcctcatcaggcagaggcatatcagggttggaaagcaattggtgaacatcccttcgttcatggtgagacttgattcacagaaacatatcgactttgcgttgaccagtcccttcggtggtggccgtccaggaagagtgaagagaaggaatgagaagtctgcctccaagaaagcctctggtggcgatggagacggtgatgacgaagagtaaatctaactctcaccgtcgctttttagctatgaagcattctgctttttgatatttttagtcttgaactctgttctccttttcagacgattgttttgtggtttgtgtgtccgaacctttcttgagttatattttattttgagacctcg

SEQ ID NO: 3078 - DNA, 547 bp, Brassica nigra
ggtgcaagtcaggttctaccgcaactatggcaagaccttcaagaagccgcgacgtccttacgagaaggagcgtctcgacgccgagctgaagcttgtcggagaatacggtcttcgttgcaaaagagagctgtggagggttcagtacacgcttagtcgtatccgtaacgctgccagagagcttctcactctcgacgagaagaaccctcgtcggatctttcaaggtgaggctcttcttaggaggatgaacaagaatgggcttcttgatgaatcccagaacaagctcgactacgttcttgctttgactgttgagaatttcctcgagcgccgtctccagactattgtcttcaagtccggtatggccaagtccattcaccatgcccgtgtccttatccgacaaaggcacatcagggttgggaggcaactggtgaacattccatcgttcatggtaaaagtagactcgcagaaacacatagacttttctctgaccagtccatttggtggtggtcgaccgggaagagtgaagagaaggaacgagagagctggagcc

SEQ ID NO: 3079 - DNA, 609 bp, Brassica napus
ggagcgccagcttgccaagatgccgaagataggattctaccgcaactatggcaagaccttcaagaagccccggcgtccttatgagaaggagcgcctggacgctgagctgaagcttgtcggcgagtatggcctgcgcaacaagcgcgagctctggcgcgtgcagatggttctgagcaagattcgcaacgctgctcgtgtcctgctcacgctggacgagaaggaccccaagcgtatcttcgagggtaacgccctgatgcgccgcatgaaccgctacggcctgctgaacgagagccaggacaagctggattacgtgctggcgctgaccccccaggacttcctggagcgccgcctgcagaccctggtcttcaagcagggcctggccaagtccatccaccacgcgcgcgtgctgatccgccagcgccacatccgcgtgggcaagcaggtggtcaacgtgcccagcttcatggtgcgcgtggacagccagaagcacattgacttcgccctgaccagccccttcggcggcggccgccccggccgcgtgaagcggaagaacgccaagaagggcggcgacggcggcgaggacgacgagtaaacgcccgccaacgtgtt

SEQ ID NO: 3080 - DNA, 817 bp, Chlamydomonas reinhardtii
ggcacgagggagcgccagcttgccaagatgccgaagataggattctaccgcaactatggcaagaccttcaagaagccccggcgtccttatgagaaggagcgcctggacgctgagctgaagcttgtcggcgagtatggcctgcgcaacaagcgcgagctctggcgcgtgcagatggttctgagcaagattcgcaacgctgctcgtgtcctgctcacgctggacgagaaggaccccaagcgtatcttcgagggtaacgccctgatgcgccgcatgaaccgctacggcctgctgaacgagagccaggacaagctggattacgtgctggcgctgaccccccaggacttcctggagcgccgcctgcagaccctggtcttcaagcagggcctggccaagtccatccaccacgcgcgcgtgctgatccgccagcgccacatccgcgtgggcaagcaggtggtcaacgtgcccagcttcatggtgcgcgtggacagccagaagcacattgacttcgccctgaccagccccttcggcggcggccgccccggccgcgtgaagcggaagaacgccaagaagggcggcgacggcggcgaggacgacgagtaaacgcccgccaacgtgttggagcaaggagcaaggggggatgctgtaacgcttccccagtcgcatatgcccgtttccatgccgcgtggtcccaattacccctggggagggagccagctctggggaggtcgaggccgcggcgcagcaagaggattttgtgcagctgatgaacagcggcatgatcagggccagttgctcagcatgtgacacccctggcgtg

SEQ ID NO: 3081 - DNA, 736 bp, Cirsium arvense
gaagaaagcagcagcagcagcgcagtcgccgccggtggacggaggagcacagcaaaccgccgccttgacgacgtcaatcaacaatggtgcacgttaacttttatcgcaactatggaaagactttcaagaagccccgtcgtccttatgagaaggaacgactggatgctgagttgaagcttgttggtgagtacggtcttagatgcaaaagagagctctggagggtccagtatgctcttagccgcatccgtaatgccgcaagaatgcttttgactcttgaggagaaagacccacgaagaattttcgagggtgaggctcttatgaggaggatgaacagatacggtctgttggatgagagccaaaacaagcttgattacgtgttggcccttactgttgaaaacttccttgagcgccgccttcagacactcgtcttcaagaccggcatggcaaagtcaatccaccatgccagagtcctcattaagcagaggcatatcagagttgggaggcaagttgtgaacgtcccatcgttcatggtgagagtggactcgcagaaacacattgacttttcgctcacgagtccgttcggtggtggccgacccggaagagtgaagcgaaagaaccagaaggcggctgcgaagaaggcagctggaggaggggatgccgatgaggatgatgaagaaatgagcactaaggtgggctacttcttatatctatgttttgttccgtacaagtgaatgtt

SEQ ID NO: 3082 - DNA, 584 bp, Jatropha curcas
ctgcaggaattcgaattccgtcttcttcgtgtgctctgcaataagacagcggaggaaagcaccggcagctaacaagaatggtacacgtctcattttatcgcaactatgggaaaacatttaagaaaccaagacgtccctatgagaaggagcgtttggatgctgagctgaagcttgttggagaatatggtctccgctgcaaaagagagctttggagggttcagtatgcattgagccgcattcgtaatgcagcaagaatgcttctcacccttgacgagaaaaacccacgtcgtatttttgagggtgaagcactgctgaggaggatgaatagatatggacttttggatgagagccagaacaaactcgattatgtgttggccttgactgtggagaactttcttgagcgccgtcttcaaactcttgtgttcaagtcgggtatggccaagtcaatccaccacgccagagtgctcatcaggcaaaggcacattaaggtagggagacaggtggttaatattccctcatttatggtgagggttgattcgcagaaacacattgatttctcactcacaagtccattcggtggtggt

SEQ ID NO: 3083 - DNA, 889 bp, Primula obconica
aactatggtaagactttcaagaagccacgtcgtccttacgagaaggaacgtcttgatgctgagttgaagcttgtgggagaatacggtcttcggtgcaagagggagctgtggagggttcaatatgctctgagtcgtatccgtaacaatgctagaatgcttctgacccttgatgagaagaacccacgtaggatctttgagggagaagctcttttgaggaggatgaacaggtacggtcttctcaaggaggaccaaaacaagctcgattacgtgcttgcacttacagtggagagctttctagagcgcagactccaaacacaagtgttcaagactggcatggccaagtctatccaccatgccagagtgcttatcaagcagaagcacatcagggtcggtaggcaggttgtgaatgttgcctcattcatggtgaggatggattcacagaagcatgtcgacttttctctcactagtccccttggagccggccgtcccggaagagtgaagcgaaagaatgcaaagagggcttctggtggtggtgaagctgtagaagagagagaagattaagagagagaaagctaaagagagaagctcgattcttattttctcatgtcagttgaatcattttctcttgaaagtcctcgttcatgcctcttttgtttgttttaagtctaatgatggttgaatgattttcattttgaaggacctctgtaggactgagtgttttgaattgttttgtttcatcgcatttcccggctttgttcgagagagattttgtttatctttatattagcaatggaactgatatttttgcgatatttggtctttttggaaatattgtcatcttctgttgtgtttcttgtgtttctttttattgacgaggaagattcttttg

SEQ ID NO: 3084 - DNA, 1055 bp, Volvox carteri
actccttgtagggcgtcagggagttgccaagatgccgaagatagggttctaccgcaactatggcaagacgttcaagaagccccggcgtccttatgagaaggagcgcctggacgctgagctgaagcttgtcggagagtatggtctgcgcaacaagcgtgagctttggcgcgtgcagatggtcctgagcaagattcggaatgctgcgcgtgtgttactcaccctggaagagaaggacccgaagcgtatcttcgagggcaatgcgcttatgcgtcgtatgaaccgctatggtctcctcagcgagagccaggacaagctggattacgtgctggcgctgactccccaggatttcctggagcgccgcctgcagaccctcgtctttaagcagggtctggcaaagtccatccaccacgctcgcgtgctgatccggcagcgtcacatccgcgtgggcaagcaggtggtcaacgtgcccagcttcatggtgcgcgtggacagccagaagcacatcgacttcgccctcaccagccccttcggcggcggccgcccgggccgcgtcaagcggaagaacgccaagaagggtggcgatggcggcgacgatgatgagtaagcaatttcaattgcagtacagcagtgaggaatgctgtaacaaccccggcccggtcatttgcacctgtgtctaatacatttcgttgacgcacaaacacatcagcttgagtgccataccgcagcaaatggacattcattacaacacggcaatgaacattttggttgctacgtggagttgggttgtttatgggtactggaagtctccatttcgcagttatcgtacttccgtagacaacttgcccaaaaacttctgacaacggcgttacttattcgtgatggttcagggttcgtgatggttcagggagcagacagtaacatgatataaatacaggaatagaggtcagttctgtctaaagtcctgtgcttacattctcaggcagtgttgggttacgaagagtactttggcgagtttatttccccttggagagctcctgtaaccctataaaggaacc

SEQ ID NO: 3085 - DNA, 2741 bp, Sorghum bicolor
gtcaagagcggagcggaaggccgaagaagcgcctcagcgcccaccccgatctgcccgcccacctaacgtctcgtcgggcgccgatcggccgccgccgcgatggggtttgacgggctggtcgtggtgtccgatccctacctgcagcgccgcttcacgcaggccgaccttcgcgtgctccagacccagtatgcggcgctgcgggacgcgtcgcctaacgggaggctgcggatacgggacctccccgccgccatctctagcgtccgcggccgcggtgcggtcaggggcagggacgccgagaaggagaatagcgcgccggagccaggccccggcctgggcctcactgacgaggagtgggcctccgtgcttaaggccgtcgcgcgcgccgacgagaagccgcatcaggacgccagcttcgagctcttcctccgcgtttacgccgagatgcagctgcgcctcaaggcagccagcggcggtggcgccggccgcgccggaggaatcgcgcgctcctcgtcctcctctgctgttgccttcctcacggcggccacaaccacgctgctgcacaccatcagcgagtccgagaaggcgtcctacgtcggccacatcaacgcctacctcgccgaggatccattcctaaagaccgccctccccatcgatccggcgaccgatcacatcttccacgtcaccaaggacggcgtgctcctatgcaaactcatcaacttggcggtacctggcaccatcgacgagcgagccatcaacaccaagagggtgctcaatctgtgggagaagaacgagaaccacacgctttgcctcaactccgccaaggcgatcggctgcactgtcgtcaacatcggcacacaggacctcgccgaagggaggcctcatctggtcctgggtttaatttctcaaataatcaagatacaactgttggcagatgttaatcttaaaagcacacctcaattagttgaattggttgaggacagtaaggagatggaggagcttatgagcttgtctcctgaaaagattctactaaggtggatgaactttcaactcaagaaaggaggtttccagaaaacagtaacaaatttttcatcagatataaaagatagtgaagcgtatgcttgtctactgaatgtcctggcacctgaatgcagtgcgaaaccatctgcgatgtctgtaaaagatctacttcatagagcaaggttaatccttgagcatgcagataggatgggctgcaaaagatacctgactccaaaagacatagttgatggtttacccaatctaaatcttgcctttgtggctcatattttccaaaaaagaaatgggttgtccaaacaaatgaaacaagtttcctttgtggatggactctctgatgatgctcaagtttccagggaagaaaggtcattccggctgtggattaacagccttggaatttctacttacatcaacaatgtgtttgaggaccttagaaatggatgggttctccttgaggtaattgacaagattgctccaggctcagttaattggaagatggcaaatcgcccaccaataaaattaccattcaggaaagtcgaaaattgcaatcaagttttgaagattggaaaagaactaaaattttctttggtgaatatcgctggaaatgatattgtgcaagggaacaaaaaactgatattagcttttctgtggcaattgatgcggtacaatattcttcaattgctgaagaatcttagatttcactcaaatggaaaagagatcacagataatgacatattggcatgggccaataaaaaagtaaaagattctggaaagcaccactctcatatgcaaagtttcaaggataaaagcctttcaagtggtacctttttccttgacttactaagtgctgtggagcctcgagttgtgaattggagccttgtgaccaaaggagaaaaagatgaagagaagcaaatgaacgcgtcatacatcatttcggtggctaggaagcttggttgctccattttcttgttgccagaagatatattggaggtgaaccagaagatgatgctaactctgacagcaagcatcatgtactggtatttgaaaaggccaacatcacattcattggactctgaaaatgggagttcatgtgagacaacctccatcacaacttcagatgattctgcatctgaatcatcgattgatgacaatacaaccagataaaagtgcaggatcatgaagataaatgatatgacctgtgtttttgaaaacttgggatactcataccagtgcagcatcggttgtgttcttgattgtttgctgtaattttaagggcaaatgcattcaagacagagggaagggaggttaagagctatggtgttcatttgtgaggtttattagtgtgaaagcttgattggtgaaagatgtgtgacatcctgtaaatattgatacaggtagctatatctgtaacatcatatagtgacagtggattgtccaaaatccacatagcttgatttgctctttgggcattttttttttttgcaacatgtcaagataggtagaacaatttgagttgtagtgtacaataaatcagtgtcctaattaggatgttaaaacttttaggagcatgttccttgaatagaaaaaagaattttaggaacatgtgaggtgtcatacctatacatatagacttctataaatagtcaattaatgttatggactaactacaacattttgagtgaacagtgcttaaatcactcgattccgat

SEQ ID NO: 3086 - DNA, 2940 bp, Sorghum bicolor
actcacccttcctctggctctgcctctgcctcgccatcattctcctcccctttcctttattttgaaccagcgcccctgcaggcggggccccgacccgtctggtgtctctctctctcctctgagctgccgcaaagggaagccaagccccacatcacaccaccccgctcccactccatactgtcaagagcggagcggaaggccgaagaagcgcctcagcgcccaccccgatctgcccgcccacctaacgtctcgtcgggcgccgatcggccgccgccgcgatggggtttgacgggctggtcgtggtgtccgatccctacctgcagcgccgcttcacgcaggccgaccttcgcgtgctccagacccagtatgcggcgctgcgggacgcgtcgcctaacgggaggctgcggatacgggacctccccgccgccatctctagcgtccgcggccgcggtgcggtcaggggcagggacgccgagaaggagaatagcgcgccggagccaggccccggcctgggcctcactgacgaggagtgggcctccgtgcttaaggccgtcgcgcgcgccgacgagaagccgcatcaggacgccagcttcgagctcttcctccgcgtttacgccgagatgcagctgcgcctcaaggcagccagcggcggtggcgccggccgcgccggaggaatcgcgcgctcctcgtcctcctctgctgttgccttcctcacggcggccacaaccacgctgctgcacaccatcagcgagtccgagaaggcgtcctacgtcggccacatcaacgcctacctcgccgaggatccattcctaaagaccgccctccccatcgatccggcgaccgatcacatcttccacgtcaccaaggacggcgtgctcctatgcaaactcatcaacttggcggtacctggcaccatcgacgagcgagccatcaacaccaagagggtgctcaatctgtgggagaagaacgagaaccacacgctttgcctcaactccgccaaggcgatcggctgcactgtcgtcaacatcggcacacaggacctcgccgaagggaggcctcatctggtcctgggtttaatttctcaaataatcaagatacaactgttggcagatgttaatcttaaaagcacacctcaattagttgaattggttgaggacagtaaggagatggaggagcttatgagcttgtctcctgaaaagattctactaaggtggatgaactttcaactcaagaaaggaggtttccagaaaacagtaacaaatttttcatcagatataaaagatagtgaagcgtatgcttgtctactgaatgtcctggcacctgaatgcagtgcgaaaccatctgcgatgtctgtaaaagatctacttcatagagcaaggttaatccttgagcatgcagataggatgggctgcaaaagatacctgactccaaaagacatagttgatggtttacccaatctaaatcttgcctttgtggctcatattttccaaaaaagaaatgggttgtccaaacaaatgaaacaagtttcctttgtggatggactctctgatgatgctcaagtttccagggaagaaaggtcattccggctgtggattaacagccttggaatttctacttacatcaacaatgtgtttgaggaccttagaaatggatgggttctccttgaggtaattgacaagattgctccaggctcagttaattggaagatggcaaatcgcccaccaataaaattaccattcaggaaagtcgaaaattgcaatcaagttttgaagattggaaaagaactaaaattttctttggtgaatatcgctggaaatgatattgtgcaagggaacaaaaaactgatattagcttttctgtggcaattgatgcggtacaatattcttcaattgctgaagaatcttagatttcactcaaatggaaaagagatcacagataatgacatattggcatgggccaataaaaaagtaaaagattctggaaagcaccactctcatatgcaaagtttcaaggataaaagcctttcaagtggtacctttttccttgacttactaagtgctgtggagcctcgagttgtgaattggagccttgtgaccaaaggagaaaaagatgaagagaagcaaatgaacgcgtcatacatcatttcggtggctaggaagcttggttgctccattttcttgttgccagaagatatattggaggtgaaccagaagatgatgctaactctgacagcaagcatcatgtactggtatttgaaaaggccaacatcacattcattggactctgaaaatgggagttcatgtgagacaacctccatcacaacttcagatgattctgcatctgaatcatcgattgatgacaatacaaccagataaaagtgcaggatcatgaagataaatgatatgacctgtgtttttgaaaacttgggatactcataccagtgcagcatcggttgtgttcttgattgtttgctgtaattttaagggcaaatgcattcaagacagagggaagggaggttaagagctatggtgttcatttgtgaggtttattagtgtgaaagcttgattggtgaaagatgtgtgacatcctgtaaatattgatacaggtagctatatctgtaacatcatatagtgacagtggattgtccaaaatccacatagcttgatttgctctttgggcattttttttttttgcaacatgtcaagataggtagaacaatttgagttgtagtgtacaataaatcagtgtcctaattaggatgttaaaacttttaggagcatgttccttgaatagaaaaaagaattttaggaacatgtgaggtgtcatacctatacatatagacttctataaatagtcaattaatgttatggactaactacaacattttgagtgaacagtgcttaaatcactcgattccgatttatgacctttacttgtgac

SEQ ID NO: 3087 - DNA, 2625 bp, Zea mays
aaacccggctggtctctctcctctgagttgcccttgccccacattacaccacaccacccccctcccactccatgctgtcaggagcggaaggccgaagcgccaccgcgcccaccctgatctgcccgcccacctaacgtcggccgtcaatcggccgccgccgcgatggggtttgacgggctggtcgtggtgtcagatccttacctgcagcgccgcttcacgcaggccgaacttcgcgcgctccaggcccagtatgcggcgctgcgggacgcgtcgcctaacgggaggctgcggatgcgggacctccccgccgccatctctggcgtccgcggtgcggccaagagcagggacgccgagaaggagaatagcgcgccggagccaggcccctgccatggcctcactgacgaggagtgggcctccgtgcttaaggccgtcgcgcgtgctgacgagaagccgcaccaggacgcgagcttcgagctcttcctccgcgtctacgctgagatgcagctgcgactcaaggcagtaagcgtctgctccggccgcgccggaggaatcgtgcgctcctcctcctcctctgctgttgccttcctcacggcggccaccaccacactgcttcacaccatcagcgagtccgagaaggcgtcctatgttggccacatcaacgcttatctcgcggatgatccgtccctgaagagcgccctccccatcgatccggcgaccgatcacatcttccatatcaccaaggacggcgtgctcctatgcaaactcatcaacttggctgtaccgggcaccatcgatgagcgagccatcaataccaagagggtccttaatctttgggagaagaacgagaaccacacgctttgcctcaattctgccaaagcgatcggctgcactgtcgtcaacatcggcacacaagacctcgccgaagggaggcctcatctggtcctgggcttaatatctcaaataatcaagatacaactgttggcaaatgttaatctgaaaagcacacctcaattagttgaattggttgaggacagtaaggagatggaggagcttatgagtttatctcctgaaaagattctactaaggtggatgaactttcaactgaagaaagcaggtttccagaaaagagtaacaaatttttcatcagatataaaagatagtgaagcctatgcttgtctattgaatgtcctagcacctgaatgcagtgcaaaaccatctgcgatgtctgtaaaagatctacttcatagagcaaggttaattcttgagcatgcagataggatgggctgcaaaaggtacctgactccaaaagacatagttgatggtttacccaatctaaatcttgccttcgtggctcatattttccaaaaaagaaatgggttgtccaaacaaatgaaacaagtttcctttgtggatggactctctgatgatgctcaagtttccagggaagaaaggtcattccggctgtggattaacagccttggaatttcaacttacatcaacaatgtgtttgaagaccttagaaatggatgggttctccttgaggtgattgacaagattgctccaggctcagttaattggaagatggcaaatcgcccaccaatcaaattaccattcaggaaagttgaaaactgcaatcaagttttgaagattggaaaagaactaaaattttctttggtgaatattgctggaaatgatattgttcaagggaacaaaaaactgatattagcttttctatggcaattgatgcggtacaacattctacaactgctgaagaatcttagatttcactcaaatggaaaagagatcacagataatgacatattggcatgggccaataagaaagtaaaagattctggaaagcaccactcttatatgcaaagtttcaaggataaaagcctttcaagtggcacctttttccttgacttactaagtgctgtggagcctcgagttgtgaattggagccttgtgaccaaaggggaaaaagacgaagagaagcaaatgaatgcttcatacatcatttctgtggctaggaagcttggttgctccatttttttgttaccagaagatatattggaggtgaaccagaagatgatgctaactctgacagcaagcattatgtactggtatttgaaaaggccaacatcacaatcattggactctgaaaacgggagttcatgtgaaacaacctccatcacaacttcagatgattctgcatctgaatcatcgattgatgacaatacaactagataaaagagcagggtcatgaaaataattgatatgacctgtcattttgaaaacttgggattgattgtttgctgtaattttaagggcaaatacattcaagaccgaggcaagggaaatggttaagggctttgggtgtttttttgaggtttaatagtgtgattgggtgaaagatgtttgacatcctgtaaatatatctataactagtgacaataggttgtccaaaatccactatttgagttagaacaatttgagttacaatgtacaataaattagtgtcctatccgttaaagcttttaggcgcatgttgtcatatgcttatggaataactacaacattttccttgaaatatgcttaaattaacacgagcttaaatcgcttgtg

SEQ ID NO: 3088 - DNA, 2788 bp, Oryza sativa
cggaatttgaattcctcctccccactagtgtgactgtgtgagtggttgtactctgtaggcacgcaaaaggcaaggctttccgttaccccccgaatcccagagacccacacaccagttcatcatctccttcctcctcttgctttattttgaaaccaactaacgctcttcctccccctcctcctcggcccatcccccctctctctctcctctgagctgccaccccaccactccagagagagaggcggccaccgatccgtcccccgcctctctcctccgatccatccgctccgcgccatggggctcgacgggctggtcgtcgtctccgacccttacctgcagcgccgcttctcgcaggccgacctccgcgccctccaggcccagtacgcggcgctgcgggacgcggcgccgagcgggaggctgcggctgcgggacctgcctgcggcgctatcatccgccggcgtcggggccgggaaaggaggggacgccgagaaggagaacagcgcgcctgcggcggcgcagctcacggaggaggagtgggcgtccgtgctcaaggccgtcgcacgcgccgacgagaggccgcaccagggcgtcggcttcgagctcttcctccgcgtctacgccgagatgcagctgcggctcaagggcgccgccgccgggaagaaggcgggcggcggcggcgggggcatcgcgcgctcctcctcctcgtcggccgcggcgttcctcacggccgccaccaccaccctgctccacaccattagcgagtccgagaaggcctcctacgtcggccacatcaacgcctacctcgccgaggatcccttcctcaacaccgcgctccccatcgatccggccaccgatcacctcttccacctcaccaaggacggcgtgctcctatgcaagctcatcaacctggccgtgccggggacgatcgacgagcgcgccatcaacaccaagaagctgctcaacctgtgggagaagaacgagaaccacaccctctgcctcaattctgccaaggccatcggctgcactgtcgtgaacatcggcacgcaggacctcgccgagggaaggcctcaccttatcttgggtttgatatcacaaataattaagatacaacttttggctgatgtaaacctgaagagcacacctcaattggtagaattagttgaagacagcaaggagatggaggagcttatgagcttatctcctgaaaaaatattactcagatggatgaactttcaattgaagaaaggaggtttccaaagaacagtaacaaatttttcatcagatataaaagatagtgaggcatatgcttgtctactgaatgtcttggcacctgaatgcagtgctaaaccatccccaatgtcagttaaagatcttcttcatagagcaagattagttcttgagcatgcagataggatgggctgcaaaagatatctgaccccaaaagacattgtcgacggtttaccaaatctaaatcttgcttttgtggctcatattttccagaaaaggaatgggctgtcaaaacaaatgaaacaagtttcctttgtcgacggactctctgatgatgctcaagtttcgagggaagagaggtcattccggttatggattaatagccttggaatttctacatacatcaacaatgtgtttgaggatcttagaaatggatgggtgcttcttgaggtgattgacaagattgctcctggctcagttaattggaaaatggcaaataggcccccaataaaattaccattcaggaaagtggaaaattgcaatcaagttctgaagattgggaaagaactaaaattttccttggtgaatattgctggtaatgatattgtgcaaggaaacaagaaactgatattagcttttctgtggcaattgatgaggtacaatatccttcaattgttaaagaatctgagattccattcaaatggtaaagagatcacagataacgacatactgatttgggcaaacaaaaaagtaaaggattctggaaagcattctcgaatggagagtttcaaggatagaagcctttcaagtggcatatttttcctcaatttacttggtgccgtggaacctcgggttgtgaattggagccttgttaccaaaggagaaaaagatgaagaaaagcaaatgaatgcttcatacatcatttctgtggctaggaagcttggttgctccattttcttgctaccagaagatattctggaggtgaaccagaaaatgatgctaaccttgacagcaagcataatgtactggcatttgaagaagccaacatcattttcattggacaccgaaaacggcagttcatgcgaaacaagctccatctcaacatcagatgattctgcatccgagtcatcgttcgatgatagtggagctagatagattcgtgagaccatgaaaggaaacgatctgactgcttgttgaaacgtgggatgctcgtcatcccatgaagggttggctatgttcttgattctttgctataatttggagagcaaatgcattcaagattgggatgggaatggtaaagagttttgattgtttcgttttatgggttttttgtagtgtgaaatcgatttgatgagagatgtgtaacatcctgtaaatattgacacaggtagccgatatctgtaacatcatatagtggcagtggattttctgaaatccacatagattgatttgttctttggcacttctcgctccaggcaggttgcaggcagaactagtttttctttcttgtgtagcaggctatcttgtagaactaggtaggctgataattttaggaacaaag

SEQ ID NO: 3089 - DNA, 2597 bp, Brachypodium distachyon
cctaatcatacaccccatcctttattttgaaccaacgctcctctcgatccgtctctctctctctcgcggagcccccaccccccatctccaccaccctgctgctgccactacggaccggagcaatcgatcgtctccgtcttgatccgcccatcccacctaacgccggccgccgattcggaggtccaccggggtttgggcttgatggggttcgacggactggtggtggtgtccgacccctacctgcagcgccgcttcacgcagaccgacctccgcgcgctccaggcccagtacgcggcgctgcgggatgcggcgcccagcggcaggctgcggcttcgggacctccccgccgccctgaccagcctcgggcgcgccgcctctacggccggagggaaagggggcgaggtgcgcggggacgccgagaaagagaacagctcgccggagccggggctaactgacgaggagtgggcctctgtgctcaatgccgtcgcccgccccgaccacaagccgccgcagcacgacgtcaatttcgagttcttcctgcgcgtctacgcagagatgcagctgcggctcaagggtgccaggaaggtgcgcggggacggcggcatcaagcgctcctcctcctcctccgccgctttcctcacggcgtctaccaccacgctgctgcacaccatcagcgagtccgagaaggcctcctacgtgggccacatcaacgcctacctcgccgaggatcccttccttaagaacgccctccctgtcgatccggccaccgatcagctcttccacctaaccaaggacggcgtgcttctatgtaagctcattaacttggctgtgccgggcacaatagacgagcgcgcgatcaacaccaagaggctgctcaacctatgggagaagaatgagaaccacacgctctgcctcaactccgccaaggctatcggctgcactgtcgtcaacattggcacgcaagacctcgcggaggggaggcctcatcttatactagggttgatatctcagattattaagatacaactattagcagatgtgaacctgaagagtacacctcagttggttgaattggtcgaagacagccaggagatggaagagcttatgagcctttccccagaaaaaatactgctaaggtggatgaactttcagctgaagaaaggaggttttcagagaacagtaacaaatttttcatcggatataaaagacagcgaggcatatgcatgcttgttaaatgtcctggcacctgagtgcagtgctaaaccatcaccaatgtcagtaaaagatcttcttcacagagcaagattagttcttgagcatgcggataggatgggctgcaaaagatatctgtcctcaaaagacatagttgatggtttacaaaatctaaatctcgcctttgtggctcatattttccagaaaagaaatgggttgtccaaacagatgaaacaagtttcatttgttgatggactatctgatgatgctcaagtttcgagggaggagaggtcatttaggctatggattaatagccttggaatttctacttatatcaacaacgtgtttgaagatcttagaaacggatgggtgctcctggaggtcatggataagttggctcctggctcagttaattggaagatggcaaaccgacccccaataaaattaccattcaggaaagttgaaaactgcaatcaagttctgaagatcgggaaagaaataaatttttccttggtgaatattgctggtaacgatattgtgcaaggaagcaagaaactgatattagcttttctctggcaattgatgcgatacaacatcctacaactgctgaagaatcttagatttcattcgaatgggaaagagatcacggataatgacatattgttgtgggctaacaaaaaggttaaggattctggaaagcattctcgaatggaaagtttcaaggatagaagcctttcaggtggcatcttcttcgtcaacttactcagtgctgtggagccacgagttgtgaattggagccttgtaaccaaaggagaaaaagctgaagaaaaacaaatgaatgcttcatacatcatctctgtggcaagaaagcttggctgctccatcttcttgctaccagaagatatcctggaggtaaaccagaagatgatgctgacgttgacagcaagcatcatgtattggcatttgaaaaggccaacatcatatttactggaccctgaaaacagtagttcaaccgagacaagctccatctcaacttcagatgattcagcatctgaatcatcaatcgatgatagcggaactagatagatgaaggtggatggtcttctgctatttgggaattggggagcagatgcattcaagaccagagggaatggtaaagaattttgtttgattcatttgaggttttgtagtgtgcaatgtgattcggtgagtgatgtacaacatcctgtaaatattcacatagatagccaccatctgtaacaccatatagtagcagcgttttttccttgtcaaaatctacatagattgatttgttcctgagcagttctgcttcttactgataaacgtttgtgatgccagtagcgacatgaatttgttggagaagc

SEQ ID NO: 3090 - DNA, 2392 bp, Triticum aestivum
acgcaggcggacctccgcgcgctccaggcacagtacgcggggctgcgggacacggcgcccaccggcaggctgcggctgcgggacctccccgccgcgctgaccggcctggggagccccaccgctatggccgccggtaaaggggaagcgctgcgcggggacgccgggaaagagaacagctcgccgcccgagcgggcgctcacggacgaggagtggtcctccgtgctcacggctgtctcccgcgccgacgagaaaccgcagctcgacgtcaactttgagctcttcctgcgcgtctacgccgagatgcagctgcggctcaagggcgggaagaaggcgcgcgagcgcgacggcggccaaggcattaagcgctcctcctcctcgtctgccgccttcctcacggcgtccaccaccacgctgctgcacaccatcagcgaatctgagaaggcttcctacgtgggccacatcaatgcctacctcgccgaggatccgttcctcaagaacgcgctgcccgtcgatccggccaccaaccagctcttccacctcactaaagacggcgtgttgctatgtaagctcatcaacttggccgttccggggaccatcgacgagcgtgctatcaacaccaagaggctgcttaacttgtgggagaaaaacgagaaccacaccctctgtctcaactctgccaaggccatcggctgcactgttgtcaatatcggcacgcaggatctcgcagaggggaggcctcatcttatcctagggctgatatctcagattatcaagatacaactattggcagatgtaaacctgaagagcacacctcagttggtcgaattggttcaagacagccaggagatggaggagcttatgagcctttctcctgaaaaaatactactaaggtggatgaactttcagctgaagaaaggaggtttccagagaacagtaacaaatttttcatcggatataaaagacagtgaggcatatgcttgcttgttaaatgtcctggctccagaatgcagtgctaaaccatcgccaatgtcagtaaaagatcttcttcatagagcaagattagttcttgagcatgcagataggatgggctgcaaaagatatctggccccgaaagacatagttgatggtttacaaaatctaaatctcgcctttgtggctcatatttttcaaaaaaggaatgggttgtcgaaacaaatgaagcaagtttcgtttgtggatggagtatctgatgatgctcaagtttcaagggaagagaggtcatttaggctatggattaacagccttggaatttctacatatataaacaatgtattcgaagatcttagaaatggatgggtgctccttgaggtcatggataaggttgctcctggttcagttaattggaagtttgcaaaccgacccccaataaaacttccattcagaaaagttgaaaactgtaatcaacttctgaagataggaaaggaaataaaattttccttggtgaatattgctggtcatgatattgtgcaaggaaacaagaaattgatattagcttttctctggcaattgatgcggtacaacatactacaactgttgaagaatcttagatttcattcgaatgggaaggagatcacagataatgacatactattatgggctaacaaaaaggttaaggattctggaagacagtctcaaatgggaagtttcaaggatagaagcctttcaagtggcatattttttgtcaacttactaagtgctgtggagcctcgcgttgtgaattggagccttgtaaccaaaggagaaaaagatgaagaaaaacaaatgaatgcttcctacatcatctctgtggctagaaagcttggttgctccatcttcttgctgccagaggatataacggaggtcaaccagaagatgatgctgactttgacagcaagcatcatgtattggcatttgaaaaggccaacatcatattcactggaccctgacaacagtagtttgtgtgagacaagttctatctcaacttcagatgactccgcatctgaatcatcaattgatgatagcggaactagatagatgaaattgcatggtctgactgctacttcaggactcaagattctatattcttgattctttgctataaattggagagcagacgcattcaagaatgaaggggagaatggtgaaagagttttgtttgtttcatttgaggttctgtagtgtgcaaattgatttggtgagtaatgtacaacatcctgtaaatattgacacaggtagcaagtatatgtaacatcatatagtggcagttgtttattcaaaatccaaccacattgattagtttgttgagcaattttgctcaggcgacgccggtgactcatgtagtaatttttggcaatgatttaaattgctatgtcac

SEQ ID NO: 3091 - DNA, 912 bp, Pennisetum glaucum
ggcatccattttgtctaggccagtagtgcatgcctccttttaatttgttccttcagacaactcacacctgcaggttcctttgtgtccaaaccaaggaaaggcaggttccttgctctcatctcggtctcttgccatatcgtctgccccaggctcttccttccctagcttttctctctctcggtctctctctcttcaagctgaggaaacgcaggacaggttagcagaagctggttgcatgctcgctccatgagtgccatggagcccaggaagaagtccagctatcttgtcgccgtcgtcttcgcctcgctcttgctgtcctccatggcaggaggtcataggaagctggtaaacaaagatgacgcaggatccatggagacgtcggaatccatgcaacagctgcagggatacgacgaagcggcggcggtggtccacgagagaattctcaggcagaagcaggtgaagatggacgattacgggcgctacgaccctaccccgaccatgtctaagcctcacttcaaggacataccaaactagaaacaaccactcgtttgagatcatacatatcctcgaatacatatatatgttgcttgctagtagttgctcatcctgcgatccttatacatatatatgcgccacatatatttgtcgaataagtcgtctcatgtatcatcagcatgtccagcttgattatatgtgtacactacctatatgttgatacatatgcatgtctatgtctgaaaattatcatacaatcgtcacttagtagtatatttgttgtcgtcatcaaaagaagagcgtgtattgctgttgactaatgactagttttacccatgtatatatttttcatagctagagatatgtgtgtgcatatgtatttttttaattcagatatatgtgaaaattttacctaaa

SEQ ID NO: 3092 - DNA, 752 bp, Panicum virgatum
gcaggttcctttgtgtccaaaccaaggaaaggcactggttcctctccgtctccagccatttctgctgcttctcccctagcttttctcccctgtctctctcttcaagctggctgtatgctcctcgcgagccatggagcccaggaagtcgagttatcttgtcgtcgtcgtcttcgcttcgctcttgctgtccgccatggcaggagggcataggaagaagctgctgagcaaagatggcgcaggaccgatggagacgacggaggaatccatgcaaccgctgcaggaagacgacgaggcggccgtggtggtggtccacgagaggattctgaagcaggtgaggatggacgactacgggcgctacgaccctactccgaccatgtccaagcctcacttcaaggacatacctaactagccacacacagcccaacccatgcgcattcagatcctcgaatatatataagttgctgcttactaagccgatcctccttagacatatatatgtgccacatatttgtcgaataagttttcatgtatcatcaccatgtccagcttgattatatatgtgtacactacctgttgatacatgtgcatgtatgtctgaaattcgaaacctatgaatcattacttaagggagctagtagtatatatatttgtcgtcgtcgtcggaagaagaagaatttgtatttaatattgttgttaaatttgtcttatgactagttttatgaatggtaaggccaagaaaggcttcttcagct

SEQ ID NO: 3093 - DNA, 794 bp, Panicum virgatum
cggggactgagattcacatacccatcatatcccaggggagcaatgataatagtatatctgcaatctattttgtctacggtggtgctggtgcatgcctccttttgattgagttcttgcagacaactcacatctgcaggttcctttgtgtccaaaccaaggaaaggcacaggttcctctccgtcccctgccatttctgctgcttcattctcccctagctagcttttctctcctgtgtctctctcttcaagctggctgtatgctcctcgcgagccatggagcccaggaagtcgagttatcttgtcgccgtcgtcttggcttcgctcttgctgtccgccatggcaggagggcataggaagaagctgctgagcaaacatggcgcaggatcaatggagacgacggaagaatccatgcagccgctgcaggaagacgacgaagcggctgtggtggtccacgagaggattctgaagcaggtgcggatggacgactacgggcgctccgaccctactccgaccatgtccaagcctcacttcaaggacatacctaactaggcacacaggccaacccatgcattcaggtcctcgaatatatataagttgctgcttgctagccgctcccccttagacatatatatgtgccacatatttgtcgaataagttccatgtatcatcaccatgtccagcttgattatatatgtgtacattacctgttgatacatgtgcatgtatctctgaaattcaaaacctatcaatcattacttaagggagctggtagtatatatatttgtcgtcgccgtc

SEQ ID NO: 3094 - DNA, 726 bp, Sorghum bicolor
acaaaataaatgacaatatattttgtctactaagctagtgcattctcttctcttagttcttgcagacagctcgcatctgcaggttcctttgtgtccaaaccaaggaaaggcaggctcctctcatctcctgccatatctgctgctgctgctgctgctccccaagctttcttcctctccttctctcttcaaggtagctggctgcatgctcctcgcgagctagccatggagcccaggaagtcgaattatcttgttgccctcgttttggcgtcgctcttgctctccgccatggcaggagggcataggaagaggcttctgaacaaagatgacgcatcagaatcaatggagacatcggaatccatgcagcagctgcaggaagacgacgaaatggcggtggtggtccacgagagaattctcaggcaggtgaagatgaacgactacgggcgctacgacccttccccgaccatggctaagcctcacttcaaggacatacctatctagccagccctctatatatatagagatatatcctggaatatgtatgttatgcttgctagtcgctcctcttatacacaagtatatcacatatatttgtcccataaattccatgtatcatcaccacgtgactatatatgtccacgtgcacagtgccccactacgtgcctgttgatatatgtgcatgtacgaagtatgtctgagacttatattcagttctttgtggagctagat

SEQ ID NO: 3095 - DNA, 903 bp, Sorghum bicolor
ggggctagctagttgttaatcaaacaggctgaaccagcaagtctaatgatgacaagaccctcaaaattccacagggaaagctctgaccaacccctttagtctgccttttgtttttttagtaaacagcattcctgcaacagggactccactgagatgcacatacccatcatctcatataaacaaaataaatgacaatatattttgtctactaagctagtgcattctcttctcttagttcttgcagacagctcgcatctgcaggttcctttgtgtccaaaccaaggaaaggcaggctcctctcatctcctgccatatctgctgctgctgctgctgctccccaagctttcttcctctccttctctcttcaaggtagctggctgcatgctcctcgcgagctagccatggagcccaggaagtcgaattatcttgttgccctcgttttggcgtcgctcttgctctccgccatggcaggagggcataggaagaggcttctgaacaaagatgacgcatcagaatcaatggagacatcggaatccatgcagcagctgcaggaagacgacgaaatggcggtggtggtccacgagagaattctcaggcaggtgaagatgaacgactacgggcgctacgacccttccccgaccatggctaagcctcacttcaaggacatacctatctagccagccctctatatatatagagatatatcctggaatatgtatgttatgcttgctagtcgctcctcttatacacaagtatatcacatatatttgtcccataaattccatgtatcatcaccacgtgactatatatgtccacgtgcacagtgccccactacgtgcctgttgatatatgtgcatgtacgaagtatgtctgagacttatattcagttctttgtggagctag

SEQ ID NO: 3096 - DNA, 681 bp, Saccharum officinarum
aggcagacaactcgcatctgcaggttcctttgtgtccaaaccaaggaaaggcaggctcctctcatctcctgccatatctgctgctgctccccaagctttcctctccttctctctgcaaggtagctggctgcatgctcctcgcgagccatggagtccaggaagtcgaattatcttgttgccctcgtcttggcttcgctcttgctctccgccatggcaggagggcataggaagaggcttctgaacaaagatgacgcatcagaatcaatggagacatcgtcggaatccatgcagcagctgcaggaagacgacgaaatggcggtggtggtccacgagcgaattctcaggcaggtgaagatgaacgactacgggagatacgacccttcaccgaccatggctaagcctcacttcaaggacatacccaactaagccagcccactatatatattgagatatatatccttgaatatatatgttgtgcttgctagtcgctccttatactacacaagtgtcacatatatttgccgaataaactccatgtaacatcaccatgtggctatgtccatgtgcactgtgccacactagctacgtacctgttgatatatgtgcatgtatgacagtatgtctgaacttatcggtacttatgggagctagtagtatatatatttggtgtcctcgtcgtcg

SEQ ID NO: 3097 - DNA, 1405 bp, Setaria italica
tgccgcgtcgtcgtgacggtgccgctcgccgcagccgccctcgtcgccgtggcgcggctcgggcccgaggagctcgccggccgggtccgggacgcgcggccggtgcacctcttcctggcagcgttcctcccggccgcggcggcgaccgtgtacctgatgctccgcccgcgcgcggtgtacctggtcgactacgcctgcttccggacggcgtccaactgccgcgtgcccttctccaccttcctggagcacgccaagcaggtgccggtgctcaacgagcgcagcatccggttcatgaccaagctgctggagcggtcggggctcggggaggagacgtgcctgccgccggcgcaccactacatcccgccctacaagtactgcaccctcgacgcggcgcgcggcgaggtggacctcgtcgtgttcggggcgctcgacgacctgttcgccaagacgggggtcagccccggcgacatcgacatcctcgtcgtgaactgcagcctcttctgcccgaccccgtccttcgtcgacatgatcatcaacaggtacaagctgcgcagcgacatccggagcacgcacctctccgggatggggtgcagcgcggggctcgtctccgtggggctcgcccggaacctcctccaggtggctcccagaggcgcgcacgcgctggtggtgtcgacggagaccatcacgcccaactactacgtgggcagcgagcgcgccatgctcctgcccaactgcctcttccggatcggcggcgcggcggcgctgctgtccaactcccccgcgaaggcccggttccggctcaggcacgtcgtgcgcacgctcaccggcgcgcaggacagcgcgtacacgtgcgtgttccaggaggaggacgacaggggaaacgtcgggatcaacctgaacaaggacctgatgaccatcgccgggaacgcgctcaaggccaacatcaccgccatcgggcccctcgtgctcccggcctctgagcagctcctgttcgcgctctccttcatcgtgcgcaaggtgctcagcgggaagttcaagccgtacatccccgacttccgcacggccttcgaccacttctgcatccacgccggcggccgcgccgtcatcgacgagctgcagcgcagcctcaacctgtcggatcagcaggtggaggcatcgcggatggcgctgcaccggttcgggaacacgtcaagcagctcgctctggtacgagctggcctacatcgaggccaagggacggatgcggaaaggtgaccgggtgtggatgattgggtttgggtccgggttcaagtgcaacagcgcggcgtgggagtgcatcgagcccgcggcgaacgcggaggggccctgggcgacgtcgattcacaggtacccggtggacatcccggacgtgctcaagcactaactgg

SEQ ID NO: 3098 - DNA, 1757 bp, Zea mays
cgacaccactcgcacaagcgtgcccacaagagtgtctgtgcatcgcagaaagagagagaagaaaaaaaggggcagcatgaactcgccacctccgctggccaggggcctcatggccgtgtaccgccgggtcgtggacaacatcctcgccgtcgtggcggtgccggtcgccgcggccgcgctggtcgccgcggcgcggttcgggccgccggaggaactggccggccggctcggtgaggtgcgacccgcgcacctcttcctcgccgcgttcgtcccggccgcggctgccacggtgtacctcatgctgcggccgcgggcggtgtacctggtggactacgcctgcttccgcacggcgtccaactgccgcgtccccttctccaccttcctggagcacgcgaagcagtgccggtgctcaacgagcgcagcatccggttcatgaccaagctgctggagcgctcggggctcggggaggagacgtgcctgccccccgcgcaccactacatcccgccctacaagtactgcaccatcgacgcggcgcgcggcgaggtggacctcgtcgtcttctcgacgctcgacgacctgttcgccaagacgggcgtcagccccggcgccatcgacatcgtcgtcgccaactgcagcctcttctgccccacgccgtccttggtcgacatgatcataaacaggtacgggctgcgcagcgacgtccgcagcgtgcacctctccggcatggggtgcagcgccgggctcatctccgtggggctcgccaggaacctcctccaggtcgctccggaaggcacgcacgcgctggtcgtctccacggagaccatcacgcccaactactacgtcggcagcgagcgtgccatgctccttcccaactgcctcttccgcataggcggcgccgcggcgttgctgtccaactccccggccaaggccaggttccgcctcaagcacgtcgtgcgcacgctcaccggcgcgcaggacaacgcgtacacgtgcgtgttccagcaggaggacgacagcggcaacgtcgggatcaacctgaacaaggacctgatgaccatcgccgggaacgcgctcaaggccaacatcaccgccatgggacccctcgtcctcccggcctcggagcagctcctgttcgccctctccttcatcgcgcggaaggtgctcagcggcaagttcaagccgtacatccccgacttccgcaccgccttcgaccacttctgcatccacgcgggcggccgcgccgtcatcgacgagctgcagcgcagcctcaaactgtcggacgagcaggtagaggcgtccaggatggcgttgcaccggttcgggaacacgtccagcagctcgctgtggtacgagctagcgtacatcgaggccaaggggcggatgcggaggggtgaccgagtctggatgattggttttgggtccggtttcaagtgcaacagcgcggcgtgggagtgcatcgcgcccgcggcggacgcgcagggaccctgggcaacgtccatccacaggtacccggtggacattccagacgtgctcaagcactaactagcttctacgtccatcaacagacaacagttgcttccgctcaccccaaacaaaaaaacaacaactcttttagggccgaataattgagatgtatacagtataccgcgacatgttgttgggtttgttaattgttcatcctgttgattcatcggctagtctcacagttgtatcactatcacactatggttatggacgcgcggtgagacagaagtgta

SEQ ID NO: 3099 - DNA, 1741 bp, Sorghum bicolor
agtgcctgcgtgcatcgaccgcagaaaaaggaaaagaaaaagtggcagcatgagctcgccacctctgttcggcaacggcaagggcctcaaggccgtgtgccgccgcgtggtggacaacatcctcgccgtcgtgacggtgccgctcacggccgccgcgctggtcgccatggcgcggttcgggccggaggaacaactggccggccagttccgcgaggcgcggcccgtgcacgtcttcttggcggcgttcgtccctgccgcggctgccacggtgtacctgatgctgcgcccgcgcgcggtgtacctggtggactacgcctgcttccgcacggcgtccaactgccgcgtccccttctccacgttcctggagcacgccaagcaggtgcccgtgctcgacgagcgcagcatccggttcatgaccaagctgctggagcgctcgggtctcggggaggagacgtgcctgccccccgcgcaccactacatcccgccctacaactactgcaccctcgacgcggcgcgcggcgaggtcgacctcgtcgtcttctccgcgctcgacgacctgttcgccaagacgggcatcagcgccggcgccatcgacatcgtcgtcgtcaactgcagcctcttctgccccacgccgtccttcgtcgacatgatcgtccacaggtacaagctgcgcagcgacgtccgcagcgtgcacctctccggcatggggtgcagcgccgggctcatctccgtggggcttgccaggaacctcctccaggtcgctccgaaaggcacgcacgcgctggttgtctccacggagaccatcacgccaaactactacgtgggcagcgagcgcgctatgctcctgcccaactgcctgttccgcgtaggcggcgccgcggcgctgctgtcgaactccccggacaaggcaaggttccgcctgaagcacgtcgtgcgcacgctcaccggcgcgcaggacagcgcgtacacgtgcgtgttccagcaggaggacgacaacggcaacgtgggcatcaacctgaacaaggacctgatgaccatcgccgggaacgcgctcaaggccaacatcaccgccatgggacccctcgtcctcccggcatcagagcagctgctgttcgcgctctccttcatcgcgcggaaggtgatcagcggcaagttcaagccgtacctgccggacttccgcacggcgttcgagcacttctgcatccacgcgggcgggcgcgccgtcatcgacgagctgcagcgcagcctgggcctgtcggacgagcaggtagaggcgtcgaggatgacgctgcaccggttcgggaacacgtcgagcagctcgctgtggtacgagctggcctacatggaggccaaggggtgtatgcggaggggtgaccgcgtgtggatgattgggtttgggtccgggttcaagtgcaacagcgcggcgtgggagtgcatcgagcccgcgcgcaccgccgagggaccctgggccacgtccatccacaggtacccggtgcacattccagacgtgatgaagcactaataatactagcttgaccgtcaacaacagcgcattggctaagattaaatcccgtggaataattgtgacgtatacagtatacagggacatgtccgtgttctgtttattaattaattctcatgttgatagttaataaggaaaaagcatttcttccgttatagtctcacagtagggtagtatatcacatcatgcatctgggcaaagccttggaacaggagtgta

SEQ ID NO: 3100 - DNA, 1479 bp, Sorghum bicolor
atgagctcgccacctctgttcggcaacggcaagggcctcaaggccgtgtgccgccgcgtggtggacaacatcctcgccgtcgtgacggtgccgctcacggccgccgcgctggtcgccatggcgcggttcgggccggaggaacaactggccggccagttccgcgaggcgcggcccgtgcacgtcttcttggcggcgttcgtccctgccgcggctgccacggtgtacctgatgctgcgcccgcgcgcggtgtacctggtggactacgcctgcttccgcacggcgtccaactgccgcgtccccttctccacgttcctggagcacgccaagcaggtgcccgtgctcgacgagcgcagcatccggttcatgaccaagctgctggagcgctcgggtctcggggaggagacgtgcctgccccccgcgcaccactacatcccgccctacaactactgcaccctcgacgcggcgcgcggcgaggtcgacctcgtcgtcttctccgcgctcgacgacctgttcgccaagacgggcatcagcgccggcgccatcgacatcgtcgtcgtcaactgcagcctcttctgccccacgccgtccttcgtcgacatgatcgtccacaggtacaagctgcgcagcgacgtccgcagcgtgcacctctccggcatggggtgcagcgccgggctcatctccgtggggcttgccaggaacctcctccaggtcgctccgaaaggcacgcacgcgctggttgtctccacggagaccatcacgccaaactactacgtgggcagcgagcgcgctatgctcctgcccaactgcctgttccgcgtaggcggcgccgcggcgctgctgtcgaactccccggacaaggcaaggttccgcctgaagcacgtcgtgcgcacgctcaccggcgcgcaggacagcgcgtacacgtgcgtgttccagcaggaggacgacaacggcaacgtgggcatcaacctgaacaaggacctgatgaccatcgccgggaacgcgctcaaggccaacatcaccgccatgggacccctcgtcctcccggcatcagagcagctgctgttcgcgctctccttcatcgcgcggaaggtgatcagcggcaagttcaagccgtacctgccggacttccgcacggcgttcgagcacttctgcatccacgcgggcgggcgcgccgtcatcgacgagctgcagcgcagcctgggcctgtcggacgagcaggtagaggcgtcgaggatgacgctgcaccggttcgggaacacgtcgagcagctcgctgtggtacgagctggcctacatggaggccaaggggtgtatgcggaggggtgaccgcgtgtggatgattgggtttgggtccgggttcaagtgcaacagcgcggcgtgggagtgcatcgagcccgcgcgcaccgccgagggaccctgggccacgtccatccacaggtacccggtgcacattccagacgtgatgaagcactaataatac

SEQ ID NO: 3101 - DNA, 1959 bp, Sorghum bicolor
ggctttaaaacaacctcaccacctctgctccctgccggaatccacacacacaccacgccacacgcaggtcgcaggcacgagcacacccccactagaggtagagtgcctgcgtgcatcgaccgcagaaaaaggaaaagaaaaagtggcagcatgagctcgccacctctgttcggcaacggcaagggcctcaaggccgtgtgccgccgcgtggtggacaacatcctcgccgtcgtgacggtgccgctcacggccgccgcgctggtcgccatggcgcggttcgggccggaggaacaactggccggccagttccgcgaggcgcggcccgtgcacgtcttcttggcggcgttcgtccctgccgcggctgccacggtgtacctgatgctgcgcccgcgcgcggtgtacctggtggactacgcctgcttccgcacggcgtccaactgccgcgtccccttctccacgttcctggagcacgccaagcaggtgcccgtgctcgacgagcgcagcatccggttcatgaccaagctgctggagcgctcgggtctcggggaggagacgtgcctgccccccgcgcaccactacatcccgccctacaactactgcaccctcgacgcggcgcgcggcgaggtcgacctcgtcgtcttctccgcgctcgacgacctgttcgccaagacgggcatcagcgccggcgccatcgacatcgtcgtcgtcaactgcagcctcttctgccccacgccgtccttcgtcgacatgatcgtccacaggtacaagctgcgcagcgacgtccgcagcgtgcacctctccggcatggggtgcagcgccgggctcatctccgtggggcttgccaggaacctcctccaggtcgctccgaaaggcacgcacgcgctggttgtctccacggagaccatcacgccaaactactacgtgggcagcgagcgcgctatgctcctgcccaactgcctgttccgcgtaggcggcgccgcggcgctgctgtcgaactccccggacaaggcaaggttccgcctgaagcacgtcgtgcgcacgctcaccggcgcgcaggacagcgcgtacacgtgcgtgttccagcaggaggacgacaacggcaacgtgggcatcaacctgaacaaggacctgatgaccatcgccgggaacgcgctcaaggccaacatcaccgccatgggacccctcgtcctcccggcatcagagcagctgctgttcgcgctctccttcatcgcgcggaaggtgatcagcggcaagttcaagccgtacctgccggacttccgcacggcgttcgagcacttctgcatccacgcgggcgggcgcgccgtcatcgacgagctgcagcgcagcctgggcctgtcggacgagcaggtagaggcgtcgaggatgacgctgcaccggttcgggaacacgtcgagcagctcgctgtggtacgagctggcctacatggaggccaaggggtgtatgcggaggggtgaccgcgtgtggatgattgggtttgggtccgggttcaagtgcaacagcgcggcgtgggagtgcatcgagcccgcgcgcaccgccgagggaccctgggccacgtccatccacaggtacccggtgcacattccagacgtgatgaagcactaataatactagcttgaccgtcaacaacagcgcattggctaagattaaatcccgtggaataattgtgacgtatacagtatacagggacatgtccgtgttctgtttattaattaattctcatgttgatagttaataaggaaaaagcatttcttccgttatagtctcacagtagggtagtatatcacatcatgcatctgggcaaagccttggaacaggagtgtacacccaaactgtttgtaacgtcagaatcttactgtgcagtccccatatatgtaattcgtcagaactggttgcttgatgtctgtttttattaattaaaagataatcatcatatgtctg

SEQ ID NO: 3102 - DNA, 2218 bp, Oryza sativa
tttaaatttcgcctccatatatcgatcacatccggggaaccaacaaaccaacacacatccaacgaaagggtgagcaaccaaactttaactgtacaacgtaggcatagcgcgcggcatgagtatggctgcacgttttctcgacagcctcaaggctacgtaccagtactaccaccgtgccatgggcaacgtcctcgtcgccgtgccggccgctgctggcgccctcgtcacggtggctctcctcgcgccggaggccgagtcgacgacggtggcgatcgggcgtctacgcgagctgatcaggcccgcgcacctcttcctggccgtcttcctcccggccgccgcggccaccgtgtacctcgtgatgcgcccgcgggcggtgtacctcgtcgactacgcgtgcttccgcacggcgcccaactgccgcgtccctttcgccacgttcctcgagcacgcgaggcaggtgcccacgctcaccgagcgcagcgtgcggttcatgacgcggctgctcgagcggtcggggctcggggaggagacgtgcctgccgccggcgcaccactacatcccgacctacaagtactgcaccctcgaggccgcccgtgccgaggtcgacctcgtcgtcttctccgccgtcgacgagctcttcgccaagaccggcgtcagccccgacgacgtcgacatactcgtcgtcaactgcagcctgttctgccccacgccgtcgttcgtcgacatgatcgtgaacaggtacaagctgcggagcgacatccgcagcatgcacctgtccggcatgggctgcagcgcgagcctcatctccatcggcctcgcgaggaacctcctgcaggtggcgccgcatggcgcgcgcgcgctcgtcgtctccacggagaccatcacgcccaactactacgtcgggaacgagcgcgcgatgctcctgcccaactgcctcttccgcatgggcggcgcggccgcgctgctgtcgacgtccccggcgaaggcgcggttccggctgaagcacgtcgtgcgcacgctcaccggcgcggaggacagcgcgcaccactgcgtgttccaggaggaggacgagcacgggagcatcggaatcaaccttagcaaggatctcatgaccatcgccggcaacgcgctcaaggccaacatcacggccatcgcgccgctcgtcctgccggcgtcggagcagctcaagttcgcgctcgccttcatcgcgcggaaggcgctcagcggcagggtcaagccgtacatcccggacttccgcgcggcgttcgagcacttctgcatccacgccggcgggcgggcggtgatcgacgagctgcagcgcagcctctgcctctcggacgagcaggtgcaggcgtcgcggatggcgctccaccgattcgggaacacgtcgagcagctcggtgtggtacgagctggcctacgtcgaggccaagggacgcatgcgccgcggcgaccgcgtgtggatgatcggcttcggctccggtttcaagtgcaacagcgcggcgtgggagtgcatctcgccggcgcgcgacgacgacgggccgtgggccacgtcgatccacaggtatccggtggacattcccgacgtgctcaagcactaggaagacacggcatcgctgtccttctgaataattcagtgttaattaaaacagaaaactgtaatattcctgtttagtgtgtgtgtgaggctgcgttctttccacaagtttcccaacccctttccctcgttttccgcgtgcacgcttttcaaactgctaaatggtgtatttttttgcaaaaagtttctatacgaaagttgctttaaaaaaacaaattaatctatttctaaaaaaaaaattaactaatacttaattaatcacacgctaatggaccgctccgttttctgtgcggtggagttgggttcccaaccccaagtatcaaacacagcctgagagagtgtgtgactccttctacggagtgcatggagttgctacagagtggagtaaaaagttgtcgttgacaggtagtacaataatgttatgattattgcgaatattaaagttgataacggaaaaggaattatcttttcttgcctccaccaagttaaggatatatggtgttcaccgatcacaatctacactgttgcccttgctggtcatcctctgtcaatttattcgctctgtctcacaataaatttattaattcatttcatttgttgtaaaatattttttttagataac

SEQ ID NO: 3103 - DNA, 1869 bp, Oryza sativa
acacacacaaatcaacgcgcccaacgcacgcaagggctaattaaccactttcgacctgcgtactaatcctaacatagcactttcgacctcctcacgtaggcaaaacaagctagcagcatgagcacagcggcatcacctttgctcgagcgcctcaaggctgcgtaccactaccacgccgccgtgggcaacgtccgcgccatcttcattacgctcctggccgcggccgctgtcgctgcgctgacccaccttgcgccggaggaggtggtgatcggccggctacgggagctgaggactgtgcacctcttcctcgccatcttcctcccggtggccgcggccaccatgtacctcatgcttcgcccgcgaccggtatacctcgtcgattacgcgtgcttccgcacggcgcccaactgccgtgtccccgcagccaccttcctcgagtacgccaagcaagtcccggtcatcaccgaccgcagcgtgcggttcatgacgcggctgctcgagcgatcggggctcggggaggagacgtgcctgccaccggcgaaccactacatcccgccgtacaagtactgcaccctcgacgccgcccgtggtgaggtcgacctcgtcgtcttctccgccgtcgatgagctcttcgccaagaccggcatcagccccgacgacgtcgacatactagtcgtcaactgcagcctcttctgccccacgccgtcgttcgttgacatgatcgtgaacaggtacaagctgcggagcgacatccgcagcatggacctgtccggcatgggttgcagcgcgagccccatctccatcggcctcgccaggaacctcctgcagttggcgccgcatggcgcgcgcgcgctcgtcgtctccacggagaccatcacgcccaactactacgtcgggaacgagcgcgcgatgctcctgcccatctgcctattccgcatcggcggcgcggccgcgctgctgtccacgtccccggcgaaggcgcggttccggctgcagcacgtcgtgcgcacgctcaccgccgcggaggacagcgcgtaccactgcgtgttccaggaggaggacgagcacgggaacaccgggatcaaccttagcaaggaactcatgaccatcgccggcaacgcgctcaaggccaacatcaccgccatcgcgccgctcgtcctgccggcgtcggagcagctcaagttcgcgctcgccttcatcgcgcggaaggcgctcagcggcagggtcaagccgtacatcccggacttccgcgcggcgttcgagcacttctgcatccacgccggcggtcgggcggtgatcgacgagctgcagcgcagcctctgcctctccgacgagcaggtggaggcgtctcggatggtgctccaccggttcggcaacacgtcgagcagctcggtgtggtacgagctggcctacatcgaggccaagggccgcatgcgccgcggcgaccgcgtgtggatgatcggcttcggctccggtttcaagtgcaacagcgcggcgtgggagtgcatctcgccggcgcgcgacgccgacgggccgtgggctacgtcgatccacaggtatccagtggacattcccgacgtactcaagcactaagcagtggtattgggatcctctgatgtgaagttagagaaacatgatgactgatacgtggacccaaccgctcacgagcccacttaccagtgaccacatcaggaggaagttcacgtaggatccgcttcctaagcagagagagtaatcgtaatcctatagaataatcgagttgtcgaccaaactaactaaacgttgtaagttactaagttcttattactgtgtctccctgtatcgactgctacagagtacatgatgctgacaagtagtataatattgttc

SEQ ID NO: 3104 - DNA, 1899 bp, Panicum virgatum
ggccaccatcgagaaaagacacgtccatgatgaggaggagcagggcgctggctcggactccgactcctcttcctcgtcctcgtcatgcgccaccccacgccgcggcccctgctccccctgctccccctacacccagcaatggccgcagagttacaggcaatcaattgacattcttagtagtgtgcaatcaccgaatctcagttttttaggcactccaactctgagcagattgtccaattctttcctagctgtcaccgattcctttcggagcaaaacccctgaaatagtctctaactttgtcaagccacttctgagccccgctacaagtgatgagcagcagcaacacgaagatacccgaaagagttcccagtaccttctgccctcaaggaagccatcattgcaacaaatccccgaagatcagaagccactggtagctggtcatgaagtgtctccttatcgaaactgctcttacacccatggagtgatgaatggaataaatgttctatgtggcgtgggaatcctatcaacaccttatgcgattaaacaagggggttggattggacttgggatactcagtttattcgctttgcttgcatggtacactggtatgctcctgcgccattgcttggacagcaaggagggccttgagacatacccagatattggccatgccgcctttggcagcaccggtcgcatagttatctcgataatcctgtatgtggaattgtatgcctgttgcatcgagtatttgatattggagagcgacatttgtcaaaattgttccccactgctcatctgaccattgggagcttgacactgaactctcatgtatttttgcaatcttgactaccatcatagtaatgccaaccacctggctccatgacctgagctgcctgagctatatttcagctggaggtgttattgcatcaatccttgtggtcatctgcctgtcctgggtggggattgttgatgatgttggctttgagaacaaagggactgtgctgaacctcccaggaattcctattgcacttggattgtatggttactgctactctgggcatggggtgtttccaaacatctattcgtctctgaagaatcgcaatcagttcccttcaattctttttacttgcattgggctgtctaccgttttatatgctggtgctgctgtgatgggatacaaaatgtttggagaagccacagagtctcagttcacgcttacttaccagacaactcagtggtttcaaaggttgctgtttggacaacggtggcaaatccaataacaaaatatgcattaaccataatcccactggctatgagtttggaagagctgctgccatcaaatcaacagaagtactcgaacattatcatgcttagatcagccttggtggtgtcaaccctcctgattgctttatctgtgcctttctttggacttgtgatggccttggtgggttccttattcgccatgcttgtgacctatattttgccttgcgcgtgtatttggcaatccttaggacaaaagtggggtggcatcagatagcagcttgttcgttcatcatcattgtcggggtttgctgcgcttgcgtggggacatactcatccctgtccgggataatccagaactacacataataaagttcctgtgatcctttatatacagctgcccagcagtactgtgtgctatatgagccaaagatatacaaggtggaaagtttcccagcaattgagtcgtgtatattaaatatgtggcatgctgtacttcgtgggtcaacagtatgtagtatgggcttgaggttgtatcatgcggaagtaacagtattctttatggcgcagacaaaaaacaagtttgagttgtcttgtagtttttatgatttgattctatcaatatatgttcttctggtt

SEQ ID NO: 3105 - DNA, 1992 bp, Saccharum officinarum
gccctactcgttttgggaacttgtttcgaagagaagcagattttgaggagacgacggcagagtgagggggagatgaggagcccggtgccggagcgtagcctcatcatcgagagcgacgacgacgatgacacccaatccgctgtcgccaccaactggacaggacacggccacgacgaggaggagccggagcaggactccgactcctcgtcgtcgtcttcatcctgcgccaccccacgccgcggcccaagctcccccgcctacacccagcaatggccgcagagttacaggcaatcgattgacattcttagtagcgtgcactcacccaatctgagctttttggggactccaactctgagcagactgtcaaactctttccttgccatcaccgattcttttcggggcaaagcccctgaaacaatctcaaactttatcaagccacttcttggccccacatcaagtgatgagcagcagcagcaacatgaagatacccgaaagagttctcagcacattatgccctcaagaaaatcatctttgcaacaaatccctgaggatcaaaagccactggtagttggtcatgaggcgtctcataatcgaaattgctcttacacccagggagtgatgaatggaataaatgttctatgtggcgtgggaatcctatcaacaccttatgccatcaaacaagggggttggattgggctggtgatactctgtttatttgcattgcttgcatggtacactggcgtgctcctgcgccattgcctggacagcaaggagggcctcgagacatacccagatatcggccatgcagcctttggcagcacaggtcgcatagttatctcgataatactgtatgtggaattgtatgcatgttgcatcgagtatttgatattggagagtgacaatttgtcaaaattattccccactgcacacctgaccattgggagcttgacgctgaactcacatgtattttttgcaatcttgactaccatcatagtcatgccaaccacctggctccgtgacctgagctgtttgagctacatttcagctgggggtgtcattgcatcaatccttgtggtcatctgcctgttcttggttggggttgtcaataatgtcggctttgagaacgaagggactgcactgaacctcccaggaattcctattgcaattggattatatggttactgctactcagggcatggggtatttccaaacatatattcctctctgaagaatcgcaaccagtttccttcaattctttttacatgcattgggctgtctacctttttgtatgctggtgctgcagtgatgggatacaaaatgtttggtgaagccacagagtcccaattcacactcaacttaccagataattccctcatttctaaggttgctgtttggacaacggtggcaaatccaataaccaaatatgcattaactattattccattggctatgagtttggaagagttgctgccaccaaaccaacaaaagtattctacaataatcatgcttagatcatctctggtgatgtcaaccctcctgattgctctatctgtgcctttctttggacttgtgatggccttggttggttccttgtttgccatgcttgtgacctatattctgccttgcgcgtgttttttggcaatcctcaagacaaaagtggggtggcatcagatagcagcttgctcgttcatcatagctgttggggtttgctgtgcctgcgtgggaacatactcatccctgtcaaagataatccagaactacacataatacagctgttcctgactgcctgttatcctatatatgcagctgcccaacaaaatcatgtgtgtgcaatatgggccaagcatatataagatgaaagtttaccctgcaattcactctctgtataataaattattggtgtcttatcatagggctcaacgatttgtactatggttttaaggtggtttcatgcgtaagtaacattgttccttatggtgcggaaaaaaaaac

SEQ ID NO: 3106 - DNA, 2159 bp, Sorghum bicolor
caaacacgcgcttaacctgcggatatattttagtggtgagatgagtgtacataggcagcaggggtttattcgttttgggtacttgtttcgaagagaagcagatttcgaggagacgaaggctgagtgagcaggagatgaggagcccggtgccggagcgtagcctcatcatcgagagcgatgacgacgacgacacccaatccgctgtcgccaccaactggataggacacgggcacggccacgacgaggaggagccggagcaggagcccggttcggactctgactcttcgtcgtcgtcttcgtcctgcgccaccccacgccgcggcccaagctcccccgcctacacccagcaatggccgcagagttacaggcaatcgattgacattcttagtagcgtgcactcatccaatctgagctttttggggactccaacgctgagcagactgtcaaattctttccttgccatcaccgattcttttcggggcaaagcccctgaaacaatctcaaactttgtcaagccacttcttggtcccacatcaagtgatgagcagcagcagcagcagcatgaagatacccgaaagagttctcagtacattatgccctcaagaaaatcatctttggaacaaatccctgaggatcaaaagccactggtagttggtcatgaggcgtctcgtaatcgaaattgctcttacacccagggagtgatgaatggaataaatgttctatgtggcgtgggaatcctatcaacaccttatgccatcaaacaagggggttggattgggctggtgatactctgtttatttgctttgcttgcatggtacactggcgtgctcctgcgtcattgcctggacagcaaggagggcctcgagacatacccagatattggccatgcagcctttggcagcacaggtcgcatagttatctcgataatactgtacgtggaattgtatgcatgttgcatcgagtatttgatattggagagtgacaatttgacaaaattattccccactgcacacctgaccattgggagcctgacgctgaactcacatgtattttttgcaatcttgactaccatcatagtcatgccaaccacctggctccgtgacctgagctgtttgagctacatttcagctgggggtgtcattgcatcaatccttgtggtcatttgcctgttcttggttggggttgtcaatgatgtcggctttgagaacgaagggactgcactgaaccttccaggaattcctattgcaatcggattatatggttactgctactcagggcatggggtatttccaaacatatattcctctctgaagaatcgcaaccagtttccttcaattctttttacatgcattgggctgtctacctttttgtatgctggtgctgcagtgatgggatacaaaatgtttggtgaagccacagagtcccaattcacactcaacttaccagataattccctcatttctaaggttgctgtttggacaacggtggcaaatccaataaccaaatatgcattaactattattccattggctatgagtttggaagagttgctgccaccaaaccaacaaaagtattctacaataatcatgcttagatcatctctggtgatgtcaaccctcctgattgctctatctgtgcctttctttggacttgtgatggccctggttggttccttgtttgccatgcttgtgacctatattcttccttgcgcatgttttttggcaatcctcaagacaaaagtggggtggcatcagatagcagcttgctcgttcatcatagctgtcggggtttgctgtgcctgcgtgggaacatactcatccctgtcaaagataatccagaactacacataatacagctgttcctgttatgcagctgcccaacaaaatcatgtgtgtgctatatgggccaagcatatacaagatgaaagtttaccctgcaattcactctatgcataataaattattggtgtcttatcatagggctcaacgatttgtactatggttttaaggtggtatatcatgcgtaagtaacattgttccttatggtgcgcaaaaaacaagttgatttggtattcttgcaattttatgatttgattgtatcaaaagttgaatggagcaagagtccatgaacttaataggatgtgccacttagttcacgaa

SEQ ID NO: 3107 - DNA, 2908 bp, Sorghum bicolor
attttggtacgtatctaccgaggtgcaggaggagccgaggagctgaagcttaataaaaaatgtagccaccaaacacgcgcttaacctgcggatatattttagtggtgagatgagtgtacataggcagcaggggtttattcgttttgggtacttgtttcgaagagaagcagatttcgaggagacgaaggctgagtgagcaggagatgaggagcccggtgccggagcgtagcctcatcatcgagagcgatgacgacgacgacacccaatccgctgtcgccaccaactggataggacacgggcacggccacgacgaggaggagccggagcaggagcccggttcggactctgactcttcgtcgtcgtcttcgtcctgcgccaccccacgccgcggcccaagctcccccgcctacacccagcaatggccgcagagttacaggcaatcgattgacattcttagtagcgtgcactcatccaatctgagctttttggggactccaacgctgagcagactgtcaaattctttccttgccatcaccgattcttttcggggcaaagcccctgaaacaatctcaaactttgtcaagccacttcttggtcccacatcaagtgatgagcagcagcagcagcagcatgaagatacccgaaagagttctcagtacattatgccctcaagaaaatcatctttggaacaaatccctgaggatcaaaagccactggtagttggtcatgaggcgtctcgtaatcgaaattgctcttacacccagggagtgatgaatggaataaatgttctatgtggcgtgggaatcctatcaacaccttatgccatcaaacaagggggttggattgggctggtgatactctgtttatttgctttgcttgcatggtacactggcgtgctcctgcgtcattgcctggacagcaaggagggcctcgagacatacccagatattggccatgcagcctttggcagcacaggtcgcatagttatctcgataatactgtacgtggaattgtatgcatgttgcatcgagtatttgatattggagagtgacaatttgacaaaattattccccactgcacacctgaccattgggagcctgacgctgaactcacatgtattttttgcaatcttgactaccatcatagtcatgccaaccacctggctccgtgacctgagctgtttgagctacatttcagctgggggtgtcattgcatcaatccttgtggtcatttgcctgttcttggttggggttgtcaatgatgtcggctttgagaacgaagggactgcactgaaccttccaggaattcctattgcaatcggattatatggttactgctactcagggcatggggtatttccaaacatatattcctctctgaagaatcgcaaccagtttccttcaattctttttacatgcattgggctgtctacctttttgtatgctggtgctgcagtgatgggatacaaaatgtttggtgaagccacagagtcccaattcacactcaacttaccagataattccctcatttctaaggttgctgtttggacaacggtggcaaatccaataaccaaatatgcattaactattattccattggctatgagtttggaagagttgctgccaccaaaccaacaaaagtattctacaataatcatgcttagatcatctctggtgatgtcaaccctcctgattgctctatctgtgcctttctttggacttgtgatggccctggttggttccttgtttgccatgcttgtgacctatattcttccttgcgcatgttttttggcaatcctcaagacaaaagtggggtggcatcagatagcagcttgctcgttcatcatagctgtcggggtttgctgtgcctgcgtgggaacatactcatccctgtcaaagataatccagaactacacataatacagctgttcctgttatgcagctgcccaacaaaatcatgtgtgtgctatatgggccaagcatatacaagatgaaagtttaccctgcaattcactctatgcataataaattattggtgtcttatcatagggctcaacgatttgtactatggttttaaggtggtatatcatgcgtaagtaacattgttccttatggtgcgcaaaaaacaagttgatttggtattcttgcaattttatgatttgattgtatcaaaagttgaatggagcaagagtccatgaacttaataggatgtgccacttagttcacgaactctgaaattttagtatttttttttagaaaatagaatatattaagcttctgcatgaaacctcatagtctgtccgcgcattttaggtgatgtctaatgtagcattgtcatagtcagtacatgtcggcacttgaaaagcgtgtgaggacatgcatgggtaaggtgggagcgtgctggaaataagcataagttgagcaggggcatatgttgtcatttatcatccatttttattagacttggtgcctccatgatatgtacatggatatccgagggagtagtcaactgtgcatatgttctcgagttctgaggcatgtttgcttggctgaaaagttatggctaaaaatactgtttgctgatttgttatgagagaaaaaacactgtttaatggttggtaaattcggcagataagttcaaatgaacatttgtatagaagatgagcctctgtttgtggttagaaaatgactattgttataatctatctctaacgattaatttaatttttttagttttggtcacatttatctcatcccactttcacacaaaaaacgaataatcactggatcatttaaacaataatacaaaatatgatcaacaatggtcatgttctggttctatgaaagatcgttaaaggaactgaagatgaattttcttcatagggctatttttctttgtcaaataagcc

SEQ ID NO: 3108 - DNA, 2428 bp, Zea mays
ggttcttatataccctagaagtctttcaaaacattcaatcattagttggttgtgagatattccttcatttcggctgtagtagagagcttaatcttgggattttgggaagttttcccttgtgtacttgtttttggacggttcgaatgctcgctacgttcgtcgatcatcatcaagaacatttatagtcatttgttgggccgggtgcatctcgtttgagagttttattgtttttgttgattttagaagcaaatcaatattgtcttgttaaaagctttttttattggctccctttcacacaccgtctagtcgccagctttgatcaaagataaagatgtgctttcaaatggtacaaaatacgaaaaagaaatagaaatagatatattagtgttttccagtgaagatctatagtagagtttaaactgtaaaaatactaggaaaaattactggacatgtgtattactataataaaaaaaacctcaagcataggaagagctggagcgaaccctgccaaccacgcccataacctccacacatatatatattgtagttgtagtgagatggcacagcagaacagaggttattcgttttagctacccgttttgaagagaagccgattttggaggagacgatgatgagtccggcgtcggagcgcagcctcatcatccagagcgacgacgacgacgacgcccgatccggccacgacgtggaggagccggagcaggactccgactcctcctcgtcgtcctcatcctgcgccaccccacgccgcggcccaagctcacccccctacatccagcaatggccgcagagttacaggcaatcgatcgacattctcagcagcgtgcagtcacccaacctgagctttctggggactccaactctgagcaggctgtcgaactctttcctcgccatcaccgattctttccggagcaaggcccccgaaacgatctctagctttatcaagccactccttggccccacgccaagtgacgagcagcagcggcagcatgaaggcacccgaaagagttccgagtaccttgtgccctcgagaagatcatctctgcagcagatcccagaggatcaaaagccacctgtaggtggccatggggcgtctcatgaccagaactgctcttacacccagggagtgatgaatggaataaatgttctatgtggtgtggggatcctatcaacaccttatgccatcaaacaggggggctggattgggctggcgatactctgtacatttgctcttctcgcatggtacacaggtgtgctcctgcgccattgcctggacagcaaggagggcctcaagacatacccagatattggccatgcagcctttggcagcacaggccgcatagttatctcgataatactgtacgtggagttgtatgcatgttgcatcgagtatttgatattggagggtgacaatttgtcaaaattattccccaatgctcacctgaccattgggagcatgacactgaactcacatgtattttttgcaatcttgactaccatcatagtcatgccaaccacctggctccgtgacctgagctggctgagctacatttcagctgggggtgtcattgcatcaatccttgtggtcatctgcctgttcttggttggggttgtcaatgatttcggctttgagaatgaagggactgcactgaacgccccaggaattcctattgcaattggattatatggttactgctactcagggcatggggtttttccaaatatctattcctccctgaagaatcgcaaccagtttccttcaattctttttacttgtattgggctgtctacctttttgtatgctggtgctgcagtgatgggatacaaaatgtttggtgaagccacagagtcccaattcacactcaacttaccagataattctgtcatttctaagattgctgtttggacaacggtggcaaaatcaataaccaaatatgcattaactattattccattggctatgagtttggaagagctgctgccaccaaaccaacaaaagtattctacaataatcatgcttagatcatctctggtgatatcaaccctcctgattgctctatctgtgcctttctttggacttgtgatggccttggttggttctttgtttgccatgcttgtgacctacattttgccttgcgcttgttttttggcgatcctcaagacaaaagtggggtggcatcagatagcagcttgctcgttcatcatagttgtcggggtttgctgtgcctacgtgggaacatactcgtccctgtcgaagataatccagaactacgcatagcacagctgttcctgtgatcctgtatatgcatctgcccgacaaaatcatgtgtgtgctatatgggccgaacatatgtacaagatgaaagtttaccattcaattcactcgatgtataataaattattggtgcct

SEQ ID NO: 3109 - DNA, 2036 bp, Setaria italica
gtggtgcccacgcagacgcagacgcagacgcagacgcagcagagcccggaagagaaggagggaggagtaagatgaggagctcggtgtcggagcgcagcctcatcatcgagagcgacgacgacgacgaccatccccaatcccaaccgccatccgcagccgccgccaggagaagacgccaccacgaccagggctccggctccgactccgactccggctcgggctccgactcgtcctccccctgcgccaccccgcgcgccgagcccaccgcctcctcctacacccagcaatggccgcagagctacaggcaatccatcgacatccttagtagcgtgcagtcaccaaatctcagcttcttagggaccccaactctaagcaggctctccaactccttcaccaactctttccgtggtaaaacccctgaaatcatctctaatctcgtcaagccactcctgcgccccaccacaagtgatgagcagcaacgtgaagaagcgcgaaagagctcccagtaccttctgccctcgagaaaaccctctttgcaacaaatccctgaggatcagaagccactgctagttgctgatgaggtgtctcctcatcagaaatgctcttacacccaggcagtggtcaatggaataaatgttctatgtggtgtgggaatcctatcaacaccttatgccatcaaacaaggtggttggcttggactggccatactctgtttatttgctattcttgcatggtatactggtgtgctcctgcgccgttgcctagacagcaaggagggccttgagacatacccagatattggccatgccgcctttggcaccaccggtcgtatagccatctcgataatcctgtatgtggaactgtatgcctgttgcatcgagtatctgatactggagagcgacaatttatcaaaattattccccaatgcacacctaaccattgggagcttgacattgaactcccatgtatttttcgcaatcttgactaccatcattgtcatgcccaccacttggctccgtgaccttagctgcctgagctacctttcagctggaggtgtcattgcatctatccttggagtcatctgcctgttctgggcaggtgccgttgacaatgttggctttgagaacgaaggaactgtgctgaacctccctggaatccctattgcgattggattgtatggttattgctactcagggcatggggtgtttccgaacatctattcttctctgaagaatcgcaaccagttcccttcaattctctttacttgtattgcgctgtctaccattttgtatgctggtgccgcggtgatgggatacaaaatgtttggtgaagccacaaagtctcagttcacactcaacttaccagagaatttagtagtttcaaaggttgcagtttggaccacggtggcaaatccaataaccaaatatgcattaaccataatcccactgtctatgagtttggaggagttgctgccgccaaatcaacagaagtactcaaacataatgatgcttagatcagcccttgtggtgtcaaccctcctcattgctctatctgtacccttctttggacttgtgatggccttggttggttctttgctcacgatgcttgtgacctatattctaccttgcgcgtgctttctggcaatccttaagacaaaggtgacttggcaccaggtcgcagcttgctcattcatcatggcggtcggggtttgctgcgcgtgtgtggggacatactcgtccctgtccaggataatccagagttacacctgatcagtgtacatgttgcagttattccagtcacccaccgtatacacgaaaagcatatacaagacaaatttttacccagtaatttagcgagtctgatgcataataaatttacgacatgtatgtgaaatgcttgcatgttagtgtaccaagaaatatgtagcaaggcttttagtaggttgtatcatgcataaataacaaactagaaatatgatttgtattctgttgatctgttttcggtggaatatgatttgtattcggttgatttgtatc

SEQ ID NO: 3110 - DNA, 2131 bp, Saccharum officinarum
ggactgctggcgtggagtggacgagtggtgttgcccacgacgcaggctccttttcatcaggtccggagggagagaggggctgaggcctgaggggagagagagcaagggggagcagagaccagagagagacagattgaggccccaagatgaggagctccgtgtctgagcgcagcctcatcatcgagagcgacgacgacgacgacgagcgtccccaaacccagccatccgccgccgcccgcagcacaagacgtcaccgccacgaggacgaggagcgctccggctccggctcaggctccgactccgattccggctcctcctcctcgtcctgcgccaccccgcgcggtccggccaccgcctcctcctacacccagcaatggccacagagctacaggcaatctatcaacattcttagtagcgtgcagtcaccaaatctgagcttcttggggaccccaactctaagcagattatccaactctttcatcaccaattcttttcggggtaaaacccctgaaatcatctctaatcttgttaagccacttcttcaccccactacaagtgatgaccttcagcagcagcagcatgaagaaagaaagagttcacagtaccttctgccttcgagaaaaccgtctttgcaacagattcctgaggatcaaaagccagtgccagttgctcatgaggtctctccttatcataaatgctcttacacccaggcagttgtgaatggaataaaaggtctatgtggtgtgggaatcctatcaacgccttatgccatcaaacaagggggctggcttggactggtgatactctgtttatttgcaattctagcatggtatactggtgtgctcctgcgccgttgcctggacagcaaggagggccttgagacatacccagatattggccatgccgccttcggaaccaccggtcgtattgccatctcgataatcctgtatgtggaactatatgcctgttgcatcgagtatctgatattggaaggtgacaatttatcaaaattattccccaatgcacacctgaccattgggagcttgacagtgaactcccatgtacttttcgcaatcttgactaccatcatagtcatgccgaccacttggctccgtgaccttagctgcctgagctacctttcagctggaggtgtcattgcatcaatccttggagtcttctgcctattctgggtaggtgttattgataatgttggctttgagaacaaaagaactgcactgaacctccctggaatccctattgcaattggattgtatggttattgctactcagggcatggggtgtttccaaacatctactcttctctgaagaatcgtaatcagttcccttcaatcctttttacttgcattgggctgtctaccattttatttgctggtgcagcggtgatgggatacaaaatgtttggtgaagccacacagtctcagttcacactgaacttaccagagaatttagtggtttcaaagattgcagtttggaccacggtggcaaatccaataaccaaatatgcattaaccataaccccactggctatgagtttggaggagttgctgccaccaaatcaacagaagtactcaaacatagtgatgcttagatcagccttggtggtgtcaaccctcctcattgctctatctgtacccttctttggacttgtgatggccttggttggttctttactcacgatgcttgtgacctatattctaccttgtgcgtgctttttagcaatcctgaggagaaaagtgagctggcaccaggtagcagcgtgctcgttcatcatcgtggtcggggtttgctgcgcgtgtgtggggacatactcatctctgtcaaagataatccagaactacacatgagcgcacatgatacagctgttcctgcaatccaaatttagttactcctacatatatttatacagtaaccgaaccaccccattactcaagtgctctgagccatacaagacaaaaaattttgcccaacaaattagtcaagttgatgtataataaatttgtgtgatgtcaatgcttgcatgttaatggatcaacacaaataagtttgtagcaaggatttgaggttgtatcatgcatatatataacaagacattatttgtgaattgtcacac

SEQ ID NO: 3111 - DNA, 2718 bp, Sorghum bicolor
ctcggagctggactgctggcgtggagtggacgagtggtgttgtccacgcaggcgcagaagcaggctcctttttcatcaggtccggagggactaggaggggcagggactgagagagagagagagagagagagagagagagagagcagccgtggagtggagtggagtggagcagactgattgagcccccaagatgaggagctccgtgtctgagcgcagcctcatcatcgagagcgacgacgacgacaacgacgaccgtccccaatcccagccatccgccgccgccgcccgcagcagaagacgccaccaccaacacgaggagggctccggctccggctccggctcaggatccgactccgattccggctcctcctcgtcgtcctgcgccaccccgcgtggtcacgctcaggccaccgcctcctcctacacccagcaatggccacagagctacaggcaatccatcaacattcttagtagcgtgcagtcaccaaatctgagcttcttggggaccccaactctaagcagattatccaactctttcatcaccaattcttttcggggtaaaacccctgaaatcatctctaatcttgttaagccacttcttcgccccactacaagtgatgaccttcagcagcagcatgaagaaagaaagagttcacagtaccttctgccttcgagaaaaccgtctttgcaacagattcctgaggatcaaaagccagtgccagttgctcatgaggtctctccctatcataaatgctcttacactcaggcggttgtgaacgggataaatgttctatgtggtgtgggaatcctatcaacgccttatgccatcaaacaagggggctggcttggactggtgatactctgtttatttgcaattctagcatggtatactggtgtgctcctgcgccgttgcctggacagcaaggagggccttgagacatacccagatattggccatgccgccttcgggaccaccggtcgtatagccatttcgataatcctgtatgtggaactatatgcctgttgcatcgagtatctgatattggaaggtgacaatttatcaaaattattccccaatgcacacctgaccatcgggagcttgacagtgaactcccatgtacttttcgcaatcttgactaccatcatagtcatgccgaccacttggctacgtgaccttagctgcctgagctacctttcagctggaggtgtcattgcatcaatccttggagtcatctgcctattctgggtaggtgttgttgataatgttgactttgagaacaaaggaactgcgctgaacctccctggaatccctattgcaattggattgtatggttattgctactcagggcatggggtgtttccaaacatctactcttctttgaagaaccgtaatcagttcccttcaatcctttttacttgcattgggctgtctaccattttatttgctggtgctgcggtgatgggatacaaaatgtttggtgaagccacacagtctcagttcacactgaacttaccagagaatttagtggtttcaaagattgcagtttggaccacggtggcaaatccaataaccaaatatgcattaaccataaccccactggctatgagtttggaagagttgctgccaccaaatcaacagaagtactcaaacatagtcatgcttagatcagccttggtggtgtcaaccctcctcattgctctatctgtacccttctttggacttgtgatggccttggttggttctttactcacgatgcttgtgacctatattctaccttgtgcgtgctttttagcaatcctgaggagaaaagtgagctggcaccaggtagcagcgtgctcattcatcatcatggtcggggtttgctgtgcatgtgtggggacatactcatctctgtcaaagataatccagaactacacatgagcgcacatgatatatacagctgttcctgcaaatccaaatttagttactcctacatatacagtaaccgaaccaccccattactcatgtgctcacactatgagccatacaagacaaaaattttgcccagcaaattagtcaagttgatgtaatgccagcatattagttaagtttatgtataataaatttgtgtgatgtcaatgcttgcatgttaatggatcaacacaaataagtctgtagcaaggatttaaggttgtatcatgcatatatgtaacaagacattatttgtgaacacaagatcaggtggattttgtgctatcattttttgtgaaccgactgccctgcgcctgtgtctgcctgcctaccttggatggtgccagcccaatccgttgaaagggtcacataggaagggagagaaggggaacctgctacagtgctgcccttgcattgggagaagccgcaacagcggagttttttgagcggctgagaaggtttgcgaagaagacgtcctgggagtttttcagttcgagacgggtggatgctgtttgctgtccactggtagacttttttttttcctttttttgttcaacatttcacggcagaagggagtggagtctggagtccatctggccattggtactttattttcttctttttttattaagcaactccaagccaatgatttgattgacagtgaggtaatggctgatggtaaattggattagggacctactatgttgtgctttagtattacctttgtgatgacgaaatttaaatgccataagaagtattataggatt

SEQ ID NO: 3112 - DNA, 2829 bp, Sorghum bicolor
agctcggagctggactgctggcgtggagtggacgagtggtgttgtccacgcaggcgcagaagcaggctcctttttcatcaggtccggagggactaggaggggcagggactgagagagagagagagagagagagagagagagagagcagccgtggagtggagtggagtggagcagactgattgagcccccaagatgaggagctccgtgtctgagcgcagcctcatcatcgagagcgacgacgacgacaacgacgaccgtccccaatcccagccatccgccgccgccgcccgcagcagaagacgccaccaccaacacgaggagggctccggctccggctccggctcaggatccgactccgattccggctcctcctcgtcgtcctgcgccaccccgcgtggtcacgctcaggccaccgcctcctcctacacccagcaatggccacagagctacaggcaatccatcaacattcttagtagcgtgcagtcaccaaatctgagcttcttggggaccccaactctaagcagattatccaactctttcatcaccaattcttttcggggtaaaacccctgaaatcatctctaatcttgttaagccacttcttcgccccactacaagtgatgaccttcagcagcagcatgaagaaagaaagagttcacagtaccttctgccttcgagaaaaccgtctttgcaacagattcctgaggatcaaaagccagtgccagttgctcatgaggtctctccctatcataaatgctcttacactcaggcggttgtgaacgggataaatgttctatgtggtgtgggaatcctatcaacgccttatgccatcaaacaagggggctggcttggactggtgatactctgtttatttgcaattctagcatggtatactggtgtgctcctgcgccgttgcctggacagcaaggagggccttgagacatacccagatattggccatgccgccttcgggaccaccggtcgtatagccatttcgataatcctgtatgtggaactatatgcctgttgcatcgagtatctgatattggaaggtgacaatttatcaaaattattccccaatgcacacctgaccatcgggagcttgacagtgaactcccatgtacttttcgcaatcttgactaccatcatagtcatgccgaccacttggctacgtgaccttagctgcctgagctacctttcagctggaggtgtcattgcatcaatccttggagtcatctgcctattctgggtaggtgttgttgataatgttgactttgagaacaaaggaactgcgctgaacctccctggaatccctattgcaattggattgtatggttattgctactcagggcatggggtgtttccaaacatctactcttctttgaagaaccgtaatcagttcccttcaatcctttttacttgcattgggctgtctaccattttatttgctggtgctgcggtgatgggatacaaaatgtttggtgaagccacacagtctcagttcacactgaacttaccagagaatttagtggtttcaaagattgcagtttggaccacggtggcaaatccaataaccaaatatgcattaaccataaccccactggctatgagtttggaagagttgctgccaccaaatcaacagaagtactcaaacatagtcatgcttagatcagccttggtggtgtcaaccctcctcattgctctatctgtacccttctttggacttgtgatggccttggttggttctttactcacgatgcttgtgacctatattctaccttgtgcgtgctttttagcaatcctgaggagaaaagtgagctggcaccaggtagcagcgtgctcattcatcatcatggtcggggtttgctgtgcatgtgtggggacatactcatctctgtcaaagataatccagaactacacatgagcgcacatgatatatacagctgttcctgcaaatccaaatttagttactcctacatatacagtaaccgaaccaccccattactcatgtgctcacactatgagccatacaagacaaaaattttgcccagcaaattagtcaagttgatgtaatgccagcatattagttaagtttatgtataataaatttgtgtgatgtcaatgcttgcatgttaatggatcaacacaaataagtctgtagcaaggatttaaggttgtatcatgcatatatgtaacaagacattatttgtgaacacaagatcaggtggattttgtgctatcattttttgtgaaccgactgccctgcgcctgtgtctgcctgcctaccttggatggtgccagcccaatccgttgaaagggtcacataggaagggagagaaggggaacctgctacagtgctgcccttgcattgggagaagccgcaacagcggagttttttgagcggctgagaaggtttgcgaagaagacgtcctgggagtttttcagttcgagacgggtggatgctgtttgctgtccactggtagacttttttttttcctttttttgttcaacatttcacggcagaagggagtggagtctggagtccatctggccattggtactttattttcttctttttttattaagcaactccaagccaatgatttgattgacagtgaggtaatggctgatggtaaattggattagggacctactatgttgtgctttagtattacctttgtgatgacgaaatttaaatgccataagaagtattataggatttgataagagtatctttttcgcttttttgcagcagccacctgtatttctcgaagctcacagattatacatatacccataggaagaattttgtcaccaatcattcacaaat

SEQ ID NO: 3113 - DNA, 2138 bp, Brachypodium distachyon
atctcactgctttcagttgagttgtttctgtcttctcttctgttgccggcgcctgcgaggagacggacggaaggaagatgaagagcttgctgtcggaggaaagcaccttcatcatcgagagcgacgacgacgaggaggatcccgccggcctccaggacgccggcctcaacgaagacggcaacggcgacggcgacggctcctcctccgactcctcgtcctgcgccacccctcgctgcgacagccgcccgggctcctacacccagcaatggccgcagagctacaggcaatcaattgacatttatagtagcgtgcagtcgcccaatctgagttttttggggaccccaactctaagcagactgtccaactctttcctcacaaactcttttcgaggcaaaacccctgaaatcatctctaatcttgtcaagccacttctgcgcccaactacaagtgatgagcaacagcaaccacaacaacaacagcagcagcatgaagatatccgtaagagttctcagtaccttctgccatcaagaaaaccatccctgcaacagatccctgaggatcaaaagccactcgtggttggtcatgaggtttctccctatcaacaatgctcttacacccagggagcgatgaatggaataaatgttctatgtggtgttggaatcctatcaacaccttatgccattaagcaagggggctggctcggactggttatacttgttttatttgctttgctcgcatggtacactggtgtactactacgccgttgcctagacagcaaggagggccttcagacatacccggacattggtcatgctgcctttggcaccactggtcgtatagcgatctcggtaatcctgtacatcgaactctatgcctgttgcatcgagtacttgatattggaaagcgacaatttatcaaagttatttcccaatgtacacctaaccattgggagcttgacactaaactcacatgtattctttgcaatcttgaccaccatcattgtcatgccaactacttggctccgtgaccttacctgtctgagctatatttcagttggaggtgtcattgcatcgatccttgttgtgatctgcctattctggattggggttgttgatcatgtcggctttgagaacaaaggggctacgttaaacctcccaggaattcctattgcaattggattgtatggttattgttattcagggcatggggtgttcccaaacatctattcttctctgaagaatcgaaaccagttcccttccattcttttcacttgcattgcgttctctaccattttgtttgctgccgctgctgtgatgggatataaaatgtttggtgaatccacagagtctcagttcacactcaacttgccagagaatctgctggtttccaagattgccgtttgggctacggtggcaaatccaataaccaaatatgcgttaactataaccccactggctatgagtttggaggagttgctgccgcgaagtcagcagaagtactcaaacataatcatgctaagatcagcgctggtcgcctcaaccctgcttattgctctgtcggttcccttctttgcacttgtaatgtctctgattggttcactactcgccatgcttgtgacctacattctaccttgtgcctgctttttggccatccttaagacaaaagtgacttggtatcagattacagcttgctcattcatcatcatcgtaggggtttcttgcgcctgcgtggggacatactcatcactctccgggattatccagaactacacctaggtccttttcctacctgtcctgcatacataatagagattgttgggtcgactgcattattattgtacatgtaattaagcttatgtatcagcaaagcatatcaattttgcctagaaattcagtcaaacacatggatgaatggtgtaatggaatttgtgttattgttaaatttgtagcaacttgatgcttgcatgatatgatcggatggatctgatggtgagtattaattcagttctgaacttgaattcctccctcaatccgatattgttctgcaatgtagtagcagtatatttatgtatgacacatgtatgaatggttgaactgaactacaaattgtcgcgaaaaaagcagtatatttattcgtcc

SEQ ID NO: 3114 - DNA, 1952 bp, Brachypodium distachyon
atgaagagcttgctgtcggaggaaagcaccttcatcatcgagagcgacgacgacgaggaggatcccgccggcctccaggacgccggcctcaacgaagacggcaacggcgacggcgacggctcctcctccgactcctcgtcctgcgccacccctcgctgcgacagccgcccgggctcctacacccagcaatggccgcagagctacaggcaatcaattgacatttatagtagcgtgcagtcgcccaatctgagttttttggggaccccaactctaagcagactgtccaactctttcctcacaaactcttttcgaggcaaaacccctgaaatcatctctaatcttgtcaagccacttctgcgcccaactacaagtgatgagcaacagcaaccacaacaacaacagcagcagcatgaagatatccgtaagagttctcagtaccttctgccatcaagaaaaccatccctgcaacagatccctgaggatcaaaagccactcgtggttggtcatgaggtttctccctatcaacaatgctcttacacccagggagcgatgaatggaataaatgttctatgtggtgttggaatcctatcaacaccttatgccattaagcaagggggctggctcggactggttatacttgttttatttgctttgctcgcatggtacactggtgtactactacgccgttgcctagacagcaaggagggccttcagacatacccggacattggtcatgctgcctttggcaccactggtcgtatagcgatctcggtaatcctgtacatcgaactctatgcctgttgcatcgagtacttgatattggaaagcgacaatttatcaaagttatttcccaatgtacacctaaccattgggagcttgacactaaactcacatgtattctttgcaatcttgaccaccatcattgtcatgccaactacttggctccgtgaccttacctgtctgagctatatttcagttggaggtgtcattgcatcgatccttgttgtgatctgcctattctggattggggttgttgatcatgtcggctttgagaacaaaggggctacgttaaacctcccaggaattcctattgcaattggattgtatggttattgttattcagggcatggggtgttcccaaacatctattcttctctgaagaatcgaaaccagttcccttccattcttttcacttgcattgcgttctctaccattttgtttgctgccgctgctgtgatgggatataaaatgtttggtgaatccacagagtctcagttcacactcaacttgccagagaatctgctggtttccaagattgccgtttgggctacggtggcaaatccaataaccaaatatgcgttaactataaccccactggctatgagtttggaggagttgctgccgcgaagtcagcagaagtactcaaacataatcatgctaagatcagcgctggtcgcctcaaccctgcttattgctctgtcggttcccttctttgcacttgtaatgtctctgattggttcactactcgccatgcttgtgacctacattctaccttgtgcctgctttttggccatccttaagacaaaagtgacttggtatcagattacagcttgctcattcatcatcatcgtaggggtttcttgcgcctgcgtggggacatactcatcactctccgggattatccagaactacacctaggtccttttcctacctgtcctgcatacataatagagattgttgggtcgactgcattattattgtacatgtaattaagcttatgtatcagcaaagcatatcaattttgcctagaaattcagtcaaacacatggatgaatggtgtaatggaatttgtgttattgttaaatttgtagcaacttgatgcttgcatgatatgatcggatggatctgatggtgagtattaattcagttctgaacttgaattcctccctcaa

SEQ ID NO: 3115 - DNA, 1357 bp, Zea mays
cacccctcctccccccgagtatattagtttactcgctgcctgtgttccaaaacctttcgtcttttcccccgtctacaaaggcttgacaggcactcgcagccccaggcagagagactccttccctgcgaaggcttctcctctcccctatcccccccccccccccccccccccaactcgtcgcattctcctcggttcagcagcgacgggatggcgatagaccacgcggcgcgtctcggactgacgagcagaggtgccacgggaggcggcgggtgcggagacgacgtcgacgccgagaaccggcggtggccgccgtggctgaagccgctgctgtgcacgagcttcttcgtccaatgcaggatccacgccgacgcgcacaagagcgagtgcaacatgtactgcctcgactgcatggacggcgcgctctgctccctctgcctcgcgcgccaccgcgaccaccactccatccagatacggaggtcgtcgtaccacgacgtgatccgggtgtcggagatacacaaggtgctggacatcgccggcgtgcagacgtacatcatcaacagcgcgcgcgtggtgttcctcaacgagcgcccgcagcctcgcccgggcaagggcgtcaccaacacctgcgaggtctgcgagcgcagcctcctcgactgcttccgcttctgctccctcgggtgcaagatagtgggcacggcgcgtggttaccgtcccaagaagaagcacggcggcggaggcggcggcggtaacaagaggaagagagcggcgcttaaggacgtgcgctctgactcggaggagtcgtgcaccagcaccagcggcgccagcagcgacaagagcagcgtcgtgcagagcttctcgccgtcgaccccgccgccggcctccgctagctaccgccgcccagggaacaagcgccggaagggcgtcccgcaccggtcgcccttcggtagcctcatcgtcgagttctaggactccttcgtcagcgcctaggcaatgcgctctctactgtacaggacatgacaaagcccggaagggaagggaataacaggacgcgcttctggacgtggaggccggccggcggcgcaaatgccagcgacgggcgagagcggtaagcacacaccagcggtgcagcccgtgctgctatagttttgcttctttttcgcgctttgttacttcagttggtactaagttttgcagccttgtacattgtaatatactagtactactctccaatgctagatgtacatatacatacacagtgttggcagtatcataatgtgggggtagcagtataggcagcgaggtgtgttcgtatgcgcatcatcagctgtgtaataaaaataaagaaatgcttgctcca

SEQ ID NO: 3116 - DNA, 1347 bp, Hordeum vulgare
acgcgccgagtcttcctcctcccattctttttttacttggcacaagccacaggtgctgcactacttttcctcggtctacaaagccttcgcgcccctgcgccggcgaactgctttcttgcacagcatttcttccctcccctgccatcttgcatccacattcctctcctttcgccggccgaagatggcaatagaccacgcatcccctctcgcgctcaagagcggcggcgccacgggaggagcggagtgcgacgaggaggcggggaaccagcggtggccgccgtggctgaagccgctgctggcgacgagcttcttcgtgcaatgccgggtgcacgccgacgcgcacaagagcgagtgcaacatgtactgcctcgactgcatcggcggcgcgctctgctcgctctgcctcgcccaccaccgcgaccaccacgccatccagatacggaggtcgtcgtaccacgacgtgatccgggtgtcggagatacagagggtgctggacatcaccggcgtgcagacgtacatcatcaacagcgcgcgcgtggtgttcctcaacgagcgcccgcagccgaggccgggcaagggagtcaccaacacctgcgacgtctgcgagcgcagcctcctcgactcgttccgcttctgctccctcggatgtaaaattgtaggcacgtccggcggccaccggccgaggaagaaacacggcggcgtcggcggcggcggcaagaagaagaagagagcggcgctcaaggacgcgcggtcggactcggagcactcgtgcacgagcacaagcggcggcagcagcgacaagagcagcgtggtgcagagcttctcgccgtcgaccccgccggccacctccagcagctaccgcgccggaaacaagcgccgcaagggcatcccgcaccggtcgccgttcggcagcctcatcgtggagctctaggacggcacacagagccaagcgcatgtctggcctgatcaacgctctagcctactgtatacgtgacatagccaagaaggtaatagctgcgcgccctgaacggcgatgagccgccgtcgaggggcacacactaatactatagcgtggtacttccagtttcgagttttagctagttaccactggtaaaaccctagtgtcagactgtaaagtaacttgcaactccatgacgacgaccaagttttgcaatatacagtatactgtagtgtactccatgcgactatgaccatatggttatcgcactagatcgtaaatgtgcatagatgacagataaatgtaccagtagtatgtggagcaggagggcagtgtggtgttcatgtactgcacgagccatgtaatgaaaataagaacgctgctcagca

SEQ ID NO: 3117 - DNA, 1355 bp, Hordeum vulgare
acgcgccgagtcttcctcctcccattctttttttacttggcacaagccacaggtgctgcactacttttcctcggtctacaaagccttcgcgctcctgcgccggcgaactgctttcttgcacagcatttcttccctcccctgccatcttgcatccacattcctctcctttcgccggccgaagatggcaatagaccacgcatcccctctcgcgctcaagagcggcggcgccacgggaggagcggagtgcgacgaggaggcggggaaccagcggtggccgccgtggctgaagccgctgctggcgacgagcttcttcgtgcaatgccgggtgcacgccgacgcgcacaagagcgagtgcaacatgtactgcctcgactgcatcggcggcgcgctctgctcgctctgcctcgcccaccaccgcgaccaccacgccatccagatacggaggtcgtcgtaccacgacgtgatccgggtgtcggagatacagagggtgctggacatcaccggcgtgcagacgtacatcatcaacagcgcgcgcgtggtgttcctcaacgagcgcccgcagccgaggccgggcaagggagtcaccaacacctgcgacgtctgcgagcgcagcctcctcgactcgttccgcttctgctccctcggatgtaaaattgtaggcacgtccggcggccaccggccgaggaagaaacacggcggcgtcggcggcggcggcaagaagaagaagagagcggcgctcaaggacgcgcggtcggactcggagcactcgtgcacgagcacaagcggcggcagcagcgacaagagcagcgtggtgcagagcttctcgccgtcgaccccgccggccacctccagcagctaccgcgccggaaacaagcgccgcaagggcatcccgcaccggtcgccgttcggcagcctcatcgtggagctctaggacggcacacagagccaagcgcatgtctggcctgatcaacgctctagcctactgtatacgtgacatagccaagaaggtaatagctgcgcgccctgaacggcgatgagccgccgtcgaggggcacacactaatactatagcgtggtacttccagtttcgagttttagctagttaccactggtaaaaccctagtgtcagactgtaaagtaacttgcaactccatgacgacgaccaagttttgcaatatacagtatactgtagtgtactccatgcgactatgaccatatggttatcgcactagatcgtaaatgtgcatagatgacagataaatgtaccagtagtatgtggagcaggagggcagtgtggtgttcatgtactgcacgagccatgtaatgaaaataagaacgctgctcagcatggccatg

SEQ ID NO: 3118 - DNA, 1563 bp, Sorghum bicolor
gccttgagcgacaaacagcccggatgcgcaccgaggcgataagaacgaaccagagctctctatcaagcgccagcatcaagcaccacccccaagtctcccctcctctagtattttagttggcccgatgcctgtgttccaaaacctttcttcgtcttttcccccgtctacaaagacttgacactcgcagccgcagccgccggcagactccttccccgcgaaggcttctcctctcctctcccctctcccttccactcgcacgcattctcctcggttccgcggcgacgagatggcaatagatcacgcgacgcctctcggactcaagagcagaggcgccatgggaggcggtgagtgcgactacgacgacgccgagaaccagcggtggccgccgtggctgaagccgctgctgtccacgagcttcttcgtccaatgcaggatccacgcggacgcgcacaagagcgagtgcaacatgtactgcctcgactgcatgaacggcgcgctctgctccctctgcctagcgcaccatcgcgaccaccactccatccagatacggaggtcctcctaccacgacgtgatccgggtgtcggagatacagaaggtgctggacatcgccggcgtgcagacgtacatcatcaacagcgcgcgcgtggtgttcctcaacgagcggccgcagccacgcccgggcaagggcgtcaccaacacctgcgaggtctgcgagcgcagcctcctcgactgcttccgcttctgctccctcggctgcaagatagtgggcacagcccgtggctaccgtcccaagaagaagcacggcatcggcggcggcggtcacaagaagaagagggcggcgcttaaggtcaaggacgtgcgctctgactcggaggattcgtgcaccagcaccagcggcgccagcagcgacaagagcagcgtggtgcagagcttctcgccgtcgaccccgccgccgacgtctgccagccaccgccgcccagggaacaagcgccggaagggcgtcccgcaccggtcgcccttcggcagcctcatcgtcgagttctgaggactctctgtgtcagcgcctaggcaatgcaactctgtactctgcgtagtactgcatgacatagcccagaagagaagggaataacagccggcggcgcaaatgccagcgaagggccgagagcggtaagaacacaccagtggtgcttctatagtttgcttctttcttacagttacagttgctagtcactagcagtgctaccagtaagatagctgctacttacagcctccgtaaccgcgactaagttttgcagccttgtacattgtaatactcctatactatagaccagcactctccaaagttagatgtatatatacatatatatacttttgtagtatcagaatgtatgggttagcagtaggcagcgaggtgttcgtcagttcgtgtgtgtgcatcatcagctgtgtaataaaaataagaaatgctgctctaaatcatgccggaattggctgctgctggactgctgctattgcaggataagattggcacatcattcagtgcagtgtccgtttccggtgtcc

SEQ ID NO: 3119 - DNA, 1685 bp, Sorghum bicolor
catcatcatattcaatcattcatatgttacacatgtactgtaccacgcttatcgggtgggttctcaggccttgagcgacaaacagcccggatgcgcaccgaggcgataagaacgaaccagagctctctatcaagcgccagcatcaagcaccacccccaagtctcccctcctctagtattttagttggcccgatgcctgtgttccaaaacctttcttcgtcttttcccccgtctacaaagacttgacactcgcagccgcagccgccggcagactccttccccgcgaaggcttctcctctcctctcccctctcccttccactcgcacgcattctcctcggttccgcggcgacgagatggcaatagatcacgcgacgcctctcggactcaagagcagaggcgccatgggaggcggtgagtgcgactacgacgacgccgagaaccagcggtggccgccgtggctgaagccgctgctgtccacgagcttcttcgtccaatgcaggatccacgcggacgcgcacaagagcgagtgcaacatgtactgcctcgactgcatgaacggcgcgctctgctccctctgcctagcgcaccatcgcgaccaccactccatccagatacggaggtcctcctaccacgacgtgatccgggtgtcggagatacagaaggtgctggacatcgccggcgtgcagacgtacatcatcaacagcgcgcgcgtggtgttcctcaacgagcggccgcagccacgcccgggcaagggcgtcaccaacacctgcgaggtctgcgagcgcagcctcctcgactgcttccgcttctgctccctcggctgcaagatagtgggcacagcccgtggctaccgtcccaagaagaagcacggcatcggcggcggcggtcacaagaagaagagggcggcgcttaaggtcaaggacgtgcgctctgactcggaggattcgtgcaccagcaccagcggcgccagcagcgacaagagcagcgtggtgcagagcttctcgccgtcgaccccgccgccgacgtctgccagccaccgccgcccagggaacaagcgccggaagggcgtcccgcaccggtcgcccttcggcagcctcatcgtcgagttctgaggactctctgtgtcagcgcctaggcaatgcaactctgtactctgcgtagtactgcatgacatagcccagaagagaagggaataacagccggcggcgcaaatgccagcgaagggccgagagcggtaagaacacaccagtggtgcttctatagtttgcttctttcttacagttacagttgctagtcactagcagtgctaccagtaagatagctgctacttacagcctccgtaaccgcgactaagttttgcagccttgtacattgtaatactcctatactatagaccagcactctccaaagttagatgtatatatacatatatatacttttgtagtatcagaatgtatgggttagcagtaggcagcgaggtgttcgtcagttcgtgtgtgtgcatcatcagctgtgtaataaaaataagaaatgctgctctaaatcatgccggaattggctgctgctggactgctgctattgcaggataagattggcacatcattcagtgcagtgtccgtttccggtgtcctcgcctagcagcagcacctgacatcctgtggtgaacccccaatccagatgccgcc

SEQ ID NO: 3120 - DNA, 1379 bp, Triticum aestivum
gctacttttcctccacctcggcctacaaagccttcgcgctcctgtgccggcgagccgctttcttgcaaagcatttcttccctcccctgctctcccgcatccacattcttccttctcgtttccccggcgcaagatggcaatagaccacgcgtcccctctcgcgctcaagagcggcggcgccacgggaggagcggggtgcgaggacgaggaggcggagaaccagcggtggccgccgtggctgaagccgctgctggcgacgagcttcttcgtgcaatgccgggcgcacgccgacgcgcacaagagcgagtgcaacatgtactgcctcgactgcgtcaacggcgcgctctgctcgctctgcctcgcccaccaccgcgaccaccacgccatccagattcggaggtcgtcgtaccacgacgtgatccgggcgtcggagatacagagggtgctggacatcaccggcgtgcagacgtacatcatcaacagcgcgcgcgtggtgttcctcaacgagcgcccgcagccgaggccgggcaagggggtcaccaacacctgcgaggtctgcgagcgcagcctcctcgactcgttccgcttctgctccctcggatgcaaaatcgtaggcacgtccggcggccaccggccgaggaagaagcacggcggcaagaagaagaagagagcggcggtcaaggacgcgcggtcggactcggagcactcgtgcacgagcaccagcggcggcagcagcgacaagagcagcgtggtgcagagcttctcgccgtcgaccccgccggccacctccagcagctaccgcgccggcaacaagcgccgcaagggcatcccgcaccggtcgccgttcggcagcctcatcgtggagtactaggacagcacacatgccatgcctgccctgatcaacactctagcgtactgtacacgtgacatagccaagaaggtaatggctgcgcgccctgaacggcgagccccgtgccgccgtcgaggggcacgagcagcgagcacatactatagcgtgtgactttcagtttgttgcagactcttcagttatagctagttaccaccggtaaaacagtagcgttagactgtaagtaacttgcaactccatgacgacgactaagttttgcaatatactgtagtaaactccttgcccccatatggttacggcactagatcgtaaatgtgcatagatgatagataaatgtatcaccgtagggaaccgtagtgtgtggagcaggaggccagcgtggtgttcatgtgtgtgcgcggcacgggccatgtacagtaataaaaagtacttaaattgctccatgcacgacacaagtggccgatctatgcacgacacgtaaatccagcggccgacgcccttctcaatcaacg

SEQ ID NO: 3121 - DNA, 1311 bp, Triticum aestivum
gctacttttcctccacctcggcctacaaagcctccgcgctcctgcgccggcgagccgctttcttgcaaagcattttctttcctcccctgctctcccgcatccacattcttccttctcgtttcgccggcgcaggatggcaatagaccacgcgtcccctctcgcgctcaagagcggcggcgccacggggaggagcggggtgcgaggacgaggaggcggagaaccagcggtggccgccgtggctgaagccgctgctggcgacgagcttcttcgtgcaatgccgggcgcacgccgacgcgcacaagagcgagtgcaacatgtactgcctcgactgcatcaacggcgcgctctgctcgctctgcctcgcccaccaccgcgaccaccacgccatccagattcggaggtcgtcgtaccacgacgtgatccgggtgtcggagatacagagggtgctggacatcaccggcgtgcagacgtacatcatcaacagcgcgcgcgtggtgttcctcaacgagcgcccgcagccgaggccgggcaagggggtcaccaacacctgcgaggtctgcgagcgcagcctcctcgactcgttccgcttctgctccctcggatgcaaaatcgtaggcacgtccggcgggcaccggccgaggaagaagcacggcggcgtgggcggcggtggcaagaagaagagagcggcggtcaaggacgcgcggtcggactcggagcactcgtgcacgagcaccagcggcggcagcagcgacaggagcagcgtggtgcagagcttctcgccgtcgaccccgccggccacctccagcagctaccgcgccggcaacaagcgccgcaagggcatcccgcaccggtcgccgttcggcagcctcatcgtggagtactaggacagcgcacatgccatgcctgccctgatcaacactctagcgtactgtacacgtgacatagccaagaaggtaatggctgcgcgccgtgaacggcgagccccgtgccgccgtcgaggggcacgagcagtgagcacatactatagcgtgtgactttcagtttgttgcagactcttcagttatagctagttaccaccggtaaaaccgtagcgtccgttatactgtaagtaacttgcagctccatgacgacgactaagttttgcaatatcactgtagtaaactccatgcccatatggttatgaggcttatggcactaagtagatcgtaaatgtgcccatagatgatagataaatgtatcacgtagtgtgtggagcaggaggccagtgcggtggtgttcatgtacgtgcacgggccatgtaataaaaataag

SEQ ID NO: 3122 - DNA, 735 bp, Pennisetum glaucum
cgcgaaggcttcgtctccctctccttctttctctcttccactcgcattcgaccgcctcggttcgccggcgacgagatgggcgccatcgatcacgcgacccctctgggactgaagggcagatacgccatgggcgggggcgagtgcgacgacgacgcggagaaccagcggtggccgccgtggctgaagccgctgctgtccacgagcttcttcgtccaatgcagggtccacgccgacgcgcacaagagcgagtgcaacatgtactgcctcgactgcatgaacggcgcgctctgctccctctgcctcgcgcaccaccgcgaccaccacgccatccagattcggaggtcgtcctaccacgacgtgatccgggtgtcggagatacagaaggtgctggacatcaccggcgtgcagacgtacatcatcaacagcgcgcgcgtggtgttcctcaacgagcgcccgcagccccgccccggcaagggcgtcaccaacacctgcgacgtctgcgaacgcagcctcctcgactgcttccgcttctgctccctcggatgcaagattgtgggaacggcccgaggataccgccccaccaagaagaagcacggcggcggaggcggcggcgatagcaagaagaagaggagggcggcgctcaaggacgtgcggtgcgactccgaggactcgtgcaccggcagcagcggcggcagcagcgacaagagcagcgtcgtgcagagcttctcgccgtcg

SEQ ID NO: 3123 - DNA, 1586 bp, Oryza sativa
ccccgagtcttcctccgattagtttacttaaccccggtgtttgcagatacttttcgtcttttgccccccttggtctacaaaagacttcacactacatacattcagaagtgctttctttcgcttcgagcctcttcctctcttttctctcgtctcttccatccacattcttctctctctctcgattgcttcgcactgggaatggcgatagaccatgcgtcccctttctcgctgaagaacagaggcgacatgggaggaagggggtatgaggaggaagaggtggagaaccagcggtggccgccgtggctgaagccgctgctgtcgacgagcttcttcgtgcaatgcaggatccacgccgacgcgcacaagagcgagtgcaacatgtactgcctcgactgcatgaacggcgcgctctgctccctctgcctctcccaccaccgcgaccaccacgccatccagatacggaggtcgtcgtaccacgacgtgatccgggtgtcggagatacagaaggtgctggacatcaccggcgtgcagacgtacatcatcaacagcgcccgcgtggtgttcctcaacgagcgcccccagccgaggcccggcaagggcgtcaccaacacctgcgaggtctgcgagcgcagcctcctcgactccttccgcttctgctccctcggatgcaagattgtgggtacgtccggtggataccgcccaaggaagaagcacggcgggtgcggcggcggcggcggcggcggcgacggtggcaagaagaagaagaagagggcggcgctcaaggacgcgcggtacgagtccgaggactcgtgcacgagcaccagcggcggcagcagcgacaagagcagcgtcgtgcagagcttcacgccgttgaccccgccgccgacctccgccagctaccgcaccggcaacaagcgccgcaagggcgtcccgcaccggtcccccttcggcagcctcatcgtcgagttctagggagtctcgacgcgtccgcgcctgatcaacatagtgtactgtacacatgacatagccaaacacaataaccgtgtgccccggaatggcggcgagcccggcgcttcccttcccggaggccggccggcgtaatgccggagaagggcaagagcagtaagccacgtcacatacatattatagcttgtttgttacttttcagcttcggtttttagttacagttcagttactcctagttagtacccagtcaagtccaagcactgctgggtgcttacgactcggtaacggcaactaagttttgcaaccgtgtaaaaatatagtagcagtagtagtaacctccatattgtagatgtacagagctgtggtggggtaggagacagtcacacagtgggatattcatatgtgcattatattacccatgtaataaaaaaaaaagagttgctgctccaaattaccccggaatcgccacgggtttttggttggatcgcttccaatgctgcattcggtcgagtgactcatcgatcactaattcactcgcagagcggtgtgtctttgacattctgcaggtgtaccccagcacagacgcggcatgaagaggctgctcgccgtggccgctgctg

SEQ ID NO: 3124 - DNA, 1451 bp, Zea mays
gtgtctccctgactccctccctctagaattttacagtattctactcgctgcctgcgttccaaaacctttcgtcttttcccccgccgtctacaaagacttcacactcgcagccgcaggctgctccggcagactcctacaccgggaagacttctcctctcctctctcctctctcctctctcccttccactcgcgctctcctggataccgcgcgcggcgacgagatggcgatagatcacgcgacccctctcgggctgaagcggagaggcgccatgggcggaggcggcgagtgcgacgacggcagtgatacccggcggtggccgccgtggctgaggccgctgctgtccgcgagcttcttcgtccaatgcagggtccacgccgacgcgcacaagagcgagtgcaacatgtactgcctcgactgcatgggcggcgcgctctgcgcgctctgcctcgccgcgcgccaccgcgaccaccactccatccagatacggaggtcgtcgtaccacgacgtgatccgggtgtcggagatacagaaggtgctggacatcgccggcgtgcagacgtacatcatcaacagcgcgcgcgtggtgttcctgaacgagcggccgcagccccgcccgggcaagggcgtcaccaacacctgcgaggtctgcgagcgcagcctcctcgactgcttccgcttctgctcccttgggtgcaagatagtgggcacggcccgtggctaccgtcctgggaagaagaagcacggcggcggcggcggtaacaagaagagggcgtcgccggcgccggcgcttaaggacgtgcggtctgactcggaggactcgtgcaccagcaccagcggcgccagcagcgacaagagcagcgtcgtgcagagctcccctccgccgccgacctctgccagccaccgcccccccgggaacaagcgccggaagggcgtcccgcaccggtcgcccttgggcagcctcatcgtcgagctctaggactcttcgtcagcgccaaggcaaggcaacgcactctgtagtacatgacatagccccccgaagagaagggaataacaaacagtaagcctctggacgtggagggcgaagggcgacagcggtaagccgtaagatcggacaatccttagttttgcttcttctcaggttttgttttgcttttacagttactagcagtggtaccatcagtaagataaccgcgactaagttttgcagccttgtacattgtaatattattactatagaccatgactctccgatgcttagatgtatatagtaatagtatcagaacgtgggggtagcagtcgatcggcagcgaggtgttcgtcgtatgtgcatcataagctgtatgtaataaaaataagaaacgctgctccagatcctactgttgctcgctgcccccccccccctcacagcattggctgctgctattgctattgatattgcgggacaagatcg

SEQ ID NO: 3125 - DNA, 1574 bp, Brachypodium distachyon
ctatcaaaatgctcgccgagtcttcctcccccccatttgttttcctttaccaccagcgtcgcacgcagtacttttccccggtctacaaagacctcactctcctcccccccgggcgaaactgctttcttccaaagccttctcctttccctcctctctctcgcatccacattgttctcgtttccccggccagggatggcaatagaccacgcatcccctctcgccttcaggtgcagaggcgccatgggaggagcagagtgcgaggacgaggcggaggacaaccagcggtggccgccgtggctgaagccgctgctggcgacaagcttcttcgtgcaatgcagggtccacgccgaagcccacaagagcgagtgcaacatgtactgcctcgactgcatcaacggcgcgctctgctccctctgcctcgcccaccaccgcgaccaccacgccatccagatacggaggtcgtcgtaccacgacgtgatccgggtgtcggagattcagaaggtgctggacatcgccggcgtgcagacgtacatcatcaacagcgcgcgcgtggtgttcctcaacgagcggccgcagccgaggcccggcaagggggtcaccaacacctgcgaggtctgcgaccgcagcctcctagactccttccgcttctgctccctcggatgcaaaattgcaggcacgtccggcggctaccggccgaggaagaagcacggcggcggcgttgagagtaagaagaagaagaagaaaagagcggcggcgctcaaggacgcgcggtcttactcggacggctcgagcagcagcagcagcagcgacaggagcagcgtggtgcagagcttcacgccgtcgaccccgccgcccaccaccagcagcagctaccgcgccggcaataagcgccgcaagggcatcccgcaccggtcgccgttcggcagcctcatcgtcgagttctagcttcagctagaaaaggtcagctctgtagcatactgtatagtagtggtactacatgacatagacaagagggaaataactgcgccgcccagaacaagccctgtgcttccaagcgcagagtggccggccggggtaatgccggagtgcggcatgagctgtaagcacattataccataccgtgttactttcagtttcaagttttagttacagttcagttagttagtagtactccgtcaaatcgtacttcactagtactagctgctttgcaaccttgtatttataccccccatatggtagatgtctcagaaatgtggagcaagtaaggacctgcaggaggtagtgctggggtgttcatatggtgtgcacgagccatgtaataatacaaataagattgctgctcgtagctaattatgcaatcatgtttttggtgttccgatgctgcagagctagctacgcaggacgggattgatctgagaacccccattaatgcggtcgatcgccgccaaggagatgctgggggcgacatggctacaactgatacggtaactcggcgaaattaccgccgccgtcggaagaaactccggctgctcgagtgagcctacctgtgtgcatgtagcagatccgggtggagg

SEQ ID NO: 3126 - DNA, 1166 bp, Brachypodium distachyon
gggatggcaatagaccacgcatcccctctcgccttcaggtgcagaggcgccatgggaggagcagagtgcgaggacgaggcggaggacaaccagcggtggccgccgtggctgaagccgctgctggcgacaagcttcttcgtgcaatgcagggtccacgccgaagcccacaagagcgagtgcaacatgtactgcctcgactgcatcaacggcgcgctctgctccctctgcctcgcccaccaccgcgaccaccacgccatccagatacggaggtcgtcgtaccacgacgtgatccgggtgtcggagattcagaaggtgctggacatcgccggcgtgcagacgtacatcatcaacagcgcgcgcgtggtgttcctcaacgagcggccgcagccgaggcccggcaagggggtcaccaacacctgcgaggtctgcgaccgcagcctcctagactccttccgcttctgctccctcggatgcaaaattgcaggcacgtccggcggctaccggccgaggaagaagcacggcggcggcgttgagagtaagaagaagaagaagaaaagagcggcggcgctcaaggacgcgcggtcttactcggacggctcgagcagcagcagcagcagcgacaggagcagcgtggtgcagagcttcacgccgtcgaccccgccgcccaccaccagcagcagctaccgcgccggcaataagcgccgcaagggcatcccgcaccggtcgccgttcggcagcctcatcgtcgagttctagcttcagctagaaaaggtcagctctgtagcatactgtatagtagtggtactacatgacatagacaagagggaaataactgcgccgcccagaacaagccctgtgcttccaagcgcggaggtcggccggccggggtaatgccggagtgcggcatgagctgtaagcacattataccataccgtgttactttcagtttcaagttttagttacagttcagttagttagtagtactccgtcaaatcgtacttcactagtactagctgctttgcaaccttgtatttataccccccatatggtagatgtctcagaaatgtggagcaagtaaggacctgcaggaggtagtgctggggtgttcatatggtgtgcacgagccatgtaataatacaaataagattgctgctcgtagctaatta

SEQ ID NO: 3127 - DNA, 1379 bp, Avena sativa
ccttccaccagtgtcgcacgcacttacttttccccggtctacaaagccgtcacactcctgtgccggccaactgctttcttcaaagccttctctccccttcctcgtctcagctggtctcctgcatccacattcttcccgtttcgccggccagctcaagaatcaagatggcaatagaccatgcgtcccctctggcactgaagagcagaggcgccacgggaggagcggagtgcgaggacgaggcggagaaccagcggtggccgccgtggctgaagccgcttctggccacgagcttcttcgtgcaatgcagggtccacgccgacgcgcacaagagcgagtgcaacatgtactgcctcgactgcgtcaacggcgcgctctgccctctctgcctcgcccaccaccgcgaccaccacgccatccagatacggcggtcgtcgtaccacgacgtgatccgggtgtcggagatacagcgggtgctggacatcgccggtgtgcagacgtacatcatcaacagcgcgcgcgtggtgttcctgaacgagcggccgcagccgaggcccggcaagggggtcaccaacacctgcgacgtctgcgagcgcagcctcctcgacactttccgcttctgctccctcggatgcaagattgtaggcacgtccggcggacaccgcccgaggaagaaacaaagcggcagcggcagcggcggcgacggcggcggccagaagaagaggaagaagagggtggcggtcaaggacgcgcggtcggagtcggagcactcgtgcaccagcagcagcgacaagagcagcgtggtgcagagcttcacgccgtcgaccccgccgcccgcctccagcagccaccgcaccggcagcaagcgccggaagggcgtcccgcaccggtcgccgttcggcagcctcatcgtggagttctaggacagcaggcgtgtgtgccggccctgatcaacaacactctgtaacatactgtatactagaacatgacatagacaagagcacgagaggtaataaccgcgcgggcgccctggacggcgaaccctgtgcttccgggcgcggtggtcgcccgccgcccgccggcgtaatagtgccggccggggatcggcctgagcagtaagtctccaaagcgtgttactttcagtttcagaagtttagctacactttcagctatagccacctgtggtaaaaccgtagtgctagctactgtagtatatttacaccgccgtaacgggtagggtaatataacctccacacacatggtagatcgtagatatgtacattgtgtgtcccagatgtggagcagggttgcaggaggcagtgtcagtgtgggtgtttatatgtgcaggggccatgtagtaataagaaaacgctcctcctaat

SEQ ID NO: 3128 - DNA, 655 bp, Pennisetum glaucum
gcctggttacatattcggctttcgttgccgaaggaaaggggcgaaagggagtagaggaagccaggaaggccggcctgcttcacctggttttcaggttcatgagttgtgcgtgctaccaagagtgtatgcgtcgtgtgatttcagaattgaggatgctatcaaggtcttggagatcagcgtccctctttcctctcatcgtcgtccttgccttgctgttctcaacttcatccgcagggagaccatgcaatttcttgacggatcatcaagatgccctacgccatcaacgagaggcagcagtggctgaacaggaggcagtagtgccactagtgcatggtcggatgctcaacgtcaagacgaacgattatggcagctataaccctcccccaaccatggacaagccacatttcaagctcatacccaactgatcaaattatgtatccaggttgctgcaacggagtggcttagctgcctacatatgtctgtgcctgatgtatagatagagaggtattcctagccttgctaaaactattataatgacatttagtagctttttatagatgttgctcgtgcagtcgtgctgtgttcagtagccacaaagagcagtcagtgtttattcggttgaacttgtcatatattgtacttaaacaatacagat

SEQ ID NO: 3129 - DNA, 547 bp, Cenchrus ciliaris
gaggaaggcctgcttcacctggtttcaggttcatgtcttgtgcgtgctgccaagagtgtatgcatcgtgtgatttcagaaatgaggatgctagcacggtcttggagatccccgtccctctttcctctcatcatctttgccttgctgttctcaacttcattcgcagggagaccgtgcaatttcttgacggatcaggatgccctacaccatcaaggagaggcagcagtggctgaacagaaggaggcagtagtgccactggtgcatggtcggatgctcaacgtgaagacgaatgattacggcagctatgacccttccccaaccatggacaagccgcacttcaagctcatacccaactgatcaaattatgcatcgaggatgccgctaaggagtggacgatgaggagcttattagctgcttacattacatatatatgtgcctgatgatgtatagatagagaggtattcctagccttgctaaaactatcataatgacatttagtgtgttttttatagatgttgctcgtgcagtcgtgctgtgttcagtagcca

SEQ ID NO: 3130 - DNA, 1153 bp, Setaria italica
attcgctatgctggccgcccccaccgcgcctctccatcactcccccgacgccatgagcctgtagcccagcagcggtcgccaaagaagccgccatgggcaggtccagaggcggcaagggcgccggcgactcgaagtcgttcccgtcgccggcgtcgtcctcggcgtcgtcgtcggagttcgagttcacggtcacgctgtcgccggcgtccaagcagcggtcggcggcgcagctgtgccccgccgacgagctcttctacaagggccagctcctgccgctgcagctgtcgccgcgcatctccatggtgcgcacgctgctgctgtcctcggcgtccacgtcctccgcctccgactccacatccacgtccaactcgtcccgcgactccaacggcagcacctcctcgtccttctccgccgactgcgccgcgctcctgctcccggactccgcggcatcatcgtcccgccccagctccgccaccgaggacgaccggcacctgcacccgctctccgccgccgcctcgttcgccggcctgccgccggccaagcgcaccgggaagcagtacctctcgtccttcgccacccgcttctcctccgtcttccaccgcggcggcgctccggccgccaagaagcagccgtccaagtcgctcgccaaggaggtgatcaagaagtacgccaagaaggtgaagccgctgtacgagaagctctcccagatccccaagaaccagaacaacgtcaacgtcaacgttaacggcgccagcgccggcgccaacaaccagccgcagcaggggttcaagaagccgttcaccttctccatccgcaagaagcgggccgacgacgaccacgccgtcgtcgcggccgcggcagcggtggacgccgacgtcgttagcggcaagtacgcgcactccaactccttctccgggaacctccggttcccgcgacagaagcggtgcgcggcgagctgcccgtcgtcgatgcggtcgtcgccgagccactcgggcctgctcaccttcggcggggccggcggcgctggcttccccgacgtgccggccgccgcggccgcggccgtggcgggcggcattggcgtcggaccggtttcactgtccacggcgtcgtcgatggaggagctccagagcgccatcgagggcgccatcgcgca

SEQ ID NO: 3131 - DNA, 2120 bp, Sorghum bicolor
ctcacatgcgaccgcggccgtcgtgggctcatggccaccgtcccccgccggggcatctccttctcctcggcgcagctgcagctgcgagccagcgactccgaccctcataaacgacgtcaggttcgtcacccccgaaaagtttttaccttttcctcccgtctcctcggctcctcctcctcgctatgctggccgcccccaccgcgcctctccatcactcccccgacgccatgactctgtagcggcacgcagcaccgcaaagccagccaccatgggcaggacgagaggcagcaagagcgccggcggcgtgaggtcgttcccgtcgccggcgtcgtcgtcctcggcgtcgtcgtcggagttcgagttcacggtcacgctgtcgccggcgtccaagcagcggtcggcggagcagctgtgcccggcggacgagctcttctacaagggccagctcctgccgctgcagctgtcgccgcgcatctccatggtgcgcacgctgctgctgtcgtcggcgtccacgtcctccgcctccgcgtccgactccacctccacgtccaactcctcccgcgactccaacggcagcacgtcgtcgtccttctccgcggactgcgccgcgctgctgctcccggactccgcggcctcgtcgtctcgccccagctccgccaccgaggatgaccgccacctgcacccacacccgctgtcggccgccgccgccttcgcggggctgccacccgccagcaagcgcaccgggaagcagtacctctcgtccttcgccacccgcttctcctccgtcttccacctggcggcgctccggccgcggcgaagaagcagccgtccaagtcgctcgccaaggaggtgatcaagaagtacgccaagaaggtgaaaccgctctacgagaagctctctcagatccccaagaaccagaacaacgtcaacgtcggcgtcggtggcgccaacaaccaaccgcagcaggggttcaagaagccgttcactttctccatccgcaagaagagaggcgacgacgaccacgccgtcgcggctgcggcagcggtggaggcagaggttgttggcggcggcaagtacgcgcactccaactccttctccgggaacctccggttcccgcgccagaagcgggccgcggcgagctgcccgtcatcgatgcggtcgtcgccgagccactcgggtctgctcaccttcggcggggccggcggcgtcggcttccccgacgtgccggcagcggcggctgcggccgttgcgagcggcattggcgtcggtccgcccgtgtcgctgtccacggcatcgtccatggaggagctccagagcgctatcgagggcgccatcgcgcactgcaagaacacgatgggcggcgccgtgtcgttgtgcccgcgcaaggcggcggcggcggcggcggtcgccgatgagatctgcgccttctgagcgcgcgagcgcgctaggattcaagcggcggagagctaagtaagcaggctgtttaatcggtagcagtacttatctgttgttattagtaattttaatttcattcgtctcgttttggtaagactctatgatcatggtcgtaaataagggtagttcgaaggggttaaaaatgataatccgagcctttcaatctctccttttcctgggtttggattttgcattggcgccctccaatttttacctctaattgcatctacctacctaaagaaaatgttggggcaaccttactaatatataaattcaccaaaaaaaaaactgcctcaattttgatgctttcaatgcaaacattccagttttgaaggatcatgaaaatatctgctagaacctgaaaatcagttgcaatgattatacttcatcctaaatttttgaagcaaaatggagtatgaagttccaaacctgatgatggagggtgttgatgcaaatttcatttcctagagaagggtggtcaaaagctccttagttgattatgctaagatttggactctgatgtggcagtacgtctgagctagtggtatcaattttttgctgtgattttgttcgttccaagactagagtttaatactaagctaatgctaatatagtttggcttttaaatctgtactttcatgattgcttcaaaaagttcgtcttgt

SEQ ID NO: 3132 - DNA, 2247 bp, Sorghum bicolor
ctcacatgcgaccgcggccgtcgtgggctcatggccaccgtcccccgccggggcatctccttctcctcggcgcagctgcagctgcgagccagcgactccgaccctcataaacgacgtcaggttcgtcacccccgaaaagtttttaccttttcctcccgtctcctcggctcctcctcctcgctatgctggccgcccccaccgcgcctctccatcactcccccgacgccatgactctgtagcggcacgcagcaccgcaaagccagccaccatgggcaggacgagaggcagcaagagcgccggcggcgtgaggtcgttcccgtcgccggcgtcgtcgtcctcggcgtcgtcgtcggagttcgagttcacggtcacgctgtcgccggcgtccaagcagcggtcggcggagcagctgtgcccggcggacgagctcttctacaagggccagctcctgccgctgcagctgtcgccgcgcatctccatggtgcgcacgctgctgctgtcgtcggcgtccacgtcctccgcctccgcgtccgactccacctccacgtccaactcctcccgcgactccaacggcagcacgtcgtcgtccttctccgcggactgcgccgcgctgctgctcccggactccgcggcctcgtcgtctcgccccagctccgccaccgaggatgaccgccacctgcacccacacccgctgtcggccgccgccgccttcgcggggctgccacccgccagcaagcgcaccgggaagcagtacctctcgtccttcgccacccgcttctcctccgtcttccacctggcggcgctccggccgcggcgaagaagcagccgtccaagtcgctcgccaaggaggtgatcaagaagtacgccaagaaggtgaaaccgctctacgagaagctctctcagatccccaagaaccagaacaacgtcaacgtcggcgtcggtggcgccaacaaccaaccgcagcaggggttcaagaagccgttcactttctccatccgcaagaagagaggcgacgacgaccacgccgtcgcggctgcggcagcggtggaggcagaggttgttggcggcggcaagtacgcgcactccaactccttctccgggaacctccggttcccgcgccagaagcgggccgcggcgagctgcccgtcatcgatgcggtcgtcgccgagccactcgggtctgctcaccttcggcggggccggcggcgtcggcttccccgacgtgccggcagcggcggctgcggccgttgcgagcggcattggcgtcggtccgcccgtgtcgctgtccacggcatcgtccatggaggagctccagagcgctatcgagggcgccatcgcgcactgcaagaacacgatgggcggcgccgtgtcgttgtgcccgcgcaaggcggcggcggcggcggcggtcgccgatgagatctgcgccttctgagcgcgcgagcgcgctaggattcaagcggcggagagctaagtaagcaggctgtttaatcggtagcagtacttatctgttgttattagtaattttaatttcattcgtctcgttttggtaagactctatgatcatggtcgtaaataagggtagttcgaaggggttaaaaatgataatccgagcctttcaatctctccttttcctgggtttggattttgcattggcgccctccaatttttacctctaattgcatctacctacctaaagaaaatgttggggcaaccttactaatatataaattcaccaaaaaaaaaactgcctcaattttgatgctttcaatgcaaacattccagttttgaaggatcatgaaaatatctgctagaacctgaaaatcagttgcaatgattatacttcatcctaaatttttgaagcaaaatggagtatgaagttccaaacctgatgatggagggtgttgatgcaaatttcatttcctagagaagggtggtcaaaagctccttagttgattatgctaagatttggactctgatgtggcagtacgtctgagctagtggtatcaattttttgctgtgattttgttcgttccaagactagagtttaatactaagctaatgctaatatagtttggcttttaaatctgtactttcatgattgcttcaaaaagttcgtcttgtctgctctctccccgccgctcaatgtttttgttttgtttgattgtcatttgtcaagctggtttattcttactgccaccgatgaaagaaaaatggagcatttgtttacttgatttgatgagttcggttt

SEQ ID NO: 3133 - DNA, 1852 bp, Saccharum officinarum
aaagtcgcatcatgggcaggacgagaggcaacaagagcgcagccggcgccggcggcgtgggcggcgtgaggtcgttcccgtcgccggcgtcgtcgtcctcggcgtcgtcgtcggagttcgagttcacggtcacgctgtcgccggcgtccaagcagcggtcggcggagcagctgtgcccggccgacgagctcttctacaagggccagctcctgccgctgcagctgtcgccgcgcatctccatggtgcgcacgctgctgctgtcgtcggcgtccacgtcctccgcctccgcgtccgactccacttccacgtccaactcctcccgcgactccaacggcagcacgtcgtcgtccttctccgctgactgcgccgcgctgatgctcccggactccgcggcctcgtcatctcgccccagctccgccaccgaggatgaccgccacctgcaccacccgctgtcagccgccgcctccttcgcggggctgccacccgccaacaagcgcaccgggaagcagtacctctcgtccttcgccacccgcttctcctccgtcttccaccgtggcgccggcgctccggccgcgaagaagcagccgtccaagtcgctcgccaaggaggtgatcaagaagtacgccaagaaggtgaaaccgctctacgaaaagctctcccagatccccaagaaccagaacaacgtcagcggcagcggcgggggcgtcggtggcgctaacaaccaaccgcagcagggggtcaagaagccgttcaccttctccatccgcaagaagagaggcgacgacgaccacgccgtcgcggctgcggcagcggtggaggcagaggttgttggcggcggcaagtacgcgcactccaactccttctccgggaacctccggttcccgcgccagaagcgggccgcggcgagctgcccgtcatcgatgcggtcgtcgccgagccactcgggtctgctcaccttcggcggggccggcggcgtcggcttccccgacgtgccggctgcagcggctgcggccgttgcgagcggcattggcgtcggtccgccggtgtcgctgtccacggcatcgtccatggaggagctccagagcgctatcgagggcgccatcgcgcactgcaagaacacgatgagcggcgccgtgtcggtgtgcccgcgcaaggcggcggcggcgggcgccgatgagatctgcgccttctgagcgctcgaagtaagcaggctgtttaatcggtagcagtacttatctgttgttagtaattttaattccattcgtctccttttggtaagactatgatcgtggtcgtaaataagggtagttcgaagggttaaaatgataatcggagcctttcaatatctccttttcctgggtttggaatttgcattggcaccctccaatttttacctctaattgcatatatctacccaaagaaaatgttgaggcaatcttaataatacataaattcaaaaaaaaaactgcctcaactttgatgctttcagtgcgaacattcagttttgaaggatcgacatgcatgaaaacctatgaaatgcctgtattttccaacttgaatcctgtctcctagatagaagggagaacctgaaaatcagttgaagtgagtatagttcatccaaaatttttgaaacaaaatggagtgtgaagttcccaacctgatgatggagggtgttgatgcaaatttcatttcctagagcagaagggttgtcgaaagctccttagttcatttaagctgagaatttggactctgatgtggcagtactccataagtctgagctagtggtgtcattttttgctctgattttgttccaagactagagtttaatactaatgccttgatcgcttgactg

SEQ ID NO: 3134 - DNA, 1186 bp, Sorghum bicolor
cccgtctcctcggctcctcctcctcgctatgctggccgcccccaccgcgcctctccatcactcccccgacgccatgactctgtagcggcacgcagcaccgcaaagccagccaccatgggcaggacgagaggcagcaagagcgccggcggcgtgaggtcgttcccgtcgccggcgtcgtcgtcctcggcgtcgtcgtcggagttcgagttcacggtcacgctgtcgccggcgtccaagcagcggtcggcggagcagctgtgcccggcggacgagctcttctacaagggccagctcctgccgctgcagctgtcgccgcgcatctccatggtgcgcacgctgctgctgtcgtcggcgtccacgtcctccgcctccgcgtccgactccacctccacgtccaactcctcccgcgactccaacggcagcacgtcgtcgtccttctccgcggactgcgccgcgctgctgctcccggactccgcggcctcgtcgtctcgccccagctccgccaccgaggatgaccgccacctgcacccacacccgctgtcggccgccgccgccttcgcggggctgccacccgccagcaagcgcaccgggaagcagtacctctcgtccttcgccacccgcttctcctccgtcttccacctggcggcgctccggccgcggcgaagaagcagccgtccaagtcgctcgccaaggaggtgatcaagaagtacgccaagaaggtgaaaccgctctacgagaagctctctcagatccccaagaaccagaacaacgtcaacgtcggcgtcggtggcgccaacaaccaaccgcagcaggggttcaagaagccgttcactttctccatccgcaagaagagaggcgacgacgaccacgccgtcgcggctgcggcagcggtggaggcagaggttgttggcggcggcaagtacgcgcactccaactccttctccgggaacctccggttcccgcgccagaagcgggccgcggcgagctgcccgtcatcgatgcggtcgtcgccgagccactcgggtctgctcaccttcggcggggccggcggcgtcggcttccccgacgtgccggcagcggcggctgcggccgttgcgagcggcattggcgtcggtccgcccgtgtcgctgtccacggcatcgtccatggaggagctccagagcgctatcgagggcgccatcgcgca

SEQ ID NO: 3135 - DNA, 2284 bp, Zea mays
ccatagtagcgttctctcttcttgaaatcaggtttctttgtgtagcaggcaccggttgttacgctgcttcaaccggtctgtgtctaacgatgcggttgttaggctgcttcaaaccggtctgtatcaactgcatctacagtcttgtcgtgctacgtccgctatcgatcattcgatgcatatctccttctcagtaaaattataggaacaaaaaggacgcattttcttttcttttttttttgtctctcaggagtacttcgacaagtgaagctcgtggatagcattgccttgcttcgtcgtagttgacagttgacacctatactcctacgtgccgactcgagtccccgtccaggcgtctatggaaagtgatcagtcatcgctcacatgcgatcgcggccgtcagcgtcatggcccccgtccctgccggcctcaactcggcgcaggtgcgacccctcacagtcacataaagacgtcaggttccccacccccgaaaagtttttacctttcctcccgtctccgtctcctcgctggctcgctatgctggccgcctccaccgcgcctctccgtcactcccccaacgccatgagtctgtaacggcacacgtaccatgggcaggaccagaggcaacaggggcgtgggcggcgcgaagtcgttcccgtcgccggcgtcgtcctcggcctcgtcgtcggagttcgagttcacggtcacgctgtcgccggcgtccaagcagcggtcggcggagcagctgtgcccggccgacgagctcttctacaagggccagctcctgccgctgcagctatcgccgcgcatctccatggtgcgcacgctgctgctgtcctcggcgtccacgtcgtccgcctccgcgtccgactccaccaactcctcctcccgcgactccaacggcagcacgtcgtcgtccttctccgccgactgcggcgcgctcctgggcccggactcggcggcctcgtcgtctcgccccagctccgccaccgaggacgaccgccacctgcatccgccgtcggccgccgcggggctgctgccacccgccaagcgcaccgggaagcagtacctctcgtccttcgccacgcgcttctcctcggtcttccaccgcggcggcgccggcgctccggccgcgaagaagcagccgtccaagtcgctcgccaaggaggtgatcaagaagtacgctaagaaggtgaaaccgctctacgaaaggctctcccagatccccaacaagaaccagaacaacgtcgtcaacggcaacagccaaccgcagcagaggttcaagaagcccttcaccttctccatccgcaagaaaaagggcgacgccgtcgcggcagtggtggaggcggcagcagaggttggcggcaacaagtacgcgcactccagctccttctccggaaacctctggttcccgcgccagaagcgggccacggcgagctgcccgtcatcgatgcagtcgtcgcctagccactcgggtctgctcacctttggcggggctggcggcgtgggcttccccgacgtgccggccgttgccagcggcattggcgtcggtccggtgtcgttgtccacggcatcgtccatggaggagctccagagcgctatcgagggcgccattgcgcactgcaagaacacgatgggcggaaccgtgtcggtcaaggcggcggcggcggccgccgacgagatctgcacgttctgagcgcgaccacgctaggattccggggggagctaagtaaagcaggctgttttaatcggtagcagtacttatctgttattagcaaatttaatttcgtccgtctccttttttttttttgggtaagactctatggtcatggtcgtaaataggggtagttcggagggggttaagatgatagtcggagcctttttcgatctctccttatccttccttggtttggaaatttgcattagcgccctctaaattgtagctctaattgcattagcacccacggctacaccactgaacaaaatgttggggcaaccttaacacagtactacataaaattcacaaaacagcctcaagcgttcatcttaatttgatgctagcttccaatgcattgcaaagctccgtagtagttcatgtaaaagctgggggatctgggactctgatgtggcagtaggtggtatcgattttatttttatttttatatttttgctgtgagtttaataatataataatactataagctaacgctagtagtatagtttggctttaaacctgtggtacttggcatgattgattgcttcaaaaagttcgccttgtctgctctcc

SEQ ID NO: 3136 - DNA, 2784 bp, Oryza sativa
gccaactcccccgattattagctgaaaaacaatgggggtatttgtaaattttgccactaattatttcattttgtatttgggctacagccaggacagcctcctgagccgtccgatcgcgatccggaatcgatccaacggcttcgggggccacccccacatgcgacaatccgcatcttctcctcataaagcggtcagactcgtaatcccggaaaagttttcaccttttccctcccacctcgcctcgccatgctcacctcgccctcgtctccgatccactcctcctcctcctccacccgccgcgccatgagcccgtagcttacgtggcagcagcgagaaaccatgggcaggtcaagaggcaaggatggcggcgggaggtcgttcccgtcgccggcgtcgtcgtcgtcggcgtcgtcgtcggagttcgagttcacggtcacgctgtcgccggcgtcgaagcagaggtcggcggcgcagctgtgcccggcggacgagctgttctacaagggccagctcctgccgctgcagctgtcgccgcgcatctccatggtgcgcacgctgctgctctcgtcggcgtcgacctcctccgcgtcggcctccgactccacctccaactcgtcctcctcccgcgactccaacggcagcacgtcgtcgtccttctccgccgactgcgccgcgctgctgctcccggactctgccgcctcctcctcccgccccagctccgccaccgaggacgaccgccacctcgccccgccgccgccgccgccgggtgtcgctgcctcgttcgccgccaagcgcaccggcaagcagtacctctcgtcgttcgccacccgcttctcctccgtcttccaccgcggcggcgcccccgcccccgccgccgccgccgccaacgccaagaagccgccgtccaagtcgctcgccaaggaggtgatcaagaagtacgccaagaaggtgaagccgctgtacgagaagctctcccagatccccaagaatcagagcaacagcagcggccagccgctgcagcagcagcagcagcaggggttgaagaagccgttcagcttctcgatgcgcaagaagcgcggcgacgacgaccacgccgcagcggccccggccgcggcggccgccgtggccgcggaggtgggcggcggcggcaagtacgcgcactccaactccttctccgggaacctccggttcccgcgccagaagcggtgcgcggcgagctgcccgtcctcgatgcgctcctcgccgagccactccggcctgctcaccttcggcggcgcgggcggcgtcggcttccccgacgtgccagccgccgccgcggcggcgatgtccggcggcattagcgtgggccccgtgtcgctgtccacggcgtcgtcgatggaggagctccagagcgccatcgagggcgccatcgcgcactgcaagagcacaatgggcggcgccgtgaccatgtgctcgcgcaaggcggcggcggccgccgacgagatctgcgcgttctgagcgcacgtaggattcgggcggggacgaagctaagtaaggcggtttaatcgatagcattatgtgttaattttatgtgttttgttaattaattttgtgtcctcctggtaagactattaagtatgattatggtggtaaataagggtagtttcaaggggtaaaatgatatttggagcctttggaattttgatatctccctttattccaaaaatatggaatttgcgtcggcgccctccaaacatatcctctcattgcatcaaggacaaaaatttaagtttatgaggctagcaaactcaactagtcattaattcataaggagaaaattcagttggagatatttccaaatgtcttctgttttggaattaggaggattgatgtgtatgatatcttttgctacataaacaacaattagaacctgcctttgaaagattattatatggctgggaaatggatttcccaattcgagatttgccgattagaatccatgaaagtagctggtccatctagtggagtgtccctacagacttttggagcacaaagctgccaattttctatgatggagtcttcaaaaaaaaaactttctatgattgagggtgttgatgcaggtttcatttcctggaaaagggatttgcaaagttccttaggttaattagatcaggttttggaatctgatgtggcagtctgagcaagtgctgtcattttctttttgttgtgatttttgtctcaactatcaagacaagtgtttattaagctaattctaatataattttggcttttgtactttcacatcacatggtaacttgtatgatcattgtttcaaaataatcccctcatctgccccccaatctttggtgcttcattaaaggaattatgattgttaagcacatatgttcctttattgttcccttgattttgtatgacctctccatttctgtccagtgttcaccttaattggggatcatgtacctttttgtccccagttaattagccactcattttaccttaaatcctacaaaatctgctgctcattgctacaacttaaagtgctcatttccttgcaagttaatactaattctacaatacccgttaggtagattcccctggaactagttggacaccactgcgtgccaacacccacaagaagttagcagtagcagttggaagttggaaaacgattcccttgctagatctggctcacgcaaatgctgtttctttcacatgtcttgccctttggaatgcagtatacatttgctaatcaatggagttaattacaagtccttgtaccactag

SEQ ID NO: 3137 - DNA, 1634 bp, Oryza sativa
atgcgacaatccgcatcttctcctcataaagcggtcagactcgtaatcccggaaaagttttcaccttttccctcccacctcgcctcgccatgctcacctcgccctcgtctccgatccactcctcctcctcctccacccgccgcgccatgagcccgtagcttacgtggcagcagcgagaaaccatgggcaggtcaagaggcaaggatggcggcgggaggtcgttcccgtcgccggcgtcgtcgtcgtcggcgtcgtcgtcggagttcgagttcacggtcacgctgtcgccggcgtcgaagcagaggtcggcggcgcagctgtgcccggcggacgagctgttctacaagggccagctcctgccgctgcagctgtcgccgcgcatctccatggtgcgcacgctgctgctctcgtcggcgtcgacctcctccgcgtcggcctccgactccacctccaactcgtcctcctcccgcgactccaacggcagcacgtcgtcgtccttctccgccgactgcgccgcgctgctgctcccggactctgccgcctcctcctcccgccccagctccgccaccgaggacgaccgccacctcgccccgccgccgccgccgccgggtgtcgctgcctcgttcgccgccaagcgcaccggcaagcagtacctctcgtcgttcgccacccgcttctcctccgtcttccaccgcggcggcgcccccgcccccgccgccgccgccgccaacgccaagaagccgccgtccaagtcgctcgccaaggaggtgatcaagaagtacgccaagaaggtgaagccgctgtacgagaagctctcccagatccccaagaatcagagcaacagcagcggccagccgctgcagcagcagcagcagcaggggttgaagaagccgttcagcttctcgatgcgcaagaagcgcggcgacgacgaccacgccgcagcggccccggccgcggcggccgccgtggccgcggaggtgggcggcggcggcaagtacgcgcactccaactccttctccgggaacctccggttcccgcgccagaagcggtgcgcggcgagctgcccgtcctcgatgcgctcctcgccgagccactccggcctgctcaccttcggcggcgcgggcggcgtcggcttccccgacgtgccagccgccgccgcggcggcgatgtccggcggcattagcgtgggccccgtgtcgctgtccacggcgtcgtcgatggaggagctccagagcgccatcgagggcgccatcgcgcactgcaagagcacaatgggcggcgccgtgaccatgtgctcgcgcaaggcggcggcggccgccgacgagatctgcgcgttctgagcgcacgtaggattcgggcggggacgaagctaagtaaggcggtttaatcgatagcattatgtgttaattttatgtgttttgttaattaattttgtgtcctcctggtaagactattaagtatgattatggtggtaaataagggtagtttcaaggggtaaaatgatatttggagcctttggaattttgatatctccctttattccaaaaatatggaatttgcgtcggcgccctccaaacatatcctctcattgcatcaaggacaaaaatttaagtttatgaggctagcaaactcaa

SEQ ID NO: 3138 - DNA, 2269 bp, Setaria italica
cccctccaaaccccgctctttccttctcgcgcaacttcgccgtcccctccggcccgcgcccgcgtcgtctccggccgcgcgccgccggatccctcgccgccggttgcaagattttccagcattggttattcatctatttcacaagttaagaaacatcaaattctggatgtgagcaacaaaataagttctttcctctttagccagccccgaccgatatcaatggctacagctccggccaatggtgattcacaaagtggccctcagaggaactatcaggttgttgttgcagctactcgtgacatgggcattgggaaggatggggtcttgccatggaagcttcttggtgaccttaagttcttcaaggaggttacactttcaacatctgaccctgccaagaagaatgcagttataatgggaaggaaaacgtgggagagcattcctgtaaagtcaaggccattgcctggtcgtttgaatgtcatacttactcgatctggtagttttgattttgctacagtagaaaatgttgttatctgtggaagcatgaagtctgccctggaactgctagcatcaactccatattgcgtatcaattgagaaagtttttgttatagggggtgggcaggtactgagggagtatcttaatggacctgcatgtgaggccatccatctaactgacgttcagtccagcattgagtgtgacacattcatacctccaattgacttctcagtgttccagccatggtattcatctttcccggtggtagagagcaacattaggcattcttttgtgacctttgttcgtgttagaaaatcactggaagaaactcatgtctcaaatggaaaggaatcaactgaggtggataccaagaatgacaagtttgaaacagagaacttctcttttcttcccaagatgatatttgatcgccatgaggaatatcattaccttaatcttgctgaagatattataaagtctggtgctcagaaaaatgacaggacaggaacaggaacgttgtcaaaatttgggtgtcagatgcgattcaacttaaggaaaatttttcctctgttgacaacaaagagggtattttggcgtggtgtcgttgaagaactcctatggttcatcagtggttcaacaaatgcaaaggttctacaagagaaaggtattcatatctgggacggcaatgcttcaagagagtatcttgacagtgttggcttggcacacagggaggaaggtgatctaggtccagtttatggatttcaatggcgacactttggtgctgaatacacagacatgcatgctgactacactggaaaaggttttgatcagctaatggatgtgattgacaagatcaagaataatcctgatgaccggcgaataattttgtcggcatggaatccttcagatctcaagaagatggctcttcctccttgccacatgtttgcacaattttatgttgagaatggggagctatcctgccagatgtatcaacgctctgcagacatgggacttggtgttccattcaacattgcatcatattctcttcttacatacatgattgctcaagtttgtggtctttctcctggggatttcgtccatgttataggggatgcacatgtctacagaactcatgttcgagctttggaggagcaaattcagaagatgcctaagccatttccaattttgaagataaatccttcaaagaaggatatagattctttcgtggcatcagacttcaagctagttggctatgatcctcaccagaagatagagatgaaaatggcaatataatggtaacgcggctcagcttgagccccagcctacgagcttggcgaaattcgttggactgctactatatatttaagattaaccggacatggcaccaacttgtttttggtgatggtgccgaatgttcgttcaactgggagatcttccccacctcccctatttggggttgcactcaggctgcttatctgaactctacaggacctgctccccttttatccggagccggtgttgttgcgagtgagctgcttccgggcaacgccctgttccaaagggtcgactggcgtgtgccccgtgacgatgtactatccgtgtcactgaattcgttttacttgttaaaactcgttactgtttgatgcctacatgtgtgttctgtctggttctatttcctttcgacgtcagataacgacctgcatgctttaagcatgcgatccgctgctgtttttctccagacatgtgctggaagtgcgagcggcgtgcttgacaaagg

SEQ ID NO: 3139 - DNA, 2317 bp, Sorghum bicolor
gcatacgctctctcgtgtcccgtgccgccgctcgagtgcgctctctgtgtctactctggtggcgacgactgggggtcgggggaccgccgccaccgccgtacgccaggtgcccaggtccccatcttcgggcccttcgccagttcgccggcgacgatcatccaccaggttgcaagattttccagcgctgcttgctcacccatttctcaatttagaaaacctcaatttctggatctcagaaccaaatcacgaccataccactttattcagccccgactgattgcaatggctgcagctccggccaatggtgattcacagagtggtcctcagaggaactaccaggttgttgttgctgccactcgtgacatgggcattgggaaggatggggttctgccatggaagcttcttggtgatcttaaattcttcaaagagcttacactaactacatctgatcctgccaagaagaatgcagttataatgggaaggaaaacatgggagagcattcctgttaagtcaaggccattgcctggtcgtttgaatgtcatacttactcgatctggtagctttgattttgcaacagtagagaatgttgttatatgtggaagtatgaattctgccttagaactgctagcatcaactccatactgcttatcaattgagaaagtttttgttgtaggaggtgggcaggtactgagagaatatcttaatggacctgcttgtgaggctatccatctaactgacattcagtcgagcattgagtgtgacactttcatccctccagttgacttctcagtgttccagccatggtattcatctttcccagtggtagagagcaacattaggcattcttttgtgacttttgttcgtgttagaaagtcagtggcagaaactcatgagtcaaatggcaaggaatcaactgaggttgataccaagaatgacaaatttgaaatagagaatttctcttttctccccgagatggtatatgaccgccatgaggagtatcaatatctcaatcttgttgaagatattataagatctggtgctcagaaaaatgacaggacaggaactggaacaatgtcaaaatttggatgtcagatgcggttcaacttaaggaaaaattttcctctgctgacaacaaagagggtattttggcgtggtgttgtcgaagaactcctttggttcatcagtggctcaacaaatgcaaaggttttgcaagagaagggtattcacatctgggatggcaatgcttcaagagagtatcttgacagtgttggcttggcacacagggaggaaggtgatctaggtccagtttatggatttcaatggcgtcactttggtgctgaatacactgacatgcatgctgactatactggaaaaggttttgatcagctaatggatgtgattgacaagatcaagaataatcctgatgaccgccgaataattatgtctgcgtggaatccttcagatctcaagaagatggctcttcctccttgccacatgtttgcacaattttatgttgaaaatggggagctatcctgccagatgtatcaacgctctgcagacatggggcttggtgttccattcaacatcgcatcatattctcttctgacatacatgatcgctcaagtttgtgatctttctcctggagattttgtccatgttataggggatgctcatgtctatagaactcatgttcgagctctggaggagcaaattcagaagatgcctaaaccatttccaattttgaagataaatccttcaaaaaaggatatagattctttcatggcatcagacttcaagctggttggctatgatcctcaccagaagatagagatgaaaatggcagtgtaatggtgacttagctggagccccagcctttggactcggtgggtgaaatcagtcagactgggtactacataaaaattaaccggacatcgcactagcttgtttttggtgatggtgctggatgttccgtgggagacgtttctccccttattagttgcgattgcatactatggtcgcttaaatgaactctacaaaaccggctcccttttatctggagcgagttgatgactcaattgcgagcaagagatgatctgggcatcataccctgttgcaagggcctactggtgtgtgtgcccccgtgaggctgtgacgtttgtgctactgccccttgagaaccatgtaaccgaaattgctgttgtgtacctggtagagctccgtactgtttggtatctggttgccttaatgcgtgccctgattatttcagtttccagtttggacgcaagataacgacttgattgtaggtttttaagaaaca

SEQ ID NO: 3140 - DNA, 2690 bp, Sorghum bicolor
gggcctttgcgctgcgggccgccgacctgcctttttgttctacccttcggccattccccccgcatacgctctctcgtgtcccgtgccgccgctcgagtgcgctctctgtgtctactctggtggcgacgactgggggtcgggggaccgccgccaccgccgtacgccaggtgcccaggtccccatcttcgggcccttcgccagttcgccggcgacgatcatccaccaggttgcaagattttccagcgctgcttgctcacccatttctcaatttagaaaacctcaatttctggatctcagaaccaaatcacgaccataccactttattcagccccgactgattgcaatggctgcagctccggccaatggtgattcacagagtggtcctcagaggaactaccaggttgttgttgctgccactcgtgacatgggcattgggaaggatggggttctgccatggaagcttcttggtgatcttaaattcttcaaagagcttacactaactacatctgatcctgccaagaagaatgcagttataatgggaaggaaaacatgggagagcattcctgttaagtcaaggccattgcctggtcgtttgaatgtcatacttactcgatctggtagctttgattttgcaacagtagagaatgttgttatatgtggaagtatgaattctgccttagaactgctagcatcaactccatactgcttatcaattgagaaagtttttgttgtaggaggtgggcaggtactgagagaatatcttaatggacctgcttgtgaggctatccatctaactgacattcagtcgagcattgagtgtgacactttcatccctccagttgacttctcagtgttccagccatggtattcatctttcccagtggtagagagcaacattaggcattcttttgtgacttttgttcgtgttagaaagtcagtggcagaaactcatgagtcaaatggcaaggaatcaactgaggttgataccaagaatgacaaatttgaaatagagaatttctcttttctccccgagatggtatatgaccgccatgaggagtatcaatatctcaatcttgttgaagatattataagatctggtgctcagaaaaatgacaggacaggaactggaacaatgtcaaaatttggatgtcagatgcggttcaacttaaggaaaaattttcctctgctgacaacaaagagggtattttggcgtggtgttgtcgaagaactcctttggttcatcagtggctcaacaaatgcaaaggttttgcaagagaagggtattcacatctgggatggcaatgcttcaagagagtatcttgacagtgttggcttggcacacagggaggaaggtgatctaggtccagtttatggatttcaatggcgtcactttggtgctgaatacactgacatgcatgctgactatactggaaaaggttttgatcagctaatggatgtgattgacaagatcaagaataatcctgatgaccgccgaataattatgtctgcgtggaatccttcagatctcaagaagatggctcttcctccttgccacatgtttgcacaattttatgttgaaaatggggagctatcctgccagatgtatcaacgctctgcagacatggggcttggtgttccattcaacatcgcatcatattctcttctgacatacatgatcgctcaagtttgtgatctttctcctggagattttgtccatgttataggggatgctcatgtctatagaactcatgttcgagctctggaggagcaaattcagaagatgcctaaaccatttccaattttgaagataaatccttcaaaaaaggatatagattctttcatggcatcagacttcaagctggttggctatgatcctcaccagaagatagagatgaaaatggcagtgtaatggtgacttagctggagccccagcctttggactcggtgggtgaaatcagtcagactgggtactacataaaaattaaccggacatcgcactagcttgtttttggtgatggtgctggatgttccgtgggagacgtttctccccttattagttgcgattgcatactatggtcgcttaaatgaactctacaaaaccggctcccttttatctggagcgagttgatgactcaattgcgagcaagagatgatctgggcatcataccctgttgcaagggcctactggtgtgtgtgcccccgtgaggctgtgacgtttgtgctactgccccttgagaaccatgtaaccgaaattgctgttgtgtacctggtagagctccgtactgtttggtatctggttgccttaatgcgtgccctgattatttcagtttccagtttggacgcaagataacgacttgattgtaggtttttaagaaacattctgatgcgtttttcttgtgctgtgctgctgggggtagaaagtctagcgctgcgcttgacgaagacgggtccaagcgcttgcactcgcagtgcaggtgccgcacgtcagcattactcctaatctaaactaatcctgcaactgtgcagtcggccgaactcgaagatactgcaaacagtaggatgatgcggcccctgcaagtttgtagagctgaccagtcgtttccgtttcacattgtttttttttctctttaatcaagttacattagtcgtggattgcttgttcagtggttcttggctgcagccatcagcct

SEQ ID NO: 3141 - DNA, 2218 bp, Saccharum officinarum
accggctccgaattcctgggtcgacccacccgtccggtcccgtgccgcccctcgagtgcactctctgtgtctactctggtggcgacgactgggggtcgggggaccgccgccaccgccaccgccaccgccgtacgccaggtgcccaaactcccatcttcgggcccttcgccagttcgccgacgacgagcatccaccaggttgcaagattttccagcactgcttgctcacccatttctcaatttagaaaacctcaatttctgtacctgagcaccaaatcaagaccataccactttagtcagtcccaactgatggcaatggctgcagctccggccagtggtgattcacagagtggtcctcagaggaactatcaggttgttgttgctgccactcgtgacatgggcattgggaaggatggggtcttgccatggaagcttcttggtgatcttaaattcttcaaagagcttacactcactacatctgatcctgccaagaagaatgcagttataatgggaaggaaaacatgggagagcattcctgttaagtcaaggccattgcctggtcgtttgaatgtcatacttactcgatctggtagttttgattttgcaacagtagagaatgttgttatatgtggaagcatgaagtctgccttagaactgctagcatcaactccatactgcttatcaattgagaaagtttttgttgtaggaggtgggcaggtactgagagaatatcttaatggacctgcatgtgaggctatccatctaactgacattcaatcgagcattgagtgtgacactttcatccctccagttgacttctcagtgttccagccatggtattcatctttcccagtggtagagagcaacattaggcattcttttgtgacttttgttcgtgttagaaagtcagtggcagaaactcatgagtcaaatggcaaggaatcaactgaggttgataccaagaatgacaaatttgaaatagagaatttcacttttctccccaagatggtatatgactgccatgaggagtatcaatatctcaatcttgttgaagatattataaggtctggtgctcagaaaaatgacaggacaggaactggaacattgtcaaaatttgggtgtcagatgcggttcaacttaaggaaaaattttcctctgctgacaacaaagagggtattttggcgtggtgttgtcgaagaactcctttggttcatcagtggctcaacaaatgcaaaggttttgcaagagaagggtattcatatctgggatggcaatgcttcaagagagtatcttgacagtgttggcttggcacacagggaggaaggtgatctaggtccagtttatggattccaatggcgtcactttggtgctgaatacactgacatgcatgctgactatactggaaaaggttttgatcagctaatggatgtgattgacaagatcaagaataatcctgatgaccgccgaataattttgtcagcatggaatccttcagatctcaagaagatggctcttcctccttgccacatgtttgcacaattttacgtggaaaatggggagctatcctgccagatgtatcaacgctctgcagacatggggcttggtgttccattcaacatcgcatcatattctgttctgacatacatgatcgctcaagtttgtgatctttctcctggagattttgtccatgttataggggatgctcatgtctatagaactcatgttcgagctctggaggagcaaattcagaagatgcctaaaccatttccaattttgaagataaatccttcaaaaaaggatatagattctttcatggcatcagacttcaagctggttggctatgatcctcaccagaagatagagatgaaaatggcagtgtaatggtggcttagctgtggagccccagcctttggactcggtggtgaaatcagtcagactggtactacataaaaattaaccgggcatcgcactagcttgtttttggtgatggtgctgaatgttccgtgggagacgtttctccccttattagttgcgattgtgtactctggtcgcttaagtgaactctacaaaaaccggctcccttttatctggaacgagttgatgactcaactgcgagtgagatgatctgggcatcataccctgttgcaagggcctactggtgtgtgtgcccctgtgaggttgtaacgtttgcgccactgcctcgtgagaatcatgtaacc

SEQ ID NO: 3142 - DNA, 2166 bp, Pennisetum glaucum
ccggatctccaaccgccggttgcgagattttccagcatcggttgttcattcatttcacaagtgagaaaacctcaatttctggacgtgtgtagcaaaaaaagttctttctgctgtagtcagtcccgactggtagcaatggctacagctccagccaatggtgattcacagagtggtcctcagaggagctatcaggttgttgtggctgccacttgtgacctgggcattggtaaggatggggttttgccatggaagcttcctggtgaccttaagttcttcaaggagcttacacatgccacatctgaccctgccaagaaaaaatgcagttataatgggaaggaaaaacatgggagagcattcctgttaagttaaggccattgcctggtcgtttgaatgtcatacttactcgatctggtagttttgattttgcaacagtagaaaatgttgttatctgtggaagcatgaagtctgccttagaactgctagcgtcaactccatattgcttatcgattgagaaagttttgttataggggtgggcaggtactgagggagtatcttaatggacctgcatgtgaggccatccatctaactgacattcagtcgagcattgagtgtgacaccttcatccctcctattgacttctcagtgttccagccatggtattcatcttttccggtggtagagagcaacattaggcactcatttgtgacctttgttcgtgttagaaaatcagtgcaagaaactcatgagtcaaatggaaaggaatcaactgaagtcgatgccaagaatgacaagtttgaaactgagagtttctcttttctccccaagatgatatttgaccggcatgaggagtatcattatcttaatcttgttgaagatattataaggtctggtgcgcagaaaaatgacaggacaggaacaggaacattgtcaaaatttgggtgccaggtgcggttcaacttaaggaaaaattttcctctactgacaacaaagagggtattttggcgtggtgttgtcgaagaactcatgtggttcatcagtggttcaacaaatgcaaaggttctgcaagagaaaggtattcatatctgggatggcaatgcttcaagagagtatctagatagtgttggcttggcacacagggaggaaggtgatctaggtccagtttatggatttcaatggcggcactttggtgctgaatatacagacatgcatgctaactacactggcaaaggttttgatcagctaatggatgtgattgacaagatcaagaataatcctgatgaccggcgaataattttgtcggcatggaatccttcagatctcaagaagatggctcttcctccttgccacatgtttgcacaattttacgttgagaatggggagctatcctgccagatgtatcaacgctctgcagacatgggacttggtgttccattcaacattgcatcgtattctcttctcacatatatgattgctcaagtttgtgatctttctcctggggattttgtccatgttataggggatgcacatgtctacagaactcatgttcgagctttggaggagcaaattcagaagatgcctaagccattcccagttttgaagataaatccttcaaagaaggatatagattctttcgtggcatcagacttcaagctggttggctatgatcctcaccagaagatagagatgaaaatggcaatataatggtggcggcgcagctggagccccagcccgaggtcggcaaaattagtcggacagccactatattaaaattaaccggacatggcactagcttgtttttggtgatggtgccgaatgttcgttcactgggagacgtttcccaatccccagctcccctattcccgattgtactctggcttcttgtgtgaactctacgaatacgaaaccttctcttgcgcttcaggtcgtctggtcgttatggaaagagaggaacatgcgtgttcatgagagagttgtgcagctagtgttgcaggcaccacgtgtcttggaggaagcacggaggtgagccccggcgggttttgtcgggattggatcactcagtcgtcgtagattgcagctttagtctcgtgccttgtgtttgactttatccctttgttctgtaagattcgtgtatccagaatttttctcttaatgaatacgtgctatgca

SEQ ID NO: 3143 - DNA, 2574 bp, Zea mays
gaaggcacacagccgccgctgtttcttcatcttactcgtgctcggcacgcaggcgacggcgacggcggcggcgttcaggctcgggctctcagcgacggtatcagtggtctcccgcctctcgccagtcgcgtcgcgccctcgcctccgatcctctgcacaccgtccggtgaccttgtgttgtaagtttttccagcactgcttgctcacccatttctcaattagaaaacctcaaattctgtccctgagcaccaaatcaagaccataccaatttagtgagtccggacagatggcaatggccgcagttctggccaatggtgattcacagggtcgtcctcagaggaactatcaagttgttgttgctggcactcgtgacatgggcattgggaaggatggggtcttgccatggaagcttcctggtgatcttaaattctttaaagagcttacactaattacatctgatcctgtcaaaaagaatgcagttataatgggaaggaaaacatgggagagcattccagttaagtcaaggccattgcctggtcgtttgaatgtcatacttactcgatctggtagttttgattttgcaacagtagagaatgttgttatctgtggaagtatggagtctgccttagaactgctagcatcaactccatattgcttatcaattgagaaagtgtttgttataggaggcgggcaggtactgagagaatatcttaaaggacctgcatgtgaggctatccatctaactgacattcagtcgagcattgagtgtgacactttcatccctccggttgacttctcagtgttccagccatggtattcatctttcccggtgatagagagcaacattaggcattcgtttgtgtcttttgttcgtgttagaaagtcagtggcagaaactcatgagtcaaatggcaaggaatcaaccgaggttgataccaagaatgacaaatttgaaacagagaatttctcttttctccccaagatggtatatgaccgccatgaggagtaccaatatctcaatcttgttgaagatattataaggtctggtgctcagaaaaacgacaggacaggaactggaacattgtcaaaatttgggtgtcagatgcggttcaacttaaggaaaaattttcctctgctgacaacaaagagggtattttggcgtggtgttgtcgaagaactcctttggttcatcagtggctcaacaaatgcaaaggttttgcaagagaagggtattcatatctgggatggcaatgcttcaagagagtatctcaacagtgttggcttggcacacagggaggaaggtgatttaggtccaatttatggatttcagtggcgtcactttggtgctgaatacactgacatgcatgctgactatacgggaaaaggttttgatcagctaatggatgtgattgacaagatcaagaatgatcctgacgaccgtcgaataattttgtcggcgtggaatccttcagatctcaagaagatggctcttcctccttgccacatgtttgcacaattctatgtggaaaatggggagctatcttgccagatgtatcaacgctctgcagacatggggcttggtgttccattcaacatcgcatcatattctctcctgacatacatgattgctcaagtttgtgatctttctcctggagattttgtccatgttataggggatgcccatgtctatagaaaccatgttcgagcactggaggagcaaattcagaagatgcctaaaccatttccaattttgaagataaatccttcaaaaaaggatatagattcttttatggcatcagacttcaagctggttggctatgacccccaccagaagatagagatgaaaatggcagtgtaatggtggcttggctggagccccccatcctatggactcggtggatgtaatcagtaggactggtactacataaaaattaaccggacaccgcactagcttgtttttggtgatggtgctgaatgttcagtgggagacgttttctctgatttatcagttgcgatttgcgtactatggtcgcttaagtcaactctacaaaatcggctcccttttatctggagccagttgattactcgattgcgagtgtgagggatgatctaggcataccctgttgcaagggcctactgggtgtgtgccggcccccatgaggctgtgacgattgcgccagtccagtacctcgtgagaattatgtaaccgaagttgccgtgtacctgggagaactcccgtactgtttggtgtttgattgcctatttcactttgcagtttggtcacaagataacgacttgctggtagggttttgagaacacattctgttgcgtttttcttgtgctttctggggggcagaaagcctagcgccgtgcttgccgaagtcgggctagcgcttgcacttgcagcggcggtgtacgatttggttggagcgtgaagtctcaagtgatcctgcaactgtcctgtcagttaaactcaaagatgttggaaattgtagtacgatgcgacccctgcgagttttgtagagttgaccctctttcatttcattgtttttttaattcaaatcaagtttcgtt

SEQ ID NO: 3144 - DNA, 1842 bp, Pennisetum glaucum
tggggttttgccatggaagcttcctggtgaccttaagttcttcaaggagcttacacatgccacatctgaccctgccaagaaaaatgcagttataatgggaaggaaaacatgggagagcattcctgttaagttaaggccattgcctggtcgtttgaatgtcatacttactcgatctggtagttttgattttgcaacagtagaaaatgttgttatctgtggaagcatgaagtctgccttagaactgctagcgtcgactccatattgcttatcgattgagaaagtttttgttatagggggtggacaggtactgagggagtatcttaatggacctgcgtgtgaggccatccatctaactgacattcagtcgagcattgagtgtgacactttcatccctcctattgacttctcagtgttccacccatggtattcatcttttccggtggtagagagcaacattaggcattcatttgtgacctttgttcgtgttagaaaatcactggcagaaactcatgagtcaaatggaaaggaatcaactgaaattgataccaagaatgacaagtttgaaacagagaatttctcttttctccccaagatgatatttgaccggcatgaagagtatcattatcttaatcttgttgaagatattataaggtctggtgctcagaagagtgacaggacaggaacaggaacactgtcaaaatttgggtgtcagatgcggttcaacttaaggaaaaattttcctctgctgacaacaaagagggtattttggcgtggtgttgtcgaagagcttctgtggttcatcagtggttcaacaaatgcaaaggttctacaagagaaaggtattcatatttgggatggcaatgcttcaagagagtatcttgatagtgttggcttggcacacagggaggaaggtgatctaggtccagtttatggatttcaatggcgacactttggtgctgaatatacagacatgcatgctaactacactggaaaaggttttgatcagctaatggatgtgattgacaagatcaagaataatcctgatgaccgacggataattttgtcagcatggaatccttcagatctcaagaagatggctcttcctccttgccacatgtttgcacaattttacgttgagaatggggagctatcctgccagatgtatcaacgctctgcagacatgggacttggtgttccattcaacattgcatcgtattctcttctcacatacatgattgctcaagtttgtgatctttctcctggggattttgtccatgttataggggatgcacatgtctacagaactcatgttcgagctttggaggagcaaattcagaagatgcctaagccattcccaatattgaagataaatccttcaaagaaggatatagattctttcgtggcatccgacttcaagctggtcggctatgatcctcaccagaagatagagatgaaaatggcaatataatggtggctaaacctaaaaccctgagcccaagtcgaaatcagtcggactgctactatattaaaattaaccagacatcgcactagcttgtttttggtgatggtgctgaatgtttgctcactgggaggcgttccccacctcccctaattgccattgtactctggcatcttatctggactctacaaaacctgctccccttttatcgggagccggtgtcgatgactcgttgcgactgagagcctgctttttgggcaacgccatgttgcaagggtcgactggcgcgtgccccgcgagacgatgtattacctcgtgagataccccatgtcactgaattcgtctactacttggtaaacctcggtactgtttggtaaaaaaaa

SEQ ID NO: 3145 - DNA, 2593 bp, Oryza sativa
ttcactactttcaattcgtacaaaatccctcaaaaaaaaaaggaaagaaaaccccccttttcacactaacctctactctcccccgtctcagttcccgatctgcagcggcggaggagagagagacaccgccgccgccgccgccgccctccggcgaactcggccgggaggcgcacggcgtgggacggacaccagcaccaccctccctctcttcctctccttcctcaccccccaacccccgacccccgacccccgtctcggttcatccgcgcggcctccattccatctcggcggctcgaatccaaccgaaggttgcaagattttcgggcattagctgtgcacccatttctcaattcagaagacctcaatctctggagggcagcagaaaactaaggtcttgctgctttattcaaacccgactgatagccatggctacaactctctccaatggtgtttcacagaatggccctcagaggaactatcaggtagttgttgctgctactcgcgacatgggcattggaaaggatggggtcttgccatggaagctccttggcgaccttaaatttttcaaggagcttacagtgactacagctgatcctgtgaagaaaaatgctgttataatggggaggaaaacatgggagagtttaccccttaaggctaggccattgcctggccgtttgaacatcatattgactaggtctggtagttttgagtttgcaacagtcgaaaatgttgttatctgtggaagcatgaactctgcattggaactactatcatcaactccatactgtttatccattgagaaagtttttgttatagggggtggacaagtactaagggaatctcttaatggaccttcatgtgaggcagtccatttaactgacattcagtcaagcattgagtgtgacacctttattcctccgattgacttatcggtgttccaaccatggtattcatctttgcctgtggtagagagcaacattaggcattcgtttgtgacctatgttcgggttagaaaaacaatggcagaaacacatgactcaaatggcaaggaatcagctaatgatggtatcaagagtgacaaatttgaaaccgagaatttctcttttctccctaagttgatatttgaccgccatgaggagtatcactatctcaatcttgttgaagatattataaggagtggtgctcagaaaaatgacagaacaggaacagggacattatcgaaatttggttgtcagatgcggttcaacttaaggaatagcttcccattgttgacaacaaagaaggtattttggaggggtgttgttgaagaactcctgtggttcatcagtggctcgacaagtgcaaaggttttacaagagaaaggcattcatatttgggatggcaatgcttcgagagagtatcttgacagtgttggcttagcacatagggaagaaggtgatctaggtccagtttatggatttcaatggcgacactttggtgctgaatataccgacatgcatgctgactatactggtaaaggctttgatcagctaatggatgtgattgacaagatcaagaataatcctgacgataggcgaattatcctatctgcgtggaatccttcagatctcaagaagatggcccttcctccttgccacatgtttgcacaattttatgttgagagcggggagctatcgtgccagatgtatcaacgctctgctgatatgggacttggtgttccattcaacattgcatcatattctcttctgacatacatgattgctcatgtttgcggtctttctcctggagagtttgtccatgttattggtgatgcccatgtctatagaacacatgtgcgagctctggaggagcaaatccagaagctacctaaaccatttccagttttgaagattaaccctttgaagaaggatatagattctttcgtggcatcagacttcaagctggtcggttatgatcctcaccagaagattgaaatgaaaatggcaatataatttggtggctaagctgggacccccagtcactatgtgagcttggagaaacttaagcaggaaaaccttatgcgaacatcgcactagcttacttttttttttttagtggtggtgctggatgttcatttggacctatgttctccatttatccgcgattgtacttttatctcggtcgccgatctaaaccctacgaaaacaccggtcactggctcccccttttatttggacccagtgaatgatgttagagcttgtttcgagttgacaccatgttggaagaggccaaccgggcgttatgtgtagctcggcgatggatgtcatgtaccctgactgcgacacacattttggtcattttggtgaagcttcggagtgcctctggtgttgctggacgacacctactaattgtctccatctgagatttttctttccacatgtttggaacaccagatgatgggtgatgatgctgacctgtggatttggagttgttcagcatatgttggcactttttctgatgtttgtgaaatgagttgtgttgcgtgcttggaaattgcgcttggtggcggcgcttgcagcaaggactgaatgagatcttttgacactgacgttaa

SEQ ID NO: 3146 - DNA, 2353 bp, Zea mays
gacagccgccgccgtttcttcatcttcctcgcaacgccgacgctgcaacttccgctccctccccgactcgcgctcggcacgcaggcacgcgactgcggtggcgctcaggctcgggctctcagcaacggcggggcagtcccagactcagcgtctccctctcgccaatcgccttgcgccctcgctccgttcctctgctcaccggccgattctgcgttgcaagattttccagcatagcttgctcacctacttctcaatttagaagacctcaatttctggatctgagcatcaaatcaagaccataccactttagtcagtcctgtctgatggcactgactgcagctccagccagtggtgattcacagagtggtcctcagaggaactatcaggttgttgttgctgccacttgtgacatgggcattggcaagggtggggtattgccatggaagcttcttggtgatcttaaattcttcaaagaacttacactaactacaactgatcctgccaaaaagaatgcagttataatgggaaggaaaacatgggagagcattcctgttaagtcaaggccactgcctggtcgtttgaatgtcatacttactcgatctggtagttttgattttgcaacagtagagaatgttgttatatgtggaagtatgaaatctgccttagagctgctagcatcaactccatactgcttatcaattgagaaagtttttgtcataggaggtgggcaggtactgagagaatatttgaatggacctgcatgtgaggctatccatctgactgatattcagtcaagcattgagtgtgatactttcatccctccagttgacttttcagtgttccagccatggtattcatctttcccagtggtagagagcaacattaggcattcttttgtgacttttgttcgtgttagaaagtcagtggcagaaactcatgagtcaaatggcaaggaatcaactgagattgataccaagaatgacaaatttgaaatagagaatttctcttttctccccaagatagtatatgaccgccatgaggagtatcaatatctcaatcttgttgaagatattataaggttcggtgctcagaaaaatgacaggacaggaactggaacattgtcaaaatttgggtgtcagatgcgattcaacttaaggaaaaattttcctctgctgacaacaaagagggtgttttggcgtggtgttgtcgaagaactcctttggttcatcagtggctcaacaaatgcaaaggttttgcaagaaaagggtattcatatctgggatggcaatgcttcaagagagtatcttgaccgtattggcttggcacacagggaggaaggtgatctaggtccagtttatggatttcaatggcgacactttggtgccgaatatactgacatgcatgctgactatactggaaaaggctttgatcagctaatggatgtgattgacaagattaagaacaatcctgatgaccgccgaataattttatcggcgtggaatccttcagatctcaagaagatggctcttcctccttgccacatgtttgcacaattttatgtggagaacggggagctatcctgccagatgtatcaacgctctgcagacatggggcttggtgttccattcaacatcgcatcatattctcttttgacatatatgattgctcaagtttgtgatctttctccaggagattttgtccatgttataggggatgctcatgtctatagaaatcacgttcgagctctggaggaacagattcagaagatgcctaaaccatttccaattttgaagataaatccttcgaaaaaggatatagattctttcatggcgtcagacttcaagctggttggctatgatcctcaccagaagctagagatgaaaatggcagtgtaacggtggcttagctctggagcccccagccttggaacctcggtgggtgaaatcagtcgaacgaactggtactacataaaaaatgaaccggacatcgcactagcttgtttttggtgatggtgctgaatgttgtgcgggaggcgttttcccccgttattagtagcgatctgcgtgctatatatggtcgctgaagtcaaaattgtctctcttttattttttatctactactactactcatttgcgagtgagagatggtctgggcacaccattcaattgcaacggcctactggtgtgttgccccccaatgagggctgtgacgattgcgccactacctcgtgagaaacatgatgtgaccgaaattgctgtgtacctgcatggtagaacaacgcactctttggtatctggttgccttaatacgtgacctggttaattcagtttccagtttggatgggcacaagata

SEQ ID NO: 3147 - DNA, 2177 bp, Avena sativa
gatccaaaggcccacgccccaaaattccggcgcacccatcactcggtagcgagaggactgggactgggagtctgggagccagccctaacaaccgaatacgccgccgccgcaagtcttgacttgttcctcccagcgagcaacggcgagcggccgccgcccaccatcgccgacgactcccaattcaggccgcaaggtttttctgcattacttctactcctgttcctcggttcggaaaacgccaatatctggacaacatcagcagcctaagatcttgccacttcaatcaatctcggtggatagccatggcaaccgccctcgccaatggcgattcgcagaacagccttcagaggaactaccaggttgtcgttgctgctacgcgtgacatgggcattgggaaggatggggacttgccgtggaagcttcccagcgaccttaaattcttcaagaatgttacactgactacgtctgaccctgcgaagaagaatgcagttataatggggcggaaatcctgggacagcttaccacttaaagcaaggccgttacgtggtcgtttgaatgtcatattgactcgatctggtagttttgattttgcaacggccgagaatgttgttatctgtggaagcatgaactctgccctagaacttctagcatccactccatattgcttgtcaatcgagaaggtttttgtgataggaggtgggcagatactgatggaatggctgaatgcacctgcatgtgaggccatccatataactgacatcgagtcaaacattgagtgcgacactttcattcctccagttgacttctcggtgttccagccatggtgttcatctttgccagtaactgagagcaacattaggcattcttttgtgaccttcgttcgtgtgagaaaatcagttcctgaatcgaatggcaaggagtcaactgagcatgataccaagagtaacaagtttgaaatcgagaacttctcttttctccctaagatgatattcgatcgccatgaagagtattactacctcaaccttgttgatgatattataaggtgtggtgctcagaaaggtgacaggactgggacagggacattatctaaatttggttgccagatgcggttcaacctaaggaagagcttccccttgctgacaacaaagagggtgttttggcgtggtgttcttgaagaactgctgtggttcatcagtggctcgactaatgcaaaggttttgcaggaaaagggtattcatatatgggatggcaatgcgtcaagagaatatcttgatagtgtcgacctagcaaatagggaggaaggtgatttaggcccggtttatggattccaatggcgacactttggcgctgaatacacagacatgcatgctgactatactggaaaaggttttgatcagctaatggatgtgattgacaagatcaagaataatcccgacgatcggcggatcatcctgtctgcatggaatccttcagatctaaaaaagatggcccttcctccctgccacatgtttgcacaattttatgttgagaatggggagctatcgtgccagatgtaccaacgctctgcagacatgggacttggtgttccattcaacattgcatcatattcccttctgacatgcatgattgctcaagtttgtggtctctcccctggagatttcatccatgtcataggggacgcccacgtttacagaacgcacattcgagctttagaggagcagatccagaagcagcccaaaccgttcccaattctgaagataaaccctttgaagaaggatattgattcttttgtggcatcggacttcaagctggacagctacgacccgcacaagaagatagagatggagatggcgatatagtggtggctttagccggacccttggtccgagtttggaaacattaatccaactgctatagtatcagaatatcgcaccggctttttgttgggaggtgctgaaagttcattctgaggtgtaattgtactcgagttagatcgcgtatccctactctagaaaactacgtgtcccctttatttggagcatagtggtgactcgaatatggggagtgtttgagtgttgaaagggccaactggtttgtgcctcgcgatgatcgatatactgtatacccattagacctgaacttgtaggagatccacatcaagaattttattcaggaac

SEQ ID NO: 3148 - DNA, 1980 bp, Panicum virgatum
tacgctttcaacatctgaccctgccaagaagaatgcagttataatgggaaggaaaacatgggagagcattcctgttaagttgaggccattgcctggtcgtttgaatgtcatacttactcgatctggcagttttgattttgcaacagtagaaaatgttgttatctgcggaagcatgaagtctgccttagaacttctagcatcaactccatattgcttatcaattgagaaagtttttgttatagggggtgggcaggtactgagggagtatcttaatggacctgcatgtgaggccatccatctaactaacattcagttgagcattgagtgtgacactttcatcccaccaattgacttctcagtgttccaaccatggtattcatctttcccggtggtagaaagcaacattaggcattattttgtgacctttgttcgtgttagaaaatcactggcagaaactaatgactcagatggaaaggaatcaactgaggttgatagcaagaacggcaagtttggaatagaaaatttctcttttcttccgaagatgatatttgatcgccatgaggagtatcattatcttaatcttgttgaagatattataagatctggtgctcagaaaaatgacaggacaggaaccggaacattgtcaaaatttgggtgtcagatgcggttcaacttaaggaaaaattttcctctgctgacaacaaagagggtattttggcgtggtgttgtcgaagaactcctgtggtttgtcagtggttcaacaaatgcaaaggttctacaagagaaaggtattcatatctgggatggcaatgcttcaagagaatatcttgacagtgttggcttggcacaaagagaggaaggtgatctaggtccagtttacggatttcaatggcgacactttggtgctgaatatacagacatgcatgctgactacactggaaaaggttttgatcaactaatggatgtgattgacaagatcaagaataatcctgatgatcgtcgaataattttgtcggcatggaatccttcagatttgaagaagatggctcttcctccttgccacatgtttgcacaattttacgttgagaatggggagctatcctgccagatgtatcaacgctctgcagacatgggacttggtgttccattcaacattgcatcatattctctcctcacttacatgattgctcaagtttgtgatctttctcctggggattttgtccatgttataggggatgcacatgtctacagaactcatgtccgagctttggaggagcaaattcagaagatgccgaagccttttccaattttgaagataaatccttcaaagaaggacatagatacttttgtggcatcagacttcaagctggttggctatgatcctcaccagaagatagagatgaaaatggcgatataatggtgtctcagctggagtgccagcctaggagctcggcaaaattagttggactgctaccatactaaaaattaaccgaacatcgcactagcttgtttttggtgatggtgccgaatgttcgttccatgggagatgttccccacctccccggccaatttgtcattgtactatggttggcttatctgaactctacaacacacgctccccttttatcaggagctggtgttgatgactcaatgcgagtgagtgctgcttctgggcaacgccctgttgcaagggtcgactggtgtgtgccccggcgacgatttacttcatgtacctcgtgagatactcgtgtacttggtaaaactcggaactgtttgatgtctgcatgtgtgctgtctggtccactccctttcgccgtcagaaaacgtcaagcatgctcagaacatgtgctcaaccgtgttttatttcgcaagcatgtgcttggacatgcgagtggcgtgcttaagaaaggtactagctggtcgcagagtcgtgtctcgtgtgtttaccaaatccagcgtgtaaaataaaatattttgccc

SEQ ID NO: 3149 - DNA, 2022 bp, Brachypodium distachyon
tcaggtcacccggtttttcagcaagcgtatcatcccattttttgctttgcgaaggattaaatctgttgaagcaagcaacaaaccaaggttttaccgcttccaccaatctcaagcgatggccatgtttgcaaatgtcgccaatggcagttcatataatcctgatattcggaggaactatcaagtggtggttgctgcaacccatgagatgggcattgggaaggatggagcgttaccatggaaactgcctagtgatctaaatttttttaaggagcttacaatggccacatcagatccatcaaagaaaaatgcagtcataatgggaaggaaaacatgggaaagcatacctgctaagtttagaccactgcctggtcgcttgaatgttatactgactcgttctggtagttttgattttgcaacagtggagaatgttgttatatgtggaagcttggattcttccttggaactactagcatcaactccctacagcttaacaattgagaaagcttttttaatagggggtggccaggtgctgagggattctctaaatgcgccggcatgtgaggccatccatcttactgacatagagtcaaccattgaatgcgatacttacattcctcctattgatctatcggttttccacccttggtattcatcttttccagttgtggaaaacaacattaggcactctttcgtgacttttgtccgcgttagaaaaccagtaacagaagttaatgattcaaatggcaatgatgctaagaaggaaaggtttgaaataaagaatttttcatttctaccaaaaatgatctttgaaaggcatgatgagtatcagtatctcaaccttgttcaagatataatacagagtggtgcaagaaaaaatgacagaacaggaacaggaacattatcaaaatttggttgccagatgcggtttaacttgaggagaaactttccattactaacaacaaagagagtgttttggcgtggtgttcttgaagagcttctgtggttcatcagtggctcaacaaatgcaaaggttttacaggaaaaaggcattcatatatgggatggcaatgcttcaagggagtatcttgacagtattggtttatctcaaagagaggagggtgatttgggaccagtttatggatttcagtggagacacttcggtgctgaatataccgacatgcatgccgattatacaggaaaaggttatgatcagttaattgatgtcattaacaaaatcaggaataaccctgatgataggcgaatcattctttctgcatggaatccgacagatctcaagaagatggcacttccaccttgccacatgtttgcacagttttatgttgagaatggggagttatcatgtcagatgtatcaacgttctgctgatatgggccttggtgtaccattcaacattgcttcatattctcttctgacatgtatgattgcacaagtttgtgatctttctcctggagattttgtccatgttattggtgatgcccatgtctacagtacacatgttcgagctttggaggaacaaatcaagaagcagcctaagccatttcctattttgaagataaatcctgtgaagaaggatatcgattcatttgttgcatcggattttgaactggtttgctatgatcctcaccagaaaatagaaatgaagatggcagtataaggagtttccaacttagcatccaccattggtaccagtaatatgtcagctgttttttttttcagaagcaaagtttcgctttggtgctgccacatgtacttgtattatggatggtgtctttaatatttatttggatagttggatttgagtttcgttgacatccggtccagtggcatttgtgcttctaggtctctaggactcgagagccttgaggaatcttttgcaccctttggatatatgaatgggaagttagaagtatgatgactataatttcgggtcttcatttaattttgttaggtctggcctttgtatactaaaactgataggaattaggagttggttgattgtta

SEQ ID NO: 3150 - DNA, 1826 bp, Brachypodium distachyon
cgatggccatgtttgcaaatgtcgccaatggcagttcatataatcctgatattcggaggaactatcaagtggtggttgctgcaacccatgagatgggcattgggaaggatggagcgttaccatggaaactgcctagtgatctaaatttttttaaggagcttacaatggccacatcagatccatcaaagaaaaatgcagtcataatgggaaggaaaacatgggaaagcatacctgctaagtttagaccactgcctggtcgcttgaatgttatactgactcgttctggtagttttgattttgcaacagtggagaatgttgttatatgtggaagcttggattcttccttggaactactagcatcaactccctacagcttaacaattgagaaagcttttttaatagggggtggccaggtgctgagggattctctaaatgcgccggcatgtgaggccatccatcttactgacatagagtcaaccattgaatgcgatacttacattcctcctattgatctatcggttttccacccttggtattcatcttttccagttgtggaaaacaacattaggcactctttcgtgacttttgtccgcgttagaaaaccagtaacagaagttaatgattcaaatggcaatgatgctaagaaggaaaggtttgaaataaagaatttttcatttctaccaaaaatgatctttgaaaggcatgatgagtatcagtatctcaaccttgttcaagatataatacagagtggtgcaagaaaaaatgacagaacaggaacaggaacattatcaaaatttggttgccagatgcggtttaacttgaggagaaactttccattactaacaacaaagagagtgttttggcgtggtgttcttgaagagcttctgtggttcatcagtggctcaacaaatgcaaaggttttacaggaaaaaggcattcatatatgggatggcaatgcttcaagggagtatcttgacagtattggtttatctcaaagagaggagggtgatttgggaccagtttatggatttcagtggagacacttcggtgctgaatataccgacatgcatgccgattatacaggaaaaggttatgatcagttaattgatgtcattaacaaaatcaggaataaccctgatgataggcgaatcattctttctgcatggaatccgacagatctcaagaagatggcacttccaccttgccacatgtttgcacagttttatgttgagaatggggagttatcatgtcagatgtatcaacgttctgctgatatgggccttggtgtaccattcaacattgcttcatattctcttctgacatgtatgattgcacaagtttgtgatctttctcctggagattttgtccatgttattggtgatgcccatgtctacagtacacatgttcgagctttggaggaacaaatcaagaagcagcctaagccatttcctattttgaagataaatcctgtgaagaaggatatcgattcatttgttgcatcggattttgaactggtttgctatgatcctcaccagaaaatagaaatgaagatggcagtataaggagtttccaacttagcatccaccattggtaccagtaatatgtcagctgttttttttttcagaagcaaagtttcgctttggtgctgccacatgtacttgtattatggatggtgtctttaatatttatttggatagttggatttgagtttcgttgacatccggtccagtggcatttgtgcttctaggtctctaggactcgagagccttgaggaatcttttgcaccctttggatatatgaatgggaagttagaagtatgatgacta

SEQ ID NO: 3151 - DNA, 2028 bp, Oryza sativa
cccgccaaaaaaaagaaaaaaaaacgcggctcctcgcgcctccccccgaccaccacctcggcgattcgacggcgaccgctcgctgctggcctccgccggcttggtttcggctcgcggcgccatctcgggccacacattttttcagaaagagtaacatcctgatcttgagacttcaaagtctcaaatatcttgaattcagggacaaactcaatttctcccgctttcacaaatctcaagtgatagtcatgtctacaaatgttaacaatggtaactcagagagcaaccttaagagaagttatcaagttgtggtttctgctactcgcgacatgggtattgggaaggatgggacgctgccatggaagctgccgggtgacctgaagttttttaaagatattacagtgactacgtcagacccttcaaagaaaaatgctgttgtaatgggaaggaaaacatgggaaagcataccccttaagtttagaccactccctggtcgtttgaatgtaatattgactcgttctgggagttttgattttgcaactgcagaaaatgttgttatctgtgggagtttggattctgccttgcaactgctagcaacaactccatactgtttgacagttgagaaaacttttataataggaggtggcgagattctgaggcaatctttaaatgcgcctgcttgtgaggccatccatcttaccgacatagagtccagcattgaatgtgatactttcattcctccaattgatctctccatgttccacccatggtattcatcatttccagtggtagaaaacggcatcaagcattctttcatttcctttgttcgtgttacaaaatcaattgcagaagctaatgattctagtggcaaggaattgactggaaatgattctaagaaggtcaagtttgaaattgagaatttttcctttttacctaaaatgatatttgaaaggcacgaggagtatcaatatctcaatcttgttcaagatataataagaaatggtgctaagaaaaatgacagaacaggaacagggacagtatcaaagtttggttgccagatgcggttcaacttaaggaggaactttccattgctcacaacgaagagggtattttggcgtggtgttcttgaagagctattgtggttcattagtggctcaacaaatgcaaaggttttacaggagaaaggtattcacatatgggatggcaatgcttcaaggcagtatcttgacagtattggtttaacacaaagggaggagggggacttgggaccagtttatggatttcagtggagacactttggtgctgaatatactgacatgcatgctgactacgtgggaaaaggttttgatcagttaatggatgtcattgacaagatcaagaataatcccgatgatagaagaatcattttatctgcatggaatccaacagacctgaaaaagatggccctgccaccatgccacatgtttgctcagttttatgttgagaatggggagttgtcatgccagatgtaccaacgctctgctgatatggggctcggtgtgccattcaacattgcatcatattctcttctgacatgtatgattgcacaagtgtgtgatctttctcctggggattttgtccatgttataggtgatgcccatgtttaccgtacgcatgttgaagcgttagaggagcaaatgcggaagcagcctaaaccattccctattttgaagataaatcctgtgaagaaagatattgattcttttgtaacatcagacttcaaactggttcgctatgatcctcaccataagatagaaatgaagatggcagtatgagttggtagcttctatttgcagacttctgttgtatatttgatggcaaattgatatggttgattggattgaagtgccttgtcatcctgtcttacaaatatgtcttacaaattgatatatttgctgttgtactggatgattggtataagatggatcatttccaccgaatgcttccatccacagtgaagaagatgctaaaacgtttgaaaaattcaggaaa

SEQ ID NO: 3152 - DNA, 1868 bp, Triticum aestivum
acaccattgttgagcacgcgtaccaccacaatttctcgttggacaaggcataaatctcttgaggccatcaacaaactgaagtcttcctgcttccatcaatctcgaatgatggcaggtgtcacaaatggcaattcacacagtgatattcagagaaaatatcaagttgtggttgctgctacccgtgagatgggcattgggaaggacggagcattgccatggaagctgcctagtgaccttaagttttttaaggatctcacaatggctacagcagacccatcaaagaaaaatgctgttataatgggaaggaaaacatgggaaagcatacccactaagtttaggccattgcccggtcgcttgaatgttatactgactcgttcgggcagttctgattatgcaactgttgaaaatgttgtcacctgtggaagcttggattcttccttagaactactagcatcagctccctacagctcaacaattgagaaagcctttctaatagggggtggtcaggtactgagggaatcgctaaatgcatctgcatgtgaggccatccatcttactgacatagagtccaccattgagtgtgatactttcattcctcctattgatccattggtcttccacccatggtattcatcttctccagttgtggagaacaacattaggcattctttcgcgacctttgttcgcgttagaaagtcagcggaagaggctaatgattcaaatcccagtgaattaaccagcaatgatgctaagaaggaaaagtttgaaattcagaatttttcctttctaccaaaaatgatcttcgaaaagcatgatgaatatcagtatctcaatcttgttcaagatatattacgaagtggtgctcggaaaaatgacagaacaggaacaggaacaatatcaaaatttggttgtcagatgcggtttaacttgaggaagaattttccattacttacaacaaagagggtgttttggcgtggtgttcttgaagaactgttgtggttcatcagtggctcaacgaatgcaaaggttttacaggaaaaaaatattcgtatatgggatggcaatgcgtcaagggagtatcttgacagtattggtctatcacaaagagaggagggtgacttgggaccagtttatggatttcagtggagacacttcggtgctgaatatactgacatgcatgctgattatacggggaaaggttttgatcagttagctgatgtcattaacaagatcaagaataaccctgacgataggcgtatcattatgtctgcatggaatccaacagatctcaagaagatggcacttccaccttgccacatgtttgcacagttttatgtcgagaatggagaattatcctgtcagatgtatcaacgttcagctgacatggggcttggtgtaccattcaacattgcatcatattctcttctgacgtgtatgattgcacaagtttgtgatctttctcctggagagtttgtccatgtgatgggcgacgcccatgtctacagcacgcacgtccaagccttggaggaacaacttcagaagcagcccaagccatttcctattctgaagataaaccctctgaagaaggatatagactcgttcgtcgcgtcagacttcaagctggtctcctacgatcctcaccagaagatagagatgaagatggcagtataataaggagttgcatccaccggtagtaccagcatgtacgatatctaatgttgatgatgcctttgttaaaccatgattcgtgacgcaatctctaggcaacctttttcactgcgcgatcgatgccttggtggatccctggccatgggcataagctggggaatgaatgcaaaatagtgggatcttggttgctaccaacagcg

SEQ ID NO: 3153 - DNA, 2044 bp, Triticum aestivum
ctgcgacccacgcgtccgcgccaacgacagccgacgcctgccccctcctccgcttcctcctccccaccggcggcgagcgcgcgcggcaccgggggcgccgtctcagcagccaccggggcaagccggcacggtctcggccacaccatttttgagcacgcgtaccaccacaatttctcattggacaaggcataaatctcttgaggccatcaacaaactgaagtcttcctgcttccatcaatctcaaatgatggcaggtgtcacaaatggcaattcacacagtgatattcagagaaaatatcaagttgtggttgctgctacccgtgagatgggcattgggaaggacggagcattgccatggaagctgcctagtgaccttaagttttttaaggatctcacaatggctacagcagacccatcaaagaaaaatgctgttataatgggaaggaaaacatgggaaagcatacccactaagtttaggccattgcccggtcgcttgaatgttatactgactcgttcgggcagttctgattatgcaactgttgaaaatgttgtcacctgtggaagcttggattcttccctagaactactagcatcagctccctacagctcaacaattgagaaagcctttctaatagggggtggccaggtactgagggaatcgctaaatgcatctgcatgtgaggccatccatcttactgacatagagtccaccattgagtgtgatactttcattcctcctattgatccattggtcttccacccatggtattcatcttctccagttgtggagaacaacattaggcattctttcgcgacctttgttcgcgttagaaagtcagcagaagaggctaatgattcaaatctcagtgaattaaccagcaatgatgctaagaaggaaaagtttgaaattcagaatttttcctttctaccaaaaatgatcttcgaaaagcatgatgaatatcagtatctcaatcttgttcaagatatactacgaagtggtgctcggaaaaatgacagaacaggaacaggaacaatatcaaaatttggttgtcagatgcggtttaacttgaggaagaattttccattacttacaacaaagagggtgttttggcgtggtgttcttgaagaactgttgtggttcatcagtggctcaacgaatgcaaaggttttacaggaaaaaaatattcgtatatgggatggcaatgcgtcaagggagtatcttgacagtattggtctatcacaaagagaggagggtgacttgggaccagtttatggatttcagtggagacacttcggtgctgaatatactgacatgcatgctgattacacggggaaaggttttgatcagttagctgatgtcattaacaagatcaagaataaccctgacgataggcgtatcattatgtctgcatggaatccaacagatctcaagaagatggcacttccaccttgccacatgtttgcacagttttatgtcgagaatggagaattatcctgtcagatgtatcaacgttcagctgacatggggcttggtgtaccattcaacattgcatcatattctcttctgacgtgtatgattgcacaagtttgtgatctttctcctggagagtttgtccatgtgatgggcgacgcccatgtctacagcacgcacgtccaagccttggaggaacaacttcagaagcagcccaagccatttcctattctgaagataaaccctctgaagaaggatatagactcgttcgtcgcgtcagacttcaagctggtctcctacgatcctcaccagaagatagagatgaagatggcagtataataaggagttgcatccaccggtagtaccagcatgtacgatatctaatgttgatgatgcctttgttaaaccatgattcgtgacgcaatctctaggcaaccttttttcactgcgcgatcgatgcctttggtggatccctggccatgggcataagctggggaatgaatgcaaaatagtgggatcttggttgctaccaacagcgactagcgggttgtttatttctcattttgcgtttaa

SEQ ID NO: 3154 - DNA, 2589 bp, Triticum aestivum
acacagaggaagttttcagccgcttcgctagggtttgggcgcgcttgtttcccgccgcctccgccccaaaaaagcgagcaacagccgacgcctccccctcctcctcctcacccacggcggcgagcgcgtgcagcgtccgggggagccgtctctacagccaccgaggcaagcgccggcctcggccacaccatttttcagcacgcgtaccaccgcaatttctcgttggccaaggcttaaatctcttgaagccatcaacaaactgaagtcttcctgcttccatcaatctcaaatgatggcaggtgtcacaaatggcaattcacacagtgatattcagaggaaatatcaagttgtggttgctgctacccgtgagatgggcattgggaaggacggagcattgccatggaagctgcctagtgaccttaagttttttaaggatctcacaatggctacagcagacccatcaaagaaaaatgctgttataatgggaaggaaaacatgggaaagcatacccactaagtttaggccattgcccggtcgcttgaatgttatactgactcgttcgggcagttctgattatgcaactgttgaaaatgttgtaacctgtggaagcttggattcttccctagaactactagcatccgctccctacagctcaacaattgagaaagcctttctaataggtggtggccaggtactgagggaatcgttaaatgcatctgcatgtgaggccatccatcttactgacatagagtccaccattgagtgtgatactttcattcctcctattgatccattggtcttccacccatggtattcatcttctccagttgtggagaacaacattaggcattctttcgcgacctttgttcgcgttagaaagtcagcagaagaggctaatgattcaaatctcagtgaattaaccagcaatgatgctaagaaggaaaagtttgaaattcagaatttttcatttctaccaaaaatgatcttcgaaaagcatgatgagtatcagtatctcaatcttgttcaagatatactacgaagtggtgctcggaaaaatgacagaacaggaacaggaacaatatcaaaatttggttgtcagatgcggtttaacttgaggaagaattttccattacttacaacaaagagggtgttttggcgtggtgttcttgaagaactgttgtggttcatcagtggctcaacgaatgcaaaggttttacaggaaaaaatatccgtatatgggatgggaatgcgtcaagggagtatcttgacagtattggtctatcacaaagagaggagggtgacttgggaccagtttatggatttcagtggagacacttcggtgctgaatatactgacatgcatgctgattacacggggaaaggttttgatcagttagctgatgtcattaacaagatcaagaataaccctgacgataggcgtatcattatgtctgcatggaatccaacagatctcaagaagatggcacttccaccttgccacatgtttgcacagttttatgtcgagaatggagaattatcctgtcagatgtatcaacgttcagctgacatggggcttggtgtaccattcaacattgcatcatattctcttctgacgtgtatgcttgcacaagtttgtgatctttctcctggagagtttgtccatgtgatgggcgatgcccatgtgtacagcacgcacgtccaagccttggaggaacaacttcagaagcagcccaagccatttcctattctgaagataaaccctctgaagaaggatatagacgcgttcgtcgcgtcagactttaagctggtctcctacgacccgcaccagaagatagagatgaagatggcagtataaaccaaggagttagtcagcatccagcattcgcaccagcatacgatatgtatcgttgatggcgatgcctttattacaccatgattcgtgacggaatctctaggcaacctttttccactgagcgatcgatgccttggtggatccctggccatggcataagctggctggcgaatgtgtgcaaaatagtgggatcttggttgctaccagtagcggctagcgagttgtttatttctcattttgcatttccgaggttttaggttcttggcagtatgggtgcagtgattcgcgacgatggcagggtcatgttcatcaggtcgtccgtcgttgtcaactctggttgcatccacgccatcaattccatatcagacgagggacgacagccgtggcctccactgtcgaacaaactactcggtcgaatgaaaaaaagccttcgagagaaaccaagcaaggtcgaggacggcttcatcacaggttcacaagtcacaaagcttcttaactgctaagaaacaaacagtgcttagcgcctttccaaagcatattcattctgtcaaagcacccgtcaaaaaggtgctgctttacgaatcacggacgcactaattcgatgttcgtgactatacagccggaatgagcttcacgcaaaggatacataactttctaaaggctgttaaaaccagaggaagtctgttgattggcataagattcgaccaaagtcaacacggaacaaaatgttaacacatg

SEQ ID NO: 3155 - DNA, 1318 bp, Pennisetum glaucum
gcccattcccgcgtcgcccctcccgccgccgcctcgccgcgccgccgccgccgccggagaagatgggtcgcgtgatccgcgcgcagcgtaagggtgcgggctccgtgttcaagtcccacacccaccaccgcaagggccccgcccgcttccgctccctcgacttcggcgagcgcaacgggtacctcaagggtgtcgtcaccgacgtcatccacgaccccggccgcggtgcgccgctcgccaaggtcaccttccgccaccccttcaggtacaagcaccagaaggagctcttcgtcgccgccgagggaatgtacaccggccagttcgtctactgcgggcgccgcgccacgctctccatcggcaacgtgctgccgctacgcgggatccctgagggagccgtcgtctgcaacgtcgagcaccacgtcggcgaccgcggtgtcttcgccagggcctctggggactacgccatcgtcatcagccacaaccccgacaacggaacctccaggatcaagctcccctctggtgccaagaagattgtccccagcagctgccgtgccatgatcggtcaggttgctggtggaggcaggactgagaagcccatgcttaaggctggtaatgcctaccacaagtaccgtgtgaagaggaactgctggcctaaggtgcgtggtgtggccatgaaccccgtggagcatccccacggaggaggtaaccaccagcacattggtcacgcctcaaccgtccgccgtgacgcaccccccggccagaaggttggtctcattgctgccaggaggaccggtcgtctcaggggccaggctgctgccactgctgccaaggccgacaaggccacttagagttattgttatcgtatctttgtttatctatctctagatggttgaaggacatgtgttccagtatggatgtgttgcctggtactctggtgaaccattgtgtcagttttcttggtctctgtctggattttacattatgcctaaagaagtttttgcctggatattttgtgctcaatggtattggattggacgcgtcggttcatcttcggaagagactcaagctgcatataattaagaaggaaactaaagtttttgctgtgacatattcagatgatcagggccagcagagccttctcccactatgagttttggttcacataaaagttccttttttttgttaagggaagaatgaaagttcccttgcacttgtataatgcaccacgaaatttctttgcgctacacttttcggagagagttgtacttcactttcgcggcctgagcaagctcagattcttctaattagctttttgtac

SEQ ID NO: 3156 - DNA, 1064 bp, Pennisetum glaucum
gcgggctccgtgttcaagtcccattcccgcgtcgcccctcccgccgccgcctcgccgcgccgccgccgccgccggagaagatgggtcgcgtgatccgcgcgcagcgtaagggtgcgggctccgtgttcaagtcccacacccaccaccgcaagggccccgcccgcttccgctccctcgacttcggcgagcgcaacgggtacctcaagggcgtcgtcaccgacgtcatccacgaccccggccgcggcgcgccgctcgccaaggtcaccttccgccaccccttcaggtacaagcaccagaaggagctcttcgtcgccgccgagggcatgtacaccggccagttcgtctactgcggccgccgcgccacgctctccatcggcaacgtgctgccgctacgcggaatccctgagggagccgtcgtctgcaacgtcgagcaccacgtcggcgaccgcggtgtcttcgccagggcctctggggactacgccatcgtcatcagccacaaccccgacaacggaacctccaggatcaagctcccctctggtgccaagaagattgtccccagcagctgccgtgccatgatcggtcaggttgctggtggaggcaggactgagaagcccatgcttaaggctggtaatgcctaccacaagtaccgtgtgaagaggaactgctggcctaaggtgcgtggtgtggccatgaaccccgtggagcatccccacggaggaggtaaccaccagcacattggtcacgcctccaccgtccgccgtgacgcaccccccggccagaaggttggtctcattgctgccaggaggaccggtcgtctcaggggccaggctgctgccactgctgccaaggccgacaaggccacttagagttattgttatcgtatctttgtttatctatctctagatggttgaaggacatgtgttccagtatggatgtgttgcctggtactctggtgaaccattgtgtcagtgttcttggtctctgtctggattttacattatgcctaaagaagtttttgcctggatattttgtgctcaatggtattggtttgtgaggccatggaa

SEQ ID NO: 3157 - DNA, 1136 bp, Pennisetum glaucum
gcggtactcaacatccgacgccgccatatctcggccccccaaaccctaaccctcttcccttctttccctccggcgccgccaccccgcgtcgccgctgccgccgccgagatgggccgcgtgatccgcgcgcagcgtaagggtgcggggagcgtgttcaagtcccacacccaccaccgcaagggccccgcccggttccggtccctcgacttcggcgagcgcaacgggtacctcaagggcgtcgtcaccgatgtcatccacgaccccggccgcggcgcgccgctggccaaggtcaccttccgccacccgttccgctacaagcaccagaaggagctcttcgtcgccgccgagggcatgtacacgggccagttcgtctactgcgggcgccgcgccacgctctccatcggcaacgtgctgccgctcagggggatccccgagggtgccgtcgtctgcaacgtcgagcaccacgttggggaccgcggcgtcttcgccagggcgtccggggactacgccatcgtcatcagccacaacccggacaacggcacatcaaggatcaagctcccctcgggtgctaagaagattgtcccgagcagttgccgtgccatgattgggcaggttgctggtggtggcaggactgagaagccaatgttgaaggctggcaatgcctaccacaagtaccgcgtgaagaggaactgctggcctaaggtgcgtggtgtggccatgaaccctgttgagcatcctcacggaggaggtaaccaccagcacattggtcacgcctccaccgtccgtcgtgatgctcctcctggccagaaggttggtctcattgccgcaaggagaactggtcgtcttagaggccaagctgctgctactgctgccaaggctgataaggccacttaagtcagttagttttgccatatggagcataatctaccttatagattaaacatgatttactgcatggatgttaatttttgtgtcattttgatgagactgagcgtttatcagctttgtggctggctaatgttgagattttttggttctatataaacaagttgcaatgtgtgttatcgtattttatgcctagcgctctcagtgaccgctgatatttcctgaacacattgtggaatgcatctatcttt

SEQ ID NO: 3158 - DNA, 1277 bp, Sorghum bicolor
ccaccaccttcatatccaacggcccaccccgcccgtctatatccgcctccaaaccctacccttcttcattccttcccctccggcgccgccaccccagactctccgccgccggcaagatgggccgcgtgatccgcgctcagcgtaagggtgcggggtccgtgttcaagtcgcacacccaccaccgcaagggccctgcccggttccggtccctcgacttcggcgagcgcaacgggtacctcaagggcgtggtcaccgacgtcatccacgacccgggccgcggcgcgccgctggccaaggtcaccttccgccacccgttccgctacaagcaccagaaggagctcttcgtcgctgctgagggcatgtacacgggccagttcgtctactgcggacgccgtgctacgctctctatcggcaacgtcctgccgctcagggggatccccgagggtgccgtcgtctgcaacgttgagcaccacgttggggaccgcggcgtctttgccagggcgtctggggactacgctatcgtcatcagccataacccagacaacggcacatcaaggatcaagctcccgtctggtgctaagaagattgtcccaagtagctgccgtgccatgatcgggcaggtcgctggtggtggcaggactgagaagccaatgctgaaggctggcaatgcctaccacaagtaccgtgtgaagaggaactgctggcctaaggtgcgtggtgtggccatgaaccctgttgagcatcctcatggaggaggtaaccaccagcacattggtcatgcctccactgtccgccgtgatgctcctcctggccagaaggttggtctcattgccgcgaggaggactggtcgtcttaggggccaagctgctgctactgctgccaaggctgacaaggccacttaaactcgttaaattttctatatgcagcattagatatcttatagattaaaacatgtttggatcttaattttgtgtgtcattctgatgagcgatgaacatggacgtttcagtttttgtggcaagctactgatgagatttttgttctctttaatcaaagttgtactttatgttctcttgtttttgtctagttgttacaaaacttaagtacttcattccaaactgtattttgttctggttttctagatacataacttttgctacgcacctagatatatggtaaaagctgtgtatctacaaaagccataataacttacaatttggaacatgggatatttcataatctgtacactgatatgcatttattttctcagtttttcc

SEQ ID NO: 3159 - DNA, 1321 bp, Sorghum bicolor
aaattttgcgaactgcctaacccgttggccccattccgcaaaagccaccaccttcatatccaacggcccaccccgcccgtctatatccgcctccaaaccctacccttcttcattccttcccctccggcgccgccaccccagactctccgccgccggcaagatgggccgcgtgatccgcgctcagcgtaagggtgcggggtccgtgttcaagtcgcacacccaccaccgcaagggccctgcccggttccggtccctcgacttcggcgagcgcaacgggtacctcaagggcgtggtcaccgacgtcatccacgacccgggccgcggcgcgccgctggccaaggtcaccttccgccacccgttccgctacaagcaccagaaggagctcttcgtcgctgctgagggcatgtacacgggccagttcgtctactgcggacgccgtgctacgctctctatcggcaacgtcctgccgctcagggggatccccgagggtgccgtcgtctgcaacgttgagcaccacgttggggaccgcggcgtctttgccagggcgtctggggactacgctatcgtcatcagccataacccagacaacggcacatcaaggatcaagctcccgtctggtgctaagaagattgtcccaagtagctgccgtgccatgatcgggcaggtcgctggtggtggcaggactgagaagccaatgctgaaggctggcaatgcctaccacaagtaccgtgtgaagaggaactgctggcctaaggtgcgtggtgtggccatgaaccctgttgagcatcctcatggaggaggtaaccaccagcacattggtcatgcctccactgtccgccgtgatgctcctcctggccagaaggttggtctcattgccgcgaggaggactggtcgtcttaggggccaagctgctgctactgctgccaaggctgacaaggccacttaaactcgttaaattttctatatgcagcattagatatcttatagattaaaacatgtttggatcttaattttgtgtgtcattctgatgagcgatgaacatggacgtttcagtttttgtggcaagctactgatgagatttttgttctctttaatcaaagttgtactttatgttctcttgtttttgtctagttgttacaaaacttaagtacttcattccaaactgtattttgttctggttttctagatacataacttttgctacgcacctagatatatggtaaaagctgtgtatctacaaaagccataataacttacaatttggaacatgggatatttcataatctgtacactgatatgcatttattttctcagtttttcc

SEQ ID NO: 3160 - DNA, 1421 bp, Sorghum bicolor
tcacactgacacgtcggtcccaccactaatcggacggtccaaaccagccgtgaaccccatctccaccgtccgccctagggtaaccctcccagtttcccgaccgcgcactatataaacctctctcttctccctcgtccaaccctagccgcagcgcgctcatttccgcgttccccctcccgcctcgccgcgccgccgccgccaccgccggagaagatgggtcgcgtgatccgcgcgcagcgtaagggtgcggggtccgtcttcaagtcccacacccaccaccgcaagggccccgcccggttccgctccctcgacttcggcgagcgcaacgggtacctcaagggcgtcgtcaccgacgtcatccacgacccgggccgcggcgcgccgctcgccaaggtcaccttccgccaccccttcaggtacaagcaccagaaggagctcttcgtcgccgccgagggcatgtacacgggccagttcgtctactgcggccgccgcgccacgctctccatcggcaacgtcctgccgctccgcgggatccccgagggtgccgtcgtctgcaacgtcgagcaccacgtcggtgaccgtggtgtcttcgccagggcctctggggactacgccatcgtgatcagccacaaccctgacaacggcacctcgaggattaagctaccctctggtgccaagaagattgtccccagcagctgccgtgccatgattgggcaggtcgctggtggaggcaggactgagaagccgatgctgaaggctggtaacgcgtaccacaagtaccgtgtgaagaggaactgctggcctaaggtgcgtggtgtggccatgaaccctgtggagcatccccacggaggaggtaaccaccagcacattggtcacgcctccaccgtccgccgtgacgctccccctggccagaaggtcggtctcattgctgccaggaggactggaaggctcaggggacaggctgctgccactgccgccaaggctgacaaggccacctagagttgttatcgtcgttcttgtttatctatctctctgctgtgctttagacggttaaaggacatgagtttcagtatgaatgtgttgttgcctagtactatggtgaaacattgtgtcagttttttgtggtcgctgtctggattttccattatgcctaaagaagattacatggatgttttgatgctaaattatatttgcccgtcaggccctggccctctttgctttgtttcaattgttgtagaattgttgatttcaaacaaatgtaagttgtaacttgtttggctttataagtgctgagggggcacagcattctttgcttgaacggctagagaatgagcatctgtgcccatctccgtccgatgctatatgttggatacatcttgtgactttgagcttgagaaatttcaccagtcgcgagacccgag

SEQ ID NO: 3161 - DNA, 1012 bp, Saccharum officinarum
ttcattccttcccctccggcgccgccacccccagactctctctccgccgccggcaagatgggccgcgtgatccgcgctcagcgcaagggtgcggggtccgtgttcaagtcccacacccaccaccgcaagggccctgcccggttccggtccctcgacttcggcgagcgcaacgggtacctcaagggcgtggtcaccgacgtcatccacgacccgggccgcggcgcgccgctggccaaggtcaccttccgccacccgttccgctacaagcaccagaaggagctcttcgtcgctgccgagggcatgtacacgggccagttcgtctactgcggacgccgtgctacgctctccatcggcaatgtcctgccgctcagggggatccccgagggtgccgtcgtctgcaacgttgagcaccacgtcggggaccgcggcgtctttgccagggcgtctggggactacgcgatcgtcatcagccataacccagacaacggcacatcaaggatcaagcttccctctggtgctaagaagattgtcccaagtagctgccgtgccatgattgggcaggtcgctggtggtggcaggactgagaagccaatgctgaaggctggcaatgcctaccacaagtaccgtgtgaagaggaactgctggcctaaggtgcgtggtgtggccatgaaccctgttgagcatcctcatggaggaggtaaccatcagcacattggtcatgcctccactgtccgccgtgatgctccgcctggccagaaggttggtctcattgctgcaaggaggactggccgtcttaggggtcaagctgctgctactgctgccaaggctgacaaagccacttaaactcgttaaattttccatatgcaggattagatatcttatagattaaaacatgtttggatcttaattttgtgtcattttgatgagtgatgaactgattataccatggacgtttcagtttttgtggcaagctactgatgagatttttgttctctttaatcaaagttgtact

SEQ ID NO: 3162 - DNA, 1474 bp, Sorghum bicolor
cccactcctcctcccgcaacatctctcacactgacacgtcggtcccaccactaatcggacggtccaaaccagccgtgaaccccatctccaccgtccgccctagggtaaccctcccagtttcccgaccgcgcactatataaacctctctcttctccctcgtccaaccctagccgcagcgcgctcatttccgcgttccccctcccgcctcgccgcgccgccgccgccaccgccggagaagatgggtcgcgtgatccgcgcgcagcgtaagggtgcggggtccgtcttcaagtcccacacccaccaccgcaagggccccgcccggttccgctccctcgacttcggcgagcgcaacgggtacctcaagggcgtcgtcaccgacgtcatccacgacccgggccgcggcgcgccgctcgccaaggtcaccttccgccaccccttcaggtacaagcaccagaaggagctcttcgtcgccgccgagggcatgtacacgggccagttcgtctactgcggccgccgcgccacgctctccatcggcaacgtcctgccgctccgcgggatccccgagggtgccgtcgtctgcaacgtcgagcaccacgtcggtgaccgtggtgtcttcgccagggcctctggggactacgccatcgtgatcagccacaaccctgacaacggcacctcgaggattaagctaccctctggtgccaagaagattgtccccagcagctgccgtgccatgattgggcaggtcgctggtggaggcaggactgagaagccgatgctgaaggctggtaacgcgtaccacaagtaccgtgtgaagaggaactgctggcctaaggtgcgtggtgtggccatgaaccctgtggagcatccccacggaggaggtaaccaccagcacattggtcacgcctccaccgtccgccgtgacgctccccctggccagaaggtcggtctcattgctgccaggaggactggaaggctcaggggacaggctgctgccactgccgccaaggctgacaaggccacctagagttgttatcgtcgttcttgtttatctatctctctgctgtgctttagacggttaaaggacatgagtttcagtatgaatgtgttgttgcctagtactatggtgaaacattgtgtcagttttttgtggtcgctgtctggattttccattatgcctaaagaagattacatggatgttttgatgctaaattatatttgcccgtcaggccctggccctctttgctttgtttcaattgttgtagaattgttgatttcaaacaaatgtaagttgtaacttgtttggctttataagtgctgagggggcacagcattctttgcttgaacggctagagaatgagcatctgtgcccatctccgtccgatgctatatgttggatacatcttgtgactttgagcttgagaaatttcaccagtcgcgagacccgagtacttacccctctcaatttgaaatcccg

SEQ ID NO: 3163 - DNA, 1043 bp, Sorghum bicolor
aaccctagccgcagcgcgctcatttccgcgttccccctcccgcctcgccgcgccgccgccgccaccgccggagaagatgggtcgcgtgatccgcgcgcagcgtaagggtgcggggtccgtcttcaagtcccacacccaccaccgcaagggccccgcccggttccgctccctcgacttcggcgagcgcaacgggtacctcaagggcgtcgtcaccgacgtcatccacgacccgggccgcggcgcgccgctcgccaaggtcaccttccgccaccccttcaggtacaagcaccagaaggagctcttcgtcgccgccgagggcatgtacacgggccagttcgtctactgcggccgccgcgccacgctctccatcggcaacgtcctgccgctccgcgggatccccgagggtgccgtcgtctgcaacgtcgagcaccacgtcggtgaccgtggtgtcttcgccagggcctctggggactacgccatcgtgatcagccacaaccctgacaacggcacctcgaggtaggattaagctaccctctggtgccaagaagattgtccccagcagctgccgtgccatgattgggcaggtcgctggtggaggcaggactgagaagccgatgctgaaggctggtaacgcgtaccacaagtaccgtgtgaagaggaactgctggcctaaggtgcgtggtgtggccatgaaccctgtggagcatccccacggaggaggtaaccaccagcacattggtcacgcctccaccgtccgccgtgacgctccccctggccagaaggtcggtctcattgctgccaggaggactggaaggctcaggggacaggctgctgccactgccgccaaggctgacaaggccacctagagttgttatcgtcgttcttgtttatctatctctctgctgtgctttagacggttaaaggacatgagtttcagtatgaatgtgttgttgcctagtactatggtgaaacattgtgtcagttttttgtggtcgctgtctggattttccattatgcctaaagaagattacatggatgttttg

SEQ ID NO: 3164 - DNA, 1046 bp, Sorghum bicolor
catcaaaacatccatgtaatcttctttaggcataatggaaaatccagacagcgaccacaaaaaactgacacaatgtttcaccatagtactaggcaacaacacattcatactgaaactcatgtcctttaaccgtctaaagcacagcagagagatagataaacaagaacgacgataacaactctaggtggccttgtcagccttggcggcagtggcagcagcctgtcccctgagccttccagtcctcctggcagcaatgagaccgaccttctggccagggggagcgtcacggcggacggtggaggcgtgaccaatgtgctggtggttacctcctccgtggggatgctccacagggttcatggccacaccacgcaccttaggccagcagttcctcttcacacggtacttgtggtacgcgttaccagccttcagcatcggcttctcagtcctgcctccaccagcgacctgcccaatcatggcacggcagctgctggggacaatcttcttggcaccagagggtagcttaatcctacctcgaggtgccgttgtcagggttgtggctgatcacgatggcgtagtccccagaggccctggcgaagacaccacggtcaccgacgtggtgctcgacgttgcagacgacggcaccctcggggatcccgcggagcggcaggacgttgccgatggagagcgtggcgcggcggccgcagtagacgaactggcccgtgtacatgccctcggcggcgacgaagagctccttctggtgcttgtacctgaaggggtggcggaaggtgaccttggcgagcggcgcgccgcggcccgggtcgtggatgacgtcggtgacgacgcccttgaggtacccgttgcgctcgccgaagtcgagggagcggaaccgggcggggcccttgcggtggtgggtgtgggacttgaagacggaccccgcacccttacgctgcgcgcggatcacgcgacccatcttctccggcggtggcggcggcggcgcggcgaggcgggagggggaacgcggaaatgagcgcgctgcggctagggtt

SEQ ID NO: 3165 - DNA, 1311 bp, Zea mays
gcactatataatgctctctcttctctctcgtccaacgctagccgcaccgcgctcacttccgcaccctcttcccgccgcgccgccgccgccgccgcttcctccccgccgccgggcaagatgggtcgcgtgatccgcgcgcagcgtaagggtgcgggatccgtgttcaagtcccacacccaccaccgcaagggccccgcccggttccgctccctcgacttcggcgagcgcaacgggtacctcaagggcgtagtcaccgacgtgatccacgaccccggacgcggcgccccgctcgccaaggtcaccttccgccaccccttcaggtacaagcaccagaaggagctcttcgtcgccgccgagggcatgtacaccggccagttcgtttactgcggccgccgcgccacgctctccatcggcaacgtcctgccgctccgcgggatccccgagggtgccgtcgtctgcaacgtcgagcaccacgttggtgaccgcggtgtcttcgccagggcctctggggactacgccatcgtgatcagccacaaccctgacaacggaacctcgaggatcaagctgccatctggtgccaagaaaattgtccccagcagctgccgtgccatgattgggcaggttgccggtggtggcaggactgagaagccgatgctgaaggctggcaacgcctaccacaagtaccgtgtgaagaggaacagctggcccaaggtccgtggtgtggccatgaaccccgtggagcatccccacggaggaggtaaccaccagcatatcggtcacgcctctactgtccgccgcgatgctccccctggccagaaggtcggtctcattgcggctaggaggactggaaggctcagaggccaggctgctgccacagcctccaaggctgacaaggccacctagagtattgttgttgttttatctatccctctgctgtgatttattagatggttaaaaggacgtgttccggtatggatggtactatggtgaaacattgtgtcagtttttgtggtatctgtatggattttcaagtatgcctaaagaagtttttggtgctcaatgatatatgcctcttttctcagtttgcattttggtttgttgttgtagaattgttgaacggttgtctccgatcgtgtaatttctgagttccttaacgttggttgtgcatggtttgtcaaacaaatgtaagtggtaattaccctgaacttcattacggctgagttatagagattgttggaactgggaggtgcttgatagacggctggacagattttgagcctagaaatttaaatttcaacacagttctcccta

SEQ ID NO: 3166 - DNA, 1204 bp, Zea mays
ttagtccattacccaccgaaggccccgcccaaccaccttcgtatccgacggcccaccccgctcgtctatatccgcctccaaaccctagctcttccattcttccccctccggcgccgcctcccccagacacttcgccgccggcaagatgggccgcgtgattcgcgctcagcgcaagggtgcggggtccgtgttcaagtcccatacccatcaccgcaagggccctgcccggttccggtccctcgacttcggcgagcgcaacgggtacctgaagggcgtggtcaccgacgtcatccacgacccgggccgcggcgcgccgctggccaaggtcaccttccgccatccattccggtacaagcaccagaaggagctgttcgtggctgctgagggcatgtacactggccagttcgtttactgcggacgccgtgctacactctccattggcaacgtcctgccgctcagggggatccctgagggtgccgttgtctgcaacgttgagcaccacgtcggggatcgcggtgtcttcgccagggcgtctggggactacgcgatcgttatcagccataacccagacaacggcacatcgaggatcaagctcccctctggtgctaagaagattgtcccaagtagctgccgtgccatgattgggcaggtcgctggtggtggcaggactgagaagccaatgctgaaggctggcaatgcctaccacaagtaccgcgtcaagaggaacagctggcctaaggtgcgtggtgtggccatgaaccctgttgagcatcctcatggaggaggtaaccaccagcacattggtcatgcctccactgtccgccgtgatgctcctcctggccagaaggttggtcttattgccgcaaggagaactggtcgtcttaggggccaagctgctgctactgctgccaaggctgacaaggcctaaatttgcgttacgcagcattagccatcttatatagattaaaaatatttttcctgcatggatcttaattttgtatcattctgatagcgatgaactgatgatactatggaccttccagtttttgttgcaagctattgatgatattttttcttctttaatcaaagttgtactatatgttgtgctgtttttgtctagctgctacaaaacttaggtactccttcctgcactttttattgacaatacgcagcattagccatcttatgttgtgcatttttttcc

SEQ ID NO: 3167 - DNA, 1349 bp, Zea mays
cccatccctcctcccgcagcctctctgtctctcgctcattataatcacactgacacgacggtcccagcactcatcggacggtccaaaccagccgtgaacccatctccaccgtccgccctagggtaaccctcctcaaccccgatcattcactatatatataattctctctcttctcccacctccaaccctagccgcactgcgctcatttctgcatccccctcccgccgcgccgcctcaccgccgccggagaagatgggtcgcgtgatccgcgcgcagcgtaagggtgcggggtccgtgttcaagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctctccatcggcaacgtgctgcccctccgcgggatccctgagggtgccgtcgtctgcaacgtcgagcaccacgtcggtgaccgcggtgtcttcgccagggcctctggggactacgccattgtgatcagccacaaccctgacaacggcacatcgaggattaagctgccctctggcgccaagaagattgtccccagcagctgccgtgctatgattgggcaggttgctggtggaggcaggactgagaagccgatgctcaaggctggtaacgcgtaccacaagtaccgtgtgaagaggaacagctggcccaaggtgcgtggtgtggccatgaaccctgtggagcatccccacggaggaggtaaccaccaacacatcggtcacgcctctactgtccgccgagacgctccccctggccagaaggttggtctcattgccgctaggaggactggaaggctcaggggtcaagctgctgccacagcctccaaggctgacaaggccacctagagttattgtcgttgtttatctgtctactgtgctttagattgttaaaggacatgtgtttcagaacggatgtgttgttgcctcgtactatggtgaaacattgtctcagtttttgtggtcgctgtcaggattttgcattatgcctaaagatgtttactttggatatttttgtgttaaaatggtactgtattggatatgcctcccttgcttcgttttattttggcctttgtagaattgttgagcggttgtctctttgcgtgggatcgtgtaatttctgagttgctggaacgttggcaatacatggtttccgtcga

SEQ ID NO: 3168 - DNA, 2701 bp, Oryza sativa
attacactgacaaatccgcccccacgaatccaacggcccagatcaaccccaccctccatcccagccgtccacgctagggctatccctccccgaaaccccccacgccgacctctatataaaccggagaccttctccctcctccaaccctagccacccccgcctcccccattctccccgccgccgccgccgccgtctcgccgccgacgaggagatgggtcgcgtgatccgcgcgcagcgtaagggtgcgggctccgtgttcaagtcccacacccaccaccgcaagggccccgcgaggttccgctccctcgacttcggcgagcgcaacggctacctcaagggcgtcgtcaccgacatcatccacgaccccggccgcggcgcgccgctcgccaaggtgacgttccgccacccgttccggtacaagcaccagaaggagctgttcgtcgcggcggaggggatgtacacggggcagttcgtctactgcggccgccgcgccacgctctccatcggcaacgtgctcccgatccggtcggtacccgagggcgccgtggtctgcaacgtcgagcaccacgtcggcgaccgcggcgtcttcgccagggcgtccggcgactacgccatcgtcatcagccacaaccccgataacggcacatccaggatcaagctcccctctggtgccaagaagattgtccccagcagctgccgtgccatgatcggtcaggttgctggtggtggcaggactgagaagccgatgctcaaggctggaaacgcctaccacaagtaccgcgtgaagaggaactgctggcctaaggtgcgtggtgtggccatgaaccccgttgagcatccccacggaggaggtaaccaccagcacattggtcacgcctccaccgtccgccgtgatgcacctcctggccagaaggttggtctcatcgctgcaaggaggactggtcgtctcagaggccaggccgccgctaccgctgccaaggccgacaaggccacttagagtgttacttattgttgctactatccatattcgctaccatgcttatcatcgctagattaaaggacatgtattccagtatggtcgtgctttttgcttggtactctggtcacatttgtgatgaatgttcgcagttttcgtggtcatggtctggattctacattccacctaaagaagtttttacctggttatttaatccttgagttgttgaattagctcatggtaattgtcagtagtcttccacttggttctctctgtggatgatcgttcttgttctctgtttgcgctgtggctgattgttctcatgtttttaaggtttttgggttagtcactggtcgcttcgtcactgtgagccaaaccatatgccggtagttttcttcttcaccatcatccgtttgatcctgactcgcggatctcctaatccaacttctctcttttttttttttaatccaaactcacccaacgttggaaacatagcttggaaccccttgaaattgaacagaatttatagcaggcaaaaatgtaagaaaccacgctagtgtagcaggcttacagcggggcaaagcagcttttgttaagcaaccacttacgttagagattcagagataagcgatgttactttgtttttaccaacatttacatacaagcggtacaacacatattgccagaaaccacttggttttccagccataatttttgacaattcatgacgcgcgcgcgcacacacaatgctggattcacagggtcacacagccatgagccatcagactggaagggctctgtttgttcatcacatagtcacagatcgccttggcctttagcagttgcaggggttgcacttgcagctggaaccacagctgcagccatgggcaccctcaccagattcagctgctttgccaactccctcaaattgcctgcaaagaaataaatcaaattcaggagcgaacagtttcaggcatggaaagataacatcttcagcttttcttcagcatatggtcacatgtctgaatctcagacaggagttcccttcagtttagtttttttatcaaggaaaagattcatagatatcaatatatcataccccttctcaggtgcaacaccgaggacagtggttgtagtagtagtggtgatggtgatcttctcagccaggtcagggtacatctttctgaaccaagaaacaaaaagtagaacatgagatgattcggtaaccagaaatgaaaaatctcttctcatcttgtgggtagcttcatctgaatattactccaaaccaatgggaggaggcaacacaggagatggaagagtatatgcttttatcatggaaaatacatcaaaatcacctgaactaattgggtgtatctctgaattctgaaagcttatgccagtttagcttgataaatacatagcaaaacatattcagaatcagtagctgaagattgaacgtacccgcagccaccgctgcatccgcaggaaccacagttgcaacttccaccgcacgacatcttgatcttctgggtcacttgtaaactcttcaggaacttgtatagttggatgaaatgagagattgaaagctcgatatgaactcagttcaatatgcccccctatttatagtagtagtacgcttgagaagaagctgcagaattatgtcaagcattatcttgccagaaagatgtagctggttgaaatggccttgaaaaatcattatcattc

SEQ ID NO: 3169 - DNA, 1308 bp, Brachypodium distachyon
cttccgaaacaaatccaacggcccaaacccacccctatcccccatctcggccgtccgcgctagggtaatcgatcgcgaaacctgccccatcctatataaagctctgccttctccctcctccaaccctagccgcacccagctccccatccccctcaccgccgccactgcgccgctgccgccaccgccgccgagatgggtcgcgtgatccgcgcgcagcgtaagggtgcgggctccgtgttcaagtcgcacacccaccaccgcaagggcccggcgcgcttccgttcgctcgacttcggcgagcgcaacgggtacctcaagggcgtcgtcaccgacgtcatccacgacccggggcgtggcgcgccgctcgccaaggtgaccttccgccaccccttcaggtacaagcaccagaaggagctcttcgtcgccgcggagggcatgtacaccggccagttcgtctactgcggacgccgcgccacgctctccgtcggcaacgtcctcccgctccgctccgtgcccgagggaggcgtcatctgcaacgtcgagcaccatgtcggcgaccgcggcgtcttcgccagggcctccggggactacgccatcgtcatcagccacaaccctgacaacggcacctcaaggatcaagctcccctctggtgccaagaagattgtcccaagcagctgccgtgccatgattggtcaggttgctggtggaggcaggactgagaagccaatgctcaaggctggtaatgcctaccacaagtaccgcgtgaagaggaactgctggcctaaggtgcgtggtgtggccatgaaccctgtggagcatccccacggaggaggtaaccaccagcatattggtcatgcctccactgtccgccgtgatgcaccccctggccagaaggttggtctcattgctgccaggaggactggtcgtctcagaggccaggctgctgcctctgctgccaaggctgacaaggccacttagagttatcgtcgctgtttatctatatttgctcccgtgctcgcctctagattacccctcaaggacatgtattccattatggatgtggtttttgctcggtactttggtaacctggacatgtttgttatcagttttcgcagttgtggtctggattcttcattccacataaagaagattatgcttggatattttgtgttgtcattctatcaggctctgttgctcggtcaaatctgttggatgtctaacttgctagttctgtggtctggattcttcattcgcatgaagattcttcatcacataaagaagactatgcttggatttgttgatgcgtgt

SEQ ID NO: 3170 - DNA, 1060 bp, Brachypodium distachyon
aaccctagccgcacccagctccccatccccctcaccgccgccactgcgccgctgccgccaccgccgccgagatgggtcgcgtgatccgcgcgcagcgtaagggtgcgggctccgtgttcaagtcgcacacccaccaccgcaagggcccggcgcgcttccgttcgctcgacttcggcgagcgcaacgggtacctcaagggcgtcgtcaccgacgtcatccacgacccggggcgtggcgcgccgctcgccaaggtgaccttccgccaccccttcaggtacaagcaccagaaggagctcttcgtcgccgcggagggcatgtacaccggccagttcgtctactgcggacgccgcgccacgctctccgtcggcaacgtcctcccgctccgctccgtgcccgagggaggcgtcatctgcaacgtcgagcaccatgtcggcgaccgcggcgtcttcgccagggcctccggggactacgccatcgtcatcagccacaaccctgacaacggcacctcaaggatcaagctcccctctggtgccaagaagattgtcccaagcagctgccgtgccatgattggtcaggttgctggtggaggcaggactgagaagccaatgctcaaggctggtaatgcctaccacaagtaccgcgtgaagaggaactgctggcctaaggtgcgtggtgtggccatgaaccctgtggagcatccccacggaggaggtaaccaccagcatattggtcatgcctccactgtccgccgtgatgcaccccctggccagaaggttggtctcattgctgccaggaggactggtcgtctcagaggccaggctgctgcctctgctgccaaggctgacaaggccacttagagttatcgtcgctgtttatctatatttgctcccgtgctcgcctctagattacccctcaaggacatgtattccattatggatgtggtttttgctcggtactttggtaacctggacatgtttgttatcagttttcgcagttgtggtctggattcttcattccacataaagaagattatgcttggatattttgtgttgtcattcta

SEQ ID NO: 3171 - DNA, 985 bp, Avena sativa
cgccgccgccgccgagatgggtcgcgtgatccgcgctcagcgtaagggtgccggctccgtcttcaagtctcacacccaccaccgcaagggccctgcccgcttccgctcgctcgacttcggcgagcgcaatgggtacctcaagggcgtcgtcaccgacgtcatccacgacccggggcgtggcgcgccgttggccaaggtgaccttccgccacccgttcaggtacaagcaccagaaggagctcttcgtcgccgccgagggcatgtacaccggacaattcgtctactgcggacgccgcgccaccctctccgtgggcaacgtcctcccggtgcgcgccatccccgagggaggcgtcatctgtaacgtggagcaccacgtcggcgaccgtggcgtcttcgccagggcctccggggactacgccatcgtcatcagccacaaccctgacaacggcacatcaaggatcaagctcccctcaggagccaagaagattgtgcccagcagctgtcgtgccatgatcggtcaggtcgctggtggtggaaggactgagaagcccatgcttaaggctggaaacgcctaccacaagtaccgtgtgaagaggaactgctggcccaaggtgcgtggtgtggccatgaaccctgtggagcatccccatggaggaggtaaccaccagcacattggtcatgcctccaccgtccgccgtgatgccccacctggccagaaggttggtctcattgctgccaggaggactggtcgtctcagaggccaggctgctgcctctgctgccaaggccgacaaggccacttagagatatcgttgctgtttatctatgtttgctaccgtgctcgtctctagattattgcacctcatggacatgtattccagtatggatgtcgtttttggttggtactttgggaacctggtgatgtttgttatcagttttcgaacctgtggtttggattcttcgatccacctaattaagattaagctt

SEQ ID NO: 3172 - DNA, 1154 bp, Secale cereale
ggggctctcctgtgtcgtccgttggcgtacgtcctcgacggcccgcccgccctcccctccgccgctgccgccgtcgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctcgccaaggtgaccttccgccacccgttcaggtacaagcaccagaaggagctcttcgtcgccgccgagggtatgtacaccggccagttcgtctactgcggacgccgcgccaccctctccgtcggcaacgtcctcccgctccgctccgtgcctgagggaggcgtcatctgcaacgtcgagcaccacgtcggcgaccgcggtgtcttcgccagggcctccggtgactacgccatcgtcatcagccacaaccccgacaacggcacctcaaggatcaagctaccctctggcgccaagaagattgtcccaagtagctgccgtgccatgattggccaggttgctggtggtggcaggactgagaagccaatgctcaaggctggtaacgcctaccacaagtaccgcgtgaagaggaactcctggcctaaggtgcgtggtgtggccatgaaccctgtggagcatccccacggaggaggtaaccaccagcatattggtcacgcttccactgtccgccgtgatgcaccacctggccagaaggttggtctcatcgctgccaggaggactggtcgtctcagaggccaggctgctgcctctgctgccaaggccgacaaggccacttagagctatcattgctgtttatctatgtttgctgcctctagattacccatcaaggacatgtattgcagtatggatgtcgtttttgctcggtactttggtaacctggtgatgtttgttatcagttttcgctgtggtctggattcttcggtccacataaagaagattatgcttggatatttgtttgtcgagttgcttgagttagccgctggtgcttattttttgttttagtttaggatgtttgcttctatttcgtggttccttctaatatttgtgtttgtttggcctctaataaa

SEQ ID NO: 3173 - DNA, 1033 bp, Hordeum vulgare
ccacccattcccctcaccgccgccgccactccgccgctgccgccgacgagatgggtcgcgtgatccgcgctcagcgtaagggtgcgggctccgtcttcaagtcccacacccaccaccgcaagggccccgcccgcttcaggtcgctcgacttcggcgagcgcaacgggtacctcaagggcgtcgtcaccgatgtcatccacgacccaggacgtggtgcgccgttggccaaggtgaccttccgccacccgttcaggtacaagcaccagaaggagctctttgtcgccgccgagggtatgtacaccggccagttcgtctactgcggacgccgcgccacgctctccgtaggcaacgtcctccccctccggtccgtgcctgagggaggcgtcatctgcaacgtcgagcaccacgtcggcgaccgtggtgtcttcgccagggcctccggtgactacgccatcgtcatcagccacaaccccgacaacggcacctcaaggatcaagctaccctctggtgctaagaagatcgtcccaagcagctgccgtgctatgattggtcaggttgctggtggtggcaggactgagaagccaatgctgaaggctggtaacgcctaccacaagtaccgtgtgaagaggaactcctggcctaaggtgcgtggtgtggccatgaaccctgttgagcatccccacggaggaggtaaccaccagcatattggtcatgcttccactgttcgccgtgatgcaccacccggccagaaggttggtctcattgctgccaggaggactggtcgtcttagaggccaggctgccgcctctgctgcgaaggccgacaaggccacttagagttatcattgctgtttatctatgtttgctgcctctagattacccgtcaaggacatgtattgcagtaaggttgtcgtttttgctcggtactttggtaacctggtgatgtttgttatcagttttcgccgtggtctggattcttcagtccacataaaggagattatgcttggatatttgtttgttgggttacttgagtt

SEQ ID NO: 3174 - DNA, 1331 bp, Hordeum vulgare
tatttcactgacgttgcggtcctactgcctgcctaaacgaatccaacggcccagacgcgcctccatcccccatcccgaccgtccaccctagggtaatcgaacaacaaaccccgtgccgcaccctatatattgctccctcttcttcctcttcgaaccctagcccagctgcccacccattcccctcaccgccgccgccactccgccgctgccgccgacgagatgggtcgcgtgatccgcgctcagcgtaagggtgcgggctccgtcttcaagtcccacacccaccaccgcaagggccccgcccgcttcaggtcgctcgacttcggcgagcgcaacgggtacctcaagggcgtcgtcaccgatgtcatccacgacccaggacgtggtgcgccgttggccaaggtgaccttccgccacccgttcaggtacaagcaccagaaggagctctttgtcgccgccgagggtatgtacaccggccagttcgtctactgcggacgccgcgccacgctctccgtaggcaacgtcctccccctccggtccgtgcctgagggaggcgtcatctgcaacgtcgagcaccacgtcggcgaccgtggtgtcttcgccagggcctccggtgactacgccatcgtcatcagccacaaccccgacaacggcacctcaaggatcaagctaccctctggtgctaagaagatcgtcccaagcagctgccgtgctatgattggtcaggttgctggtggtggcaggactgagaagccaatgctgaaggctggtaacgcctaccacaagtaccgtgtgaagaggaactcctggcctaaggtgcgtggtgtggccatgaaccctgttgagcatccccacggaggaggtaaccaccagcatattggtcatgcttccactgttcgccgtgatgcaccacccggccagaaggttggtctcattgctgccaggaggactggtcgtcttagaggccaggctgccgcctctgctgcgaaggccgacaaggccacttagagttatcattgctgtttatctatgtttgctgcctctagattacccgtcaaggacatgtattgcagtaaggttgtcgtttttgctcggtactttggtaacctggtgatgtttgttatcagttttcgccgtggtctggattcttcagtccacataaaggagattatgcttggatatttgtttgttgggttacttgagttagcccagtgtgcttattctttgtgttgtgtttttgtttgagttaagcttctattgcttgatctccaaaagtagtattgtttgtttttgtgcgttactctagatatgacatgacattacctctcacagac

SEQ ID NO: 3175 - DNA, 1020 bp, Leymus cinereus x Leymus triticoides
  misc_feature (661)..(661): n is a, c, g, or t
gctgcccacccattcccctcaccgccgccgccacttcgccgctgccgccgctgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtcaccttccgccacccattcaggtacaagcaccagaaggagctcttcgtcgccgccgagggtatgtacaccggccagttcgtctactgcggacgccgcgccacgctctccgtcggcaacgtcctcccgcttcgctccgtgcctgagggaggcgtcatctgcaacgtcgagcaccacgtcggcgaccgtggtgtcttcgccagggcctccggtgactacgccatcgtcatcagccacaaccccgacaacggcacctcaaggatcaagctcccctctggcgccaagaagattgtcccaagcagctgccgtgccatgattggtcaggttgctggtggtggcaggactgagaagccaatgctgaaggctggtaacgcctaccacaagtaccgtgtgaagaggaactcctggcctaaggtgcgtggtgtngccatgaaccctgttgagcatccccacggaggaggtaaccaccagcatattggtcacgcctccactgtccgccgtgatgcaccacctggccagaaggttggtctcatcgctgccaggaggactggtcgtctcagaggccaggctgccgcctctgctgccaaggccgacaaggccacttagagttatcattgcggtttatctatgtttgctgcctctagattacccgtcaaggacatgtattgcagtatggatgtcgtttttgctcggtactttggtaacctggtgatgtttgttatcagttttcgctgtcgtggtctggattcttcagtccacataaagaagattatgcttggatatta

SEQ ID NO: 3176 - DNA, 995 bp, Pseudoroegneria spicata
  misc_feature (15)..(15): n is a, c, g, or t
  misc_feature (20)..(20): n is a, c, g, or t
  misc_feature (116)..(116): n is a, c, g, or t
  misc_feature (197)..(197): n is a, c, g, or t
  misc_feature (293)..(293): n is a, c, g, or t
  misc_feature (323)..(323): n is a, c, g, or t
  misc_feature (407)..(407): n is a, c, g, or t
  misc_feature (428)..(428): n is a, c, g, or t
  misc_feature (539)..(539): n is a, c, g, or t
  misc_feature (590)..(590): n is a, c, g, or t
  misc_feature (743)..(743): n is a, c, g, or t
  misc_feature (752)..(752): n is a, c, g, or t
  misc_feature (835)..(835): n is a, c, g, or t
  misc_feature (842)..(842): n is a, c, g, or t
  misc_feature (885)..(885): n is a, c, g, or t
  misc_feature (893)..(894): n is a, c, g, or t
  misc_feature (914)..(914): n is a, c, g, or t
ctcaccgccgccgcnactcngccgctgccgccgccgagatgggtcgcgtgatccgcgctcagcgtaagggtgcgggctccgtcttcaagtcccacacccaccaccgcaagggcccngcccggttcaggtcgctcgacttcggcgagcgcaacgggtacctcaagggcgtcgtcaccgatgtcatccacgacccgggncgtggtgcgccgctggccaaggtgaccttccgccacccgttcaggtacaagcaccagaaggagctcttcgtcgccgccgagggtatgtacaccggncagttcgtctactgcggacgccgcgccacnctctccgtcggcaacgtcctcccgctccgctccgtgcctgagggaggcgtcatctgcaacgtcgagcaccacgtcggcgaccgnggtgtcttcgccagggcctcnggtgactacgccatcgtcatcagccacaaccccgacaacggcacctcaaggatcaagctcccctctggcgccaagaagattgtcccaagcagctgccgtgccatgattggncaggttgctggtggtggcaggactgagaagccaatgctgaaggctggtaangcctaccacaagtaccgcgtgaagaggaactcctggcctaaggtgcgtggtgtggccatgaaccctgttgagcatccccacggaggaggtaaccaccagcatattggtcacgcctccactgtccgccgtgatgcaccacctggccagaaggtnggtctcatngctgccaggaggactggtcgtctcagaggccaggctgccgcctctgctgccaaggccgacaaggccacttagagttatcgttnctgtttntcctctagattacccaggacatgtattgcagtaaggatgtcgnttttgctnngtactttggtaacctggtgntgtttgttatcagttttcgctgtcgtggtctggattctttggtccacataaagaaattatgcttggatatttgtttgtcca

SEQ ID NO: 3177 - DNA, 974 bp, Secale cereale
  misc_feature (361)..(361): n is a, c, g, or t
gcccacccattcccctcgccgccgcctccactccgccgctgccgccgtcgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctcgccaaggtgaccttccgccacccgttcaggtacaagcaccagaaggagctcttcgtcgccgccgagggtatgtacaccggccagttcgtctactgcggacgccgcgccaccctctccgtcggcaacgtcctcccnctccgctccgtgcctgagggaggcgtcatctgcaacgtcgagcaccacgtcggcgaccgcggtgtcttcgccagggcctccggtgactacgccatcgtcatcagccacaaccccgacaacggcacctcaaggatcaagctaccctctggcgccaagaagattgtcccaagtagctgccgtgccatgattggccaggttgctggtggtggcaggactgagaagccaatgctcaaggctggtaacgcctaccacaagtaccgcgtgaagaggaactcctggcctaaggtgcgtggtgtggccatgaaccctgtggagcatccccacggaggaggtaaccaccagcatattggtcacgcttccactgtccgccgtgatgcaccacctggccagaaggttggtctcatcgctgccaggaggactggtcgtctcagaggccaggctgctgcctctgctgccaaggccgacaaggccacttagagctatcattgctgtttatctatgtttgctgcctctagattacccatcaaggacatgtattgcagtatggatgtcgtttttgctcggtactttggtaacctggtgatgtttgttatcagttttcgctgtggtctgg

SEQ ID NO: 3178 - DNA, 1127 bp, Triticum aestivum
ttaacgccgggtttcccagccaggcctttaaaacgccgcccgtgatttaattcgctcactatagggcgatgggcccgacgttcaatgttcccgccgccatgcccgcggaatagcgtgttcccgccgaggtaacccattcccctcaccgccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccacgctctccgtcggcaacgtcctcccgctccgctccgtgcctgagggaggcgtcatctgcaacgtcgagcaccacgtcggcgaccgtggtgttttcgccagggcctccggtgactacgccatcgtcatcagccacaaccccgacaacggtacctcaaggatcaagctcccctctggcgccaagaagatcgtcccaagcagctgccgtgccatgattggtcaggttgctggtggtggcaggactgagaagccaatgctgaaggctggtaacgcctaccacaagtaccgcgtgaagaggaactcctggcctaaggtgcgtggtgtggccatgaaccctgttgagcatccccacggaggaggtaaccaccagcatattggtcacgcctccactgtccgccgtgatgcaccacctggccagaaggttggtctcatcgctgccaggaggactggtcgtctcagaggccaggccgccgcctctgctgccaaggccgacaaggccacttagagttatcgttgctgtttatcaatgtttgctagctctagattacccgtcaaggacatgtattgcagtaaggatgttgtttttgctcggtactttggtaacctggtgatatttgttatcagtttttgctgtcgtggtctggattcttcagtccacataaagaag

SEQ ID NO: 3179 - DNA, 1195 bp, Triticum aestivum
acccattcccctcgccgccgccgccactccgccgctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgttggtaacgtcctcccgctccgctccgtgcctgagggaggcgtcatctgcaacgtcgagcaccacgtcggcgaccgtggtgtcttcgccagggcctccggtgactacgccatcgtcatcagccacaaccccgacaacggcacctcaaggatcaagctcccctctggtgccaagaagattgtcccaagcagctgccgtgccatgattggtcaggttgctggtggtggcaggactgagaagccaatgctcaaggctggtaacgcctaccacaagtaccgtgtgaagaggaactcctggcctaaggtgcgtggtgtggccatgaaccctgtggagcatccccacggaggaggtaaccaccagcatattggtcacgcttccactgtccgccgtgatgcaccacctggccagaaggttggtctcatcgctgccaggaggactggtcgtctcagaggccaggctgccgcctctgctgccaaggccgacaaggccacttagagctatcgttgctgtttatctatgtttgctgcctctagattacccgtcaaggacatgtattgcagtatggatgtcgtttttgctcggtactttggtaacctggtgatgtttgttatcagttttcgctgtcgtggtctggattcttcggtccacataaagaagattatgcttggatatttggttgtccagttacttgagttagcccctggtgcttatttttgtttattgtttctgttttagtttagctctattggtggatctataaacttgtttggttgaatcaaacgtatagcagcagtatgtttgcttctatctgatgttctttggaattttaaccttagagttaatataaaaaaaaaga

SEQ ID NO: 3180 - DNA, 1361 bp, Triticum aestivum
tatttcactgagttgcggtcctactgcgtgaccaaacgaatccaacggcccagacgcgcccccatcccccatcccgaccgtccaccctatagggtaatcaaaccacaaagcccgtgccgcaccctatatattgctccctcttcctcctcgtcgaaccctagcccagctgcccacccattcccctcaccgccgccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagctcttcgtcgccgccgagggtatgtacaccggccagttcgtctactgcggacgccgcgccaccctctccgtcggcaacgtcctcccgctccgctccgtgcctgagggaggcgtcatctgcaacgtcgagcaccacgtcggcgaccgtggtgtcttcgccagggcctccggtgactacgccatcgtcatcagccacaaccccgacaacggcacctcaaggatcaagctcccctctggtgccaagaagattgtcccaagcagctgccgtgccatgattggtcaggttgctggtggtggcaggactgagaagccaatgctcaaggctggtaacgcctaccacaagtaccgcgtgaagaggaactcctggcctaaggtgcgtggtgtggccatgaaccctgtggagcatccccacggaggaggtaaccaccagcatattggtcacgcttccactgtccgccgtgatgcaccacctggccagaaggttggtctcatcgctgccaggaggactggtcgtctcagaggccaggctgccgcctctgctgccaaggccgacaaggccacttagagctatcgttgctgtttatctatgtttgctgcctctagattacccgtcaaggacatgtattgcagtatggatgtcgtttttgctcggtactttggtaacctggtgatatttgttatcagttttcgctgtcgtggtctggattcttcggtccacataaagaagattatgcttggatatttgtttgtccagttacttgagttagcccctggtgcttatttttgtttattgtttctgttttagtttagctctattggtggatctataaacttgtttggttgaatcaaacgtatagcagcagtatgtttgcttctatctgatgtttctttggaattttaaccttagagtttatata

SEQ ID NO: 3181 - DNA, 1156 bp, Vitis vinifera
ataaaaactctaccctaatcgcctcttcagccctgtatcatcaacccaacttcgccgccacttgagcttcagttcccgatcgccatggggcgagtgatacgagcacagaggaaaggtgcgggatcggttttcaagtcccatacccaccaccgcaaaggtccagcccgtttccgaagcctagacttcggggagagaaatgggtatctaaagggcgtagtcaccgaaatcatccacgacccgggtcgaggcgccccactcgcccgagtcaccttccgccaccctttccgatacaaacaccagaaggagctgttcgtggcggctgagggcatgtacacgggccagttcgtttactgcggcaagaaagccaccctcattgtcggtaacgttctgcccctgcgctctattcccgaaggtgccgtggtctgtaacgttgaacatcacgttggtgatcgaggtgtcttcgccagggcatccggcgattatgctattgttgtcagccacaaccctgataatggcaccagcaggatcaagctcccatctggggctaagaagattgttccaagtggatgcagagcaatgattgggcaggttgcaggtggagggaggactgagaagcccatgctcaaggctggtaatgcttaccacaaatatagagtaaagaggaactgctggccaaaggtacgtggtgtggcaatgaacccagtggagcatccccatggaggaggaaaccaccagcacattgggcatgcaagtacagtcaggcgcgatgcccctcctggccaaaaggtgggtcttattgctgcaagaagaactggtcgtctccgagggcaagctgctgccactgctgccaaagccgacaaggcatagtgagttatatcttgtttgaatactgtttttttggggacttctaccttttatttttatcaattttcaccaaagacaactagtagtgctttatattggacattttgctcagatttgaagcttttgataggcatgctactctatgtggttaatcgtttaatgtggagagatttgttttcttttatatgaatgaatcagtccaaacacaaagaacttaattttgtgtagaggaaccttaacttgggcttatgagcaaatatgctcattcctccaaaagatgaactacagcctg

SEQ ID NO: 3182 - DNA, 1097 bp, Vigna unguiculata
gaggtaggtttattgaacactgcagagctgcaatgggacgtgtgatccgtgcgcagcgtaagggtgcgggctcagtcttcaagtcccacacccaccaccgcaagggaccggctcgcttccgcagcctcgacttcggtgagcggaatggctaccttaagggtgtcgtcaccgacgtcatccacgaccctggccgcggcgccccacttgccaaggtgacgttccgtcacccattcagatacaagaagcaaaacgagctcttcgttgccgccgaaggcctttataccggtcagttcatatactgtggcaagaaggccactctcgttgttggtaatgttttgccccttcgctctatccccgaaggagctgttatatgcaacgttgagcaccatgtcggtgaccgtggtgtctttgctagggcttccggcgactatgccatcgttatcagccacaaccctgacaatgacacctctaggattaagcttccatctggtgcgaagaagattgttccgagtaattgcagggccatgatagggcaagttgcaggtggtggaaggactgagaagcctcttcttaaggcaggaaatgcttaccacaagtttagagtgaagaggaattgctggccgaaggtgcgtggtgttgctatgaatccagttgagcatcctcacggaggaggtaaccaccagcacattggtcacgccagtactgtcaggcgtgatgctcctcctggtcaaaaggttggtctcattgccgctaggaggactggtcgtcttagaggacaagctgctgcaactgctgccaaggctgataaggcttgaggagagtgttcttaggattggtatatttgattgcttctttttcaattttgtttttattctctgatagattgttatgttaatctgtttggcctctcttttgataaccattttctgtccaaaacatggagtttttaatagacggtcatttatatttgtttgagttacatgtcctttggctgcatgatggtactgttgttattgttctggtgccgctaggtgtctgtttcgggattccttctagcttttcggagttgccgtggttaacaaataatttttcacgta

SEQ ID NO: 3183 - DNA, 1106 bp, Vigna unguiculata
acattgcagagctgcaatgggacgtgtgatccgtgcgcagcgtaagggtgcgggctcagtcttcaagtcccacactcaccaccgcaaggggccggctcgcttccgcagcctcgacttcggtgagcggaatggctaccttaagggtgtcgtcaccgacgtcatccacgaccctggccgcggcgccccacttgccaaggtgactttccgccatccattcagatacaagaagcaaaacgagctcttcgttgccgccgaaggcctttataccggtcagttcatatactgtggcaagaaggccactctcgttgttggtaatgttttgcctcttcgctctatccctgaaggagctgttatatgcaacgttgagcaccatgtcggtgaccgtggtgtctttgctagggcttccggcgactatgccattgttatcagtcacaaccctgataatgacacctctaggattaagcttccatctggtgcgaagaagattgttccgagtgattgcagggccatgatagggcaagttgcaggtggtggaaggactgagaagcctcttcttaaggcaggaaatgcttaccacaagtttagagtgaagaggaattgctggccgaaggtgcgtggtgttgctatgaatccagttgagcatcctcacggaggaggtaaccaccagcacattggtcacgccagtactgtcaggcgtgatgctcctcctggtcaaaaggttggtctcattgccgctaggaggactggtcgtcttagaggacaagctgctgcaactgctgccaaggctgataaggcttgaggagagtgttcttaggattgctatatttcattgcttgtttttcaattttgtttttctttctctgatagattacgatgttaatctgtttggcctctcttttgagaaccattctctgcttaaaacatggagtttttagtagacggtcatttatatctgagttacatgtcctttggctgcatgatggcactgttattgtttatgatgacactcgatgttgtattttgggattccttcgagcttttcggatttgcaatggttaaacataaaataaaagataatgatttatcagatccaaaaaaaaaaaaaa

SEQ ID NO: 3184 - DNA, 1136 bp, Vigna unguiculata
ggccttcccgtctgagaggtaggtaatcgaacattgcagagctgcaatgggacgtgtgatccgtgcgcagcgtaagggtgcgggctcagtcttcaagtcccacactcaccaccgcaaggggccggctcgcttccgcagcctcgacttcggtgagcggaatggctaccttaagggtgtcgtcaccgacgtcatccacgaccctggccgcggcgccccacttgccaaggtgactttccgccatccattcagatacaagaagcaaaacgagctcttcgttgccgccgaaggcctttataccggtcagttcatatactgtggcaagaaggccactctcgttgttggtaatgttttgccccttcgctctatccccgaaggagctgttatatgcaacgttgagcaccatgtcggtgaccgtggtgtctttgctagggcttccggcgactatgccatcgttatcagtcacaaccctgataatgacacctctaggattaagcttccatctggtgcgaagaagattgttccgagtgattgcagggccatgatagggcaagttgcaggtggtggaaggactgagaagcctcttcttaaggcaggaaatgcttaccacaagtttagagtgaagaggaattgctggccgaaggtgcgtggtgttgctatgaatccagttgagcatcctcacggaggaggtaaccaccagcacattggtcacgccagtactgtcaggcgtgatgctcctcctggtcaaaaggttggtctcattgccgctaggaggactggtcgtcttagaggacaagctgctgcaactgctgccaaggctgataaggcttgaggagagtgttcttaggattgctatatttcattgcttgtttttcaattttgtttttctttctctgatagattacgatgttaatctgtttggcctctcttttgagaaccattctctgcttaaaacatggagtttttagtagacggtcatttatatttctgagttacatgtcctttggctgcatgatggcactgttattgtttatgatgacactcgatgttgtattttgggattccttcgagcttttcggatttgcaatggttaaacataaaataaaagataatgatttatcagaaaaaaaagaaaaaaa

SEQ ID NO: 3185 - DNA, 1020 bp, Actinidia deliciosa
  misc_feature (636)..(636): n is a, c, g, or t
cgcctccaaccctagagagcgagagcgagagcgagagcgagagagatgggacgagtgatcagagcgcagcgtaagggcgcggggtccgtgttcaagtcccacacccaccaccgcaagggcccggctcggttccgcagcctggacttcggcgaacgcaacggctacctaaagggcgtggtcaccgagatcgtacacgaccccggccgaggcgcccccctcgctcgcgtcaccttccgccaccccttccgatacaagcaccagaaggagctcttcgtcgccgccgagggcatgtacaccggccagttcatcttctgcggcaagaaggccaatctcatggtcggcaatgtccttcccctccgatccatccctgaaggtgccgtcgtttgcaatgttgaacaccatgtcggtgaccgcggggtcttggctagggcttctggggattatgcaattgttatcagtcataatccggataatggtacctcaagaatcaaactcccatccggagcgaagaagattgttccaagcgggtgccgtgcaatgattggccaggttgctggaggaggacgtacagagaagcccatgcttaaggctggtaatgcataccacaaataccgggtgaagaggaactgctggccnaaggttcgtggtgtggctatgaaccccgtggagcatccccatggtggtggtaaccaccaacatattggtcatgccagtactgtgcgccgtgatgctcctcctgggcaaaaggttggtcttatcgctgctaggaggacaggtcgcctccgcggacaagctgctgctaccgctgccaaggctgacaaggcttaaggattttttggaagttatgttggctttatttttattattctcttacattgttttgcgtctgagtcagattttgaatgccatttgcaactttgccgtggcaagttgggaatttaagaattggagttttgttttcgtgatcttttgatgaatggatattactctctcggagctcctttggatggttaaaaaaaa

SEQ ID NO: 3186 - DNA, 1127 bp, Cajanus cajan
aaaccctagaatccccatccatctgagagaggtaaggtaggttagcattccagccgcaatgggacgtgtgattcgtgcgcagcgtaagggtgcgggttccgtcttcaagtcccacacgcaccaccgcaagggcccggcgcgcttccgcagtctcgacttcggcgagcgcaacggctacctgaagggcgtggtcaccgacgtcatccacgaccctggccgcggcgcgccgctcgccaaggtcactttccgccaccctttccggtacaagaagcagaacgagcttttcgtggccgccgagggcttgtacactggtcagttcatctactgcggtaagaaggccacccttgttgttggcaacgtcttgcccctccgatccatccctgaaggtgctgtcatctgcaacgtcgagcaccatgttggtgaccgtggtgttttcgccagggcttctggtgactacgccattgttatcagccacaaccctgataatgacacctctaggattaagcttccttccggtgcgaagaagattgttccaagtgactgtagggctatgattgggcaagttgcaggtggtggaaggactgagaagcctcttcttaaggctggaaatgcttaccacaagtttagagtgaagaggaattgctggcccaaggtgcgtggtgttgctatgaaccctgttgagcatcctcacggaggtggtaaccaccagcatattggtcacgccagcactgtcaggcgagatgctccaccgggacaaaaggttggtcttattgctgctaggaggactggtcgccttagaggacaagccgctgcaactgctgctaaggctgataagggtgcttaggaacaacgtttattatatttgattgcatttttcaattttgtttttccgatagtttgtgttaaactgttagtttaaattagctctttaaacagcctgcattatatcatgccatttattgataagttttaattgatagactatattcattgatatattttgatgaactttaatgcatattttcaccatgcaagtatgtgtatcattatcctgtatctgcaacggtaattaaccattggttatggtgactctagtggtatttaaccggtggttatatattaatatt

SEQ ID NO: 3187 - DNA, 1424 bp, Ricinus communis
ggcccccatcgagctattataacacgagaactggactttgctaacattataaaagcctaggctactgtctaaacccaacccaaattacaacactctaaacagattttagggtttcctccaaaagaataacaaaggctaaaagcgtaaattcaaaacacaaaacttccctctcttcccctcctcaataaaaccacttctctttcttttatatcctttacccatcggccgccacctaagaaaccctaatccccaaaaccctgaaaaagaaacccagaagccgaaatgggtcgtgtaatccgtgcccaacgtaagggtgcaggctccgttttcaaatcccacacccaccaccgcaaaggccccgcccggttccggtccctagacttcggcgagcgcaatgggtacctaaaaggagtggtgaccgacatcatccatgatccgggtcgtggagctccgcttgcaaaggtaacatttaggcatccatttaggtacaagcaccagaaagagctgtttgttgcagcagaagggatgtacacaggtcagtttgtgtactgtggaaagaaggcaaatttgatggtgggaaatgtgttgcctcttagatcaataccagaaggagctgttgtttgtaatgtggaacatcatgttggcgacagaggttcttttgctagatgttctggtgattatgctattgttattagtcataatcctgataatggaactaccaggattaagcttccttctggagccaaaaagattgtaccaagtggctgccgagctatggttggtcaagttgcaggtggagggagaactgagaagcctatgttgaaggcaggaaacgcatatcacaaatacagagtgaagaggaactgctggcccaaggttcgtggtgttgctatgaatcctgtggagcatccccatggtggtggtaatcaccagcatattggacatgccagtactgttcggcgagatgctcctcctggacaaaaagttggtctcattgctgcaaggaggactggtcgtctccgtggacaagctgctgctactgctgcaaaagctgacaagggtgcataaattactagctgaacttctattctggggtgtcgtaagtttagaaagttttgcagttgcaacatttcaagttctgttatcctcgggatatattactttggatagttttcttttatctggtgaaggacttcagcacatattccatttttgttagaaattcagtacttgatttggttcatcctttcttttgagtactgcatcattttatctctttttttggtttaattttaattaaaaataaaccacaaaatgcactgacaagtaaatcgttaagctaaagattagcagccctgagatagtatcttgggttaaattatgattgcaagtcgttcttaaaggggatgaaaagggggatcaaa

SEQ ID NO: 3188 - DNA, 742 bp, Gossypium hirsutum
cgcgcagcgtaagggtgcggggtccgtgttcaagtcccacacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctctccatcggcaacgtgctgcccctccgcgggatccctgagggtgccgtcgtctgcaacgtcgagcaccacgtcggtgaccgcggtgtcttcgccagggcctctggggactacgccattgtgatcagccacaaccctgacaacggcacatcgaggattaagctgccctctggcgccaagaagattgtccccagcagctgccgtgctatgattgggcaggttgctggtggaggcaggactgagaagccgatgctcaaggctggtaacgcgtaccacaagtaccgtgtgaagaggaacagctggcccaaggtgcgtggtgtggccatgaaccctgtggagcatccccacggaggaggtaaccaccaacacatcggtcacgcctctactgtccgccgagacgctccccctggccagaaggttggtctcattgccgctaggaggactggaaggctcaggggtcaagctgctgccaca

SEQ ID NO: 3189 - DNA, 1147 bp, Vigna unguiculata
ggcgcgcccgctatatattaccagcatagccaaaaaccctagctttcccatccatctttcttccatctgcgcggcggatacacacacaggtgaatcggaatgggaagggtaattcgcgcccagcgtaagggtgcggggtctgttttcaagtcccacacccaccaccgcaagggtccggcgaggttccgcagtctcgatttcggagaacgcaatggctacctgaagggagtggtcaccgacattattcacgatcccggtcgcggcgctccacttgccaaggttacatttcgccatcccttccgctacaagaagcagacggaactcttcgtcgccgcggaaggtctttacactgggcagttcctctactgcggcaagaaggccaccctcgtagttggcaacgtcttgcccctccgatctatccccgagggtgcggtcatctgcaacgttgaacaccatgtcggcgatcgcggcgtcttcgccagagcctccggcgactacgccattgttatcagccacaacccggataacgacacatctaggatcaagcttccatctggagcgaagaagattgtgccaagtgcatgtagggcaatgattgggcaagttgcaggtggagggagaactgagaagcctcttcttaaggccggtaatgcttaccataagtttagagtgaagaggaactgctggcctaaggtgcgtggtgtggctatgaatccagttgagcatcctcacggaggaggtaaccaccagcacattgggcatgctagtactgtcaggcgtgatgctcctcctggccagaaggttggtctcattgctgccagaaggactggtcgtcttagaggccaagccgctgccactgctgctaaagctgacaagactacttaaggatactgttagagctgttgtgcttaattacaaattttcaagttttgtttctttgatagtttatgttcaactttttggctactattttgagtaccatttccaccattaatatgaagcttgtaatgtgcggtgttttatatttgattaagatctctattcacgtgatttcaactagttggaacttttaacgttctagtacggttgtttgccataacgttctattcaagtgaagccacttccgaccccttttttttcataggtc

SEQ ID NO: 3190 - DNA, 1130 bp, Vigna unguiculata
  misc_feature (39)..(39): n is a, c, g, or t
taccagcatagccaaaaaccctagctttcccatccatcnttcttccatctgcgcggcggatacacacacaggtgaatcggaatgggaagggtaattcgcgcccagcgtaagggtgcggggtctgttttcaagtcccacacccaccaccgcaagggtccggcgaggttccgcagtctcgatttcggagaacgcaatggctacctgaagggagtggtcaccgacattattcacgatcccggtcgcggcgctccacttgccaaggttacatttcgccatcccttccgctacaagaagcagacggaactcttcgtcgccgcggaaggtctttacactgggcagttcctctactgcggcaagaaggccaccctcgtagttggcaacgtcttgcccctccgatctatccccgagggtgcggtcatctgcaacgttgaacaccatgtcggcgatcgcggcgtcttcgccagagcctccggcgactacgccattgttatcagccacaacccggataacgacacatctaggatcaagcttccatctggagcgaagaagattgtgccaagtgcatgtagggcaatgattgggcaagttgcaggtggagggagaactgagaagcctcttcttaaggccggtaatgcttaccataagtttagagtgaagaggaactgctggcctaaggtgcgtggtgtggctatgaatccagttgagcatcctcacggaggaggtaaccaccagcacattgggcatgctagtactgtcaggcgtgatgctcctcctggccagaaggttggtctcattgctgccagaaggactggtcgtcttagaggccaagccgctgccactgctgctaaagctgacaagactacttaaggatactgttagagctgttgtgcttaattacaaattttcaagttttgtttctttgatagtttatgttcaactttttggctactattttgagtaccatttccaccattaatatgaagcttgtaatgtgcggtgttttatatttgattaagatctctattcacgtgatttcaactagttggaacttttaacgttctagtacggttgtttgccataacgttctattcaagtgaagccacttccgaccccttttttttcataggtca

SEQ ID NO: 3191 - DNA, 1092 bp, Vigna unguiculata
ctatccgtcttccatcgccgcggcgcgaacaaacacactctggtgaatcggaatgggaagggtaattcgcgcacagcgtaagggtgcgggctccgttttcaagtcccacacccaccaccgcaagggtccggcgaggttccgcagcctcgactttggcgaacgcaacggctacctgaagggagtggttaccgatatcatccacgaccccggtcgcggtgcccctctcgccaaggtcactttccgccaccccttccgctacaagaagcagacagaactattcgttgcggccgaaggtttatatactgggcagttcctctactgcggcaagaaggcaaccctcgtagttggcaacgtattgcccctccgatccatccccgagggtgccgtcatctgcaacgtcgaacaccacgtcggtgatcgcggtgtcttcgccagagcatccggtgactacgccattgttatcagccacaaccccgataatgacacctctaggatcaagcttccttctggagcgaagaagattgtgccgagtgcatgtagggcaatgattgggcaagttgcagggggagggagaactgagaagcctcttcttaaggctggtaatgcttaccataagtttagagtgaagaggaactgctggcctaaggtgcgtggtgtggctatgaacccagttgagcatcctcacggaggaggtaaccaccagcacattggtcatgctagtactgtcaggcgtgatgctcctcctggccagaaggttggtctcattgctgccagaaggactggtcgtcttagagggcaagctgctgccaccgctgctaaagctgacaagaccacttaaggagattgttagagatatggttaattacaaattttcaaattttgtttctttgatagtttgttttcatctgtttgggtactattttgagcaccatatccactataaatatgaagcttgtaatgtgcggtgttttatatgattaagatctgttcaatcttgctgtttgtcaatcatttggtgatttcatctagttgaaactgcgaactctctagtatggtttctttccttttgtagaccattatttcattgatcaa

SEQ ID NO: 3192 - DNA, 1120 bp, Vigna unguiculata
  misc_feature (1104)..(1104): n is a, c, g, or t
  misc_feature (1112)..(1112): n is a, c, g, or t
ctatccgtcttccatcgccgcggcgcgaacaaacacactctggtgaatcggaatgggaagggtaattcgcgcacagcgtaagggtgcgggctccgttttcaagtcccacacccaccaccgcaagggtccggcgaggttccgcagcctcgactttggcgaacgcaacggctacctgaagggagtggttaccgatatcatccacgaccccggtcgcggtgcccctctcgccaaggtcactttccgccaccccttccgctacaagaagcagacagaactattcgttgcggccgaaggtttatatactgggcagttcctctactgcggcaagaaggcaaccctcgtagttggcaacgtattgcccctccgatccatccccgagggtgccgtcatctgcaacgtcgaacaccacgtcggtgatcgcggtgtcttcgccagagcatccggtgactacgccattgttatcagccacaaccccgataatgacacctctaggatcaagcttccttctggagcgaagaagattgtgccgagtgcatgtagggcaatgattgggcaagttgcagggggagggagaactgagaagcctcttcttaaggctggtaatgcttaccataagtttagagtgaagaggaactgctggcctaaggtgcgtggtgtggctatgaacccagttgagcatcctcacggaggaggtaaccaccagcacattggtcatgctagtactgtcaggcgtgatgctcctcctggccagaaggttggtctcattgctgccagaaggactggtcgtcttagagggcaagctgctgccaccgctgctaaagctgacaagaccacttaaggagattgttagagatatggttaattacaaattttcaaattttgtttctttgatagtttgttttcatctgtttgggtactattttgagcaccatatccactataaatatgaagcttgtaatgtgcggtgttttatatgattaagatctgttcaatcttgctgtttgtcaatcatttggtgatttcatctagttgaaactgcgaactctctagtatggtttctttccttttgtagaccattatttcattgatcaactcggtcttttncctgtatngtagctca

SEQ ID NO: 3193 - DNA, 1641 bp, Vitis vinifera
ccatataaacctctcatctccctcactgacttccgccgtttccaaaaccctaaccctagcgctaaaccagaaccagaaaccttcaccaagatgggtcgggtcatccgcgcccagcgtaaaggtgccggatccgtattcaagtcccacacccatcaccgcaagggtccggcgaggttccggagcctggacttcggcgagcggaacggctacctcaagggtgtggtcaccgagatcatccacgatcccggtcgcggcgccccactcgctcgagttaccttccgccaccctttccggtacaagcatcagaaagagctgttcgtcgccgccgagggcatgtacaccggccagttcgtctactgtggcaagaaggccaatctcgttgttggcaatgttctgccgcttagatccatccccgagggtgccgttgtgtgcaacgttgagcaccatgtgggtgaccgcggggtcttcgctagggcttctggggattattcgatcgttgtcagtcacaaccctgataatggaacctccagaatcaagcttccatctggagccaagaagattgtgcccagtgggtgccgagctatgattggtcaagttgcaggtggaggtaggactgaaaagccaatgttgaaggcaggaaatgcatatcacaagttcagggtcaagagaaactgctggcctaaggtacgtggtgttgccatgaatcctgtggagcatccccatggtggtggtaaccaccagcatatcggtcatgccagtactgttcgccgtgatgcccctccagggcaaaaggttggtcttattgcggccaggaggactggtcgtctccgaggtcaagctgctgctacagctgcaaaagcagacaaggcttagagagcactgttatgttgatctgtttctcatttttgttgtgggtttagaacatcttttattgacttgccaatggataagtgagatgattatgttgaagttttggtatctggatatgggattaaggtatgttagagagcataattaaattcgaaggatcatgtttaaattcttgacttctgttgaattcctagtagtgaagatacttgtttggcccctgcgacattgtatggtagctttggtatatgccgtatgcccctaaagctttaatgaccacaaacaatattgcttgtcttcactgcaaatgataatctgttaccttctgtgtggttcacccgcgcacaacctgttcatccagttctctaagactggcttaggagacgtctccttcaggtcctgagtgttggttttattctgattctgccagcctgtaggccttgaggttaaagactggtttctgccatgtgtcgtgactcgtgcccttgtgacttactagtagaaagttacacaacgttttatactatgccacgtgcagagctgtgctcctcacatggtagccctaatttctacccgcacaagtgccaatccaaaactttatatggatccgtgggaactggagacaaagaatgccgataaatccgtgttatgatcccaaaatccaaaagagaattattagggctctgtctctactatttgacaagatttcctcatcagattgctccatttacttttagttagcccttgtggtgtcgcagttggttttaatacaat

SEQ ID NO: 3194 - DNA, 1343 bp, Vitis vinifera
acacaacctttgccaatgcctattccaataccggaaaaccctaacccagtttgagaaaatcctgtttccccaaccaaacaatccctagggcaacccccagcccacatcacctctaaaaccctaatctcgctactcctctcctctctcctccccttccctccttttccatccccaaccttcagacccccgaaaccctaaccctaaccttaaccctaatgggtcgagtcatcagagctcagcgtaaaggtgctggctcagtcttcaagtcccacacccaccaccgcaagggtccagctcgcttccgcagcctcgacttcggtgaacgcaatggctacctcaagggcgttgtcaccgatatcatccacgaccctggtcgaggcgctccactcgcccgagttaccttccgtcacccttttcgctacaagcatcagaaggagctgttcgtggccgctgaaggcatgtacactggccagttcgtctattgtggaaaaaaggccaatctcgttgtaggaaatgtattgcctgtcagatccattcctgagggtgccgttgtgtgtaacgttgagcaccatgttggtgaccgtggggtcttcgctagggcttctggtgattacgccattgtggttagccacaacccggacaatggaacctctaggattaaacttccatctggggcgaaaaagattattccaagtggttgtcgtgccatggttggtcaagttgcgggaggtggccgaactgagaagccaatgcttaaggccggtaatgcataccataaataccgggtcaagcgtaactgctggccaaaggttcgtggtgtggccatgaaccctgtggagcatccccatggtggtggtaaccaccagcatattggtcatgccagcactgttcgtcgtgacgccccacctgggcagaaggttggtctcatcgctgccaggaggactggtcgtctccgaggacaggctgctgctactgcagccaaagctgataaggcttagagagattttgaaacatctggcaattttcttgttttcttctctgtttttgttttcttttggtcacattggcagtactgcagtgatgggtatactcaagtggcatttttttgggactaagttttgtttccaagatgtcttttttcttgaagaatcacttggttatcatgattgttttagtcgaactagtctcatggtattgtgtgaggggcctttgatgggtcattttctggtattaatgctaattattcatcaataatgagtatcaatcactcgttcagggatgcttggaattgggtatagtcttgtggtttcaaccacgaattttgcaagcacctgatgttttcc

SEQ ID NO: 3195 - DNA, 991 bp, Glycyrrhiza uralensis
agaccaaaaaaaaatccctaatactaatttcctcccttcccatcatctcagtctcagaggtaactaagtggttgtttgagccgcagccgaaatgggacgcgtgatccgtgctcagcgtaagggtgccggttcggtgttcaagtcgcacacgcaccaccggaagggaccagctcggttccgcagccttgacttcggtgaacggaacggttacctcaagggtgttgtaacggacgtgatccatgaccccggtcgcggtgccccactcgccaaggtcacttttcgtcaccccttccgttacaagaagcagaacgagctcttcgttgccgccgagggcatctacactggccagttcatctactgtggcaaaaaagctaacctcgtcgtcggtaacgtccttcccctccgatccatccctgaaggtgccgtcatctgtaacgtcgagcaccacgtcggtgaccgtggcgtcttcgccagggcctccggtgattacgccatcgtcatcagccacaatcctgacaacgatacctctaggatcaaacttccatctggtgcaaagaagattgttccgagtgattgtagggcgatgattgggcaagttgcaggtggtgggagaacagagaagcctcttcttaaagctggtaatgcttatcacaaatttagggtgaagaggaattgctggcccaaggtgcgtggtgttgctatgaacccagttgagcatccccatggaggaggtaatcaccagcacattggacacgcaagtactgtcaggcgtgatgctcctcctggccagaaggttggtctcattgctgccaagagaaccggtcgtctcaggggacaagctgctgctactgcttctaaggctgataaggcataagggtgcttgaagaaaagattgttaggattacatttcagttcactgcttgtttttcaattttgttttttttttattgatagtttgtctgttaaactgttgggggtactatttgaggaa

SEQ ID NO: 3196 - DNA, 1069 bp, Arachis hypogaea
cactgccaccttccttagccgcagatatagagagtgagagagagagagagattctccgccatgggtagagtcatccgcgcacagcgtaagggtgctgggtccgtcttcaagtcccacacccatcaccgcaagggcgccgccaggttccgcagcctcgacttcggcgagcgcaacggttacctcaagggtgtggtgaccgacatcatccacgaccccggccgcggtgccccactcgccaaggtcactttccgccacccattcaggtacaagaagcagacggagctgttcgtcgctgctgaaggtatctacaccggccagttcatctactgcgggaagaaggccacactcgtggtcggaaatgttttgccactcagatccatccctgaaggagctgtcatttgcaacgtcgagcaccacgttggtgaccgcggtgtcttcgccagggcatctggtgattacgccattgttatcagccacaaccccgataatgacacttctaggatcaagctcccatctggttcaaagaagattgtgccaagtggatgcagggccatgattggacaagttgcgggtggtggaagaactgagaagccactcctcaaggctggtaatgcttaccacaaattcagggtcaagaggaactgctggcccaaggttcgtggtgttgctatgaatccagttgagcatccccacggaggaggtaaccatcaacacattggtcatgccagtactgttaggcgtgatgctccacccggccaaaaggttggtctcattgctgcaaggaggaccggtcgtcttaggggtcaagctgccgcaactgctgctaaggctgataagaccacttgaagtttttaggactttctttgattgcaagtttccaaattttgtttctttcatagtttaggttgaactgtttgggtgctattttgagaaccatttcccccataaatatgaagcttttaattgacattattttatttttgtttgagagatattcattcgtgtttattgtttttagtatgcgatttcagttggatgttaaatcttaaattacatgtcacttgatatc

SEQ ID NO: 3197 - DNA, 1088 bp, Petunia hybrida
gcggggacccagcctcgctatcgagagtgtgagagagagaggcggcgaaatgggtcgtgtaatcagagcacaacgtaagggagcagggtccgtattcaaatcccatacccaccaccgtaaaggcccagcccgattccgttcactggacttcggggaacggaacggttatttgaaaggtgttataacggaagtgattcatgacccaggtaggggtgcaccattagcacgtgtgacattccgtcacccgttccgttacaagcatcaaaaggagttgatggtagctgctgaagggatgtacactggtcagtttatttactgtggtaaaaaagcaacacttatggttgggaatgtgctgccacttagatctatacctgaaggagctgttgtttgtaatgtggaacataaagttggtgaccgtggtgttttcgctaggtgttctggtgattatgctattgttattagtcataaccctgataatggaaccactaggattaagctaccatcaggatccaagaagattgtgccaagtgggtgtcgtgctatgattggtcaagtagctggaggaggacgtactgagaaaccaatgctaaaggctggtaatgcataccacaagtacagagtcaagaggaactgctggcctaaggtccgtggtgttgctatgaatcctgtggagcatcctcatggtggtggtaaccatcaacatattggtcatgctagtacagtccgtcgtgatgcaccacctgggcaaaaggttggtcttattgctgcaaggaggactggtcgtctccgtggtcaagctgctgctacagctgccaaggctgacaaagcttagtttattactgttttcattcctgattagacttttcaatattttggtgctgaaattatactagattttgttgggatattgagtagcaagttttgtattagaaacccttatctggacaagtttgctgtttatttaatgtcgtgcattactctgataccatattgcagcctaaaactttgattgatggtggttgtatttggtgctcaagtaggaatttgtggcagtgaatgtagttcaatgaactagttagatggctttt

SEQ ID NO: 3198 - DNA, 1028 bp, Utricularia gibba
tcaggggttcggaggtatcgccggaaatgggtcgtgtcattcgcgcgcagcgtaagggagcaggctccgtcttcaagtcccatactcaccatcgaaagggcccggcgcgtttccgctctctggacttcggcgagcgtaatgggtacttgaaaggcgtggttaccgatatcatacacgatcctggccgtggtgcgccgctggcgaaggtaaccttccgccacccgttcagatatcaacaccagaaagagcttttcgtcgccgccgaggggatgtacaccggccaatttgtgtattgcggcaagaaggcgaatctcgttgttggaaatgttttgcctttaagatcaattccggaaggagccgttgtttgcaacgttgagcatcatgtgggtgatcgtggtgtctttgctagagcttctggggattatgccattgttatttctcacaatccagataatggaaccagccgcattaagcttccatctggctcaaagaagattgtgccgagcagctgccgtgcgatggtaggccaggttgctgggggtggtcgaactgagaaaccactcttgaaagccggcaatgcgtatcataaattcagggtgaagagaaatagctggcccaaggtgcgtggtgttgctatgaatcccgtggagcatcctcacggtggtggtaatcatcaacacattggtcacgcaagcaccgtccgccgtgatgccccccctggacaaaaggtcggtctcattgctgcaaggagaactggtcgtctccgtggccaagctgctgctactgccgccaagtccgacaaggtttaagattgatgatattcaaggtacaagatttcagttttcaaagtaacagccatggccgtttgtcagatcttgcttatgatgcactcagggttttgtttgatacgcgttccagttactgaattttgtccattcgaatcgaacgttgcgttcaatagcttttagatccttcgggcttggatgatatgatgaataagatgttaccaaaaagttggggtttttcag

SEQ ID NO: 3199 - DNA, 890 bp, Cajanus cajan
ttaacacaaactatcggaaaaacaaaattgaaaaatgcaatcaaatataataaacgttgttcctaagcacccttatcagccttagcagcagttgcagcggcttgtcctctaaggcgaccagtcctcctagcagcaataagaccaaccttttgtcccggtggagcatctcgcctgacagtgctggcgtgaccaatatgctggtggttaccacctccgtgaggatgctcaacagggttcatagcaacaccacgcaccttgggccagcaattcctcttcactctaaacttgtggtaagcatttccagccttaagaagaggcttctcagtccttccaccacctgcaacttgcccaatcatagccctacagtcacttggaacaatcttcttcgcaccggaaggaagcttaatcctaggtgtcattatcagggttgtggctgataacaatggcgtagtcaccagaagccctggcgaaaacaccacggtcaccaacatggtgctcgacgttgcagatgacagcaccttcagggatggatcggaggggcaagacgttgccaacaacaagggtggccttcttaccgcagtagatgaactgaccagtgtacaagccctcggcggccacgaaaagctcgttctgcttcttgtaccggaaagggtggcggaaagtgaccttggcgagcggcgcgccgcggccagggtcgtggatgacgtcggtgaccacgcccttcaggtagccgttgcgctcgccgaagtcgagactgcggaagcgcgccgggcccttgcggtggtgcgtgtgggacttgaagacggaacccgcacccttacgctgcgcacgaatcacacgtcccattgcggctggaatgctaacctaccttacctctctcagatggatgg

SEQ ID NO: 3200 - DNA, 1163 bp, Aquilegia formosa
acctaccgccgctgcaaaaccctaagagagagaaagagagagagagagtaggaagaagaagatgggtagagttatcagagctcaacgtaagggagcaggttcagtgttcaaatcccatactcatcatcgaaaaggacctgcacgatttcgaagtcttgattttggtgaaagaaatggttatttgaaaggagttgttactgaaatcattcatgatccaggacgtggtgcaccattagcaaaagtaacatttcgacatccatttaggtataagcatcaaaaagaattgtttgttgctgctgaaggaatgtatactggtcaatttgtttattgtggaaagaaagctaatttaatggttggtaatgttttaccattaagatctattcctgaaggtgctgttgtttgtaatgttgaacatcatgttggtgatcgtggtactttggctagagcttctggtgattatgctattgttatcagtcataaccctgataatggtactagcaggattaagcttccttctggagcaaagaagattgtgcccagtggatgtcgtgccatgattggtcaggttgctggtggaggtaggactgagaagcctatgctgaaagctggaaatgcctatcacaagtacagagtcaagaggaactgctggcccaaggtacgtggtgttgctatgaatcctgtggaacatccccatggtggtggtaatcatcagcacattgggcatgcaagtactgttcgccgtgatgcacctccagggcagaaagttggtctcattgctgctagaaggactggtcgtctccgtggtcaagctgctgccaatcttgccaaggagaaggcatagatatttagtagctgatcttttctttatatttctatatgttttgcgtcagacaattgttattgacatttatgcttatcattagtagagtatctggcaaagttttgtttggagaggatcataattttgatttgttggctatgaacttcattttgttttgttcttgttttgttcagtggtacatcttgtttgcaattaactgttatgcctgtattcctaagcagatctcttgatgacaatattttgtcttcaaaacctatcagtttgaatgtagtatatctgtatggtttgttttgttttaagagctgcttgaaatatttaagtg

SEQ ID NO: 3201 - DNA, 1064 bp, Musa acuminata
cttaacaccaaagctactataaatatcgcgctggcgatcgagctccaaaccctatcgactctcccttcgctgccacttcgtcgccgccgggatggggcgcgtgatccgagctcagaggaagggagcgggttcggtgttccggtcgcacacgcaccaccgcaaggggccggcgcggttccggagcctcgacttcggcgagcgcaatgggtacctcaagggcgtggtgaccgagatcatccacgaccccggccgcggcgcccctctcgcccgcgtcaccttccgtcatcccttccggtacaagctccagaaggagctgtttatcgccgccgagggcatatacaccggccagttcatctactgcggtcgcaaggcctccctcatggtcggcaacgttctcccgcttcgctccatccccgagggtgctgttgtctgcaacgtcgagcaccacgtcggcgatcgcggcgtcctcgcccgcgcctccggcgattacgccatagtcatcagccataatcctgacaatggcacgtcgaggatcaagcttccatccggagccaagaagattgtcccaagtaattgccgcgccatgattgggcaggttgctggtggtgggagaactgagaagccaatgctcaaggctggcaatgcataccacaagttcagggtgaagaggaactgctggcctaaggttcgtggtgtggccatgaaccctgtggagcatcctcacggaggaggaaatcaccaacacattggccatgcttccactgttcgccgtgatgctcctcctgggcagaaggttggtctcattgctgcaaggaggaccggtcgtctacggggacaggctgctgccactgctgcaaaggcagagaagacttcttagtttgctagcaataacaagcgtatggtaccttggtttcatttgagagtataatggtggtgacttttgttaatgttgtgctggacccttctggacttattaatcttgttcatgaattggctactttgatttacatataagatgttggttgaatcaccaggttcatatattgtcttggtccaagaatcac

SEQ ID NO: 3202 - DNA, 1144 bp, Phaseolus coccineus
agaattctcatttccatctgagaggtaggttatcgaagtttgcagagctgcaatgggacgtgtgatccgtgcgcagcgtaagggtgcgggctcagtcttcaagtcccacactcaccaccgcaagggtccggctcgcttccgcagtctcgactttggggagcggaacggctacctcaagggtgtcgtcaccgacgtcatccacgaccctggccgcggtgccccacttgctaaggttactttccgtcatcccttcagatacaagaagcaaaatgagctcttcgttgccgccgaaggcctttatactggtcagttcatctactgcggcaagaaggccactctcgtagttggtaatgttttgcccattcgctctatccctgaaggagctgttatatgcaatgttgagcaccatgtcggtgaccgtggtgtcttcgctagggcttctggcgactatgccatcgttatcagtcacaaccctgataatgacacatctaggattaagcttccatctggtgcgaagaagattgtccccagtgactgcagggccatgattgggcaagttgcaggtggtggaagaactgagaagcctcttcttaaggctggaaatgcttaccacaagtttagagtgaagaggaattgctggcccaaggtgcgtggtgttgctatgaatcctgttgagcatcctcacggaggaggtaaccaccagcacattggtcacgccagtactgtcaggcgtgatgctcctcctggacagaaggttggtctcattgctgctaggaggactggtcgtcttagaggacaagctgctgcaactgcttccaaggctgataaggtttaaggagagagtgttgttaggattggtatattatttcatttcgtgttttccatttttgtttttcttactagattgttatgttaatctgtttatcctctgttttgagaaccattttctccccagaacatggagtttttaatagacggtcatttatatctttttaagttacatgtcctacctattgctgaatgatggcactgttattgttatggtgacattggtgatttgtttttggattccttgtagcttttcggagttgcagtggttaataactaatacttcaagttcttttttattctctttgattaactc

SEQ ID NO: 3203 - DNA, 1132 bp, Phaseolus coccineus
cctagaattcatttccatctgagaggtaggttatcgagcattgcagagctgcaatgggacgtgtgatccgtgcgcagcgtaagggtgcgggctcagtcttcaagtcccacactcaccaccgcaagggtccggctcgcttccgcagtctcgactttggggagcggaacggctacctcaagggtgtcgtcaccgacgtcatccacgaccctggccgcggcgccccacttgccaaggttactttccgccatcccttcagatacaaaaagcaaaatgagctcttcgttgccgccgaaggcctttatactggtcagttcatctactgtggcaagaaggccactctcgtagttggtaatgttttgcccattcgctctattcctgaaggagctgttatatgtaatgttgaacaccatgtcggtgaccgtggtgtcttcgctagggcttccggcgactatgccatcgttatcagtcacaaccctgataatgacacatctaggattaagcttccatctggtgcgaagaagattgttcccagtgactgcagggccatgattgggcaagttgcaggtggtggaagaactgagaagcctcttcttaaggctggaaatgcttaccacaagtttagagtgaagaggaattgctggcccaaggtgcgtggtgttgctatgaatcccgttgagcatcctcacggaggaggtaaccaccagcacattggtcacgccagtactgtcaggcgtgatgctcctcctggacaaaaggttggtctcattgctgctaggaggactggtcgtcttaggggacaagctgctgcaactgcttccaaggctgataaggtttaaggagaaagtgttgttaggattggtatatttcattgcctgtttttcatttttgtttttctttctctgatagatttttatgttaaacttttggcctctcttttgagaatcattttctacccagaacatggagtttttaatagacggtaatttatatttttttaagttacatgtcctattgctgttattgtttatgggtttgtgttttgggattccttgtagcttttcggagttgcaatggtttaacacaaaataaaagcaaatgatttgtccatatccatctatgtctgtcaattcta

SEQ ID NO: 3204 - DNA, 1106 bp, Medicago truncatula
ccaatctatctactacatataaaccctaatatccacctcaaaacaaaacctagggttagaacttcttcatacctcactcccctttctccatttctcgccgccgctaaaatgggtcgtgtcatccgtgcccaacgtaagggagcaggttccgttttcaaatcccatacgcaccaccgcaaaggccccgcccgtttccgttccctcgacttcggcgagcgcaacggttacctcaaaggagtcgtcaccgacgtcatccacgatccaggtcgcggtgctcctcttgctaaggtcactttccgtcatcccttccgttatcagaaacagaaggagcttttcgttgctgctgagggtttgtataccggtcaatttatttactgcggtaaaaaggcgactcttgttgttggtaatgttttgcctcttagatctatccctgaaggtgctgtgatttgtaatgttgagggtcatgttggtgaccgtggtgtttttgctagagcttctggtgattatgctattgttatcagtcataatcctgataatgatacttctaggatcaagcttccatctggtgcaaagaagattgttccaagtgattgcagggccatgattgggcaagttgctggtggtggaagaaccgagaagccaatgttgaaggctggtaatgcttaccacaagttcagagtgaagagaaactgctggcctaaggttcgtggtgttgctatgaatccagttgagcatccccacggaggaggtaatcaccaacatattggtcatgcgagtactgtcagacgtgatgctcctcctggacagaaggttggtctcattgctgccaagaggactggtcgtctcaggggtcaagctgctgcaagtgctgctaaagccgataaataagcagtttagattgttaagattatattctattgcttgttttccaattttgtttcttgttaaactgttgtgttgttttgagaaccattttccccaaaaattatggagcttttgttagacagcattttatattttgttacatctatcttgcagtttgtctctggtttacttgatatttgtttggaaaggttaaattgccaatttttcaacttgaactcttg

SEQ ID NO: 3205 - DNA, 1237 bp, Aristolochia fimbriata
gagggaggatatataagcgtgggtttgttactccaaaccctaggccgcccctccattcctaaacaccccccgagagcaccctcgaagcagaggcgcaagagatgggtcgtgtcatccgcgcacagcgtaagggtgcgggttccgtcttccgctcccacacccaccaccgcaagggtcctgctcgcttccggtcgctcgacttcggcgagcgtaatgggtacctcaagggagtcgtcaccgaggtcatccacgacccaggtcgtggcgcccccctcgcccgtgtgactttccgccaccccttccgctacaagcaccagaaggagctgtttattgcggccgagggtatgtataccggacagtttgtttactgcggtaagaaggccacgttgatggttggcaacgttttgcccttgaggtctattccggagggagctgttgtttgcaatgtggagcaccatgttggagacagaggagttctcgctagggcgtctggtgattacgcgatcgttattagtcacaatcctgataacggaactacaaggattaagcttccttccggagctaagaagattgtaccaagcggttgcagggctatgattggtcaggttgctggaggtggtcgtacagaaaagcctcttctcaaggctggtaatgcataccataaattcagagtgaagaggaactgctggcctaaggttcgtggtgtggctatgaatcctgtagagcatcctcatggtggtggtaaccatcaacacatcggtcatgccagtactgtccgccgtgatgcacctcctggccagaaggtcggtcttattgctgcaaggaggaccggtcgtctacgtggtcaagctgctgctactgctgccaaggcagacaaggcttaatgagataaacccagatgttttgttccttagattttttccttggactcgtttgtttgaacatccttttaccctttttattttgttactggaatattgaaaaccaattaaagttttgtcatttagatgttaatggatgcttatggatggcttaattctcgtataatttaggtgtgctttttactctccatggttgctgttgtttgcgcctatattagtttgtggttgtagaaatattttgcagatattgtggcattgttgtattgttgtattgttgtattttgcagatacgttccttgattctctgcatgtctccgctctcagcgtggagaagttaataactttgataatcaggc

SEQ ID NO: 3206 - DNA, 999 bp, Phaseolus coccineus
ttatggggggagaattcatttacatctctgagaggtaggttatcgaaggttgcagagctgcaatgggacgtgtgatccgtgcgcagcgtaagggtgcgggctcagttttcaagtcccatactcaccaccgcaagggtccggctcgcttccgcagtctcgactttggagagcggaacggctacctcaagggtgtcgtcaccgacgtcatccacgaccctggccgcggtgccccacttgccaaggttactttccgccatcccttcagatacaagaagcaaaatgagctcttcgttgccgccgaaggcctttatactggtcagttcatctactgcggcaagaaggccactctcgtagttggtaatgttttgcctattcgctctattcctgaaggagctgttatatgtaatgttgagcaccatgttggtgaccgtggtgtcttcgctagggcttccggcgactatgccatcgttatcagtcacaaccctgataatgacacatctaggattaagcttccatctggtgcgaagaagattgttcccagtgcctgcagggccatgattgggcaagttgcaggtggtggaagaactgagaagcctcttcttaaggctggaaatgcttaccacaagtttagagtgaagaggaattgctggcccaaggtgcgtggtgttgctatgaatcccgttgagcatcctcacggaggaggtaaccaccagcacattggtcacgccagtactgtcaggcgtgatgctcctcctggacaaaaggttggtctcattgctgctaggaggactggtcgtcttagaggacaagctgctgcaactgcttccaagggtgataaggtttaaggagagagtgtttttaggattggtatatttcattgcctgttttccatttttgtttttctttctctgatagattgttatgttaaacttttggcctctcttttgagaatcattttctaccaagaatatggagtttttaatagacagtaatttatat

SEQ ID NO: 3207 - DNA, 1110 bp, Phaseolus coccineus
agaggtaggttatcgagcattgcagagctgcaatgggacgtgtgatccgtgcgcagcgtaagggtgcgggctcagtcttcaagtcccacactcaccaccgcaagggtccggctcgcttccgcagtctcgactttggggagcggaacggctacctcaagggtgtcgtcaccgacgtcatccacgaccctggccgcggcgccccacttgccaaggttactttccgccatcccttcagatacaaaaagcaaaatgagctcttcgttgccgccgaaggcctttatactggtcagttcatctactgtggcaagaaggccactctcgtagttggtaatgttttgcccattcgctctattcctgaaggagctgttatatgtaatgttgaacaccatgtcggtgaccgtggtgtcttcgctagggcttccggcgactatgccatcgttatcagtcacaaccctgataatgacacatctaggattaagcttccatctggtgcgaagaagattgttcccagtgactgcagggccatgattgggcaagttgcaggtggtggaagaactgagaagcctcttcttaaggctggaaatgcttaccacaagtttagagtgaagaggaattgctggcccaaggtgcgtggtgttgctatgaatcccgttgagcatcctcacggaggaggtaaccaccagcacattggtcacgccagtactgtcaggcgtgatgctcctcctggacaaaaggttggtctcattgctgctaggaggactggtcgtcttagaggacaagctgctgcaactgcttccaagggtgataaggtttaaggagagagtgttgttaggattggtatattatttcattgcctgttttccatttttgtttttcttactagattgttatgttaatctgtttatcctcttttttgagaaccattttctccccagaacatggagtttttaatagactgtcatttatatctgtttaagttacatgtcctacctattgctgaatgatggcactgttattgttatggtgacattggtgatttgtttttggattccttgtagcttttcggagttgcaatggtttaacacaaaataaaagacaaatgatttgttc

SEQ ID NO: 3208 - DNA, 898 bp, Phaseolus coccineus
gaggtaggttatcgaagtttgcagagctgtaatgggacgtgtgatccgtgcgcagcgtaagggtgcgggctcagtcttcaagtcccacactcaccaccgcaagggtccggctcgcttccgcagtctcgactttggggagcggaacggctacctcaagggtgtcgtcaccgacgtcatccacgaccctggccgcggtgccccacttgctaaggttactttccgtcatcccttcagatacaagaagcaaaatgagctcttcgttgccgccgaaggcctttatactggtcagttcatctactgcggcaagaaggccactctcgtagttggtaatgttttgcccattcgctctatccctgaaggagctgttatatgcaatgttgagcaccatgtcggtgaccgtggtgtcttcgctagggcttctggcgactatgccatcgttatcagtcacaaccctgataatgacacatctaggattaagcttccatctggtgcgaagaagattgtccccagtgactgcagggccatgattgggcaagttgcaggtggtggaagaactgagaagcctcttcttaaggctggaaatgcttaccacaagtttagagtgaagaggaattgctggcccaaggtgcgtggtgttgctatgaatcctgttgagcatcctcacggaggaggtaaccaccagcacattggtcacgccagtactgtcaggcgtgatgctcctcctggacagaaggttggtctcattgctgctaggaggactggtcgtcttagaggacaagctgctgcaactgcttccaaggctgataaggtttaaggagagagtgttgttaggattggtatattatttcatttcgtgttttccatttttgtttttcttactagattgttatgttaatct

SEQ ID NO: 3209 - DNA, 881 bp, Fagus grandifolia
agagttcagagctccctccccccctcccctccatattccgccgcttgctttcgagctctcacaacaaaaatgggtcgtgtcatccgtgcacagcgtaagggtgctggatccgtattcaaatcccacacccaccatcgcaaaggtccggcccgattccgtagtctcgacttcggagagcgtaatgggtacctgaaaggcgtggtgaccgagatcattcatgacccgggtcgtggtgctccgttagccaaggtcactttccgtcaccctttccgttacaagaagcagaacgagcttttcgtggctgccgagggtctctacactggccagtttctgtattgtgggaaaaaggctactcttgttgttgggaatgtgttgcctcttagatctatccctgaaggagctgtggtttgcaacgtggagcatcatgttggtgaccgtggtgtctttgctagggcttctggggattacgctattgttattagccacaacccagataacgatacctccagggtgaaactcccatctggggctaagaagattgtgccaagtgggtgcagagctatgattgggcaggttgcaggaggagggagaactgagaagccaatgctcaaggctggtaatgcttaccacaagttcagagtgaagagaaattgctggcctaaggttcgtggtgtggctatgaatccagtggagcatcctcatggaggaggtaatcaccagcatattggacatgctagtactgtcaggcgtgatgcacctcctggtcaaaaggttggtctcattgctgcaaggaggactggtcggctcagaggtcaagctgctgctactgcttctaaggctgacaagagtacttaaaacagtattctgttttacttgtttgt

SEQ ID NO: 3210 - DNA, 1259 bp, Manihot esculenta
cccccatcgagctattataacacgagaactggactttgctaacattataaaagcctaggctactgtctaaacccaacccaaattacaacactctaaacagattttagggtttcctccaaaagaataacaaaggctaaaagcgtaaattcaaaacacaaaacttccctctcttcccctcctcaataaaaccacttctctttcttttatatcctttacccatcggccgccacctaagaaaccctaatccccaaaaccctgaaaaagaaacccagaagcccaaatgggtcgtgtgatccgtgctcaacgtaagggtgcaggctccgtcttcaagtcccacacccaccaccggaaaggccctgcccgattccgctctctcgacttcggagaacgcaatgggtacctgaagggtgtggtcaccgaaattatccacgatccaggtcgcggcgcaccgcttgcccgcgtcacatttcgtcacccgttccgctacaagcaccagaaggaacttttcgttgcagctgaagggatgtatactggtcagtttgtgtactgtggaaagaaggcaaatttgatggtgggaaatgttttgcctttgaggtcaatacctgagggagctgttgtgtgtaacgtggagcatcatgtgggagatagaggagtgttcgctagatgttctggggattatgctattgttattagtcataaccctgataatggaactaccaggatcaagcttccttctggtgccaagaagattgtgccaagtggatgccgagctatggttggtcaagttgcaggtggaggcaggactgagaagcctatgttgaaggcaggaaatgcatatcacaagtacagagtgaagaggaactgttggcccaaggttcgtggtgttgctatgaatcctgtggagcatccccatggtggtggtaatcaccagcatattgggcatgctagtactgttcgccgtgatgcccctcctggacagaaggttggtcttattgctgctagaagaactggtcgtcttcggggacaagctgcagccacagctgcaaaagctgacaagggtgcataaattactttatacaatttctagttgtttttttgctattgctagacaattttgcaattgcagtaccggggtgttttatttttaaagctttgtcgtccttgggatatattgcaaccgattttcttgataagcgactattttccatattgacagtttgttgttaatgaattttagaaatttgatgagtattaatcct

SEQ ID NO: 3211 - DNA, 1242 bp, Ricinus communis
caaaactagggttttcttcactctgctccctgtctgtcaatataaaatcacttcctccacttttctgtactctttcatcagccgtatttctcttgagagcctaagagaaaccctaaaaatgggtcgagttatccgtgcacaacgtaagggagcaggctccgtcttcaagtcccacacccatcaccgaaaggggccggcgagattccggtcactcgacttcggagagcgaaatgggtacctaaaaggagtggtgaccgacatcatccatgaccctggacgtggtgcaccgcttgccaaagtaactttccgccacccttttcgctataagcaccagaaggagctgtttgtcgctgccgaaggaatgtatactggtcagtttgtgtactgtggaaagaaggcaaacttgatggtcggaaatgtcttgcctttgagatctattcctgaaggagctgtggtttgcaacgttgaacatcatgttggtgatagaggtgcctttgctagatgttctggtgattatgctattgttattagtcataacccggataatggaactaccagagttaagcttccttccggagccaagaagattgtgccaagcgggtgccgggctatggttggtcaagttgcaggtggaggtaggactgagaaaccaatgttgaaggcaggaaatgcttatcacaaatacagagttaagaggaactgctggcccaaggttcgtggtgttgctatgaatcctgttgagcatccccatggtggtggtaaccaccaacacattgggcatgccagtactgttcgccgagatgcccctcctgggcaaaaggtcggtctcattgctgcaaggaggactggtcgtctccgaggacaggctgccgctactgccgcaaaagcagacaagggtgcttaaggagctatttatttgatggttcgtatttgttaccatgttcttctggacagattgtcatttacattgcaaaagagttgtttttctagctacggcagttattggatatgtttaaaatattcttatgccatatttttgttagaaatttactaatgtttactgattttgtgtgctcccattttgatgtgatctctctctctctctggtttattcgagcattcaagtttttaagttcatctctctttctgatagatggatcgaaggtgtgaaatatgtgtgggcataagcctaatgtaccattcttactgggcaataatagtgatagtttcccagcagaagat

SEQ ID NO: 3212 - DNA, 1025 bp, Cyamopsis tetragonoloba
agaggtaagggcagtttcactctactccaatccgagagccgccatgggacgtgtgatccgtgctcagcgtaagggtgccggttccgtgttcaaatcccacacccaccaccgtaagggaccggcgaggttccgcagcctcgacttcggcgagcgtaacggttaccttaagggcgtcgtcaccgacgtgattcacgaccccggtcgcggtgctcctctcgctaaggtcactttccgtcatccattcaggtacaagaagcagaatgagctttttgttgctgctgaaggcatgtacactggccagtttgtgtattgtggtaagaaagccactcttgtggttggtaacgtcttgcctatccgttcaatccccgaaggtgctgttatctgtaacgtcgagcaccacgtcggtgaccgcggtgtgttcgctagggcttccggtgattacgccatcgtcatcagtcacaaccctgataacgacaccagcaggatcaagcttccttctggtgcgaagaaaattgtgccaagtgaatgcagggctatgattggtcaagttgcgggtggtggtagaactgagaagccacttctcaaggctggtaatgcctaccacaagtttagagttaagaggaactgctggcctaaggtgcgtggtgttgctatgaacccagttgagcatccccatggaggaggtaaccaccaacatattggtcatgcaagtactgttaggcgtgatgctcctcctggtcagaaggttggtctcattgctgccaagaggactggtcgtcttaggggacaagctgctgctactgctgccaaggctgataaggcctaagataatactattgttagggttatatttatttgcatgttttccaattttgtttgtttgatagtttgtttggtgtttgtttggtaaactctttggcactattttgagaaccattttgctgcaaaaatatcgagcttttaatagacagacttttatatttgttcaagctgtgtgtttaattttgctgattctcattgcttca

SEQ ID NO: 3213 - DNA, 1061 bp, Eschscholzia californica
aaaaaccagtaaagatgggaagagtaatccgcgcccaacgtaagggagctggatctgtattcaaatcccacacccaccatcgcaaaggtcctgctagattcagaagtctcgacttcggtgaaagaaatggttatctgaaaggtgttgttactgatatcatccatgacccaggtcgtggtgctcctctcgctaaggttactttccgtcaccccttccgttacaaacaccagaaagaactttttgttgccgccgagggtatgtataccggtcagtttttgtactgtgggaagaaagctaaccttatggttggaaatgttcttcctttgagatctatccctgaaggagctgttgtttgtaatgttgaacatcatgttggtgatagaggtgttcttgctagggcttctggtgattatgctattgttatcagtcacaatcctgacaatggtacctctaggatcaagctcccatccgggtccaagaagattgtcccaagtggttgtcgtgccatggttgggcaggttgcaggtggaggtaggacagagaagcctatgctcaaggcaggaaatgcataccacaagtacagagtgaagagaaactgctggcccaaggttcgtggtgttgctatgaatccagtggagcatcctcatggtggtggtaaccaccagcatattggtcacgccagtactgttcgtcgtgatgcaccacctggtcaaaaggttggtcttattgctgccaggagaactggtcgtcttagaggtcaagctgctgccagtgctgccaaggctgattaggtttaattcagtactactacatggtgaagatgatcatgatgtctcgattttctcttttctattgttttctattttccagactcctgtttgttaggtgttttgttgcaaggcataatcatgagacaagattttgttaagagaagttcacaagtagaaagcttaggtatcacattacttgctgtgaacctccattgatatttaagaagcttcaaagatttgtttttgtttaactgtgtttaagtctaccgctgaaatacaggcttagcttta

SEQ ID NO: 3214 - DNA, 1091 bp, Eschscholzia californica
gtcgacccacgcgtccggtctcccccgaaaccctaaaaaaccagtagagatgggaagagtaatccgcgcccaacgtaagggagctggatctgtattcaaatcccacacccaccatcgcaaaggtcctgctagattcagaagtctcgacttcggtgaaagaaatggttatctgaaaggtgttgttactgatatcatccatgatccaggtcgtggtgctcctctcgctaaggttactttccgtcatcccttccgttacaaacaccagaaagaactttttgttgccgccgagggcatgtataccggtcagtttttgtactgtgggaagaaagctaaccttatggtaggaaatgttcttcctttgagatctatccctgaaggagctgttgtttgtaatgttgaacatcatgttggtgatagaggtgttcttgctagggcttctggtgattatgctattgttatcagtcacaaccctgacaatggtacctctaggatcaagctcccgtccgggtccaagaagattgtcccaagtggttgtcgtgccatggttgggcaggttgcaggtggaggtaggacagagaagcctatgctcaaggcaggaaatgcataccacaagtacagagtgaagagaaactgctggcccaaggttcgtggtgttgctatgaatccagtggagcatcctcatggtggtggtaaccaccagcatattggtcacgccagtactgttcgtcgtgatgcaccacctggtcaaaaggttggtcttattgctgccaggagaactggtcgtcttagaggtcaagctgctgccagtgctgccaaggccgattaggtttaatttacatggtgaagacgaacatgatgtctccttttctctttctattgttttctgtttttcagactcctgttttgttagaaagtattttgttgcaaggcacaatgatgagacaagattttgttaagagaagttcacaagtagaaagcttaggtaatcacatcagttgctgtgaacctccattgatatttaagaagcttcaaagatttggttttgtttaactgtgtttttgtcgctacagaaatacaggcttagctttgta

SEQ ID NO: 3215 - DNA, 838 bp, Vitis vinifera
aaaacaaaaacagagaagaaaacaagaaaattgccagatgtttcaaaatctctctaagccttatcagctttggctgcagtagcagcagcctgtcctcggagacgaccagtcctcctggcagcgatgagaccaaccttctgcccaggtggggcgtcacggcgaacagtgctggcatgaccaatatgctggtggttaccaccaccatggggatgctccacagggttcatggccacaccacgaacctttggccagcagttgcgcttgacccggtatttatggtatgcattaccggccttaagcattggcttctcagttcggccacctcccgcaacttgaccaaccatggcacgacaaccacttggaataatctttttcgccccagatggaagtttaatcctaggttccattgtccgggttgtggctaaccacaatggcgtaatcaccagaagccctagcgaagaccccacggtcaccaacatggtgctcaacgttacacacaacggcaccctcaggaatggatctgacaggcaatacatttcctacaacgagattggccttttttccacaatagacgaactggccagtgtacatgccttcagcggccacgaacagctccttctgatgcttgtagcgaaaagggtgacggaaggtaactcgggcgagtggagcgcctcgaccagggtcgtggatgatatcggtgacaacgcccttgaggtagccattgcgttcaccgaagtcgaggctgcggaagcgagctggacccttgcggtggtgggtgtgggacttgaagactgagccagcacctttacgctgagctctgatgactcgacccattagg

SEQ ID NO: 3216 - DNA, 1049 bp, Petunia hybrida
tcggcgcgagagagtgagagagaaacaatgggtcgtgtgatcagagcacagcgtaagggagctggttccgtcttcaaatcccacacccaccaccgcaagggcccggcccgtttccggaccctcgatttcggtgagcgaaatgggtacctcaagggtgtaatcacagaggtcattcacgatccgggtaggggtgcaccacttgcccgagtaactttccgtcacccgttccgttacaagcaccaaaaagagttgatggttgctgctgaagggatgtacaccggtcaatttatttactgtggtaaaaaagctaccctcatggttggtaatgtgttgcctcttagatctatccctgaaggagctgttgtttgtaatgtggaacataaagttggtgaccgtggtgttttcgctaggtgttctggtgattatgctattgttatcagtcacaaccctgataatggtaccactagggttaagcttccatcaggagccaaaaagattgtccccagtggatgtcgtgctatgattggtcaggttgctggaggaggacgtactgagaaaccaatgcttaaagctggtaatgcttaccacaagtaccgggtgaagaggaactgctggcctaaggtccgtggtgttgctatgaatcctgtggagcatccacatggtggtggtaaccatcaacatattggtcatgccagtacagtccgccgtgatgcacctcctgggcagaaggttggtcttattgctgcaaggaggactggtcgtctccgtggtcaagctgctgcaactgctgccaaggctgacaaggcttaagacatttgcttgttactttttatcttgtttattgcgttgtgatcagtttttcagtattcagctacaaccaatttggtagtaaaattataacatactaaattttgttgggatgtttagtgagctttgttttaatgatccctacgtggtgcagtttttttatctatgttcagtttgctcatgatcttgtcttttaatgttgtttacttcacttaatgctagttcgtcgatcaagttttaac

SEQ ID NO: 3217 - DNA, 1360 bp, Cajanus cajan
atataagaagcaaagcaaaaaaccctaacttcgatccctccttccaccggcgcggcagagagtacagtagtgttgttggatcgtaatgggtagggtgattcgtgcacagcgtaagggtgcggggtcggtgttcaagtcccacacccaccaccgcaagggtccggcgaggttccgcagtttggacttcggcgaacggaacgggtacctgaagggcgtggtcaccgacatcatccacgaccccgggcgcggcgcccctctggccaaggtcaccttccgccaccccttccgctacaagaagcagaacgagctcttcgtcgccgccgagggcctctacaccggccagttcatttactgcggcaagaaggccaccctcgtcgtcggcaatgtcttgcccatcagatccatccccgaaggtgccgtcatctgcaacgtcgagcaccacgtcggtgaccgcggcgtcttcgccagagcctccggcgactacgccattgttatcagccacaaccccgataacgatacctctaggatcaagcttccttctggtgcgaagaagattgtgccaagtgggtgtagggcgatgattgggcaagttgcgggaggagggaggactgagaagcctcttcttaaggctggtaatgcttaccacaagtttagagtaaagaggaattgctggcctaaggtgcgtggtgtggctatgaaccctgttgagcatcctcatggaggaggtaaccaccaacatattgggcatgctagtaccgttcggcgtgatgctcctcctggccagaaggttggtctcattgctgctaggaggactggtcgtcttaggggacaagctgctgccactgctgccaaagctgataagacttcttgaagagtttcttagggttgtatttgattattattataagttctcaaattttgtttctttagtagtttatgtttaactgttttgagtactacttcgagcaccattttccccataaatatgaagctggcaatagacggtgtatttgttcgagatttattcactgctgttgtttgtcaaccttttactgctagcaactagttggtacttggaatgcttctctcatttcagtgtggtttttgttttagctgcaccttatcatatttttatgctattttgcttgtgttaaagtgaagtttcccacttttcctacctttggcggccagattgtcagggaatggctcttatttcgtcagaacacctggttgtaggcataactccgtgataattaatgactgcccagctgaactatgatggattagtttcgttaaattgtttgttataatggatttgaatcttgatgaataataagttgtggttaagttgagagataaa

SEQ ID NO: 3218 - DNA, 977 bp, Solanum tuberosum
gagagagacggcggcgaaatgggtcgtgtgatcagagcacaacgtaagggagcagggtccgtcttcaagtcccacactcaccaccggaaaggcccagcccggttccgttcactcgacttcggcgagcgtaatggttacctgaagggtgttataactgaggttattcatgacccaggtaggggtgctccgctagcccgtatcactttccgtcatccattccgttacaagcaccagaaggagctgttcgttgcggcggagggtatgtacactgggcaattcgtttactgtgggaagaaggctacgctcatggttggcaatgtgctaccacttagatctatccctgaaggagctgttgtttgcaatgttgagcataaagttggtgaccgtggtgtttttgcaaggtgctctggtgattatgctattgttatcagtcacaaccccgataatggaaccactaggattaagcttccatcaggatccaagaagattgtgccaagtgggtgtcgtgccatgattggtcaggtagctggaggaggacgtaccgagaagccaatgctcaaggcaggtaacgcataccacaagtaccgagtaaagaggaactgctggcccaaggttcgtggtgttgctatgaatcccgtggagcatcctcatggtggtggtaaccatcaacatattggtcatgcaagtactgtccgtcgggatgcaccacctgggcaaaaggttggtcttattgctgcaaggaggactggtcgtcttcgtggtcaagccgccgccactgctgctaaggctgacaaggcttaaaaagtttaccttatcactgtttttacgtatttgtttccggatcagtcttttaaactatttgagtgctgaaattatactaaattttggtgggatatttagtaagttctgtttgagaaatccatatctggacaagtttaccatttaacattatgattcatttgatttttgctcctaaa

SEQ ID NO: 3219 - DNA, 942 bp, Solanum phureja
catttcctttaacaccgccgagagagagagaggagagagagagagacggcggtgaaatgggtcgtgtgatcagagcacaacgtaagggagcagggtccgtctttaagtctcacacgcaccaccggaaaggccccgcccggttccgttcgctcgacttcggcgagcgtaatggttacctgaagggtgttataactgaggttattcatgacccaggtaggggtgctccgttagcccgtatcactttccgtcatccattccgttacaagcatcagaaggagctgttcgttgcggcggagggtatgtacactgggcagttcgtttactgtgggaagaaggctacgctcatggttggcaatgtgctaccacttagatctatccctgaaggagctgttgtttgcaatgttgagcacaaagttggtgaccgtggtgtttttgcaaggtgctctggtgattatgctattgttatcagtcacaaccccgataatggaaccactaggattaagcttccatcaggatccaagaagattgtgccaagtgggtgtcgggccatgattggtcaggtagctggaggaggacgtaccgagaagccaatgctcaaagcaggtaatgcataccacaaataccgagtaaagaggaactgctggcccaaggttcgtggtgttgctatgaatcccgtggagcatcctcatggtggtggtaaccatcaacatattggtcatgctagtactgtccgtcgcgatgcaccacctgggcaaaaggttggtcttattgctgcaaggaggactggtcgtcttcgtggtcaagccgctgccactgctgctaaggctgacaaggcttaaaaagtttaccttatcactgtttttacgtatttgtttccggaacagtcttttaaactatttgagtgctgaaattatactaaattttggtgggatatttagtaag

SEQ ID NO: 3220 - DNA, 995 bp, Glycine max
ctagaatccccattccagagccaaggtaggttaaacaatcttcttcatcgtcgtcgccgcaatgggacgtgtgatccgtgcgcagcgtaagggagcaggctcggtcttcaagtcccacacgcaccaccgcaagggccctgcccgcttccggagcctggatttcggagagcgcaacggctacctgaagggtgtcgtcactgacgtcatccacgatcctggccgtggcgcgcctctcgctaaggtcgccttccgccacccgttccgctacaagaagcagaacgagctcttcatcgccgccgagggtctctacaccggccagttcatctactgcggcaagaaggccaccctcgttgtcggcaatgtgttgcctcttcgatccattcctgaaggagctgtcatctgcaacgtcgagcaccatgtcggcgaccgcggcgtcttcgctagggcgtctggagactacgccattgttatcagtcacaaccctgataatgacacctctaggattaagctcccatctggttcaaagaagattgttccaagtgactgtagggccatgattggtcaagttgcaggtggagggagaactgagaagcctcttctcaaggctggaaatgcttaccacaagttcagagtgaagaggaattgctggcccaaggttcgtggtgttgctatgaaccctgttgagcatccccacggaggaggtaatcaccagcatattggtcacgcaagtactgtcaggcgtgatgctcctcctggacagaaggttggtctcattgctgctaggaggactggtcgtcttagaggacaagctgctgcaactgctgccaaggctgataaggcttaaagagaacgttgttagggttattatatttgattgcaagtttttcagttttgtttttcttttttctgatagtttgtttgttaaactatttgggcaccttcttcagaaccattttcttcccaacatatggagttttcaatagacggtcttctat

SEQ ID NO: 3221 - DNA, 1226 bp, Glycine max
ggtgtcgcgtccgctatatattctacccgaatttctgcattttccttcttccatcggcgcggcacacacagacacacacatttcgtcggaatgggaagggtgattcgcgcacagcgtaagggtgcggggtcggtgttcaagtcccacacccaccaccgcaagggtccggcgaggttccgcagcctcgacttcggcgagcgcaacggctacctcaaaggggtcgtcaccgatatcatccacgaccctggtcgcggtgctcctctagccaaggtggcgttccgccaccccttccgctacaagaagcagatggagctcttcgtcgccgccgagggcctctacaccggccagttcatctactgcggcaagaaggccaccctcgtcgtcggcaacgtcttgcccctccgatccatccccgaaggtgccgttatctgcaacgtcgagcaccacgttggcgaccgcggcgtcttcgccagagcctccggtgactatgccattgttatcagccacaaccctgataacgacacctctaggatcaagcttccttctgggtcaaagaagattgtgcctagtgggtgcagggcgatgattgggcaggttgcaggtggagggaggactgagaagcctcttctgaaagctggtaatgcttatcacaaattcagagtgaagaggaattgctggcctaaggtgcgtggtgtggcgatgaacccagttgagcatcctcatggaggaggtaatcaccagcatattggtcatgccagtaccgtcaggcgtgatgctcctcctggccagaaggttggtctcattgctgctaggaggactggtcgtcttagggggcaagctgctgctactgctgctaaagcggataagaccacctgaagagattgttagagttttttttttttttttataagttctcaaattttgtttctctgatagtctatgctcatctgtttgggttctattttgatcaccatttctgccataaatatgaaagcttgtaacaggcggtgttttacattggttttaagatctattcaatcctgcaactgtttgaatttggaatgcacttatatagctcccgcttttttgtagctgcaccacccatagttttatttgagttattgttgaagtgcagtctactattttgattctaagtgatttgagaaattgattaaccatagcttcatcgataggtttgatatggagttgtgagttaactccattca

SEQ ID NO: 3222 - DNA, 1004 bp, Glycine max
aaaccctagaatcccagttcaaaggtaaggtaggttaacactcttcttcatcgtcgtcgcaatgggacgtgtgatccgtgcgcagcgtaagggagcaggctcggtcttcaagtcccacacgcaccaccgcaagggccctgcacgcttccggagcctggacttcggggagcgcaacggctacctcaagggcgtggtcaccgacgtcatccatgaccctggccgcggcgcgccgctcgccaaggtcgccttccgccaccctttcagatacaagaagcagaacgagctcttcattgccgccgagggcctctacaccggtcagttcatctactgcggcaagaaggccacccttgttgtcgggaacgttctacccctgaggtccatccccgaaggagccgtcatctgcaacgtcgagcatcacgtcggcgaccgcggcgtctttgcccgggcgtctggcgactacgccattgttatcagtcacaaccctgataatgacacctctaggattaaactcccatctggttcaaaaaagattgttcctagtgactgtagggccatgattgggcaagttgcaggtggagggagaactgagaagcctcttctcaaggctggaaatgcttaccacaagtttagagtgaagaggaactgctggcccaaggttcgtggtgttgctatgaaccctgttgagcatccccacggaggaggtaaccaccagcatatcggtcatgctagtactgtcaggcgtgatgctcctcctggacagaaggttggtctcattgccgcaaggaggactggtcgtcttaggggacaagctgctgcaactgctgctaaggctgataaggcttaaatagaacgttgttagggttattttatttgattgcatgtttttcagttttgtttttattttttctgatagtttgtttgttaaactatttgggcacccttttgagaaccattttcttcccaacatatggagttttcaatagacggtcttctattatttgttt

SEQ ID NO: 3223 - DNA, 996 bp, Nicotiana tabacum
  misc_feature (62)..(62): n is a, c, g, or t
  misc_feature (85)..(85): n is a, c, g, or t
attaggcgggaccagcgagcagctcgagggagagagagagagagagagagagagagagacgngcgaaatgggttcgtgtgatcangagcacaacgtaagggagcaggttcagtcttcaagtcccatacccaccaccgtaaaggccctgcccgtttccgttccctcgacttcggcgaacggaacggttacctcaagggtgtcataacggaggttattcatgacccaggtaggggtgctccgttggcacgtgtcactttccgtcacccgttccgttacaagcaccagaaggaactgttcgtggctgctgagggtatgtacactggccagttcgtttactgtgggaagaaggctactctcatggttgggaatgtgctcccactcagatctatccctgaaggagctgtcgtttgcaatgtggaacacaaagttggtgaccgtggtgtttttgccaggtgctctggtgattatgctattgtcattagtcacaaccccgataacggaaccaccaggattaagctgccttcaggatccaagaagattgtgcccagtgggtgtcgtgctatgattggtcaagttgctggaggaggacgtactgagaaaccaatgcttaaggccggtaacgcataccacaagtaccgggtaaagaggaactgctggcccaaggttcgtggtgttgccatgaaccctgtggagcatcctcatggtggtggtaaccatcaacatattggtcatgctagtactgtccgtcgtgatgcaccacctggtcaaaaggtcggtcttattgctgcaaggaggactggtcgtcttcgtggtcaagctgctgctacagctgccaaggctgacaaagcttaaaaagtttaagcttgttactgttttgccctacttgtttcctgattaagactttttatttaactatttggtgctgaaattatactaaattttgtggggatgttgagtagcaaatttgttttagatatccatatttggacaagtttg

SEQ ID NO: 3224 - DNA, 944 bp, Nicotiana tabacum
gagagagagagagaagagagagacggcgaaatgggtcgtgtaatcagagcacaacgtaagggagcaggatccgttttcaaatcccacactcaccaccgtaaaggcccggcccgattccgtaccctcgatttcggcgaacgtaatggttacctaaagggagtaatcacagaagtgattcacgatcccggtagaggagcaccactcgcgcgcgtgacattccgtcacccgttccgttacaagcaccaaaaagagttgttcgttgctgctgaagggatgtacactggtcagttcgtttactgtggtaaaaaagctactcttatggttggtaatgtgttgccgctcagatctataccagaaggagctgttgtatgtaacgtggagcataaagtaggagatcgtggtgtttttgctagatgctctggtgattatgccattgttatcagtcacaaccctgataatggtaccactagggttaagcttccatcaggagccaaaaagattgtgcccagtggatgtcgtgcaatgattggtcaagttgctggaggaggacgtaccgagaaaccaatgctcaaagccggtaatgcttaccacaagtatcgggtgaagaggaactgctggcctaaggtccgtggtgttgctatgaatcctgtggagcatcctcatggtggtggtaaccatcaacatatcggtcatgccagcacagtccgtcgtgatgcacctcctgggcaaaaggtcggtcttattgctgcaaggaggactggtcgtctccgtggtcaagctgctgccactgctgccaaggctgacaaggcttaagacaatttgcttcttgcattttatcttgttattctgtcctgttcaatttttgagtattcaactacaacaatttggtagtaaagttagtaacatgctaaattttgttggcatgtttagtaagttttgttttc

SEQ ID NO: 3225 - DNA, 1102 bp, Solanum lycopersicum
tttcttaagcccaaatcataactagggcaacacattaccctctaaaaaccctagtatatcttcttcttcctatcattcttctcaaaacccctccggcgagagagtgtagagagagagagagtagagagagaaaccggcgaaatgggtcgtgtgatcagagcacaacgtaagggagctgggtcagttttcaaatcccatacccaccaccggaaaggtccggcccgattccgtactctcgatttcggcgagagaaatgggtacctgaaaggagtaatcacagaggtgattcacgatccagggagaggtgcaccacttgcgcgggtaacattccgtcatcctttcaggtacaagcatcagaaggagctgttcgttgccgctgaagggatgtataccggacagttcgtgtattgtgggaaaaaagctactcttatggttggtaatgtgttgccgcttagatctattcccgaaggagctgttgtttgtaacgtcgagcataaagttggtgaccgtggtgtttttgctaggtgttctggtgattacgccattgttatcagtcacaatcctgataatggtaccactagggtgaagctcccatcaggagccaaaaagattgtgcccagcggatgtcgtgctatgattggtcaggttgctggtggaggacgtactgagaaaccaatgcttaaagctggtaatgcttaccataagtaccgtgtgaagaggaactgctggcctaaggttcgtggtgttgctatgaatccagtggagcatccccatggtggtggtaaccatcaacacattggtcatgccagtacagtccgtcgtgatgcacctcctggacaaaaggttggtcttattgctgcaaggaggactggtcgtcttcgtggtcaagccgctgctactgctgccaaggctgacaaggcttaagccattcacttgttacttttctatcttgttattttatcctgatcaatttttgagtattcagttaaaaacccattttgtagtaaagttataacatgctaaattttgttgggatgtttagtaagttttgttttcatgatgatccttgtttggtgcattttattaccttttcctctcatgt

SEQ ID NO: 3226 - DNA, 957 bp, Solanum lycopersicum
gctttcttcttataatcatttccttcatcaccgccgagagagaggagagagtcggcggcgaaatgggtcgtgtgatcagagcacaacgtaagggagcagggtccgtcttcaagtcccatactcaccaccggaaaggccccgcccggttccgttcactcgacttcggtgagcgtaatgggtaccttaagggtgttataacggaggttattcatgacccaggtaggggtgctccattagcccgtatcactttccgtcatccattccgttacaagcaccagaaggagcttttcgttgcggcggagggtatgtacactggtcaattcgtttactgtgggaagaaggctacgctcatggttggcaatgtgttgccacttagatctatccctgaaggagctgtcgtttgcaatgttgagcacaaagttggtgaccgtggtgtttttgcaaggtgctctggtgattatgctattgttatcagtcacaatcccgataatggaaccactaggattaagcttccatcaggatccaagaagattgttccaagtgggtgtcgtgccatgattggtcaggtagctggaggaggacgtaccgagaaaccaatgctcaaagcaggtaacgcataccacaagtacagggtgaagaggaactgctggcccaaggtccgtggtgttgctatgaatcccgtggagcatcctcatggtggtggtaaccatcaacatattggtcatgctagtactgtccgtcgtgatgcaccacctggtcaaaaggttggtcttattgctgcaaggaggactggtcgtcttcgtggacaagctgccgccaccgctgctaaggctgacaaggcttaaaaagtttaccttatcattgtttttacgtatttgtttccggatcagtcttttaaactatttgagtgctgaaattatactaaattttggtgggatattcagtaataagttttgt

SEQ ID NO: 3227 - DNA, 1011 bp, Trigonella foenum-graecum
ttctccatttctcactctttcacagtatccatccctagccgccgtaatgggacgagttatccgtgctcaacgtaagggagcaggctcagttttcaaatcccacactcaccaccgcaaaggtccggcccgattccgctccctcgacttcggtgaacgcaacggctaccttaagggagttgtcaccgacgtgattcacgatccaggtcgcggtgcaccactagccaaggtgactttccgtcatcctttccgttacaagaagcagaacgagcttttcgtggcggctgagggtttgtacaccggtcagtttatttactgcggtaaaaaagctacacttgttgttggaaatgtgttgcctcttagatctattcctgaaggtgctgtgatttgtaacgttgagggtcatgttggtgaccgcggtgtttttgctagagcttctggtgattatgctattgttatcagtcataaccctgataatgatacctctaggatcaagcttccatctggtgcgaagaagattgtgccaagtgattgcagagctatgattggacaagttgctggtggtggtagaactgagaagccaatgttgaaggctggaaatgcttaccacaagttcagagtgaagagaaactgctggcctaaggttcgtggtgttgctatgaatcctgttgagcatccccacggaggaggtaatcaccagcatatcggtcatgcaagtaccgtcagacgtgatgctcctcctggacagaaggttggtctcattgctgccaagaggactggtcgtcttaggggtcaagctgctgcaagtgctgctaaagccgataaataagcagtttagtttgttgagattatatgcaattgccatttttccaattttgtttcttgttgaactgtttccccaaaaaattatggagcttgttagacatcattttatatgatttgttgcatttatcttgcagttcttctctgtttacttgatatatgtttggaatggctaatttctaatttgttttt

SEQ ID NO: 3228 - DNA, 1003 bp, Phaseolus coccineus
tccatctgagaggtaggttatcgaaggttgcagagctgcaatgggacgtgtgatccgtgcgcagcgtaagggtgcgggttcagtcttcaagtcccacactcaccaccgcaagggtccggctcgcttccgcagtcttgactttggggagcggaacggctacctcaagggtgtcgtcaccgacgtcatccacgaccctggccgcggtgccccacttgccaaggttactttccgccatcccttcagatacaagaagcaaaatgagctcttcgttgccgccgaaggcctttatactggtcagttcatctactgcggcaagaaggccactctcgtagttggtaatgttttgcccattcgctctatccctgaaggagctgttatatgcaacgttgagcaccatgtcggtgaccgtggtgtcttcgctagggcttccggcgactatgctatcgttatcagtcacaaccctgataatgacacataggattaagcttccatctggtgcgaagaagattgttcccagtgactgcagggccatgattgggcaagttgcaggcggtggaagaactgagaagcctcttcttaaggctggaaatgcttaccacaagtttagagtgaagaggaattgctggcccaaggtgcgtggtgttgctatgaatcccgttgagcatcctcacggaggaggtaaccaccagcacattggtcacgccagtactgtcaggcgtgatgctcctcctggacagaaggttggtctcattgctgctaggaggactggtcgtcttagaggacaagctgctgcaactgcttccaaggccgataaggtttaaggagagagtgttgttaggattggtatatttcattgcctgttttccatttttgtttttctttctcttatagattgttatgttaaacttttggcctctcttttgagaatcattttctaccaagaatatggagtttttaatagacagtaatttatattttgtttaagttacatgtcctattgctg

SEQ ID NO: 3229 - DNA, 967 bp, Medicago truncatula
tagatgtaacaaaatataaaatgctgtctaacaaaagctccataatttttggggaaaatggttctcaaaacaacacaacagtttaacaagaaacaaaattggaaaacaagcaatagaatataatcttaacaatctaaactgcttatttatcggctttagcagcacttgcagcagcttgacccctgagacgaccagtcctcttggcagcaatgagaccaaccttctgtccaggaggagcatcacgtctgacagtactcgcatgaccaatatgttggtgattacctcctccgtggggatgctcaactggattcatagcaacaccacgaaccttaggccagcagtttctcttcactctgaacttgtggtaagcattaccagccttcaacattggcttctcggttcttccaccaccagcaacttgcccaatcatggccctgcaatcacttggaacaatcttctttgcaccagatggaagcttgatcctaagtatcattatcaggattatgactgataacaatagcataatcaccagaagctctagcaaaaacaccacggtcaccaacatgaccctcaacattacaaatcacagcaccttcagggatagatctaagaggcaaaacattaccaacaacaagagtcgcctttttaccgcagtaaataaattgaccggtatacaaaccctcagcagcaacgaaaagctccttctgtttctgataacggaagggatgacggaaagtgaccttagcaagaggagcaccgcgacctggatcgtggatgacgtcggtgacgactcctttgaggtaaccgttgcgctcgccgaagtcgagggaacggaaacgggcggggcctttgcggtggtgcgtatgggatttgaaaacggaacctgctcccttacgttgggcacggatgacacgacccattttagcggcggcgagaaatggagaaaggggagtgaggtatgaagaag

SEQ ID NO: 3230 - DNA, 1103 bp, Phalaenopsis aphrodite
cgcggcatccgaagaggagctccgctaccacctcctcccctcaactccgcttctccttcttcctcgtcttagccgccatgggtagagtgatccgagctcaaaggaagggtgcgggttcagttttccgatcgcatacccaccatcgcaaaggcccggctcgtttccgcagcctcgacttcagcgagcgtaatggatatcttaagggcgtggtcaccgacatcatccacgaccctggacgcggtgcgccgcttgcccgcgtaaccttccgccatccattccgttacaagcaccagaaggagctctttgtcgcggctgagggcatgtacacggggcaattcgtgtactgcggtcgcaaagcgtctctcatggtcggaaatgttcttcctcttcgctccatccctgagggcgctgtcgtatgcaacgtcgagcaccatgttggagatcgtggaatgctcgcgagggcgtctggggactacgctattgtaatcagccataaccccgataatggcaccagtaggattaaactcccatctggagcgaaaaaatccgtcccaaagtggctgccgtgccatgattgggcaagttgctggtggcggtcgaactgaaaagcctcttctgaaagcaggtaacgcctatcacaaatacagagtgaagagaaactgctggcccaaggttcgtggtgttgctatgaacccagtcgaacatccccatggaggaggaaaccaccagcatatcgggcatgcctccaccgtccgccgcgatgctccacctggacagaaggttggtcttattgctgctagaagaactgggagactcagagggcaggctgctgctacagctgcgaaggcagataagggttcttagatgatcaactattctctcttagttttatttgtttttgtttcgagtcggtaggtttctgtatggatgtattggtgaagttgaataagttttgttgttgaaaatctttattgggcgaggacagtttttctaattatttatgttttatgtttgtcatttcttcaatgtttttcttctgtatttgacaattattttggaatctgagaactgaactttgtttgtttgtgtttatttaaaatggg

SEQ ID NO: 3231 - DNA, 1060 bp, Phalaenopsis aphrodite
ctcaactccgcttctccttcttcctcgtcttagccgccatgggtagagtgatccgagctcaaaggaagggtgccggttcagttttccgatcgcatacccaccatcgcaagggcccggctcgtttccgcagcctcgacttcagcgagcgtaatggatatcttaagggcgtggtcaccgacatcatccacgaccctggacgcggtgcgccgcttgcccgcgtaaccttccgccatccattccgttacaagcaccagaaggagctctttgtcgcggctgagggcatgtacacggggcaattcgtgtactgcggtcgcaaagcgtctctcatggtcggaaatgttcttcctcttcgctccatccctgagggcgctgtcgtatgcaacgtcgagcaccatgttggagatcgtggaatgctcgcgagggcgtctggggactacgctattgtaatcagccataaccccgataatggcaccagtaggattaaactcccatctggagcgaaaaaatcgtcccaagtggctgccgtgccatgattgggcaagttgctggtggcggtcgaactgaaaagcctcttctgaaagcaggtaacgcctatcacaaatacagagtgaagagaaactgctggcccaaggttcgtggtgttgctatgaacccagtcgaacatccccatggaggaggaaaccaccagcatatcgggcatgcctccaccgtccgtcgcgatgctccacctggacagaaggttggtcttattgctgcgagaagaactgggagactcagagggcaggctgctgctacagctgcaaaggcagataagggttcttagatgatcaacttattctctcttagttttatttgtttttgtttcgtgtccgtaggtttctgtatcgatgtattggtgaagttgaagaagtctttattgggtgaggacagtttttctaatttatttatgttttatgtttgtcatttcttcggtgtttttcttctgtatttgacaattattttggaatctgagagctgaactttgtttgtttgtgtttatttaaaatgggtatactgcatt

SEQ ID NO: 3232 - DNA, 1266 bp, Gossypium raimondii
aaatccccaaaatccaatctataaatcctaatattcaatttaaaagcccaaatccccaaattccaatctaaaaaccctaatcctcaacccctcctatccctttttcactaagctctctctccccatcgtctgcctccaagagaagacagagaggtctcctcacaaccaccgtaatgggtcgtgtcattcgagctcaacgtaagggtgccggttcggtcttcaaggcccatacccaccaccggaagggtcccgcccgtttccgcagcctcgacttcggtgaacggaacggttacctcaaaggtgtcgtcaccgacgtcattcacgaccctggacgtggcgctccgttagcccgcgtcgttttccgccaccctttccgttacaagaaacagaaggaattgttcgtcgccgccgagggtatgtacaccggacagttcgtgtattgtggtaagaaagctacccttgtggttggaaatgtgttgccccttagatctatccctgaaggagctgtcgtttgcaacgttgagcaccatgttggtgaccgtggggttttcgctagagcttctggggattatgctattgttattagtcacaaccctgataatgataccaccaggatcaagcttccatctggttctaagaagattgttccaagtggctgtcgtgcgatgattggccaagttgcaggtggtggtaggactgagaaacctctcctcaaggctggtaatgcttatcacaagtttagagtgaagaggaactgctggcctaaggtgcgtggtgtagctatgaaccctgttgagcatccccatggaggtggtaaccatcaacacatcggtcatgctagtactgttaggcgtgatgctcctcctggacagaaagttggtcttattgctgctaggagaactggtaggctcagaggacaagctgctgctactgctgccaaagctgacaaggcttaggcttagatattacttgctgtaattttagttcttttggtcttcagattttacattcaagagtatttaagacctttatgcttgaaaatgtgtttgaattatcagatattggtactgttttgagttgtttgagcaatgattttgtttttgattcggatttttactcatgtttttggtatttgttgttttcggtttttacccctgttttatgttcgagttttttgaatcgagttattaggtatgaattattttgaattttggtatcttcaagttcaaagttattttcagttacttatatggaacattttatggt

SEQ ID NO: 3233 - DNA, 1246 bp, Gossypium raimondii
ttatacatcatcgagcaaaccctaaccctcaacctccattttgcccatttcactgctctcccctagatcgtctccaagagagagatctccttacagctaccgtacacattcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggccgtggcgctcctttggcccgtgtcgtcttccgtcaccctttccgttacaagaagcagaaggagcttttcgttgccgccgagggtatgtacactggacagttcgtctattgtggtaagaaggctactcttgtggtcggaaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatcaagcttccatctggttcgaagaagattgttccaagtggttgtcgtgccatgattgggcaggttgctggaggtggtaggactgagaaacctctgcttaaggctggtaatgctttccacaagtatagagtgaagaggaactgctggcctaaggttcgtggtgtggctatgaacccagttgagcatccccacggaggtggtaaccatcaacacattggtcatgctagtacagttagacgtgatgctccacctggacaaaaggttggtcttattgctgcaaggaggactggtaggctcagaggacaagctgctgccactgctgccaaggccgataaggcataataggatactagttgttttggcgtttatatttacatcaatgactgttaaagcacatttaagctagaaattttgtttgaaatttcagatatggtactgttttggagtttggatgacagttgtttatgttttcgagtttgggtttttatgtgaaagtgttttatgccagtgtttccaatcattgttctattcgtagcttccataaggatttggtttacgattacataatgttttcctaaatggttggttgttgacgtaattgaaagtttgaacagttatatctaaatgaacaatgacactgttcaaacatatataagcaactttcaatttccttttta

SEQ ID NO: 3234 - DNA, 927 bp, Gossypium raimondii
gtccgcctccaagagaagacagagaggtctcctcacaaccaccgtaatgggtcgtgtcattcgagctcaacgtaagggtgccggttcggtcttcaaggcccatacccaccaccggaagggtcccgcccgtttccgcagcctcgacttcggtgaacggaacggttacctcaaaggtgtcgtcaccgacgtcattcacgaccctggccgtggcgctccgttagcccgcgtcgttttccgccaccctttccgttacaagaaacagaaggaattgttcgtcgccgccgagggtatgtacaccggacagttcgtgtattgtggtaagaaagctacccttgtggttggaaatgtgttgccccttagatctatccctgaaggagctgtcgtttgcaacgttgagcaccatgttggtgaccgtggggttttcgctagagcttctggggattatgctattgttattagtcacaaccctgataatgataccaccaggatcaagcttccatctggttctaagaagattgttccaagtggctgtcgtgcaatgattggccaagttgcaggtggtggtaggactgagaaacctctcctcaaggctggtaatgcttatcacaagtttagagtgaagaggaactgctggcctaaggtgcgtggtgtagctatgaaccctgttgagcatccccatggaggtggtaaccatcaacacatcggtcatgctagtactgttaggcgtgatgctcctcctggacagaaagttggtcttattgctgctaggagaactggtaggctcagaggacaagctgctgctactgctgccaaagctgacaaggcttaggcctagggtattacttgctgtaattttagttcttttggcattcatattttacattcaaaagtatttaagacctttatgcttgaaaatgtgtttgaatt

SEQ ID NO: 3235 - DNA, 1111 bp, Manihot esculenta
aatctacgagctgccgctgcctctcccttctaaacccctttgaaagctgaaatgggtcgcgttatccgtgcccagcgtaagggtgccggttcagtcttcaagtctcacacccaccaccggaaaggtcctgccaggttccgctctctcgactttggggagcgcaatggataccttaagggagtggtcaccgagataatccacgatccaggtcgtggcgcgccgctcgccagagtcacctttcgccatccatttcgctacaagcaccagaaggagctttttgttgctgctgagggaatgtatactggtcagtttgtgtactgtggaaagaaggcaaatttgatggttggaaacgtgttacctctaagatcgattccggaaggagctgttgtgtgtaatgtggagcatcatgttggtgatagaggagtcttcgctagatgttctggggattatgcgattgttattagccataatcctgataatggaactaccagaatcaagcttccttctggagccaagaaaattgtgccaagtgggtgccgagctatggttggtcaagttgcaggtggaggcaggactgagaaacctctattaaaggcaggaaatgcataccacaaatacagagtcaagaggaactgctggcctaaggttcgtggtgttgccatgaaccctgtagagcatcctcatggtggtggtaaccaccagcacattgggcatgccagtactgttcgccgtgatgcacctcctggtcaaaaggttggtctcattgctgcaaggagaactggtcgtctccgaggacaagcagcagcaacagctgccaaagcagacaagggtgcttaaggcccatcactatctggaattctatgtcatgtgattatgttcttctagacaaatcatgttctggtgtaccaatgagaaacttttttcagggacctgattttgtagttgggatataacatgccttaagttttgataagttatcttcaatgcattattgcgttagaaattttcgatattgattttgctttccaccctgtcttggtttatccctgatttgaggtgtcaaagttttgtaatagtttgtgtttctgagaggaattttagattagttgtg

SEQ ID NO: 3236 - DNA, 1015 bp, Chelidonium majus
aaaaagaaaaccagagagtgagatgggtcgtgttatccgcgcccaacgtaagggagctggatctgtattcaaatcccatactcaccaccgcaaaggtccagccagattcaggagtctcgatttcggcgagcgtaatggttacctgaaaggagttgttaccgacatcatccatgacccaggacgtggtgctccacttgccaagattaccttccgtcaccccttccgttacaagcaccagaaggagcttttcgttgccgccgagggtatgtacaccggtatgttcgtctactgtgggaagaaagctaatttgatggtgggtaatgttcttcctctccgatctatccctgaaggaggtgttgtttgcaacgttgagcatcacgttggtgaccgaggagtccttgctagggcttctggtgattatgctattgttatcagtcacaaccctgataatggcacatctaggatcaaactcccatctggagccaagaagatcgtaccaagcagttgtcgtgccatggtcgggcaggttgctggtggaggtagaactgagaagcctatgctcaaggcaggaaatgcttaccacaagttccgtgtgaagagaaactgctggcccaaggttcgtggtgttgctatgaatccagtagagcatccccatggtggtggtaaccaccagcatattggtcacgccagtactgttcgccgtgatgcaccacccggtcaaaaagttggtctcattgctgccaggagaactggtcgtcttcgtggtcaagctgctgccatgtcggctaaggcagataaggcttagtttaatcagacaagataacttctactgttttttcattatttctcgtatcggttttgttttacagacatatgtggtttcttaggaggcatttcttcatgcagttctggatgatgtttttgattttccttttactattaggagtaagatttggatcagttgcaatgaactttgttatttatgcagagctttacttattataatttttatcag

SEQ ID NO: 3237 - DNA, 1066 bp, Cicer arietinum
cagagttctcattgttcatactctccactgcatctgcgtctatctccagagccgcaacaaacaatgggacgtgtgatccgtgcacagcgtaagggagctggctccgtcttcaagtctcacacacaccaccgcaaaggaccggcacgtttccgcagtctcgacttcggagaacgtaacggttacctcaaaggtgttgtaactgacgttattcacgatccaggtcgcggtgcacctctcgctaaagttactttccgtcacccgttccgttacaagaaacagaacgaactcttcgtcgccgctgaaggtttatacaccggtcaattcatttactgcggtaaaaaagcgactctcgttgttggtaatgttcttcctctccgttctatccctgaaggtgctgttatttgtaatgtcgagcatcatgttggtgaccgtggtgcttttgctagagcctctggtgattacgctattgttatcagtcacaaccctgataatgatacatctaggatcaagcttccttctggtgccaagaaggttgtgccaagtgaatgtagggcaatgattgggcaagttgctggtggaggaagaactgagaagccacttttgaaagctggtaatgcttaccacaagtttagggttaagagaaactgctggcctaaggttcgtggtgttgctatgaatcctgttgagcatcctcatggaggaggtaatcaccagcatattggtcatgcaagtactgtcagacgtgatgcacctcctggacaaaaggttggtctcattgctgccaagaggactggtcgtcttagaggtcaagctgctgctactgctgctaaggccgataaggtttaattaaaagattagtttgttaggattatattttattgctgtgttttccaattttgtttcttgttaaactgtttggttattgttatgagaaccatttccccaaaaaatgtgaagcttttggtagacagcttgttttataatatgttccatctatcctgcagtttctctgcatactgatttactatttggttggaaaggctaaattggttttttattacaattc

SEQ ID NO: 3238 - DNA, 1045 bp, Trifolium pratense
  misc_feature (777)..(777): n is a, c, g, or t
tcgccgttttccctcattctcttcaccgttccccgccgcaactaaaaaatgggacgtgttatccgtgcccaacgtaagggtgccggttccgttttcaaatcccacacccaccaccgcaaaggaccagcacgtttccgtagtctcgacttcggcgaacgtaacggttacctaaaaggagttgttaccgacgttattcacgatccaggtcgcggtgctccacttgccaaggttactttccgtcatcctttccgttacaagaaacagaatgagctttttgttgctgctgaaggtttatataccggtcaattcatttactgcggtaaaaaagctactcttgttgttggtaatgttcttcctcttagatctattccagaaggagctgtgatttgtaatgttgaaggtcatgttggtgaccgtggtgtttttgctagagcttctggtgattatgctattgttatcagtcataaccctgataatgatacctctaggatcaagcttccttctggtgcaaaaaagattgtaccaagtgactgtagggcaatgattgggcaagttgctggtggtggtagaactgagaagccacttttgaaggctggtaatgcctatcacaagtttagggtgaagagaaactgctggcctaaggttcgtggtgttgctatgaatccagttgagcatccccatggaggaggtaatcaccagcatattggtcatgcaagtaccgtcagacgtgatgctcctcctggacagaaggttggtctcattgctgccaagaggacnggtcgtcttaggggtcaagctgctgcaagtgctgctaaagccgataaataagaagcttagattgtcagagttatatgttattgcttggtttccagttttgtttcttgttgaactgtttttgtgaaccatttccccaaaaatttattgagcttttgttagacatcattttatttaaatgggttgcatctatatccttgtgttgtttctgtgctttctgatttatcatttgtttggaatggctaaaatattttttacaacttgatttaaa

SEQ ID NO: 3239 - DNA, 1107 bp, Gossypium hirsutum
cctcaacctccatttttgccccatttcactgctctcccctagatcgtctccaagagagagatctccttacagctaccgtacacattcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggccgtggcgctcctttggcccgtgtcgtcttccgtcaccctttccgttacaagaagcagaaggagcttttcgttgccgccgagggtatgtacactggacagttcgtctattgtggtaagaaggctactcttgtggtcggaaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatcaagcttccatctggttcgaagaagattgttccaagtggttgtcgtgccatgattgggcaggttgctggaggtggtaggactgagaaacctctgcttaaggctggtaatgctttccacaagtatagagtgaagaggaactgctggcctaaggttcgtggtgtggctatgaacccagttgagcatccccacggaggtggtaaccatcaacacattggtcatgctagtacagttagacgtgatgctccacctggacaaaaggttggtcttattgctgcaaggaggactggtaggctcagaggacaagctgctgccactgctgccaaggccgataaggcataataggatactagttgttttggcgtttatatttacatcaatgactgttaaagcacatttaagctagaaattttgtttgaaatttcagatatggtactgttttggagtttggatgacagttgtttatgttttcgagtttgggtttttatgtgaaagtgttttatgccagtgtttccaatcattgttctattcgtagcttccataaggatttggtttacgatta

SEQ ID NO: 3240 - DNA, 1017 bp, Gossypium hirsutum
gctctctctccccatcgtctgcctccaagagaagacagagaggtctcctcacaaccaccgtaatgggtcgtgtcattcgagctcaacgtaagggtgccggttcggtcttcaaggcccatacccaccaccggaagggtcccgcccgtttccgcagcctcgacttcggtgaacggaacggttaccttaaaggtgtcgtcaccgacgtcattcacgaccctggacgtggggctccgttagcccgcgtcgttttccgccaccctttccgttacaagaaacagaaggaattgttcgtcgccgccgagggtatgtacaccggacagttcgtgtattgtggtaagaaagctacccttgtggttggaaatgtgttgccccttagatctatccctgaaggagctgtcgtttgcaacgttgagcaccatgttggtgaccgtggggttttcgctagagcttctggggattatgctattgttattagtcacaaccctgataatgataccaccaggatcaagcttccatctggttctaagaagattgttccaagtggctgtcgtgcgatgattggccaagttgcaggtggtggtaggactgagaaacctctcctcaaggctggtaatgcttatcacaagtttagagtgaagaggaactgctggcctaaggtgcgtggtgtagctatgaaccctgttgagcatccccatggaggtggtaaccatcaacacatcggtcatgctagtactgttaggcgtgatgctcctcctggacagaaagttggtcttattgctgctaggagaactggtaggctcagaggacaagctgctgctacagctgccaaagctgacaaggcttaggcttaggcttaggcttaggatattacttgctgtaattttagttcttttggtcttcagattttacattcaagagtgtttaagacctttatgcttgaaaatgtgtttgaattatcagatattggtactgttttgagttgtttgagcaatgattttgtttttgattcggattttt

SEQ ID NO: 3241 - DNA, 1163 bp, Gossypium hirsutum
ctctctctccccatcgtctgcctccaagagaagacagagaggtctcctcacaaccaccgtaatgggtcgtgtcatacgagctcaacgtaagggtgccggttcggtcttcaaggcccatacccaccaccggaagggtcccgcccgtttccgcagcctcgacttcggtgaacggaacggttacctcaaaggtgtcgtcaccgacgtcattcacgaccctggacgtggcgctccgttagcccgcgtcgttttccgccaccctttccgttacaagaaacagaaggaattgttcgtcgccgccgagggtatgtacaccggacagttcgtgtattgtggtaagaaagctacccttgtggttggaaatgtgttgccccttagatctatccctgaaggagctgtcgtttgcaacgttgagcaccatgttggtgaccgtggggttttcgctagagcttctggggattatgctattgttattagtcacaaccctgataatgataccaccaggatcaagcttccatctggttctaagaagattgttccaagtggctgtcgtgcgatgattggccaagttgcaggtggtggtaggactgagaaacctctcctcaaggctggtaatgcttatcacaagtttagagtgaagaggaactgctggcctaaggtgcgtggtgtagctatgaaccctgttgagcatccccatggaggtggtaaccatcaacacatcggtcatgctagtactgttaggcgtgatgctcctcctggacagaaagttggtcttattgctgctaggagaactggtaggctcagaggacaagctgctgctacagctgccaaagctgacaaggcttaggcttaggcttaggcttaggatattacttgctgtaattttagttcttttggtcttcagattttacattcaagagtgtttaagacctttatgcttgaaaatgtgtttgaattatcagatattggtactgttttgagttgtttgagcaatgattttgtttttgattcggatttttacccatgttttggtatctgttgtttcggttttacccctgttttatgttcgagttttttgaatcgagttattaggtatgaattattttggatttttggtatcttcaagttcaaagttattttgagttacttatatggaacattttatg

SEQ ID NO: 3242 - DNA, 1164 bp, Gossypium hirsutum
ttttttttttgcccattccactgctcgatctccttacagctaccgtacacactcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggtcgtggcgctcctttagcccgtgttgtcttccgtcaccctttccgttacaagaagcagaaggaacttttcgttgccgcagagggtatgtacactggacagttcgtctattgtggtaagaaggctactcttgtggtcggaaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatcaagcttccatctggttcgaagaagattgttccaagtggttgtcgtgccatgattgggcaggttgctggaggtggtaggactgagaaacctctgcttaaggctggtaatgctttccacaagtatagagtgaagaggaactgctggcctaaggttcgtggtgtggctatgaacccagttgagcatccccacggaggtggtaaccatcaacacattggtcatgctagtacagttagacgtgatgctccacctggacaaaaggttggtcttattgctgcaaggaggactggtaggctcagaggacaagctgctgccactgctgccaaggccgataaggcataataggatactagttgttttggcgtttatatttacatcaatgactgttaaagcacacatttaagctagaaattttgtttgaaatttcagatatggtactgttttggagtttggatgacagttgtttatgttttcgagtttgggtttttatgtgaaagtgttttatgccagtgtttccaatcattgttctattcgtagcttccataaggatttggtttacgattacataatgttttcctaaatggttggttgttgacgtaattgaaagtttgaacagttatatctaaatgaacaatgacactgttcaaacata

SEQ ID NO: 3243 - DNA, 1205 bp, Gossypium hirsutum
ctaaccctcaacctccattttgcccatttcactgccctcccctagatcgtctccaagagagagatctcccacattcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatacacgaccctggccgtggcgctcctttagcccgtgtcgtcttccgtcaccctttccgttacaagaagcagaaggagcttttcgttgccgccgagggtatgtacactggacagttcgtctattgtggtaagaaggctactcttgtggtcggaaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatcaagcttccatctggttcgaagaagattgttccaagtggttgtcgtgccatgattgggcaggttgctggaggtggtaggactgagaaacctctgcttaaggctggtaatgctttccacaagtatagagtgaagaggaactgctggcctaaggttcgtggtgtggctatgaacccagttgagcatccccacggaggtggtaaccatcaacacattggtcatgctagtacagttagacgtgatgctccacctggacaaaaggttggtcttattgctgcaaggaggactggtaggctcagaggacaagctgctgccactgctgccaaggccgataaggcataataggatactagttgttttggcgtttatatttacatcaatgactgttaaagcacacatttaagctagaaattttgtttgaaatttcagatatggtactgttttggagtttggatgacagttgtttatgttttcgagtttgggtttttatgtgaaagtgttttatgccagtgtttccaatcattgttctattcgtagcttccataaggatttggtttacgattacataatgttttcctaaatggttggttgttgacgtaattgaaagtttgaacagttatatctaaatgaacaatgacactgttcaaacatatataagcaactttcaattt

SEQ ID NO: 3244 - DNA, 998 bp, Eschscholzia californica
caaaaccctagcctaggaaaaaaaaaaccagtcgagatgggaagagttatccgtgctcaacgtaagggagctgggtcagtattcaaatcccacactcatcaccggaaaggtccggccaggttcagaagtctcgacttcggtgaacgaaatgggtatctgaaaggtgttgtcactgacatcatccatgatccaggtcgtggtgcacctctcgccaaggtcactttccgtcaccccttccggtacaagcaccagaaggaacttttcgttgcggcggagggtatgtatactggtcagtttttgtattgtggaaagaaagctaatttaatggtgggaaatgttcttcctttgagatctatccccgaaggagctgttgtttgtaacgttgaacatcatgtcggtgatcgaggtgttcttgctagggcttctggtgattatgctattgttatcagtcacaaccctgataatggtacctctaggatcaagctcccatcaggatcaaagaagattgttccaagtgggtgcagagccatggttggccaagttgctggtggtggtaggactgagaagcctatgctgaaagctggaaatgcataccacaagtaccgagtaaagagaaactgctggcctaaggttcgtggtgttgctatgaatccagttgagcatccccatggtggtggtaaccaccaacatatcggtcacgccagtactgttcgtcgtgacgcacctcctggtcaaaaagttggtctcattgctgctagaagaactggtcgtcttcgtggtcaagctgctgcctctgcttctaaagcagactaggcttaatttagtcggaaattatgatgtcttttgttgttttgtcttcattttcatttagcagacatttgtggtttgttaggagtcatttatggtgttccctttttatcctcacaatcggtaaagttcggtcatctgttacaatgagatcctatagttttgtagtttcaaagattttgttgatggta

SEQ ID NO: 3245 - DNA, 1030 bp, Capsicum annuum
gagtaagtgagagcgccgcaatgggtcgcgttatcagagcacaacgtaagggagcaggctccgtattcaaatcccacactcaccaccgcaagggccctgctaggttccgttcactcgatttcggtgaacgcaatggttacctcaaaggtgttgttacagaaattatacatgatccaggtaggggtgcgccattagcacgtatgacattccgtcatccattccgttacaaacatcagaaggagttgttcgttgctgctgaagggatgtacactggccagttcatttactgtgggaagaaagccaatcttatggtcggtaatgtgttggcacttagatctattcctgaaggagctgttgtttgtaacgttgagcataaagttggtgaccgtggcgtttttgctagatgctctggtgattatgctattgttatcagtcacaatcccgataacggaacaactaggattaagcttccatctggatccaagaagattgtgcccagtgggtgtcgagccatgattggtcaggttgctggtggaggaagaactgagaaaccaatgcttaaagctggtaatgcataccacaagtaccgtgttaagaggaactgctggccgaaggttcgtggtgttgctatgaatcctgtggagcatcctcatggtggtggtaaccatcaacatattggtcatgccagcactgtccgtcgtgatgcaccacctgggcaaaaggttggtcttattgcagcaaggaggactggtcgcctccgcggtcaagctgctgctactgctgccaaagctgacaaggcttaagatatttagcttgttactgttttcctccttgtgttcgattttgagtattcagctgcaactgtctttatactaagttttattgggatgttgtttagaagttttgtttaaggatccttgcttcgacaaatttgccatttataaatgtgtttagcttggctaccaaaaaaaaaaaaaaaaaactcgagcgagttgcatggactgttgctgtactcgtgatggttataaac

SEQ ID NO: 3246 - DNA, 1023 bp, Capsicum annuum
ctcccattcatcttgtttcatttctcccctctatatcccttccccgagcaacacagcaagagtaagtgagagcgccgcaatgggtcgcgttatcagagcacaacgtaagggagcaggctccgtattcaaatcccacactcaccaccgcaagggccctgctaggttccgttcactcgatttcggtgaacgcaatggttacctcaaaggtgttgttacagaaattatacatgatccaggtaggggtgcgccattagcacgtatgacattccgtcatccattccgttacaaacatcagaaggagttgttcgttgctgctgaagggatgtacactggccagttcatttactgtgggaagaaagccaatcttatggtcggtaatgtgttggcacttagatctattcctgaaggagctgttgtttgtaacgttgagcataaagttggtgaccgtggcgtttttgctagatgctctggtgattatgctattgttatcagtcacaatcccgataacggaacaactaggattaagcttccatctggatccaagaagattgtgcccagtgggtgtcgagccatgattggtcaggttgctggtggaggaagaactgagaaaccaatgcttaaagctggtaatgcataccacaagtaccgtgttaagaggaactgctggccgaaggttcgtggtgttgctatgaatcctgtggagcatcctcatggtggtggtaaccatcaacatattggtcatgccagcactgtccgtcgtgatgcaccacctgggcaaaaggttggtcttattgcagcaaggaggactggtcgcctccgcggtcaagctgctgctactgctgccaaagctgacaaggcttaagatatttagcttgttactgttttcctccttgtgttcgattttgagtattcagctgcaactgtctttatactaagttttattgggatgttgtttagaagttttgtttaaggatccttgcttcgacaaatttgccatttataaatgtgtttagcttggctacc

SEQ ID NO: 3247 - DNA, 1083 bp, Lippia dulcis
ttcctcgccgttcttcacagtctccgccatgggacgtgtcatcagagctcagcgtaagggtgccggctccgttttcaagtctcacacccaccaccggaagggccccgcacgcttccgctcgctcgatttcggcgagcgaaatgggtatatcaagggcgtcgtcaccgaaatcatccacgatcccggccgtggtgcgccgctcgctcgcgtcaccttccgccaccccttccgctaccagcaccagaaggagctgttcgtcgccgccgagggcatctacaccggccagttcatctactgcgggaagaaggctaaccttgttgttggaaatgtgttgcctcttagatctattcctgagggtgctgtcgtctgcaacgtcgagcatcatgtcggtgaccgtggtgttttcgctagggcttctggggattacgccattgttatttcgcataaccctgataatggaacaactaggatcaaactcccatcaggttccaagaagattgtccccagcgggtgccgtgccatggtcggtcaagttgcaggaggaggccgtactgagaaaccacttttgaaggccggaaacgcataccacaaattcagagtgaagaggaactgctggcctaaggttcgtggtgttgctatgaacccagtggagcatcctcatggaggtggtaaccatcagcacattggtcacgcaagtacggttcgtcgtgatgcaccacctggacaaaaggtcggtcttattgctgccagaagaaccggtcggctccgtggtcaagctgctgcaactgctgctaaggccgacaaggcttagattggtatgatagatcagtcttggacgatgaagttaattttgtcaagtttttgttttcggttgagttcggattggattttgcatgatatactagttttgttgggtttattgatattaatactttgtgactttagtgatgctttttttgaaatgattctgttcaagatactacttttcatctgctgtttaactcggtttgtgattttagtttttgcaaaaatttctggttgtggaggaaaaaagttgtaaaattatagtacaagtgagtaaaa

SEQ ID NO: 3248 - DNA, 971 bp, Solanum tuberosum
agagagaaggcgccgaaatgggtcgtgtaatcagagcacaacgtaagggagcaggctccgtcttcaaatctcacactcatcaccgcaagggacctgcaaggttccgttcacttgatttcggtgaacgtaatggttatctcaaaggtgttgttacagaaatcattcatgatccaggtaggggtgcaccattggcacggatgacattccgtcatcctttccgttacaagcatcagaaggagttgttcgttgctgcagaagggatgtatactggtcaatttatttactgtgggaaaaaagctaatcttatggttggtaatgtgcttgcactcagatctatccctgaaggagctgttgtttgtaatgttgagcataaagttggtgaccgtggtgtttttgctagatgctctggtgattatgctattgttatcagtcataaccctgataacggaacaactaggattaagcttccatctgggtccaagaagattgtgcccagtggatgtcgagccatgattggtcaggttgctggtggaggaagaactgagaaaccaatgcttaaagctggtaacgcataccacaaataccgggttaagaggaactgctggcctaaggttcgtggtgttgctatgaatcctgtggagcatcctcatggtggtggtaaccatcaacatattggtcatgccagtactgtccgtcgtgatgcaccacctgggcaaaaggttggtcttattgcagcaaggaggactggtcgtcttcgtggtcaagctgctgctactgctgccaaagctgacaaggcctaagatattagttttgtgttactgttttccttcttgttgtgtttggattttgagtattcagctacaatcatctttataccaagttaagttttgttgggatattattttagaagttttgttaaggacccttgcttacacaaatttgccatttataaatgcgtttagcttggctct

SEQ ID NO: 3249 - DNA, 969 bp, Solanum tuberosum
caaaacctctccggcgagagagtgtagagagagagaagagagagaaaccggcgaaatgggtcgtgttatcagagcacaacgtaagggagctgggtcggttttcaaatcccatacccaccaccggaaaggtccggcccgattccgtaccctcgatttcggcgagagaaatggatacctgaaaggagtaatcacagaggtgattcacgatccagggagaggtgcaccacttgcacgcgtgacattccgtcatcctttcaggtacaagcatcagaaggagctgttcgttgccgctgaagggatgtacactggacagtttgtgtattgtgggaaaaaagctactcttatggttggtaatgtgttgccgcttagatctattcccgaaggagctgttgtttgtaacgttgagcataaagttggcgaccgtggtgtttttgctaggtgttctggtgattacgccattgttatcagtcacaatcctgataatggtaccactagggttaagctcccatcaggtgccaaaaagattgtgcccagtggatgtcgtgctatgattggtcaggttgctggtggaggacgtactgagaaaccaatgcttaaagctggtaatgcttaccataagtaccgtgtgaagaggaactgctggcctaaggttcgtggtgttgctatgaatcccgtggagcatccccatggtggtggtaaccatcaacacattggtcatgccagtacagtccgtcgtgatgcacctcctggacaaaaggttggtcttattgctgcaaggaggactggtcgtcttcgtggtcaagctgctgctagtgctgccaaggctgacaaggcttaagccattcacttgttacttttctatcttgttattttatcctgatcaatttttgagtattcagttaaaaaccattttgtagtgaagttataacatgctaaattttgttgggatgtttagtaagttttgttttc

SEQ ID NO: 3250 - DNA, 1082 bp, Solanum phureja
cccaaatcataactagggcaacacattaccctctaaaaaccctagtatatcatcttcttcctatcactctcctcaaaacccctccggcgagagagtgtagagagagagaagagagagaaaccggcgaaatgggtcgtgttatcagagcacaacgtaagggagctgggtcggttttcaaatcccatacccaccaccggaaaggtccggcccgattccgtaccctcgatttcggcgagagaaatggatacctgaaaggagtaatcacagaggtgattcacgatccagggaggggtgcaccacttgcacgcgtgacattccgtcatcctttcaggtacaagcatcagaaggagctgttcgttgccgctgaagggatgtacactggacagtttgtgtattgtgggaaaaaagctactcttatggttggtaatgtgttgccgcttagatctattcccgaaggagctgttgtttgtaacgttgagcataaagttggtgaccgtggtgtttttgctaggtgttctggtgattacgccattgttatcagtcacaatcctgataatggtaccactagggttaagctcccatcaggtgccaaaaagattgtgcccagtggatgtcgtgctatgattggtcaggttgctggtggaggacgaactgagaaaccaatgcttaaagctggtaatgcttaccataagtatcgtgtgaagaggaactgctggcctaaggttcgtggtgttgctatgaatcctgtggagcatccccatggtggtggtaaccatcaacacattggtcatgccagtacagtccgtcgtgatgcacctcctggacaaaaggttggtcttattgctgcaaggaggactggtcgtcttcgtggtcaagctgctgctagtgctgccaaggctgacaaggcttaagccattcacttgttacttttctatcttgttattttatcctgatcaatttttgagtattcagttaaaaaccattttgtagtgaagttataacatgctaaattttgttgggatgtttagtaagttttgttttcatgatccttgtttggtgcattttattacctattcccctca

SEQ ID NO: 3251 - DNA, 976 bp, Camellia sinensis
catttccttctcacccctacctcttcttaccttccgccgtcccaaaccctagagagagagagagagagagagatgggtcgtgtgatcagagctcaacgtaagggtgctgggtccgtattcaagtcccacacccaccaccgcaagggtccagctcggttccgcagcctcgacttcggcgagcgcaacggctacctgaagggcgtgatcaccgagatcatccacgacccaggtcgcggtgcgcctctggctcgagtcacgttccgtcaccccttccgattcaagcaccagaaggagctcttcgtcgccgccgaaggcatgtacactggccagttcgttttctgcggaaagaaagccaatctcatggttggcaatgttcttcctctcagatctatccctgaaggtgctgttgtttgcaacgttgaacaccatgtcggtgatcgtggtgtcttggctagagcttctggtgattacgctattgttatcagtcataacccagataatggtacctcaaggatcaaactcccatcaggagcgaaaaagattgtgcccagtgggtgtcgggccatgattggccaggttgccggaggaggacgtactgaaaagcccatgctcaaggctggtaacgcatatcacaagtatcgtgtcaagaggaacagctggcccaaggttcgtggtgtggctatgaatcccgtggagcatccccatggtggtggtaaccatcaacatattggtcatgccagcactgttcgccgtgatgcaccacctgggcaaaaggtcggtcttattgctgccaggaggactggtcgtctccgtggacaagccgctgctaccgctgccaaagctgataagactacttagtgagatttttaaggatgctttggctttttattttcgttattttctttccagtctttatgattcaggtggatatggagtttcacaggatatagagtaatatctgtggggaatcttagaa

SEQ ID NO: 3252 - DNA, 815 bp, Nicotiana tabacum
agagagagagagagagagagagagagagacggcgaaatgggtcgtgtaatcagagcacaacgtaagggagcagggtccgttttcaaatcccacactcaccaccgtaaaggtccggcccgattccgtaccctcgatttcggcgaacgtaacggttacctaaagggagtaatcacagaagtgattcacgatcccggtagaggagcaccactcgcgcgcgtgacattccgtcatccgttccgttacaagcaccaaaaagagttgttcgttgctgctgaagggatgtacactggtcagttcgtttactgcggtaaaaaagctactcttatggtcggcaatgtattgccgctcagatctataccagaaggagctgttgtatgtaatgtggagcataaagtgggagatcgtggtgtttttgctagatgctctggtgattatgccattgttatcagccacaaccctgataatggtaccactagggttaagcttccatcaggagccaaaaagattgtgccaagtggatgtcgtgccatgattggtcaagttgctggaggaggacgtaccgagaaaccaatgctcaaagctggtaatgcttaccacaagtaccgggtgaagaggaactgctggcctaaggtccgtggtgttgctatgaatcctgtggagcatcctcatggtggtggtaaccatcaacatattggtcatgccagcacagtccgtcgtgatgcacctcctgggcagaaggtcggtcttattgctgcaaggaggactggtcgtctccgtggtcaagctgccgccactgctgccaaggctgacaaggc

SEQ ID NO: 3253 - DNA, 976 bp, Nicotiana tabacum
gagagagggagagagagagagagggcgaaatgggtcgtgtgatcagagcacaacgtaagggagcagggtcagtcttcaagtcccatacccaccaccgtaaaggccctgcccgattccgttccctggacttcggcgaacggaatggttacctcaagggtgtcataacggaggttattcatgacccaggtaggggtgccccattggcgcgtatcactttccgtcacccgttccgttacaagcaccagaaggaactgttcgtggctgctgagggtatgtacagtggccagttcgtttactgtgggaagaaggctactctcatggttgggaatgttctcccactcagatctatccctgaaggagctgtcgtttgcaatgtggaacacaaggttggtgaccgtggcgtttttgccaggtgctctggtgattatgctattgtcatcagtcacaaccccgataacggaaccactaggattaagctgccatcaggatccaagaagattgttcccagtgggtgtcgtgccatgattggtcaagtagctggaggaggacgtactgagaagccaatgcttaaggccggtaatgcataccacaagtaccgggtaaagaggaactgctggcccaaggttcgtggtgttgctatgaatcctgtggagcatcctcatggtggtggtaaccatcaacatattggtcatgctagtactgtccgtcgtgacgcaccacctggccaaaaggtcggtcttattgctgcaaggaggactggtcgtcttcgtggtcaagctgctgctacagctgccaaggctgacaaagcttaaaaagtttagcttgttactgtttttccctacttgtttcctgattaagactttttaattaactatttggtgctgaaattatactaaattttgctctgatgttgagtagcaaatttgttttagatatccatatttggacaagtttgccatttaccgttttcattcct

SEQ ID NO: 3254 - DNA, 1058 bp, Solanum lycopersicum
taaacttgttacggccctcctccctctaaaaaccctaactccctttcttctttattccatttcttcctctattcccaaaaacttagacagaaggcgccgaaatgggtcgtgtgatcagagcacaacgtaagggagcaggctccgtcttcaaatctcacactcatcaccgcaagggacctgcaaggttccgttcacttgatttcggtgaacgtaatggttatctcaaaggtgttgttacagaaattattcatgatccaggtaggggtgcaccattggcaaggatgacattccgtcatcctttccgttacaagcatcagaaggagttgttcgttgctgcagaagggatgtatactggtcagtttatttactgtgggaaaaaagctaatctaatggttggtaatgtgcttgcactcagatctatccctgaaggagctgttgtttgtaatgttgagcataaagttggtgaccgtggtgtttttgctagatgctctggtgattatgctattgttatcagtcataaccctgataacggaacaactaggattaagcttccatctggatccaagaagattgtgcctagtggatgtcgagccatgattggtcaggttgctggtggaggaagaactgagaaaccaatgcttaaagctggtaacgcataccacaaataccgtgttaagaggaactgctggcctaaggttcgtggtgttgctatgaatcctgtggagcatcctcatggtggtggtaaccatcaacatattggtcatgcaagtactgtgcgtcgtgatgcaccacctgggcaaaaggttggtcttattgcagcaaggaggactggtcgtcttcgtgggcaagctgctgctacagctgccaaagctgacaaggcctaagatattagttttgtgttactgttttccttgttgtgtttggattttgagtattcagctactgtcatctttatactaagttaagtttaagttttgttgggatattattttagaagttttgttaaggacccttgcttacacaactttgccatttataaatgtgtttagcttggctca

SEQ ID NO: 3255 - DNA, 1242 bp, Phaseolus coccineus
cgagaacttaaaatttcaaatgattgtatttcatattctacttttctgaaacttcgtctggaactaaaactcaagatacgaaaacagaaaagtaaatttgaaatattgggctacaggaagaaactgcctatttaaattcataggttgacccaacactattcctctaaagcccatttgggctctagtgatcccggctcgatcttaaaagttactaagttgcaatttacgtcaaatacaaaacggcgtcgcgtccgctatatattatcagcaaagccaaaaaccctaggttccgatccatccttcttccatcggcgcggcgaacactcacacacacaggtgaatcggaatgggaagggtaattcgcgcacagcgtaagggtgcgggctccgttttcaagtcccacacccaccaccgcaagggtccggcgaggttccgcagcctcgatttcggcgaacgcaatggctacctgaagggagtggtcaccgacatcatccacgaccccggtcgcggtgcccctctcgccaaggtcactttccgccatcccttccgctacaagaagcagacggaactcttcgtttctgccgaaggtctatatactgggcagttcctctactgcggcaagaaggccactctcgtggttggcaacgtcttgcccctccgatccatccccgagggtgctgtcatctgcaacgttgaacaccacgttggtgatcgcggtgtcttcgccagagcatccggtgactacgccattgttatcagccacaaccccgataatgacacctctaggatcaagcttccttctggttcaaagaagattgtgccgagtgcatgtagggcaatgattgggcaagttgcaggtggagggagaactgagaagcctcttcttaaggctggtaatgcttaccacaagtttagagtgaagagaaactgctggcctaaggtgcgtggtgtggctatgaacccagttgagcatcctcatggaggaggtaaccaccagcacattgggcatgctagtactgtcaggcgtgatgctcctcctggccagaaggttggtctcattgctgccaggaggactggtcgtcttagggggcaagctgctgccactgcttctaaagctgacaagactacttaaggagattgttagagatatgcttaattacaatttttcaaattttgttctttgatagtttatgttcaactttttggcttactatttttgaactaccatttccaccattaata

SEQ ID NO: 3256 - DNA, 802 bp, Phaseolus coccineus
gacgtgtgatccgtgcgcagcgtaagggtgcgggctcagtcttcaagtcccacactcaccaccgcaagggtccggctcgcttccgcagtctcgactttggggagcggaacggctacctcaagggtgtcgtcaccgacgtcatccacgaccctggccgcggtgccccacttgctaaggttactttccgtcatcccttcagatacaagaagcaaaatgagctcttcgttgccgccgaaggcctttatactggtcagttcatctactgcggcaagaaggccactctcgtagttggtaatgttttgcccattcgctctatccctgaaggagctgttatatgcaatgttgagcaccatgtcggtgaccgtggtgtcttcgctagggcttctggcgactatgccatcgttatcagtcacaaccctgataatgacacatctaggattaagcttccatctggtgcgaagaagattgtccccagtgactgcagggccatgattgggcaagttgcaggcggtggaagaactgagaagcctcttcttaaggctggaaatgcttaccacaagtttagagtgaagaggaattgctggcccaaggtgcgtggtgttgctatgaatcctgttgagcatcctcacggaggaggtaaccaccagcacattggtcacgccagtactgtcaggcgtgatgctcctcctggacagaaggttggtctcattgctgctaggaggactggtcgtcttagaggacaagctgctgcaactgcttccaaggctgataaggtttaaggagagagtgttgttaggattgg

SEQ ID NO: 3257 - DNA, 1503 bp, Gossypium raimondii
ctcttaccttaaaaccccatttaactagtctcttctcttccaccagccgcctcaacgagagaggtctcttcataaccacccaatgggtcgtgtcatccgagctcaacgtaagggtgcgggttccgttttcaagtcccacacccaccatcgcaagggtgccgctcgtttccgcagtctcgactttggtgaacggaatggctaccttaaaggtgtcgtcacggaagttatccacgacccgggccgtggtgctcccttagtccgcgtcgtcttccgtcatccattccgttacaagaaacagaaggaactgttcgttgctgccgaaggcatgtacactggacagttcgtgtactgcggtaagaaggctactcttatggtcgggaacgtgttgcctcttagatctatccctgaaggagcggtcgtttgcaacgtcgaacatcacgttggtgatcgtggtgttttcgctagggcttctggtgattacgctattgtaatcagtcacaatcctgataacgacaccaccaggatcaagcttccatctggtgccaagaagattgttccgagtgggtgccgtgcaatgattggccaggttgcaggaggtggaaggaccgagaaacctcttcttaaggcgggcagcgcataccataagtacagggtgaagaggaactgctggcctaaggtgcgtggtgtggctatgaatccagttgagcatccccatggtggtggtaaccatcaacacattggtcatgctagtactgttaggcgtgatgctcctcctgggcagaaggttggtcttattgctgcaaggaggactggtaggctcagaggacaagccgctgccaccgcagccaaggctgataaggcttaagcgtaggtctcttaaaaactgcaaagatgtcatcatcaacagcggccaatcaagtgagggcatctcacatactcatcaagcaccaaggctctcgtcgtaaggcttcttggaaggatccagaaggtcgcgtcatctccaccaccacccgagacgccgctgtctcacagcttaaacttctccgcgacgacatcgtttccaacaaggctaagttcgacgaggttgcctctcgctactccgattgcagctccgctaaacgtggcggtgatctcggtccttttggtcgaggccagatgcaaaagccatttgaggatgcaacatataatcttaacataggcgagataagtgacattgtggatactgatagcggtgttcacatcataatgagaactggttgatcattagtgatggagcctggatatcgtgagcaattagttcagtcttcgcggactattctatccaagaacattctgaaatcacttctgataatgcctatggctaatttcattgaactctttttgcttgagagtgacctaaatgcatgggataatttggttgctaaagcatttaatttttgaacctttttggttttggtgtgacagtttataataaataaaaaatatttggtgaactaaattact

SEQ ID NO: 3258 - DNA, 786 bp, Gossypium raimondii
aatgggtcgtgtcatccgagctcaacgtaagggtgcgggttccgttttcaagtcccacacccaccatcgcaagggtgccgctcgtttccgcagtctcgactttggtgaacggaatggctaccttaaaggtgtcgtcacggaagttatccacgacccgggccgtggtgctcccttagtccgcgtcgtcttccgtcatccattccgttacaagaaacagaaggaactgttcgttgctgccgaaggcatgtacactggacagttcgtgtactgcggtaagaaggctactcttatggtcgggaacgtgttgcctcttagatctatccctgaaggagcggtcgtttgcaacgtcgaacatcacgttggtgatcgtggtgttttcgctagggcttctggtgattacgctattgtaatcagtcacaatcctgataacgacaccaccaggatcaagcttccatctggtgccaagaagattgttccgagtgggtgccgtgcaatgattggccaggttgcaggaggtggaaggaccgagaaacctcttcttaaggcgggcagcgcataccataagtacagggtgaagaggaactgctggcctaaggtgcgtggtgtggctatgaatccggttgagcatccccatggtggtggtaaccatcaacacattggtcatgctagtactgttaggcgtgatgctcctcctgggcagaaggttggtcttattgctgcaaggaggactggtaggctcagaggacaagccgctgccaccgcagccaaggctgataaggcttaagc

SEQ ID NO: 3259 - DNA, 940 bp, Ambrosia trifida
aacaagaaatgggtcgtgtaatcagagcacaacgtaagggagcaggctccgtcttcaagtcccacacccaccatcgcaaaggcccagcacgtttccgcagcctagacttcggtgaacgtaacggctaccttaaaggtgtcataacagagatcattcatgacccgggtcgtggagccccgcttgcccgggtcacgttccgtcacccgtttaggtacaagcatcagaaggagctgtttgtggctgctgaagggatgtacacgggacagtttgtgttttgcgggaagagggctaatttaatggtcggtaatgtgttgcctcttcggtctattcctgaaggagctgtggtttgtaatgtggaacatcatgttggtgatcgtggttcgtttgctagagcttctggtgattatgctattgttattagtcataatcctgataatggtaccactagggtgaagcttccttctggagccaagaaaattgtgccaagtgggtgccgtgctatgattggtcaagtagctggtggaggacgtactgagaagccaatgttgaaggctggtaatgcgtatcacaagttccgtgtgaagagaaactgctggcctaaggttcgtggtgttgctatgaatccagtggagcatccccatggtggtggtaaccatcaacatatcggtcatgccagtactgttcgtcgtgacgcaccacctggtcaaaaggttggtcttattgccgctaggaggactggtcgtctcaggggtcaagctgctgccactgctgctaaggccgacaagtgataaactggtgttatggatgtcaattttagttttgttattgttgggtctgttacttttattgttagttttttccagtttacctgctactactgttatgtttgttctcagacattcaatcattttggaaagttttgcagtaagatactgattac

SEQ ID NO: 3260 - DNA, 938 bp, Ambrosia trifida
ccggttcgacgtacgtcacgacgaacggacggtccgacgtagtctaacgacgacgaggacacggggcggagtcctaaccctacgagagagagagagagagttagagagagacaacaaatgggtcgtgtaatcagagcacaacgtaagggagcaggctccgtcttcaagtcccacacccaccatcgcaaaggcccagcacgtttccgcagcctagacttcggtgaacgcaacggctaccttaaaggagtcataaccgagatcattcatgacccgggtcgtggagccccgcttgccaaggtcacgttccgtcacccctttaggtacaagcatcagaaggagctgtttgtggctgctgaagggatgtacactggacagtttgtgttctgtgggaagaaggctaacttaatggttggtaatgtgttgccgcttcggtctattcctgaaggagctgtggtttgtaatgtcgagcatcatgttggggatcgtggctcgtttgctagagcttctggtgattatgctattgttattagtcataatcctgataatggtaccactagggttaagcttccatctggagccaagaaaatcgtgccaagcgggtgcagagctatgatcggtcaggttgcaggaggtggtagaaccgagaagccgatgcttaaagcaggtaacgcttatcacaagttccgcgtgaagagaaactgctggcccaaggttcgtggtgttgctatgaacccagttgagcatccccatggtggtggtaaccatcaacatatcggtcatgcaagtaccgttcgtcgtgatgcgccacctggtcaaaaggttggtcttattgccgctaggaggactggacggctcagaggtcaagctgctgctactgctgccaaggctgataagtagagcgcttgaatggattttggtatcaggtttgaagtttttac

SEQ ID NO: 3261 - DNA, 942 bp, Ambrosia trifida
cctaaccctacgtagagagagagagagagtttagagagagaaacaacaaatgggtcgagtaatcagagcacaacgtaagggagcaggctccgtcttcaagtcccacacccaccatcgcaaaggcccagcacgtttccgcagcctagacttcggtgaacgcaacggctaccttaaaggagtcataaccgagatcattcatgacccgggtcgtggagccccgcttgccaaggtcactttccgtcacccctttaggtacaagcatcagaaggagctgtttgtggctgctgaagggatgtacactggacagtttgtgttctgtgggaagaaggctaatttgatggttggtaatgtgttgccgcttcggtctattcctgaaggagctgtggtttgtaatgtcgagcatcatgttggtgatcgtggctcgtttgctagagcttctggtgattatgctattgttattagtcataatcctgataatggtaccactagggttaagcttccatctggagccaagaaaatcgtgccaagcgggtgcagagctatgatcggtcaggttgcaggaggtggtagaaccgagaagccgatgcttaaagctggtaacgcttatcacaagttccgcgtgaagagaaactgctggcccaaggttcgtggtgttgctatgaacccagttgagcatccccatggtggtggtaaccatcaacatatcggtcatgcaagtaccgtccgtcgtgatgcacctcctggtcaaaaggttggtcttattgccgctaggaggactggacggctcagaggtcaagctgctgctactgctgccaaggctgataagtagagcgcgcttgaatggattttggtatcaggtttgaagtttttacttatctgtttgttttattttaagttgggtacttttgattggttaatctacaatacttgatacaatgttat

SEQ ID NO: 3262 - DNA, 1023 bp, Cicer arietinum
ccatttcattgttgccgcggtaggggtagaactaaattattcgggatgggtagggttatcagggcacaacgtaagggtgcgggatcagtcttcaaatcccacacccaccaccgtaagggaccagccagattccgcagtctcgatttcggtgaaagaaacggttacctcaagggagtaatcaccgatatcatccatgaccctggtcgtggtgcacccctcgctaaggtctctttccgtcatccttttaggtataagaaacagagtgagcttttcgttgctgctgaaggaatctacactggacagtttatttactgtggaaagaaagctactcttgttgttggtaatgttttgcctctcagatctatccctgaaggagctgttatttgcaatgttgaacaccatgttggtgaccgtggtgctttcgctaggtgttctggtgattacgctattgttatcagtcacaaccccgataatgatacctctagaattaagcttccatctggagcaaagaagattgttccaagtgggtgcagagctatgattggacaagttgcaggtggaggaagaactgagaagccacttcttaaggctggtaatgcttaccacaaatttagagtgaagaggaattgctggcctaaggttcgtggtgttgctatgaatccagttgagcatcctcacggaggaggtaaccaccaacatattggacatgctagtactgttaggcgtgatgctcctcctggacagaaggttggtctcattgctgccaagaggactggtcgtcttaggggacaagctgccgcaactgctgctaaggctgataagaccacttgaagagactcttagggttttatttcattgcaagtttttgaaattttgtttgtttccttgtttgttccaaactgcttggatattgttttgagaaccctttgccccatttatatgaatcttttaaatgacagtatttatatttgttttcaactactattttgtccgtcagtttgccttcatgatttttatcaagtt

SEQ ID NO: 3263 - DNA, 1442 bp, Citrus sinensis
  misc_feature (634)..(634): n is a, c, g, or t
  misc_feature (1311)..(1311): n is a, c, g, or t
ctaactcgtccacctcttggtggcttaatataaaaaaaaattctctctaaaaaaaaaaaatttatacacacacatatgggcaatatggtaatttagaaaaccctttcttatagataaatcagcatttcgcactatctccgtttggagtcccagccgcacttgtcaaaaaaccccaaaaccctagacagagagtcacagcgaatcgactcaaatgggacgagtcattagagcacagcgtaagggagcgggctccgtcttcaagtcgcacacacaccaccgcaagggcccggccaggttccgctcgcttgatttcggggaacgcaacggctacctgaagggagtcataacggagatcatccatgatcctggccgcggcgccccgctggcccgggtcacgtttcgtcacccgtttaggtaccagcaccagaaggagctgttcgtggcggctgaagggatgtacactgggcagttcgtgtactgcggaaggaaggcgactttggttgtcggaaatgtgttgcccttgcgatcgatccctgaaggagcggtggtttgtaatgtggagcatcacgtgggtgatcgcggtgtctttgccagatgttcgggtgattatgctgttgtcattagtcataatccngataacgacactactaggattaagctcccatctggtgccaagaagattgtgccgagtgggtgccgtgctatgattggtcaagttgccggtggaggcagaacagagaagccattgttgaaggcaggaaatgcttatcacaagttcagggtgaagaggaactgctggcccaaggtccgtggtgttgccatgaaccctgttgagcatccccatggtggtggtaaccaccagcacattgggcatgcaagtacggttcgccgtgatgcaccccctggccaaaaggttggtcttattgctgctaggaggactggtcgtcttagaggacaagcagctgccactgctgcaaaggctgacaaggcttagagtttcgcttgagctcattttaattttgttttgtgctgttgaacatcttcatatggttgttatctgttagcattagattttggtttgcaattttggaaggttactaacttcttgtgattagtacattgaaagtgagagtattttgtttttgttttgttcgttacttatttgttatatgtacttcatcaggttatgtatgttggatgctgaatttaattttctccatttctcctgatgatgacttagaaactgggacttgggctgtcttttgaatccgttaatcgacagaggtgaaataactctctcgtttacatttnaataagcatctagctgcatcctacggttggtgactgcaatttaatttatagtatattagcaaaatgttaaaataagaaggggggttggtgtggggggggtggggttttatatatttcctagaaacaaaatt

SEQ ID NO: 3264 - DNA, 1814 bp, Citrus clementina
ctaacccgtccacctcttggtggcttaatataaaaaaaaattctctccaaaaaaaaaaaatttatacacacacatatgggcaatatggtaatttagaaaaccctttcttatagataaatcagcatttcgcactatctccgtttggagtcccagccgcacttgtcaaaaaaccccaaaaccctagacagagagtcacagcgaatcgactcaaatgggacgagtcattagagcacagcgtaagggagcgggctccgtcttcaagtcgcacacacaccaccgcaagggcccggccaggttccgctcgcttgatttcggggaacgcaacggctacctgaagggagtcataacggagatcatccatgatcctggccgcggcgccccgctggcccgggtcacgtttcgtcatccgtttaggtaccagcaccaaaaggagctgttcgtggcggctgaagggatgtacactgggcagttcgtgtactgcggaaggaaggcgactttggttgtcggaaatgtgttgcccttgcgatcgatccctgaaggagcggtggtttgtaatgtggagcatcacgtgggtgatcgcggtgtctttgccagatgttcgggtgattatgctgttgtcattagtcataatcctgataacgacactactaggattaagctcccatctggtgccaagaagattgtgccgagtgggtgccgtgctatgattggtcaagttgccggtggaggcagaacagagaagccattgttgaaggcaggaaatgcttatcacaagttcagggtgaagaggaactgctggcccaaggtccgtggtgttgccatgaaccctgttgagcatccccatggtggtggtaaccaccagcacattgggcatgcaagtacggttcgccgtgatgcaccccctggccaaaaggttggtcttattgctgctaggaggactggtcgtcttagaggacaagcagctgccactgctgcaaaggctgacaaggcttagagtttcgcttgagctcattttaattttgttttgtgctgttgaacatcttcatatggttgttatctgttagcattagattttggtttgcaattttggaaggttactaacttcttgtgattagtacattgaaagtgagagtattttgtttttgttttgttcgttacttatttgttatatgtacttcatcaggttatgtatgttggatgctgaatttaattttctccatttctcctgctgatgacttagaaactgggacttaggttgtcttttgaatccgttaatcgacagaggtgaaataactctctcgttcaccttttaataagcatctagctgcatcctagggttggtgactgcaatttaatttatagtatattagcaaaatgttaaaataagaagggggggggggggggggtgtttttatatatttcatagaaacaaaattctcgaggaggagaacaacaaaatattaatataaataaattgtaatgaaaaataaaaagaaaaataatgaagaaaaaataagagacctataaataaatcgtaatgaaaaataaaaagaaaattaatgaagaaaaaataagagaccgaaagagagaaacccactccttgggtttctgtcatgaatcaatgctctatcgaaatcgaacagagtgttaaggcaagaggaagtggcgagcatgagaaagttgttaaacggcaagtggaagtgacgagcatgagaacgttgatttaacaagaaaaaaaaaatggcaagcataataaattattttaataaaaaataattaaaaagaaataattggaatggcaagcatgatcaagt

SEQ ID NO: 3265 - DNA, 1237 bp, Gossypium hirsutum
cttacagccgtccaaatgggtcgtgtcatccgagctcagcgtaagggtgcgggttccgtcttcaaggcccacacccaccaccgcaagggtcccgcccgttttcgcagcctcgacttcggtgaacgaaacggctacctcaaaggcgtcgtcaccgatgttatccacgacccaggccgcggtgcgcccttagctcgcgtcgtgttccgtcacccgttccgttacaagaagcagaaggaactgttcgtcgctgctgagggtatgtacaccggacagttcgtgtactgtggtaagaaggccacccttatggtcggaaacgtgttgcctcttagatctatccccgaaggagctgtcgtttgcaacgtggaacaccacgttggtgatcgtggggttttcgctagggcttctggtgattatgccattgttattagtcacaaccctgataacgacactaccagaatcaagctaccatccggttcaaagaagattgttccaagtggttgccgcgccatgattgggcaggttgctggtggtggtaggactgagaagcctcttctcaaagctggtaatgctttccacaagtttagggtgaagaggaattgctggcctaaggtacgtggtgtggctatgaatccagttgagcatccccacggaggtggtaaccatcaacacattggtcatgctagcactgttagacgtgatgctcctcctgggcaaaaggttggtcttattgctgcaaggaggactggtagacttagaggtcaagctgctgctactgctgccaaggctgataaggcttagggttagggtaaaggggtattgcttgatttttggcctttataattacattcaagggtattgcctacatttatggttttagaaattttgtttgaattttatgataactgcactgcttcgagttgtttgaggaatttatgttttcagtttggttgctatttacttgttttatgtcaaggttccttgtccttgttttcatattatgttcagcaaaaattttcatagggttaagtttaaggaacttgattttggtgtataagaagggctaaaatttaagaatttcatgtcttttctcccttcgagtgctcatttttactgaattttccaatttcgtctggcttgaaggctgaagctgaggattctagctcgcaggtataggccaactatgactcgagagttttaagtctaagccaaaggtggagtattgtctctaatataatat

SEQ ID NO: 3266 - DNA, 983 bp, Gossypium hirsutum
ccccatcggccgcctccaagagaagacagagaggtctcctcacaaccaccgtaatgggtcgtgtcattcgagctcaacgtaagggtgccggttcggtcttcaaggcccataccaaccaccggaagggtcccgcccgtttccgcagcctcgacttcggtgaacggaacggttacctcaaaggtgtcgtcaccgacgtcattcacgaccctggccgtggcgctccgttagcccgcgtcgttttccgccaccctttccgttacaagaaacagaaggaattgttcgtcgccgccgagggtatgtacaccggacagttcgtgtattgtggtaagaaagctacccttatggttggaaatgtgttgccccttagatctatccctgaaggagctgtcgtttgcaacgttgagcaccatgttggtgaccgtggggttttcgctagagcttctggggattatgccattgttattagtcacaaccccgataatgataccaccaggatcaagcttccatctggttctaagaagattgttccaagtggctgtcgtgcaatgattggccaagttgcaggtggtggtaggactgagaaacctctcctcaaggctggtaatgcttatcacaagtttagagtgaagaggaactgctggcctaaggtgcgtggtgtagctatgaaccctgttgagcatccccatggaggtggtaaccatcaacacatcggtcatgctagtactgttaggcgtgatgctcctcctggacagaaagttggtcttattgctgctaggagaactggtaggctcagaggacaagctgctgctactgctgccaaagctgacaaggcttaggcttaggatattacttgctgtaattttagttcttttggcattcatattttacattcaaaagtatttaagacctttatgcttgaaaatgtgtttgaattaccagatattggtactgttttgagttgtttgagcaatgattttgttttt

SEQ ID NO: 3267 - DNA, 927 bp, Gossypium hirsutum
cagccgcctcaacgagagaggtctcttcataaccacccaatgggtcgtgtcatccgagctcaacgtaagggtgcgggttccgttttcaagtcccacacccaccatcgcaagggtgccgctcgtttccgcagtctcgactttggtgaacggaatggctaccttaaaggtgtcgtcacggaagttatccacgacccgggccgtggtgctcccttagtccgcgtcgtcttccgtcatccattccgttacaagaaacagaaggaactgttcgttgctgccgaaggcatgtacactggacagttcgtgtactgcggtaagaaggctactcttatggtcgggaacgtgttgcctcttagatctatccctgaaggagcggtcgtttgcaacgtcgaacatcacgttggtgatcgtggtgttttcgctagggcttctggtgattacgctattgtaatcagtcacaatcctgataacgacaccaccaggatcaagcttccatctggtgccaagaagattgttccgagtgggtgccgtgcaatgattggccaggttgcaggaggtggaaggaccgagaaacctcttcttaaggcgggcagcgcataccataagtacagggtgaagaggaactgctggcctaaggtgcgtggtgtggctatgaatccggttgagcatccccatggtggtggtaaccatcaacacattggtcatgctagtactgttaggcgtgatgctcctcctgggcagaaggttggtcttattgctgcaaggaggactggtaggctcagaggacaagccgctgccaccgcagccaaggctgataaggcttaagcgtaggctattacttattgttttagttcttttggcatttatatttaggttcattttgtttgaatttaataatgcttgtgttttcaatttggataagttatttca

SEQ ID NO: 3268 - DNA, 1269 bp, Solanum melongena
atccttaaatgggctcagaattgtttctttaggcccaattcattactagggcaacacattacacctctaaaaaccctagtatatcatcttctccccatcacttcccccaaaacccctcggcgagagaaagtgtagagaaagagagagaaatgggtcgtgtgatcagatcacaacgtaagggagccgggtcggttttcaaatcccatacccaccaccgtaaaggtccggccagattccgtacccttgatttcggcgaacgaaatggttacctgaaaggagttatcacagaggtgattcacgatccagggagaggtgcacctctcgcccgcgtgacattccgtcatcctttccggtacaagcatcagaaggagttgtttgttgccgctgaagggatgtacactggtcaattcgtgtattgtgggaaaaaagctagtcttatggttggtaatgtgttgccgctcagatctatcccagaaggagctgttgtttgtaacgttgagcataaagttggtgatcgtggtgtttttgctaggtgttctggtgattacgccattgttatcagtcacaatcctgataatggtaccactagggtcaagctcccatcaggagccaagaagattgttcccagtgggtgccgtgccatgattggtcaggttgctggaggaggacgtactgagaaacccatgcttaaagctggtaatgcttaccacaagtaccgtgtgaagaggaactgctggcctaaggttcgtggtgttgctatgaatcctgtggagcatccccatggtggtggtaaccatcaacacattggtcatgccagtacagtccgtcgtgatgcacctcctggacaaaaggttggtcttattgctgcaaggaggactggtcgtcttcgcggtcaagctgctgctactgctgccaaggctgacaaggcttaagccattcgcttgttacttttctatcttattattatgccctgagtattcagttaaaaaccatctcctagtataagttataacatgctaaattttgttgggatgtttagtaatttttgttttcatgattctcgttttgtgcaatttactccctttccccctcgtgtttagcagaactctggccttggactgtgtagcaagggagaaatttgaactgttgtcacttggtttaccccataaccggtgaggatacgctagaggtagcaatcgggcgagttggttcaaatttgaatcggtcataatgggtcaagatttaatttaattcaaatttgcttggacc

SEQ ID NO: 3269 - DNA, 957 bp, Euphorbia peplus
aattttccgaaatgggaagagtcatccgcgcccagcgtaagggtgccggctccgtcttcaaatcccacacccaccaccggaaaggtcccgcccgattccgttcactcgacttcggcgagcgtaacggatacctcaagggcgtgatcaccgagatcatccacgatcccggtcgtggtgctccgttggcccgtgtcacttttcgccacccgttccgctacaagcaccagaaggagctcttcattgctgctgaagggatgtatactgggcagtttgtgtattgtggaaagaaggctaatttgatggttgggaatgttttgccgttgcgttcgatacccgagggagctgttgtttgtaatgtggaacaccatgttggagatagagggtcttttgctcgctgctccggggattatgctattgttgttagtcataatcctgataatggaactagcagaatcaagcttccgtctggagcaaagaagattgtaccgagtggctgcagggctatggttggtcaagtagcgggtggaggcagaacagagaagcctatgttgaaggcaggaaacgcttatcacaaatacagagtgaagaggaactgctggcccaaggttcgtggtgttgctatgaatcccgtggagcatcctcatggtggtggtaatcaccagcatattggtcatgctagtactgttcgtcgtgatgcacctcctggacaaaaggttggtctcattgctgcaaggagaactggtcgtcttcggggacaagctgctgccactgctgctaaagctgacaaggcttagttgcataataaatttatctatgttgtctttagacagttttgcactagtatttgaagttttgtcgctatttcaatgttttagacttatttctcttttaatttttgataaacaacatattttgacattgacccatttactttgtcaagagtttttaatttgatga

SEQ ID NO: 3270 - DNA, 864 bp, Euphorbia peplus
cgccgccgcaatgggaagagtaatccgagcgcaacgtaagggtgccggctccgttttcaaatcccacacccaccaccgcaaaggccccgcccgattccgctcactcgacttcggcgagcgaaacgggtaccttaagggcgtcatcacggagatcatccacgacccgggtcgtggagctccgttggcccgagtgacgttccgtcatccgttccgttataagcatcagaaggagctgttcattgctgctgaagggatgtatactgggcagtttgtttattgtggaaagaaggcgaatttgatggttgggaatgttttgccgttgagatcgatacccgagggagctgttgtttgtaatgtggaacaccatgttggggatagaggctctttcgctagatgctctggggattatgctattgttgttagtcataatcctgataatggtactagcagaatcaagcttccttccggagccaagaagatcgtaccaagtggctgcagagctatggttggacaagttgcaggtggaggcagaactgagaagcccatgttgaaggcaggaaatgcataccacaaatacagagtgaagagaaactgctggcccaaggttcgtggtgtggctatgaatccagttgagcatccccatggtggtggtaatcaccagcatattggtcatgccagtaccgttcgtcgtgatgcacctcctggacaaaaggttggtcttattgctgcaaggaggactggtcgtcttaggggacaagctgctgccacagctgctaaggctgataaggcttagagtgcatagattagtatcaatatatctgttggttttcgatattgtctttagacgattttgcaagtactgtt

SEQ ID NO: 3271 - DNA, 982 bp, Actinidia deliciosa
  misc_feature (789)..(789): n is a, c, g, or t
  misc_feature (841)..(841): n is a, c, g, or t
  misc_feature (874)..(874): n is a, c, g, or t
  misc_feature (943)..(943): n is a, c, g, or t
  misc_feature (968)..(968): n is a, c, g, or t
tctctccgccgctctcaaaaccctaataccaccagattcatgggtcgggtgatccgagctcagcgcaagggcgcggggtccgtattcaagtcccacacccaccaccgcaagggtccggcccggttccggagcctggacttcggcgagcgcaacggctacctcaagggagtcgtcaccgagatcttgcacgatccgggtcggggagccccgctggcccgagtcaccttccgccacccgttccggttcaagcaccagaaggagctattcgtcgccgctgagggcatgtacaccggccagttcatcttctgtggcaagaaggcgaatctgacggtcggaaacgtcttgcccctccgatcgatccctgaaggtggtgttgtttgcaacgtcgagcaccatgttggtgatcgaggtgttttggctagggcttccggggattatgcgattgttatcagtcacaatcctgataatgatacctccagaatcaagctaccatctggggccaagaagattgtgcccagcggctgccgtgctatgattggtcaagttgccggtggtggcaggaccgagaagcctatgctgaaggcaggaaatgcttatcacaagtacagagtgaagaggaactgctggcccaaggttcgtggtgtggctatgaatcccgtggaacatcctcatggtggtggtaaccaccagcatattggtcatgcaagtactgttcgtcgtgatgctcctcctgggcaaaaggttggtctcattgctgcaaggaggaccggtcggcttcggggacaagcngctgctacagcttccaaagccgacaaggcttagagaccgttttatgagctcnagttatttaagaccttggtatgtagtttttggncgtcttttctgtttcatgtcttggtaatgtttgctgtaattggaatacatgaacttaaaaacttttttnctttttataataggattgctcttgntgtctaatttgatg

SEQ ID NO: 3272 - DNA, 1049 bp, Elaeis guineensis
cgactccctcccctcacccgcctcccctcgccgctgccgctggtcacagccgccatgggtagagtgatcagggctcagaggaagggtgcgggctcggtcttccgctcccatacccaccaccggaaaggcccggcccgcttccggagcctcgactacggggagcgcaatggttatctcaagggcgttgtgacggacatcatccacgaccccgggcgcggcgccccgctggcccgcgtcaccttccgccaccccttccgctacaagcatcagaaggagctattcatcgccgccgagggaatgtacacgggccagttcgtctactgcggccgcaaggcctccctcattgtcggcaacgtcctccccctccgctccatccccgagggtgccgttgtctgcaacgtcgagcaccacgttggcgaccgcggcgtcctcgcccgcgcctccggcgactacgccattgtcatcagccacaaccccgacaacggcacgaccaggatcaagcttccctctggtgctaagaagattgttcccagtggctgtcgtgcaatgattgggcaggtagctggtggtggcagaactgagaagcccctgcttaaggctggcaatgcctatcataagttccgggtgaagagaaattgctggccaaaggttcgtggtgtggctatgaaccctgtggagcacccccatggaggaggaaaccaccagcacattgggcatgcatccactgttcgtcgcgatgcccctcctggacagaaggtgggtcttattgcagcaaggaggacaggtcggctcagggggcaggctgcagcaaccgctgccaaagcagacaagacctcttaggttgcaaaaccattttcgaatttcttgttatatttttgattttctcaaggagtttttagttagactacagactcaattcagcagttttttgagtagtttattgtgttatttgatactattatgaaggccttgataatcttatttttgtcgtatttggatttggattattttcggtgaaactctgagtttgtgctagcttttcttgattt

SEQ ID NO: 3273 - DNA, 1515 bp, Citrus sinensis
ctaacccgtccacctcttggtggcttaatataaaaaaaaattctctccaaaaaaaaaaatttatacacacacatatgggcaatatggtaatttagaaaaccctttcttatagataaatcagcatttcgcactatctccgtttggagtcccagccgcacttgtcaaaaaaccccaaaaccctagacagagagtcacagcgaatcgactcaaatgggacgagtcattagagcacagcgtaagggagcgggctccgtcttcaagtcgcacacacaccaccgcaagggcccggccaggttccgctcgcttgatttcggggaacgcaacggctacctgaagggagtcataacggagatcatccatgatcctggccgcggcgccccgctggcccgggtcacgtttcgtcatccgtttaggtaccagcaccaaaaggagctgttcgtggcggctgaagggatgtacactgggcagttcgtgtactgcggaaggaaggcgactttggttgtcggaaatgtgttgcccttgcgatcgatccctgaaggagcggtggtttgtaatgtggagcatcacgtgggtgatcgcggtgtctttgccagatgttcgggtgattatgctgttgtcattagtcataatcctgataacgacactactaggattaagctcccatctggtgccaagaagattgtgccgagtgggtgccgtgctatgattggtcaagttgccggtggaggcagaacagagaagccattgttgaaggcaggaaatgcttatcacaagttcagagtgaagaggaactgctggcccaaggtccgtggtgttgccatgaaccctgttgagcatccccatggtggtggtaaccaccagcacattgggcatgcaagtacagttcgccgtgatgcaccccctggccaaaaggttggtcttattgctgctaggaggactggtcgtcttagaggacaagcagcggccactgctgcaaaggctgacaaggcttagagtttcgcttgagctcattttaattttgttttgtgctattgaacatcttcatatggttgttatctgttagcattagattttggtttgcaattttggaaggttactaacttcttgtgattagtacattgaaagtgagagtattttgtttttgttttgttcgttacttatttgttatatgtacttcatcaggttatgtatgttggatgctgaatttaattttctccatttctcctgctgatgacttagaaactgggacttaggttgtcttttgaatccgttaaatcgacagaggtgaaataactctctcgttcaccttttaataagcatctagctgcatcctagggttggtgactgcaatttaatttatagtatattagcaaaatgttaaaataagaagggggggggggtgtttttatatgtttcctagaaacaaaattctcgaggaggtgaacaacaaaatattaatataaataaatcgtaatgaaaaataaaaagaaaaataatgaagaaaaaataagagac

SEQ ID NO: 3274 - DNA, 1161 bp, Arachis hypogaea
tcacatttcttgtggtgcacctaacaaagttacaatgggacgtgtgatccgtgctcagcgtaagggtgcaggctctgtcttcaagtcccacacacaccaccgcaagggtgccgccaggttccgcagtctcgacttcggcgaacgaaacggttacctcaaaggcgtcgtcactgacgtcatccacgaccccggtcgcggtgcgccactcgccaaagtcactttccgccaccctttcaggtacaagaagcagaatgagctttttgttgcggcggaaggaatgtacactggacagtttgtgtattgtgggaagaaagcgacgcttgttgtcggtaatgtgttgcctttgaaagctattcccgaaggtgctgttatatgcaatgttgagcatcatgttggtgaccgtggcgttttcgctagggcttctggggattatgctattgttattagtcataatcctgataacgatacctctaggatcaagcttccctctggttcaaagaaaattgttccaagtgactgcagagctatgattggtcaagttgccggtggtgggagaactgagaagcctctactcaaagctggtaacgcataccacaagttcagagtaaagaggaattgttggcctaaggttcgtggtgtggctatgaacccagttgagcatcctcacggaggtggtaatcaccagcatattggacatgcgagtaccgtcaggcgtgatgctccccctgggcagaaggttggtctcattgctgcccggaggacaggacgtcttaggggacaagcagctgcaactgccgcaaaggccgataagggtgcttaaaaggatggttaggattatttattgtgttatgttttccaattttgtttatttgatagtatgtcctgatattttgaaccatttcccccaatatattggaccatggatagacagtagtgctttatattcgcttatgttgtatgttcaattctgtagttggaattggttatattgatattgcattttgaacggacgctatgctatcatacattaattattttaatcatatgaagttgaaccagcaagcgtaatttgtaactaagtatccgtagatactattttttgttcattagcaatttgacactacaagaaatgattgtggtactctgttggtgtcggatacc

SEQ ID NO: 3275 - DNA, 1072 bp, Phalaenopsis aphrodite
aacagaacttccgttcgtgtccctctacttcccttccatctctccgccgcctttctcatgggtagggttatccgagcacagaggaagggggcgggatcggttttcagatcccacacccaccaccgtaagggtgccgctcgtttccgtagcctcgactttagcgagcgcaatggatacctcaagggcgtggttaccgacatcatccacgatcccggccgcggagctccgctcgctcgcgtaacctttcgccacccgttccgctacaagcaccagaaggagctcttcgtcgccgcagaaggcatgtacaccggtcagttcgtgtattgcggccgtaaagcttctctcatggttggaaacgttttacccctccgctccatcccggagggtgccgttgtatgcaacgttgagcaccatgttggcgatcgcggtgtgctcgcgagggcttcgggagactacgctatcgttatcagccataaccctgataacgggacttctagaatcaagctcccatctggagcgaaaaagttagttcccagcggatgtcgagccatgatcggccaggttgccggtggtggcagaacggagaagcctctcctcaaagccggcaatgcttatcacaagtacagggtgaagcggaactgctggccaaaggtccgcggtgttgccatgaaccccgtggagcatccccatggaggaggaaaccaccagcatatcggccacgcatcaaccgttcgccgcgatgctccgcccggacaaaaggtcggtctcatcgctgccaggagaacgggtcgcctccggggacaagctgccgccactgccgccaaggccgaaaagggttcttagctgcccaggttttcgtctcgcgcttttcttcattttaatacttatagtaatcttatttgtttcgaagtatttataaaaaattgggagttttgtgctaaaaacttgatggttttgaggattattgtcgtgttagaaaccattttctttttgagatggggtttttgtttgaatatagaagtgtaaaggtgcgccaaatttagaggaataacaaaaaagaaaaaaaaatcca

SEQ ID NO: 3276 - DNA, 1050 bp, Platanus occidentalis
ccctagactctgagcagaggggaagcagagagagagagagagagatgggtcgtgtgatcagagcccagcgtaagggtgcgggttcagtgttcaaatcccacacccaccatcgcaaaggccctgccaggttcagaagcctggacttcggcgaacgcaatggctacctcaaaggggtcgtgactgaaatcattcacgatccaggtcgaggtgcaccgcttgccagagttaccttccgccaccccttccgctacaagcaccagaaggagctcttcgtcgctgccgagggcatgtacaccggtcaattcgtttactgtggtaagaaggctaatctaatggtgggtaacgttcttcccctccgatcaatccctgaaggtgctgttgtttgcaacgtcgaacaccatgtgggtgaccgaggcgttttagctagggcttctggggattacgcaattgttatcagtcataacccagataatgggactaccaggatcaaactcccatctggagccaagaagattgtaccaagtgggtgccgtgccatgataggccaagtagctggtggaggtaggactgagaagccacttctcaaggcaggcaatgcctatcacaagtacagggtgaagaggaactgctggcccaaggttcgtggtgttgctatgaatcctgtggagcatcctcacggaggtggtaaccaccagcacattgggcatgccagtactgttcgacgtgatgcccctcccgggcagaaggttggtctcattgctgccaggaggaccggtcgtctcagaggacaagcggctgccacagcttcaaaagcagagaagggtgcttagtgaaatttacgcttggttattgtcttgttcttttagttttcaacattgcttattttcctgttttgccctgttggcttctatcgtgcaaatctgaaggatacattgaggtttttttctttcaggtctaggatcaacgtttggtctatgaattttgatagcttccatgacgaatttctgtcattgttatgatatcattaatatccttggcatagttaaactt

SEQ ID NO: 3277 - DNA, 807 bp, Platanus occidentalis
aaaccctaaaccctaactctgaccagggagagagatgggtcgtgtgatcagagcccagcgtaagggtgcgggatctgtgttcaagtcccacacccaccaccgcaagggccccgctaggttcagaagcctcgacttcggtgaacgcaatggctacctcaagggagtcgtcacggaaatcatccacgaccctggtcgaggagcgcctctcgccagagtcaccttccgccaccctttccgctacaagcaccagaaagagctgttcgtcgccgccgagggtatgtacactggtcagttcgtttactgcggtaagaaggccaatctaatggtgggtaacgttctcccgctccgatcaatccctgaaggtgccgttgtctgtaacgtcgaacaccatgtcggtgaccgaggggtcctcgctagggcttctggggattacgccattgttatcagtcacaacccagataacgggacttccaggattaagcttccatctggagccaagaagattgtaccgagtgggtgccgtgccatgataggccaggttgctggtggaggcaggactgagaagccacttctcaaggcaggcaatgcttatcacaagtacagggtcaagaggaactgctggcccaaggtccgtggtgttgccatgaatcctgtagagcatccccatggtggtggtaaccatcaacacattgggcatgccagtactgttcgacgtgatgcccctcctgggcagaaggttggtctcattgctgccaggaggactggtcgtctcagaggacaagctgctgccacagcttccaaagctga

SEQ ID NO: 3278 - DNA, 1022 bp, Prunus persica
gcgaagcaacatttgggggccgctacagctagcagagaagagagacatttcagcgggaagccgccatgggtagagtcatcagagctcagcgtaaaggtgcggggtcggtcttcaagtcccacacccaccaccgcaagggtccagcccggttccgcagtctcgacttcggcgagcgcaacggctacctcaagggcgtcgtcaccgagataatccacgacccgggtcgcggagccccgctcgcccgagtcagcttccgccatcctttccgatacaaaaagcagaacgagctcttcgtcgccgctgagggcatctacactggccagttcatctactgtgggaagaaggccaatctggtcgtgggcaatgtgttgcctctcagatcgatcccggagggagctgtcgtctgcaacgtcgagcaccatgttggtgaccgtggagtccttgctagggcttctggtgattacgctgttgttatcagccacaaccctgataacgatacctccaggatcaagcttccttctggtgcgaagaagattgtgccaagtggttgcagggcaatgattgggcaggttgctggcggcggtaggactgaaaagccaatgctcaaggctggtaatgcataccacaaattcagagtgaagaggaactgctggcctaaggttcgtggtgtggctatgaacccagttgagcatcctcacggaggaggtaaccaccagcacattggacatgcaagtacagtcaggcgtgatgctcctcctggccagaaggtcggtcttattgctgcaaggagaacaggaagacttagaggacaagctgctgccactgcctccaaggctgacaaggcttaagattaatcttatatttttttgttctgattttggaccgcagaatcttttaagagtgctcaacatcaccattttccttatctaagtttgctattttggtatcgattacttcgtgtactagttatccgagactagcgggtttatttcgtggtagaaattttgtttagttgatggtcc

SEQ ID NO: 3279 - DNA, 1069 bp, Solanum phureja
ttacggccctcctccctctaaaaaccctaactccctttcttctttaatccatttcttcctctattcgcaaacctcagagagaaggcgccgaaatgggtcgtgtaatcagagcacaacgtaagggagcaggctccgtcttcaaatctcacactcatcaccgcaagggacctgcaaggttccgttcacttgatttcggtgaacgtaatggttatctcaaaggtgttgttacagaaatcattcatgatccaggtaggggtgcaccattggcacggatgacattccgtcatcctttccgttacaagcatcagaaggagttgttcgttgctgcagaagggatgtatactggtcaatttatttactgtgggaaaaaagctaatcttatggttggtaatgtgcttgcactcagatctatccctgaaggagctgttgtttgtaatgttgagcataaagttggtgaccgtggtgtttttgctagatgctctggtgattatgctatcgttatcagtcataaccctgataacggaacaactaggattaagcttccatctggatccaagaagattgtgcccagtggatgtcgagccatgattggtcaggttgctggtggaggaagaactgagaaaccaatgcttaaagctggtaatgcataccacaaataccgggttaagaggaactgctggcctaaggttcgtggtgttgctatgaatcctgtggagcatcctcatggtggtggtaaccatcaacatattggtcatgccagtactgtccgtcgtgatgcaccacctgggcaaaaggttggtcttattgcagcaaggaggactggtcgtcttcgtggtcaagctgctgcttctgctgccaaagctgacaaggcctaagatattagttttgtgttactgttttccttcttgttgtgtttggattttgagtattcagctacaatcatctttatactaagttaagttttgttgggatattattttagaagttttgttaaggacccttgcttacacaaatttgccatttataaatgcgtttagcttggctctcattatgtttttccttttcttct

SEQ ID NO: 3280 - DNA, 1110 bp, Glycine max
atacacgaagcaaaaaccctaacttcttcactatccttcttccatcggcgcggcacccacacacacagttcgtcggaatgggaagggtgattcgcgctcagcgtaagggtgctgggtcggtgttcaagtctcacactcaccaccgcaagggtccggcgaggttccgcagcctcgacttcggcgagcgcaacggctacctcaagggcgtcgtcaccgacatcatccacgaccccggtcgcggcgcccctctcgccaaggtggcattccgccaccccttccgctacaagaagcaaacggagctcttcgtcgccgccgagggcctctacaccgggcagttcgtctactgcggcaagaaggccaccctcgtggtcggcaacgtgttgcccatccgatccatccccgaaggtgccgtcatctgcaacgtcgagcaccacgtcggcgaccgcggcgttttcgccagagcctccggtgactatgctattgttataagccacaaccctgataacgacacctctaggatcaagcttccttctggtgcgaagaagattgtgccaagtgggtgcagggcgatgattgggcaggttgcaggtggagggaggactgagaagcctcttctgaaggctggtaatgcttaccataagttcagagtgaagaggaattcatggcctaaggtgcgaggtgtggcgatgaacccagttgagcatcctcacggaggaggtaatcatcagcatattgggcatgcgagtaccgtgaggcgtgatgctcctcctggccagaaggttggtctcattgctgctaggaggactggtcgtcttagggggcaagctgctgccactgctgctaaagcggataagactacttgagaagatttttagggtgttatttgttctcaaattttgtttctttcatagtttatgttgaactctttgggttctattttgaacagcatttccgccataaatatgaaaagctttgtaacagacggtgttttatattagtttgacatctattcaattctgctgtttgttaaccttttgctgatttttactagtttgaaagtggaatgtacgaatacggtttctctcgggtttgcagccgcagcgggccata

SEQ ID NO: 3281 - DNA, 993 bp, Nicotiana tabacum
tttcttcctctatcccttcatagagtgagcagagggccaaactgagaacgccgaaatgggtcgtgttatcagagcacaacgtaagggagcaggctccgttttcaaatcccacactcaccaccgtaagggccctgccaaattccgttcgctcgattacggtgaacggaacggttaccttaaaggtgtggtctcagaaatcatacatgacccaggtaggggtgcaccgttggcacgcgtaacattccgtcacccgttccgttacaagcaccagaaagagttgttcgttgctgctgaggggatgtacactggtcagtttatttactgtggtaaaaaagctaatctaatggtgggtaatgtgttggcacttagatctatccctgaaggtgctgtcgtttgtaacgtggaacacaaagttggtgaccgtggtgtttttgctagatgctctggtgattatgctattgtcatcagtcacaaccctgataatggaactactaggattaagcttccatctggagcaaagaagattgtgcccagtgggtgtagagccatgattggccaggttgctggtggaggaagaactgagaaaccaatgctcaaagctggaaatgcgtaccacaaataccgggttaagaggaactgctggcctaaggttcgtggtgttgctatgaatcctgtggagcatcctcatggtggtggtaaccatcaacatattggtcatgccagcactgtccgccgtgatgcaccacctggacagaaggttggtcttattgctgcaaggagaactggtcgtcttcgtggccaagctgctgctactgctgccaaggctgataaggcttaagatattgagtttgttacttttttcattgtcgtattctgatcggatttgagaccgtctttatactaagttttgtttggatattatttagtaagttttgtttaggaacactcgcttggacaagtttgccatttataaatgtgttttagcttggctct

SEQ ID NO: 3282 - DNA, 1127 bp, Nicotiana tabacum
  misc_feature (988)..(988): n is a, c, g, or t
gcagagagccaaaccgagaacgccgaaatgggtcgtgtaatcagagcacaacgtaagggagcaggctccgttttcaaatcccacactcaccaccgtaagggtcctgccaaattccgttcgctcgattacggtgaacggaacggttaccttaaaggtgtggtctcagaaatcatacatgacccaggtaggggtgcaccgttagcacgtgtgacattccgtcacccgttccgttacaagcaccagaaggagttgttcgttgctgcagaagggatgtacactggtcagtttatttactgcggtaaaaaagctaatctaatggtgggaaatgtgttggcacttagatctatccctgaaggtgctgtggtttgtaacgtggaacacaaagttggtgaccgtggtgtatttgctagatgctctggtgattatgctattgtcatcagtcacaaccctgataacggaactactaggattaagcttccatctggagcaaagaagattgtgcccagtgggtgtagagccatgattggccaggttgctggtggaggaagaactgagaaaccaatgctcaaagctggaaatgcataccacaaataccgggttaagaggaactgctggcctaaggttcgtggtgttgctatgaatcctgtggagcatcctcatggtggtggtaaccatcaacatattggtcatgccagcactgtccgccgtgatgcaccacctggacagaaggtcggtcttattgctgcaagaagaactggtcgtcttcgtggtcaagctgctgccactgccgccaaggctgataaggcttaagatattaagtttgttactttttcccttgtcgttgtattctgattggatttgggaccgtctttatactaagttttgtttggatattatttagtaagttttgtttagggacaccctcgcttagacaagtttgacatttataaatgtgcttaagcttggctctcgctatgtttcccttttnttcgctgatttggttccttttaaaattcgtttggtgcatcgattttgaagttggttttgtttacatgtatttttccactgttggacccaatagtggtggtttactaagagtaggtttttactagcagtaattttgaggg

SEQ ID NO: 3283 - DNA, 952 bp, Tragopogon dubius
tcctcccatctgccgtcttctccaatcgctaaccggagaaatgggtcgtgtcatcagggcacagcgtaagggagcagggtccgtcttcaagtcccatacccaccaccgcaagggtccggcgaggttccgcagtctcgacttcggtgaacgcaatggttacctcaagggtgttatcaccgaaatcatccacgatccaggacgtggtgcgcctcttgcacgcgtgactttccgtcatccgttccgttacaagcaccagaaggaacttttcgtcgccgccgaggggatgtacaccggtcagttcgtcttttgtggaaagaaggctaacttgatggtcggtaatgtccttcctctcagatctatccctgaaggagctgttgtctgcaacgttgagcaccacgttggtgaccgtggttcgtttgccagagcttctggtgattacgccattgttatcagtcacaaccccgataacggcacctctagagtgaagcttccatctggagccaagaaaattgtaccaagcggatgcagagccatgatcggtcaagttgccggtggtggacgtaccgaaaaaccaatgctgaaggccggaaacgcgtaccacaaataccgcgtgaaacgtaactcctggcccaaggttcgtggtgtggctatgaacccagtggagcatcctcatggtggtggtaaccatcaacatattggtcatgctagtacggttagacgtgatgcaccacccggtcaaaaggtcgggctcattgctgcaaggaggactgggcgtctcagaggtcaagctgccgccactgccgccaaggccgataagtgagaagactatattgttatgggtgccggttttagttttgttggtacttttggattgtctgttagtttttttgagtttatgtggaactgctttgttttttgtcatcatacattatatttaattgggaagtttttg

SEQ ID NO: 3284 - DNA, 1022 bp, Utricularia gibba
ctcgccggagatgggtcgtgtgattcgcgcccagcgtaagggagcaggctccgttttcaagtcccacacccaccatcgtaagggcccagcgcggttccgctccctcgactttggtgagcgcaatgggtatttgaaaggcgtaattaccgatatcatccacgatcctgggcgtggtgcgccgcttgcgaaagttaccttccgtcatccgttcagatatcaacaccaaaaggagcttttcattgccgccgaggggatgtacactggccaatttgtgtactgcggcaagaaggctaatttggttgttggaaatgtcttgcctttaagatcaattcctgagggtgctgttgtttgcaacgttgaacatcatgtgggtgatcgtggcgtctttgccagggcttccggggattatgccattgttatttctcataatccggataatggaaccagccgtattaagttaccatctggttcaaagaagatagtgcctagcagttgccgtgccatggttggccaggttgccggtggtggtcgaactgagaagccactcttgaaggctgggaatgcataccataaattcagagtgaagagaaatagctggcctaaggttcgtggtgttgccatgaaccccgttgagcatcctcacggtggtggtaaccatcagcacatcggtcatgcaagtactgttcgccgtgatgctcctcccggccaaaaggtcggtctcattgctgcaaggagaactggtcgactccgtggccaagccgctgctactgctgccaaggccgacaaagtttaagattgatattcacggttcaagatttcaattttctgttttatgcacttcaaaactgggctctttgttcgattttcatatgttttttatgatgtactctagatgctgtttgcttagctttatgggtcagaagttttcccactggattcacaaactgccccgagtttggtttgctcggattcttatgcaatttaatcttcaactgggacgcatttgatttgatgcagattag

SEQ ID NO: 3285 - DNA, 1011 bp, Vaccinium corymbosum
gggtcgcgtgattagagctcagcgtaagggagcaggctcagtattcaagtctcacacccaccaccgcaagggcccggccaggttccgcagccttgactttggcgagcgcaacggctacctcaagggagtcgtaaccgagatcatccacgacccggggcgtggcgcaccactggcccgagtcaccttccgccacccattcaggttcaagcaccagaaggagctcatggttgcggccgagggaatgtacacgggtcagttcattttctgcgggaagaaggcaaacttgatggtgggaaatgtgttgcctttgaggtcgattcctgaaggaggggttgtgtgtaatgttgagcaccatgtgggggatcgtggggttttggctagggcgtctggagattatgctattgttatcagtcataatccggataatgatacgagcaggatcaagctcccatctggggccaagaagattgtgcctagtgggtgcagagctatgattggtcaagttgccggaggtggaaggaccgagaagccgcttctcaaggcaggaaatgcttatcacaagtacagggtgaagaggaactgctggcccaaggttcgtggtgtggctatgaatccagtggaacatcctcatggtggtggtaaccaccagcacattggacatgccagtacagttcgtcgtgatgctcctcctggtcaaaaggtcggtctcattgccgcaaggaggactggtcgtcttcgtggacaagctgctgccacagctgccaaggcagacaagaccacttagagaatcttctatttatctttcatttgcagtttacagtcattatgttgtttttgggtggcttttgttgcttccttgttttgcgggtattgttttccaaagttttgaatatgctcaaatcagaggttcgtcttttaattagaggattgcttatgaattttgtttcaagttctatgggaaccaactagtagtatcggaatgattaacttctggcgattacatgccttggt

SEQ ID NO: 3286 - DNA, 865 bp, Helianthus annuus
agagagagaaacaatcaacaatgggacgtgttatcagagcacaacgtaagggagcaggctccgtcttcaaatcccacacacaccaccgcaaaggcccagccagattccgaagcctcgacttcggcgaacgcaacggttacctcaaaggagtcatcaccgagatcatccacgatccaggccgcggtgcgccgcttgctcgcgtcaccttccgtcatccgttccgttacaagcaccagaaggagctcttcgttgccgccgaggggatgtacaccggtcagtttgtgttttgcggtaaaaaagctaatctgatggtcggaaatgtcctgccgcttagatctattccggaaggagctgtggtttgtaatgtggagcatcatgttggggatagaggttcctttgctagggcttcgggtgattatgctattgttattagtcataatccggataacggtaccactagggtcaagcttccatctggagccaagaaaattgtgccgagcggatgcagagccatgattggtcaggttgccggaggtggtagaaccgagaagccgatgcttaaagctggtaatgcatatcacaagttccgcgtgaagagaaactgctggcccaaggttcgtggtgttgctatgaatccagttgagcatccccatggtggtggtaaccatcaacatattggtcatgcgagtacggtccgtcgtgatgcaccacctggccaaaaggtcggtcttattgccgctaggaggaccggtcgtctcagaggtcaagctgctgctactgccgccaaggctgataagtagagcacttgaatggattttggtatcaggtttgaaatttttacttatctgtttgttctgtttgaatt

SEQ ID NO: 3287 - DNA, 1079 bp, Helianthus annuus
ctccaaaccctaaccctaaccaaatgggtagagtaatccgagcccaacgtaagggagcaggctccgtcttcaagtcccacacgcaccaccgcaagggtccggcacgcttccggagcctcgacttcggtgaacgcaacggctacttgaaaggtgtgatcactgaaattatccatgacccggggcgtggtgcgccgcttgctcgcgtgactttccgtcacccgttccggtacaagcaccagaaggagctgtttgtggcggctgagggtatgtatactggacagtttgtgttttgtgggaagaaggcgaatttgatggtggggaatgtgttgccgcttagatctattcctgaaggagctgtggtttgtaatgttgagcatcatgttggggatagaggctcgtttgctagagcttctggcgattatgctattgttattagtcataatcctgataacggcaccactagggtgaagcttccatctggagccaagaaaattgtgccaagcggatgccgtgctatgattggtcaagttgctggtggaggacgtaccgagaagccaatgctgaaggccggtaacgcttaccacaagttccgtgtgaagagaaactgctggcccaaggttcgtggtgtggctatgaatccagttgagcatccccatggtggtggtaaccatcaacatattggtcatgccagtaccgtccgtcgtgacgcaccacctggtcaaaaggtcggtcttattgccgccaggaggactggtcgtctcagaggtcaagccgctgccactgctgccaaggctgataagtaataaactggtgttatggatgcttttagttttgttatctctggttctgttattggtagttttctcaagcttatttgctactgttatgtttgttttcatacattggatctttttggaaagttttggagtaagatattgattattaaacattttgttgagcttatggtattgatgttgatttgtttgatgctaaacaaaaacaaaaaagagtaaatattaaacttgttgggcggctcgggtcaaatcgattttaatattagacaagcttatgcatgcggc

SEQ ID NO: 3288 - DNA, 937 bp, Helianthus annuus
gttatagagagatacatagagagttcacagagagaaacaatcaacaatgggacgtgttatcagagcacaacgtaagggagcaggctccgtcttcaaatcccacacacaccaccgcaaaggcccagccagattccggagcctcgacttcggcgaacgcaacggttacctcaaaggagtcatcaccgaaatcatccacgatccaggccgcggtgcgccgcttgctcgcgtcaccttccgtcatccgttccgttacaagcaccagaaggagctcttcgttgccgccgaggggatgtacaccggtcagttcgtgttttgtggcaaaaaagctaatctgatggtcggaaatgtcctgccgcttagatctattccggaaggagctgtggtttgtaatgtggagcatcatgttggggatagaggttcgtttgctagggcttccggggattatgctattgttattagtcataatccggataacggtaccactagggtcaagcttccatctggagccaagaaaattgtgccgagcggatgcagagccatgattggtcaggttgccggaggtggtagaaccgagaagccgatgcttaaagctggtaatgcttatcacaagttccgcgtgaagagaaactgctggcccaaggttcgtggtgttgctatgaatccagttgagcatccccatggtggtggtaaccatcaacatattggtcatgcaagtacggtccgtcgtgatgcaccacctggtcaaaaggttggtcttattgctgctaggaggacgggtcgtctcagaggtcaagctgctgctactgccgccaaggctgataagtagagcacttgaatggattttggtatcaggtttgaaatttttacttatctgtttgttttgtttgaatttggacttttgagggttaatctacaatacttgatacaatgttattgt

SEQ ID NO: 3289 - DNA, 994 bp, Helianthus annuus
accggagcaatgggtcgcgtcatccgagctcaacgtaagggagcaggctccgtcttcaagtcccacacacaccaccggaaaggcccagcccgtttccgttccctcgacttcggcgagcgcaacggctacctaaaaggggtcattaccgaaatcatccacgacccgggccgcggagctcccctggctcgcgttacgttccgccacccgttccggtacaagcaccagaaggagttgtttgtggccgctgaggggatgtacaccggccagtttgtgttttgtgggaaaaaggctaacttgatggtcggaaatgtgctaccgcttagatcgattccggaaggagctgtggtttgtaacgtggagcatcatgttggcgatcgagggtcgtttgctagagccagtggggattatgctattgttattagtcataatccggataatggtaccactagagtaaagctcccatctggggcaaagaaaattgtgccaagtggatgccgtgctatgattggtcaagttgcaggcggtgggcgtaccgagaagcccatgctcaaggccggtaacgcataccacaagttccgcgtcaagagaaactgctggcctaaggttcgtggtgttgctatgaaccccgtggagcatcctcatggtggtggtaaccatcaacatattggtcacgccagtactgttcgccgtgatgcaccacccggtcaaaaggttggtctcattgccgctaggaggactggtcgtctcagaggtcaagccgccgccactgccgccaaggctgataagtagtgaactgatattacgggtgttgattttagcttttttctttttacgtttgcatctgctactttcatgttttgtttttgactggaatctgcaactgaaatgttgatcattacatcttgtttgaaagttttgtagtagtttttacttagttttatggattgattcttattagtcttttattacaatgcaccactttttaaacacaaag

SEQ ID NO: 3290 - DNA, 1028 bp, Helianthus annuus
agagagagaaacaatcaacaatgggacgtgttatcagagcacaacgtaagggagcaggctccgtcttcaaatcccacacacaccaccgcaaaggcccagccagattccgtagcctcgacttcggcgaacgcaacggttacctcaaaggagtcatcaccgaaatcatccacgatccaggccgcggtgcgccgcttgctcgcgtcaccttccgtcatccgttccgttacaagcaccagaaggagctcttcgttgccgccgaggggatgtacaccggtcagttcgtgttttgtggcaaaaaggcgaatctgatggtcggaaatgtcctgccgcttagatctattccggaaggagctgtggtttgtaatgtggagcatcatgttggcgatagaggttcgtttgctagggcttcgggtgattatgctattgttattagtcataatccggacaacggtaccactagggtcaagcttccatctggagccaagaaaattgtgccaagtgggtgcagagccatgattggtcaggttgccggaggtggtagaactgagaagccgatgcttaaagctggtaatgcttatcacaagttccgtgtgaagagaaactgctggcccaaggttcgtggtgttgctatgaatccagttgagcatccccatggtggtggtaaccatcaacatattggtcatgcaagtacggtccgtcgtgatgcaccacctggtcaaaaggtcggtcttattgccgctaggaggactggtcggctcagaggtcaagctgctgctactgccgccaaggctgataagtagagcacttgaatggattttggtatcaggtttgaaatttttacttatctgtttgttttgtttgaattttgtcttttgagggttaatctacaatacttgatacaatgttattgttattttgcttttttattgatgagattttagtcgtatcatgggagtgtatgattttatgtttaattttgtagcgttgttaattctttacacaacatgaatctaatgattgaaaacatg

SEQ ID NO: 3291 - DNA, 934 bp, Helianthus annuus
gagaaacaatcaacaatgggacgtgttatcagagcacaacgtaagggagcaggctccgtcttcaaatcccacacacaccaccgcaaaggcccagccagattccggagcctcgacttcggcgaacgcaacggttacctcaaaggagtcatcaccgagatcatccacgatccaggccgtggtgcgccgcttgctcgcgtcaccttccgtcatccgttccgttacaagcaccagaaggagctcttcgttgccgccgaggggatgtacaccggtcagtttgtgttttgtggtaaaaaagctaatctgatggtcggaaatgtgctgccgcttagatctattccggaaggagctgtggtttgtaatgtggagcatcatgttggggatagaggttcgtttgctagggcttcgggtgattatgctattgttattagtcataatccggataacggtaccactagggtcaagcttccatctggagccaagaaaattgtgccgagcggatgccgagccatgattggtcaggttgccggaggtggtagaaccgagaagccgatgcttaaagctggtaatgcttatcacaagttccgcgtgaagagaaactgctggcccaaggttcgtggtgttgctatgaatccagttgagcatccccatggtggtggtaaccatcaacatattggtcatgcaagtacggtccgccgtgatgcaccacctggtcaaaaggtcggtcttattgccgctaggaggactggtcggctcagaggtcaagctgctgctactgccgccaaggctgataagtagagcacttgaatggattttggtatcaggtttgaaatttttacttatctgtttgttctgtttgaatttggacttttgagggttaatctacaatacttgatacaatgttattgttattttgcttttttattgatgagatttt

SEQ ID NO: 3292 - DNA, 921 bp, Helianthus annuus
accggagcaatgggtcgcgtcatccgagctcaacgtaagggagcaggctccgtcttcaagtcccacacacaccaccggaaaggcccagcccgtttccgttccctcgacttcggcgagcgcaacggctacctaaaaggggtcattaccgaaatcatccacgacccgggccgtggagccccgctggctcgcgttacattccgccacccgttccggtacaagcaccagaaggagttgtttgtggccgctgaggggatgtacaccggccagtttgtgttttgtgggaaaaaggctaacttgatggtcggaaatgtgctaccgcttagatcgattccggaaggagctgtggtttgtaatgtggagcatcatgttggggatcgagggtcgtttgctagagccagtggggattatgctattgttattagtcataatccggataatggtaccactagagtgaagcttccatctggggcaaagaaaattgtgccaagtggatgccgtgctatgatcggtcaagttgcaggcggtggacgtaccgagaagcccatgctcaaggccggtaacgcataccacaagttccgtgtcaagagaaactgctggcctaaggttcgtggtgttgctatgaaccccgtggagcatcctcatggtggtggtaaccatcaacatattggtcacgccagtactgttcgccgtgatgcaccacccggtcaaaaggttggtctcattgctgctaggaggactggtcgtctcagaggtcaagccgccgccactgccgccaaggctgataagtagtgaactgatattacgggtgttcattttagctttttttgttacctttgcatctgctactttcatgttttgtttttgactggaatctgcaactgaaatgtttatcattacatcttgtttgaaagttttgtagta

SEQ ID NO: 3293 - DNA, 871 bp, Helianthus annuus
aacaatcaacaatgggacgtgttatccgagcacaacgtaagggagcaggctccgtcttcaaatcccacacacaccaccgcaaaggcccagccagattccggagcctcgacttcggcgaacgcaacggttacctcaaaggagtcatcaccgagatcatccacgatccaggccgcggtgcgccgcttgctcgcgtcaccttccgtcatccgttccgttacaagcaccagaaggagctcttcgttgccgccgagggcatgtacaccggtcagtttgtgttttgcggtaaaaaagctaatctgatggtcggaaatgtcctgccgcttagatctattccggaaggagctgtggtttgtaatgtggagcatcacgttggggatagaggttcgtttgctagggcttccggggattatgctattgttattagtcataatccggataacggtacaaccagggtcaagcttccatctggagccaagaaaattgtgccgagcggatgccgagccatgattggtcaggttgccggaggtggtagaaccgagaagccgatgcttaaagctggtaatgcttatcacaagttccgcgtgaagagaaactgctggcccaaggttcgtggtgttgctatgaatccagttgagcatccccatggtggtggtaaccatcaacatattggtcatgcaagtacggtccgtcgtgatgcaccacctggtcaaaaggtcggtcttattgccgctaggaggactggtcgtctcagaggtcaagctgctgctactgccgctaaggctgataagtagagcactcgaatggattttggtatcagggttgaaattttttactatctgtttgttttggttgaaatttgacttttgagggt

SEQ ID NO: 3294 - DNA, 842 bp, Helianthus annuus
aacaatcaacaatgggacgtgttatcagagcacaacgtaagggagcaggctccgtcttcaaatcccacacacaccaccgcaaagggccagccagattccggagcctcgacttcggcgaacgtaacggttacctcaaaggagtcatcaccgaaatcatccacgatccaggccgcggtgcgccgcttgctcgcgtcaccttccgccatccgttccgttacaagcaccagaaggagctcttcgttgccgccgaggggatgtacaccggtcagtttgtgttttgtggtaaaaaagctaatctgatggtcggaaatgtgctgccgcttagatctattccggaaggagctgtggtttgtaatgtggagcatcatgttggggatagaggttcgtttgctagggcttcgggtgattatgctattgttattagtcataatccggataacggtaccactagggtcaagcttccatctggagccaagaaaattgtgcccagcggatgcagagccatgattggtcaggttgccggaggtggtagaaccgagaagccgatgcttaaagctggtaatgcttatcacaagttccgtgtgaagagaaactgctggcccaaggttcgtggtgttgctatgaatccagttgagcatccccatggtggtggtaaccatcaacatattggtcatgcaagtacggtccgtcgtgatgcaccacctggtcaaaaggtcggtcttattgccgctaggaggactggtcgtctcagaggtcaagctgctgctactgccgccaaggctgataagtagagcacttgaatggattttggtatcaggtttgaaatttttacttatctgttt

SEQ ID NO: 3295 - DNA, 992 bp, Ambrosia trifida
tttccattccagtttcctcctcaacccgccgtcacatccaaaccctaaccctaaccacaatgggtcgagtcatcagagcccaacgtaagggagcaggttccgtcttcaagtcccacacccaccaccgcaagggtccagccaggttccgcagcctcgacttcggtgaacgcaacggctacctaaaaggagtgataaccgagatcatccatgacccgggtcgtggagccccgcttgcccgggtcacgttccgtcacccgtttaggtacaagcatcagaaggagctgtttgtggctgctgaagggatgtatactggacagtttgtgttttgtgggaagaaggctaatttgatggtgggtaatgtgctgccacttagatctattcctgaaggagctgttgtttgtaacgttgaacatcatgttggagatcgtggctcgtttgctagagcttctggtgattatgctattgttattagtcataatcctgataatggtaccactagggtgaagcttccttctggagccaagaaaattgtgccaagtggatgccgtgctatgattggtcaagttgctggtggaggacgtactgagaagccaatgctgaaggctggtaatgcgtatcacaagttccgtgtgaagagaaactgctggcctaaggttcgtggtgttgctatgaatccagtggagcatccccatggtggtggtaaccatcaacatattggtcatgccagtaccgttcgtcgtgacgcaccacctggtcaaaaggttggtcttattgccgctaggaggactggtcgtctcaggggtcaagctgctgccactgctgctaaggccgacaagtgataaactggtgttatggatgtcaattttagttttgttattgttgggtctgttacttttattgttagttttttcctagtttacctgctactactgttatgtttgttcttcgacattcaatcattttggaaagttttgcagtaagatactgattac

SEQ ID NO: 3296 - DNA, 784 bp, Ambrosia trifida
aatgggtcgagtcatcagagcccaacgtaagggagcagggtccgtcttcaagtcccacacccaccaccgcaagggtccagccaggttccgcagcctcgacttcggcgaacgcaacggctacctaaaaggagtcatcaccgagatcatccatgacccgggtcgtggagccccgcttgcccgggtcaccttccgtcacccctttaggtacaagcatcagaaggagctgtttgtggctgctgaagggatgtacactggccagtttgtgttttgtgggaagaaggctaatttgatggttggtaatgtgctgcctcttagatctattcctgaaggagctgttgtttgtaatgttgaacatcatgttggtgatcgtgggtcgtttgctagagcttctggtgattatgctattgttattagtcataatcctgataatggtaccactagggtgaagcttccatccggagccaagaaaattgtgccaagtggatgccgtgctatgattggtcaagttgctggtggaggacgtactgagaagccaatgctgaaggccggtaatgcttatcacaagttccgtgtgaagaggaactgctggcctaaggttcgtggtgtggctatgaatccagtggagcatccccatggtggtggtaaccatcaacatattggtcatgccagtactgttcgtcgtgatgcaccacctggtcaaaaggttggtcttattgccgctaggaggactggtcgtctcaggggtcaagccgctgccactgctgccaaggccgacaagtgataa

SEQ ID NO: 3297 - DNA, 945 bp, Cichorium intybus
gggagagaggtaagagatattcagaaatgggacgtgtgatcagagcacagcgtaagggagcaggctccgtcttcaaatcccatacccaccaccgcaagggtccggcgaggttccgcagtctcgacttcggtgaacgcaatggatacctcaagggtgtcatcaccgaaatcatccacgatcctggacgtggtgctcctcttgcacgcgtcactttccgtcatcctttccgttacaagcaccagaaggagcttttcgtcgccgccgaggggatgtacaccggtcagttcgtcttctgtggaaagaaggctaacctgatggtcggtaacgttcttcctctcagatctatccctgaaggagctgttgtttgcaacgttgaacaccatgtcggtgaccgtggttcattcgctagggcttctggtgactatgccattgtcatcagtcacaaccctgataacggcaccactagagtgaagcttccatctggagccaagaaaatcgtgccaagtggatgccgtgccatgattggtcaagttgccggtgggggccgtacagaaaaaccgatgttgaaagccggaaacgcttaccacaaattccgcgtcaaacgtaactgctggcctaaggttcgtggtgtggctatgaaccccgtggaacatccccatggtggtggtaaccaccaacatattggtcatgctagtacggttagacgtgatgcaccacccggtcaaaaggttgggctcattgccgctaggagaaccgggcggcttagaggtcaagctgccgccactgccgccaaggctgataagtgatgagaaaaactatgttggtgttatggttgttggttttagtttttggtactttgttatttgttggggttttagagtttactttgaactggtatgttgatgattttcatacatttttatattattgggaagtttttcaaaa

SEQ ID NO: 3298 - DNA, 1022 bp, Taraxacum officinale
gattatcaaccctatatcagcatctccacttccctgaattcgccgtcgtctccaaccctagccaccgagagagagagagagagagaggtaagagagaagaaccagaaatgggacgtgtcattagggctcagcgtaagggagcaggttccgtcttcaagtcccatactcaccaccggaaaggccccgccaggtttcgcagcctcgacttcggcgaacgcaatggttacctcaagggcgtcatcaccgaaatcatccacgatccaggacgtggtgctcctctagctcgcgtcaccttccgtcatcctttccgttacaagcaccagaaggagctttttgtcgcagctgagggcatgtacaccggtcagttcgttttctgtggtaagaaggcgaatttgatggttggaaacgtccttcctctcagatctatccccgagggagctgtcgtttgcaacgtcgaacatcatgtcggtgaccgtggttcattcgctagggcttccggtgattacgccatcgttatcagtcacaatcctgataacggcaccaccagggtgaagcttccatccggagctaagaaaattgttccaagtggatgccgtgctatgattggtcaggtagccggaggtggacgtaccgagaagccaatgctcaaggcaggaaacgcataccacaagttccgtgtgaagagaaactgctggcctaaggttagaggtgttgccatgaatccagttgagcatccccatggtggtggtaaccatcaacacattggtcacgcaagtactgtccgccgtgatgcaccacccggtcaaaaggttggtcttattgccgccagaagaacaggtcgtctcagaggtcaagctgctgctactgctgctaaagctgataaatagagcaaatgagcaattgaagtttgattatatggtaatggtttttgttatttttgtgtcggattatgttatgtttcgaatttatcatggttcagttttgtttgaaatttgactattgagaattaggatacagattat

SEQ ID NO: 3299 - DNA, 1015 bp, Solanum melongena
atttccctttaacacagccgagagagagagagagagagagagagagagagggcggcgaaatgggtcgtgtgatcagatcacagcgtaagggagcaggttccgtcttcaagtcccacactcatcaccgtaaaggccccgcccggttccgtaccctcgacttcggcgagcgaaatgggtaccttaagggtgttatcacggatgttattcatgacccaggtaggggtgctccattagctcgtatcactttccgtcatccattccgttacaagcaccagaaggagctgttcgttgcggcggagggtatgtacactggtcagttcgtttactgtgggaagaaggcagcactcatggttggcaatgtgttgccactcagatctatccctgaaggagctgttgtgtgtaatgttgagcacaaagttggtgaccgtggtgtttttgctaggtgctctggtgattatgctatcgtcgtcagtcacaatcccgataatggaaccacaaggattaagctcccatcaggatccaagaagattgtgccaagtgggtgtcgtgccatgattggtcaggtagctggaggaggacgtactgagaagccaatgctcaaagcaggtaacgcataccacaagtaccgggtaaagaggaactgctggcccaaggttcgtggtgttgctatgaatcctgtggagcatcctcatggtggtggtaaccatcaacatattggtcatgctagtactgttcgtcgtgatgcaccacctgggcaaaaggttggtcttattgctgcaaggaggactggtcgtcttcgtggtcaagctgctgccacagctgcaaaggctgataaggcttagaaagtttacttcatccctgtttacatttatttgtttccgtatcagtcttttcaactatttgagtgctgaaattatactaaattttggttggatattattcagtagtaagttttgtttgagaaacccatatctggacaagtttgctgtttaatgttatgactcatttagctcct

SEQ ID NO: 3300 - DNA, 1099 bp, Eucalyptus grandis
cctgcaaccttcttcgttttctccattccacagcctctcgcgcacccccctccaccagagctccgaaatcccgacgacggcgagatgggtcgcgtgatccgggcgcagcgtaagggtgcgggctccgtcttcaagtcccacacccaccaccggaaggggccggcgaggttccggagcctcgacttcggggagcgcaacgggtacctcaagggcgttgtcaccgagatcgtgcacgacccgggccgcggcgccccgctcgcccgcgtcgccttccgccaccccttccgctacaagaagcagaaggagctcttcgtcgccgccgagggcatgtacaccggccagttcgtctactgtggcaagaaggccaccctcgtcgtcggcaacgtcctgcccctccgctccatccccgagggtgccgtcgtgtgcaacgtcgagcaccacgtcggggaccgcggggtcttcgccagggcctccggggactacgcgatcgtgatcagccacaaccctgataacgacacctccagaatcaagcttccatccgggtcgaagaaaattgtgccaagtggctgccgagcaatgatcgggcaggttgctggtggaggaagaactgagaagccccttcttaaggctggcaatgcttaccacaagttcagagtgaagaggaactgctggcccaaggtgcgtggtgtggccatgaacccagttgagcatcctcacggaggaggtaatcaccaacacattggtcacgcgagcacagtcaggcgtgacgcgccacctggccagaaggttggtctcatcgccgctcggaggactggtcggctcagaggacaagccgccgcaactgcttccaaggctgataaggcttgaagagatattcctgtttttcttcatttggtattccgttggactcggttttgggtattctacaattataattctgggaatttgcggatgcattttgtagtcgaagttttgctctggtttaatgtatcagatagtcttttatatgctaaattgccatgagatgtggtgtcgcattgcctctcaaattatttttcccttctctctatgaatatcaaataaattaattatacttaat

SEQ ID NO: 3301 - DNA, 1011 bp, Unknown
  Sequence found in Organisms: Euphorbia peplus, Euphorbia esula
cccaaaccctaatctcaccactccaattccttccctttcacccaaatgggtagagtcatccgcgcccagcgtaagggtgccggctccgtcttcaaatcccacacccaccaccggaaaggccccgcccaattccgttccctcgacttcggcgagcgaaatggatatctcaagggtgtgattaccgagatcattcacgatccgggtcgtggagctccgttagcccgtgtcactttccgtcatccgttccgttacaagcaccagaaggagcttttcatcgctgctgaggggatgtacactggacagtttgtgtactgtgggaagaaggctaatttgatggttgggaatgttttgcctttgagatcgattcctgagggagctgttgtttgtaatgtggagcatcatgttggggatagaggctcttttgctagatgttctggtgattatgctatcgttgttagtcataatcctgataacggaactagcagaatcaagcttccatcaggagcaaagaagatagtaccaagtggttgcagggccatggtgggccaagtagcaggtggaggaagaacagagaagcctatgttgaaggccggaaatgcctatcacaaataccgggtgaagagaaattgctggcccaaggttagaggtgttgctatgaatccggtggagcatcctcatggaggaggtaaccaccaacatattggtcatgccagtactgttcgccgtgatgcacctcctggacaaaaggttggtctcattgctgcaaggagaactggtcgtcttaggggacaagctgctgccactgctgctaaagctgataaggcttagtttgcattttatatatttgttttgaatgaatacttctatgttttgtctagacagttttgcactagtatttgaagttttgttgctccttttcttttaattttttataaacaaggtattttgacattgtcccgttttgtgaagagttttaaatttggtgatttggttcatcactgtttggtctaa

SEQ ID NO: 3302 - DNA, 837 bp, Flaveria ramosissima
aaatcaacaatgggacgtgtaatcagagcacaacgtaagggtgcaggctccgtcttcaagtcccacactcaccaccgcaaaggtccggcgagattccggagcctcgacttcggcgaacgcaacggttatctgaaaggcgtcatcaccgagatcattcacgaccccggccgcggtgctccgcttgctcgcgtcactttccgtcatccgttccgatacaagcaccagaaggagctgtttgttgccgccgaggggatgtacaccggtcagtttgtgttttgtggtaagaaggcgaatttgatggtcggaaatgtgcttccgcttagatctatacctgaaggagctgttgtgtgtaatgttgagcatcatgttggtgaccgtggctcgttcgctagggcttccggtgattacgctattgttattagtcataatccggataacggcaccactagggtcaagcttccatctggagccaagaaaattgtgcccagcggatgtcgtgccatgatcggtcaggttgcaggaggcggtcgaacggagaagccaatgcttaaagctggtaatgcttatcacaagttccgtgtgaagaggaactgctggcccaaggttcgtggtgttgccatgaatccagttgagcatccccatggtggtggtaaccatcaacacatcggtcatgccagtactgtccgccgtgatgcaccacctggtcaaaaggttggtcttattgccgctaggaggactgggcggctcagaggtcaagctgctgctactgctgccaaggctgataaatagagcacttgagtggattttgttatctgtttttaagtttactggtatgtt

SEQ ID NO: 3303 - DNA, 1099 bp, Flaveria ramosissima
aaatcaacaatgggacgtgtgatcagggcacaacgtaagggagcaggctccgtcttcaagtcccacactcaccaccgcaaaggtccggcgagattccggagcctcgacttcggcgaacgcaacggttacctgaaaggcgtcatcaccgacatcatccatgaccccggccgcggtgctccgcttgctcgcgtcactttccgtcatccgttccgttacaagcaccagaaggagctgtttattgctgccgaggggatgtacaccggtcagtttgtgttttgtggtaagaaggcgaatttgatggtcggaaatgtgcttccgcttagatctattcctgaaggagctgttgtgtgtaatgttgagcatcatgttggtgaccgtggctcgtttgctagggcttccggtgattatgctattgttatcagtcataatcctgataacggcaccactagggttaagcttccatctggagccaagaaaattgtgcccagcggatgtcgagccatgatcggtcaggttgcaggaggtggtcgaacggagaagccaatgcttaaagctggtaatgcttatcacaagttccgtgtgaagaggaactgctggcccaaggttcgtggtgttgccatgaatccagtcgagcatccccatggtggtggtaaccatcaacatattggtcacgcaagtactgttcgtcgcgatgcaccacctggtcaaaaggttggtcttattgccgctaggaggaccgggcggctcagaggtcaagctgctgccactgctgccaaggctgataaatagagcacttgaatggattttggtatctgttttgaagttttattggtatgtttgtttcatttgaggttgaacttttgagagttaattgacaattcttgatcttattactggaaactatgttattgtgtgctgttttctttgattgtcaagtccatagttatatcacggctgcatttgatttagttgaccctagaatgaaatataagggttttggattagcataaacaggtttgtgtcattctttttcgttgatgttcaaaaactcttatctttctcatttcacttactctttatacagattggattctgagac

SEQ ID NO: 3304 - DNA, 1014 bp, Linum usitatissimum
accaacacaggtaggttagaatgggacgagtcatccgtgctcaacgtaagggagctggctccgtcttcacgtcccacactcaccacaggaagggaccggctcgattccgctcgctggacttcggcgagagaaatggatacctcaagggtgttgtgacggaggtcattcatgatccgggaaggggtgcgccgctcatcaaagtgactttccgtcatcctttccgttaccagaagcagaaggagctgttcgtcgccgccgaagggatgtacactggccagttcgtgtactgtggtaagaaggccaacctcatggttgggaacgtcttgcccctcagatctatccctgaaggagctgtcgtttgcaacgtcgagcaccacgtcggtgatcgtggtgtcttcgctaggtgttccggtgattatgccatcgttatcagtcacaaccctgataacgacaccaccagggtgaagcttccctctggtgctaagaagattgtgccgagtggatgccgtgctatgatcgggcaagttgcaggaggtgggagaacagagaagcctatgctcaaggctggaaatgcgtaccacaagtacagagtgaagaggaactgctggcccaaggttcgtggtgtggctatgaatccagtggagcatcctcatggtggtggtaaccatcaacatattggtcacgcaagtacagtgaggagggatgctcctcctgggaagaaggttggtctcattgctgccaggagaactggccgtctcagaggtcaagctgctgccactgctgccaagtctgacaagtgataaaattaggcttttaattattttgaatctgttttcagtgttttgggttttacttcggaatttttagataaatcttgaggacagtttgtcatatttttggtggtttttgttccgatcaaacttggaagtttgttacttttcttgttacggtttgtgctcttttgacaatggtgtactataattctgctttgtcctaatgcatgactgcggttgg

SEQ ID NO: 3305 - DNA, 1043 bp, Ipomoea nil
gaatctcggaaaccctagctgtttctcatagcatttctctccctctcaactctctgccctcagtcgcagcagccacttctccgagatgggacgagtcatcagagctcaacgtaagggtgccggatcggttttcaagtcccacacccaccaccgcaagggcccggcccgcttccgctccctcgacttcggcgagcgcaatggctacctcaagggtgtggtgtctgaggtcatccacgaccctggtcgcggcgccccgctcgctcgcgtcactttccgtcaccccttccgctaccagcaccagaaggagcttttcatcgccgccgaaggcatgtacaccggccagttcgtctactgtggtaagaaggccgccctcatcgtcggcaacgtgctgcctctcagatccatccctgaaggtgccgtcgtttgcaatgtcgagcacaaggtcggcgaccgcggtgtctttgccaggtgctccggcgattacgctattgttatcagtcacaaccccgacaacggaactaccaggattaagctgccatcaggatcgaagaagattgttcccagtgggtgcagggccatgattggtcaggttgctggaggtggaagaacagagaaaccactcctcaaagctggaaatgcttatcacaagttccgtgttaagaggaactgctggcctaaggtccgtggtgttgccatgaatcccgtggagcatcctcacggtggtggtaaccaccagcacattggtcacgccagcactgtccgtcgtgatgctccaccagggcaaaaggttgggctcattgctgcaaggaggactggtcgtctccgtggtcaagctgcagccactgctgccaagtccgataaggcataagctaagggttcttaagttagctcttgattatgctgcagaatttgaacttattatcaactttttacatcttcctgtacttccagacttttgttatgcagtggtttatactaaattttgttgggattttaattaagcagtagtgagttttgttcagtggttcatattggacaactat

SEQ ID NO: 3306 - DNA, 1028 bp, Lactuca sativa
acctccctcatctgccgtcgttctccgaagcttaacaggagaaatgggtcgtgttatcagagcacagcgtaagggagcaggctccgtcttcaaatcccacacccaccaccgcaagggtccggcgaggttccgcagtctcgacttcggtgagcgcaatggttacctcaagggtgtcatcaccgaaatcatccacgatccaggtcgtggtgcccctcttgcacgcgtcactttccgtcatcctttccgttacaagcaccagaaggaactcttcgtcgccgccgaggggatgtacactggtcagttcgtcttttgtggaaagaaggctaacttgatggtcggtaacgttcttcctctcagatctatcccagaaggagctgtggtctgcaacgttgagcaccacgtcggtgaccgtggttcatttgccagggcttctggtgattacgccatcgttatcagtcacaaccccgataacggcaccactagagtgaagcttccatctggagccaagaaaattgtgccaagtggatgcagagctatgattggtcaagttgcaggaggagggcgtactgaaaagccaatgttgaaagcaggaaacgcgtatcacaaattccgtgtgaaacgtaactgctggcctaaggttcgtggtgtggctatgaaccctgtggagcatcctcatggtggtggtaaccatcaacatattggtcatgcaagtacggttagacgtgatgcaccacccggtcaaaaggttgggctcattgccgccaggaggactgggcggctcagaggtcaagctgctgccaccgctgccaaggctgataagtgatgaagttagattgctattatggttttggtttttttgttatgaatcattgggtactttttattgttagttattttgagtttattacttggaattgttattgttatgttgattgtcatacattttgttttatgggaaagttttgtggtagacttgtttttgtttgttgtttggtttggttgctaatttgttcgacaacacataatag

SEQ ID NO: 3307 - DNA, 1080 bp, Lactuca sativa
cgattgccaaaccctatatcaggatcttcgctcccaagaacccgccgtcgtccccaaaccctagccaccgagtgtgtgcgtgagagagagagaggtaagagagaaccagaaatgggacgtgtgattagggcacagcgtaagggagcagggtcggtcttcaagtcccatacccaccaccggaaggggcctgccaggttccgcagcctcgactttggcgaacgcaatggttacctcaagggtgtcatcaccgaaatcatccacgatcccggccgtggtgctcctctggctcgcgtcacattccgtcatcctttccgctacaagcaccagaaggagctgtttgtcgccgctgagggcatgtacaccggccagttcgttttctgtgggaagaaagcgaatttgatggttggaaacgtccttcctctcagatctatccctgagggagctgtcgtttgcaacgtagaacatcatgtcggtgaccgtggttcgttcgccagagcttccggtgattacgccatcgttattagtcacaatcccgataacggcaccactagggtgaagctgccatcaggagcaaagaagatcgtgccgagtggatgtcgtgctatgatcggtcaggttgccggaggagggcgtactgagaagcctatgctgaaagctggtaacgcataccataaattccgtgtgaagagaaactgctggcctaaggttagaggtgttgccatgaatccagtggagcatccccatggtggtggtaaccatcaacacattggtcatgcaagtacggttcgccgtgatgcaccacctggtcaaaaggttggtcttatcgccgccagaagaactgggcgtctcagaggtcaagctgcagctactgctgctaaggctgataaataggttttttgatatttttgtttcagaatactgttatgttggtttgttgctgcgagtttatcatggttcagttttgtttgaaatttgactcttgaaggttagtctacatattcttgatgtctgttttacattctcatgagtaacttaatcatgtcttataacaatcgacgttgcttaaaactaaaatttagc

SEQ ID NO: 3308 - DNA, 933 bp, Lactuca sativa
tctgccgtcgttctccgaatctttacaggagaaatgggtcgtgttatcagagcacagcgtaagggagcaggctccgtcttcaagtcccacacgcaccaccgcaagggtccggcgagattccgcagtctcgacttcggtgagcgcaatggttacctcaagggtgtcatcactgaaatcatccacgatccaggacgtggtgctccccttgcacgcgtcactttccgtcatccattccgttacaagcaccagaaggaactcttcgtcgccgccgaggggatgtacaccggtcagttcgtcttttgcggaaagaaggctaacttgatggtcggcaacgttcttcctctcagatctattccagaaggagctgttgtgtgcaacgttgagcaccacgtcggtgaccgtggttcatttgccagggcttctggtgattacgccatcgttatcagtcacaaccccgataacggcaccactagagtgaagcttccatctggagccaagaaaattgtgccaagtggatgcagagctatgattggtcaagtagcaggaggaggtcgtacagaaaagccaatgttgaaggcaggaaatgcttaccacaaattccgtgtgaaacgaaactgctggcctaaggttcgtggtgtggctatgaaccccgtggagcatcctcatggtggtggtaaccatcaacatattggtcatgcgagtacggttagacgtgatgcaccacccggtcaaaaggttgggctcattgccgccaggaggactgggcggctcagaggtcaagccgctgccaccgctgccaaggctgataagtgatgaaactagattggaattatgtttttggtttttggtgttatgttatcatcgggtacttttgatgttagttattttgattatgttacttggaattgttattgttatgttgattgtcataca

SEQ ID NO: 3309 - DNA, 930 bp, Lactuca sativa
ttcggcgggggtcccaaccctagcaaccgagtgtgtgtgcgtcagagagaggcaagagagaaccagaaatgggacgcgtgattagggcacagcgtaagggagcagggtccgtcttcaagtcccatacccaccaccggaaggggcctgccaggttccgcagcctcgactttggcgaacgcaatggttacctcaagggcgtcatcaccgaaatcatccacgatcccggacgtggtgctcccctggctcgtgttacattccgccatcctttccgctacaagcaccagaaggagctgtttgtcgccgctgagggcatgtacaccggtcagttcgttttctgtggaaagaaggcgaatttgatggtcggaaacgtccttcctctcagatccatccctgagggagctgtcgtttgcaacgttgaacatcacgtcggtgacagaggttcattcgccagagcttctggtgattacgccatcgttatcagtcacaatcctgataacggcaccaccagggtgaagctgccatcaggagcaaagaagattgtgccgagtggatgtcgtgctatgatcggtcaggttgccggaggagggcgtactgaaaagcctatgctgaaagctggaaacgcataccataaattccgtgtgaagaggaactgctggcctaaggttagaggtgttgccatgaatccagtggagcatccccatggtggtggtaaccatcaacacattggtcatgcaagtacggttcgccgtgatgcaccacctggtcaaaaggttggtctcatcgccgccagaagaactggtcgtctcagaggtcaggctgcagctactgctgctaaggctgataaataggttttttcatatttttgtttcagaatactgttatgttggtttgttgcttcgaaattatcatggttcagttttgtttgaaatt

SEQ ID NO: 3310 - DNA, 1081 bp, Lotus japonicus
tatccctctccccggagaagaggcaactggtgtggtggtagattcactctgctcttcttgccgccgccgccgccgccgccgcaatgggtcgtgtgatccgcgctcagcgtaaaggtgcaggctccgtgttcaaatctcacacccaccaccgcaagggaccggcaaggttccgcagcctcgacttcggggaacggaacggttacctcaaaggtgttgtcaccgacgtgatccacgaccccggtcgcggtgctccgctcgccaaggtggcattccgccaccccttccgttacaagaagcagaacgagctcttcgttgcggctgagggcatgtacacgggccagttcatcttctgcgggaagaaagccacccttgtcgtcggtaacgtccttcccatcaggtctatccctgaaggtgccgttatctgcaacgtcgagcaccacgttggcgatcgcggtgtgtttgctaggtgctctggtgattacgccattgtcatcagtcacaatcctgataatgatacctccaggataaagcttccatctggtgcgaagaagattgttccgagtgactgtagggcgatgattgggcaagttgcgggtggtgggagaactgagaagcctcttctgaaggctggtaatgcttaccacaagttcagggtgaagagaaattgctggccgaaggtgcgtggtgttgctatgaaccctgttgagcatcctcatggaggaggtaatcaccagcacattgggcatgcgagtactgttagacgcgatgctccacctgggcagaaggttggtctcattgctgccaagaggactggtcgtcttagggggcaagctgctgcaactgctgctaaagctgataaggtctaagggtgctgaacaacagattgttaggattttatttgattgcttgttttccaattttgtttcttgatagtttacctgttacactgtttggttaccattttggcaatcttttccccaaaaagaaaagagctttcaacagagatttttttatatttgtccaagtgatattcataatcctgcagtttttctacctgctatattatctggttggattagtt

SEQ ID NO: 3311 - DNA, 777 bp, Lotus japonicus
gcaatgggacgtgtgatccgtgctcagcgtaaaggtgcaggctccgtgttcaaatctcacacccaccaccgcaagggaccggcaaggttccgcagcctcgacttcggggaacggaacggttacctcaaaggtgttgtcaccgacgtgatccacgaccccggtcgcggtgcgccgctcgccaaggtcgcattccgccaccccttccgttacaagaagcagaacgagctcttcgttgccgccgagggaatatacaccggccagttcatcttctgcgggaagaaagccacccttgtcgtcggtaacgtccttcccatcaggtctatccctgaaggtgccgttatctgcaacgtcgagcaccacgttggcgatcgcggtgtgtttgctaggtgctctggtgattacgccattgtcatcagtcacaatcctgataatgatacttccaggataaagcttccatctggtgcgaagaagattgttccgagtgactgtagggcgatgattgggcaagttgcgggtggtgggagaactgagaagcctcttctgaaggctggtaatgcttaccacaagtttagggtgaagagaaattgctggccgaaggtgcgtggtgttgctatgaaccctgttgagcatcctcatggaggaggtaatcaccagcacattgggcatgcgagtactgttagacgtgatgctccacctgggcagaaggttggtctcattgctgccaagaggactggtcgtcttagggggcaagctgctgcaactgctgctaaagctgat

SEQ ID NO: 3312 - DNA, 1180 bp, Cucumis melo
aaaaccctaatttccattctcaatgggtcgtgtgatcagagctcaacgtaagggtgcgggatctgtcttccgctctcacactcaccaccggaagggcccggcccgtttccggtcactcgacttcggcgagcgtaatggctacctgaaaggtgtggtcagcgaaatcattcacgatccgggcagaggtgcaccgttggcccgtgttaccttccgccatcccttccgctacaagcaccagaaggaactcttcgtcgccgctgagggtatgtacactggtcagttcgtttactgcgggaaaaaggctaatcttgttgttggtaatgtgctccccattagagccattcctgaaggagctgtggtttgtaatgtggagcaccatgttggcgacagaggtgtgtttgctagatgctctggtgattatgctattgttatcagccacaacccagacaatgataccagcaggattaagctaccatctggagcgaagaagattgtacccagtggatgccgtgctatgattggtcaggttgctggaggaggaagaacagagaagcctcttcttaaggcaggtaatgcttaccacaagttccgtgtcaagcgtaactgctggccgaaggtgcgtggtgttgctatgaatccagttgaacatccccatggtggtggtaaccatcaacatattggtcacgccagcactgtccgccgtgatgcacctcctggtcaaaaggttggtctcattgctgccagaagaactggtcggctccgaggacaggctgctgctactgctgccaaggctgacaaggcttaaagtgattcaatcggttccagacttattttccataatccttagcccttttacattatgtttgattggatttgcattttgttgaagaccctatttagaagtttttgtttctaaattttgttacaaaaatccttttttgaacataatattcctcgcaccctcttttcttgttgctgtgatgaatgtgatgaatttgatagcatgaacaccaacgtagtttttctgaaaaggatctatgttttaggttttagattacaggttcttggagaacaatttgtagccaactactaaaattaatttacaaggatattctaatatcatatatagacaaatcttttataagaaaagatctattatctaaaaaaaaaaaaaaaaaaa

SEQ ID NO: 3313 - DNA, 1120 bp, Orobanche aegyptiaca
ccatcttcatttccattttccatattacaccgccgtcctccaaaacacacacacacacacacggagcacatttcaaaatgggtcgggttatccgagcacagcgtaagggagcagggtccgttttcaagtcccacacccaccaccgtaagggcccggcccgtttccgatccctagacttcggtgagcgcaacggctacctcaagggcgtcgtcaccgatgtcatccacgatcccggccgcggcgcgccgctggcacgggtcactttccgccatcccttccgcttccagcaccagaaggagctgttcgtcgccgccgagggtatgtacaccggccagttcgtctactgtgggaagaaggctaatctcgtcgtcggcaatgttttgccgctcagatctatccccgagggtgccgtcgtttgcaacgtggagcatcacgtgggtgaccgtggggttttcgctagggcttctggggattatgctattgttatctcccacaacccggataatgatactactaggattaagctcccatcaggagctaagaaaatcgtacccagcggttgtcgtgccatggtgggccaggttgctggtggtggtcgtacagagaagccaatgcttaaagctggtaacgcttaccacaaattccgagtgaagagaaactcgtggcccaaggttcgtggtgttgctatgaatccagtcgagcatcctcatggtggtggtaaccatcaacacattggtcacgcaagtaccgttcgtcgtgatgcgccacctggacagaaggttggtcttattgctgcgaggaggaccggtcgtctccgtggtcaagctgctgctttatctgctaaagccgataaggcttaagtgttgcgtttagattggttgtagtttctgatgaaggttttggttttgttgccttctggatttcaaattgatttgaatcagattttgaatgttgaattatgtaggggatataaccgtgttgacattatgaagactattatgttttttttggtcatgttcctagtatttttcagtattatactatatacttcattttggtatttttggtcaatgttctaaacgtgcttttcaaatggtatttttcagtattatactagatt

SEQ ID NO: 3314 - DNA, 1153 bp, Orobanche aegyptiaca
cgatccatcaaccctagggcaaacctaatttccctcatcgaagaacgtctctaaaaccctatatctattcaccgccatttctcatttcactacttgcccgccgtcgtccttcttctccacccacccttaaccacacacagtcacactcacacacacaccacttccccccgaaatgggtcgtgtgatccgggcgcagcgaaagggagcaggttccgttttcaagtcccacacccaccaccgcaagggccctgcccgattccgttccctcgacttcggcgagcgaaatggctacctcaagggtgtcgtcactgacgtcatccacgaccctggccgcggcgccccgctggcacgcgtcaccttccgccatcccttccgtttccagcaccagaaggaactctttgtcgccgccgagggcatgtacaccggccaattcgtttactgcggcaagaaggctaatctagtcgtcggaaacgtgttacccctcagatctatcccggagggtgccgttgtctgcaacgtcgagcatcatgttggggatcgtggggttttcgctagggcgtctggggactatgctatcgtgatctctcacaatcctgacaatgacactactaggattaagctaccatctggagccaagaaaattgtcccgagcggttgtcgtgctatggtgggccaggtcgctggtggtggacgtactgaaaagccaatgctgaaggctggaaatgcttatcacaagtttagagtgaagaggaactcgtggcctaaggttcgtggtgttgctatgaatccagtcgagcatcctcatggtggtggtaaccatcagcatattggtcacgccagtactgttcgtcgtgatgcaccacctggacaaaaggttggtcttattgctgccagaagaaccggtcgtctccgtggtcaagctgctgctttgtctgctaaggccgataaggcttaaggcttctagtatttgtaaggaacaaggagtttttaattttgttatgatcttttttcgacttggtttgaatcagttttttgcatgttggatacattattattgcgaggatatactagagtttgttgggattctggatgttaagttgcatttttatgcttgtttaaatcgtttcaatctacgcccccccccccccatttt

SEQ ID NO: 3315 - DNA, 920 bp, Parthenium argentatum
ccttcacccctcacccaacacgccgtcatctccaacccaaccaaaccctaacaccaatgggtcgagtcatcagagcccaacgtaagggagcaggctccgtcttcaagtcccacacccaccaccgaaaaggtccggctcgtttccgcagcctcgacttcggtgaacgcaacggctacttaaaaggggtcataaccgaaattattcatgatccgggtcgtggagcaccgttggcccgggtcacgttccgtcacccgttccgttacaagcaccagaaggagctgtttgttgctgctgaagggatgtatactgggcagtttgtgttttgtgggaagaaggctaatttgatggtggggaatgtgttgccgcttagatctattcctgaaggagctgttgtttgtaatgtggaacatcatgttggggatagagggtcgtttgctagagcttctggggattatgctattgttattagtcataatcctgataatggtaccactagggtgaagcttccatctggagctaagaaaattgtgccaagtggatgccgtgctatgattggtcaggttgctggcggaggacgtactgagaagccaatgctgaaggccggtaacgcttatcacaagttccgtgtgaagaggaactgctggcccaaggttcgtggtgttgctatgaacccagtggagcatccccatggtggtggtaaccatcaacatattggtcatgccagtaccgttcgtcgtgacgcaccacctgggcaaaaggttggtcttattgccgccaggaggactggtcgtctcaggggtcaagctgctgcaactgctgccaaggccgataagtgataagctggtgttatggataccgattttagttttgttatgtttgggactgttgcttctgttattttttttgagtttatctgctac

SEQ ID NO: 3316 - DNA, 971 bp, Capsicum annuum
aaaaaaaccggcggtctaaaatgggtcgagtaatccgagcacaacgtaaaggagccggttcagtattcaaatcccatacccatcaccgtaaaggtccggcccgattccgaaccctagatttcggcgagcgtaacggttacctaaaaggcgtcatcactgacgtcattcacgatcctggtcggggcgccccgttagcccgggtcacatttcgtcatccgtttaggtataagcatcagaaggaattgttcattgctgctgaaggaatgtacactggacaatttgtttattgtgggaaaaaggcgaatttggttgttggtaatgtgttgccattgagatcgataccggaaggtgctgtggtgtgtaatgtggagcataaagttggggatcgaggtgtttttgcgaggtgttcgggggattatgctattgttattagtcataatcctgataatgggactactagagtcaagcttccatcaggatcgaaaaagattgtgcccagtggatgtcgtgccatgattggtcaggttgctggtggaggacgtactgagaaaccaatgctcaaagctggtaacgcttaccacaagtaccgtgtgaagaggaactgctggcctaaggtccgcggtgttgctatgaatcccgtggagcatcctcatggaggtggtaaccatcaacatattggtcatgctagcacagtacgtcgtgatgcacctcctggacaaaaggttggtcttattgctgcaagaagaactggtcggcttcgcggtcaagctgctgctactgctgccaaggctgacaagtgatgacgcttacgccatttgcttgttactcttttttatctttctgttgtttcctcatcgattttcgagtattcgaagctaaaaccattttgtagtgaagttgtagcatgctaaattttgttgggatgtttggtaatttttgttttgataaatccttgtttggtgcatttttac

SEQ ID NO: 3317 - DNA, 1292 bp, Capsicum annuum
gcgcaatgggcagggtaatcagagcacaacgtaaaggagcaggttccgttttcaaatcccacacgcaccaccgtaaaggccctgctaagttccgtacactcgacttcggcgaacgtaacggttatctcaaaggtgttataacggaggttattcatgatccaggtagaggtgcaccgttagcacgtattacattccgtcatccattccgttacaagcatcagaaggaactatttgtggcggcggaaggaatgtatactggacagtttgtgtattgtgggaagaaggcgaatcttatggttggtaatgtgttgccgcttagatcgattccggaaggagctgtggtgtgtaatgttgagcataaagttggtgaccgtggtgtgtttgcgaggtgttctggggattatgctattgttattagtcataatcctgacaatggaaccactaggattaagctcccatcaggatccaagaagatcgtaccaagtgggtgtcgtgccatgattggccaggtagctggaggaggacgtactgagaagccaatgcttaaggcaggtaacgcataccacaagtaccgggtgaagaggaactgctggcccaaggttcgtggtgttgctatgaatcctgtggagcatcctcatggtggtggtaaccatcaacatattggtcatgctagtactgtccgtcgtgatgctccacccgggcaaaaggttggtcttattgctgcaaggcggactggtcgtcttcgtggtcaagctgctgccacagctgcaaaggcagacaaggcttaaagagcttagcttatcactgtttttgctatttgttttcaaatcagtctttttgaactatttgactgctgaaattatactaaattttgtttgggatattcagtagcaagttttgttttagacatccatatctggacaagtttgtcattttagctcccaacatcttttgcattcttggagctcgtcatttctgtagtctgctagcgtaaactgtgatacccatctttactgctacttgagatgcttcgtaatctggttggcaagaaacttcattcttgaccaactcgttcccttgaagcaatagtaattgtgttgctcttttatatttctccatcatagcgccttttctcattgtgtttacagtacactggagcagctacatttgttcttttttcacccctgaaccctaaacccttactggcgtttcaaaattttcgtgtcttatatttatctacattgatagctgcgtggattaccttcatttccctctctacttgacgaggtgaa

SEQ ID NO: 3318 - DNA, 1324 bp, Capsicum annuum
gagagagagagagagagaggagagagacggcggcgcaatgggcagggtaatcagagcacaacgtaaaggagcaggttccgttttcaaatcccacacgcaccaccgtaaaggccctgctaagttccgtacactcgacttcggcgaacgtaacggttatctcaaaggtgttataacggaggttattcatgatccaggtagaggtgcaccgttagcacgtattacattccgtcatccattccgttacaagcatcagaaggaactatttgtggcggcggaaggaatgtatactggacagtttgtgtattgtgggaagaaggcgaatcttatggttggtaatgtgttgccgcttagatcgattccggaaggagctgtggtgtgtaatgttgagcataaagttggtgaccgtggtgtgtttgcgaggtgttctggggattatgctattgttattagtcataatcctgacaatggaaccactaggattaagctcccatcaggatccaagaagatcgtaccaagtgggtgtcgtgccatgattggccaggtagctggaggaggacgtactgagaagccaatgcttaaggcaggtaacgcataccacaagtaccgggtgaagaggaactgctggcccaaggttcgtggtgttgctatgaatcctgtggagcatcctcatggtggtggtaaccatcaacatattggtcatgctagtactgtccgtcgtgatgctccacccgggcaaaaggttggtcttattgctgcaaggcggactggtcgtcttcgtggtcaagctgctgccacagctgcaaaggcagacaaggcttaaagagcttagcttatcactgtttttgctatttgttttcaaatcagtctttttgaactatttgactgctgaaattatactaaattttgtttgggatattcagtagcaagttttgttttagacatccatatctggacaagtttgtcattttagctcccaacatcttttgcattcttggagctcgtcatttctgtagtctgctagcgtaaactgtgatacccatctttactgctacttgagatgcttcgtaatctggttggcaagaaacttcattcttgaccaactcgttcccttgaagcaatagtaattgtgttgctcttttatatttctccatcatagcgccttttctcattgtgtttacagtacactggagcagctacatttgttcttttttcacccctgaaccctaaacccttactggcgtttcaaaattttcgtgtcttatatttatctacattgatagctgcgtggattaccttcatttccctctctacttgacgaggtgaa

SEQ ID NO: 3319 - DNA, 820 bp, Lippia dulcis
acacactgtagggtgatacgagcacagcgtaagggagcgggctccgtcttcaagtcccacacgcaccaccgcaagggcccggcccgtttccgctccctcgatttcggcgagcgcaatgggtacatcaagggtgtcgtcaccgacatcatccacgaccccggccgcggcgcgccgctggcacgcgtgaccttccgccacccgttccggtaccagcaccagaaggagctcttcgtcgctgccgagggtatttacacagggcagttcatttactgtggcaagaaggccaacctcgtcgtcgggaatgtgttgccgctcagatctattccggagggagctgtcgtttgtaacgtcgagcatcatgttggggatcgtggggttttcgctagggcttcgggggattacgctattgtcatctcccacaacccggacaatggaaccaccagaattaagcttccctcaggttccaagaaaattgtcccaagtggctgccgtgccatggttgggcaagttgccggtggtggaagaactgagaagccgttattgaaggccggaaatgcctaccacaaattcagagtgaagagaaactgctggcccaaggttcgtggtgttgctatgaatccagtcgagcatcctcatggtggtggtaaccatcaacacattgggcacgccagcactgtccgtcgtgatgctcctcctgggcaaaaggttggtcttattgctgccagaagaactggtcgtctcaggggtcaagccgctgccactgccgctaaagctgataaggcttagagtaataattgttgatttaagtggtgatcaagag

SEQ ID NO: 3320 - DNA, 1245 bp, Papaver somniferum
aaaaccctaattccgcctccgccaccaccatcttcatcaccaaatgggtcgtgtaatcagatctcaacgtaagggagctggttccatcttcaaatcccatacccaccaccgcaaaggaccagcaagattcaggagtttagatttcggtgaaagaaatggttacttgaaaggagtagttactgaaatcatccacgatccaggtcgtggtgctccattagcaagagttactttcagacatcctttcagatacaagcatcagaaggagctttttgttgctgctgagggtatgtatactggacagtttttgtattgtgggaagaaagctaatcttatggttggaaatgttcttccattgagatctattcctgaaggagctgttgtttgtaatgttgaacatcatgttggtgatagaggaacattagctagagcttctggtgattatgctattgttatcagtcacaaccctgataatggtacttcaaggattaagcttccttctggagcaaaaaagattgtaccaagtggatgccgtgctatgattggccaagttgctggtggaggcaggactgagaagcccatgttgaaagcaggaaatgcttaccacaaatacagagtgaagagaaactcctggcccaaggttcgtggtgttgctatgaatccagttgagcatcctcatggaggaggtaaccaccaacatattggacatgccagtaccgttcgtcgtgatgcacctcctggacaaaaggttggtctcattgctgccaggagaactggacgtcttcgtggacaggctgcttcagctgctgccaagacagacaaagcttaagttcttggctcttttactgttttagtttgtttgatatcttgaatcaatctttcctagtttgactcatgagaggtactgtgagaagaatacttttaatgtttattgtcttcagatattacttattagtgtgtagaatgatcagaattatgtctctctgtgaaatgcaagtttgttgcttgagcaatatactgaatttaacaacacagtttgataatttcctttgtttaagtcagttttttgcaaagccatttgcagttttgaagcatatttcttgaattattgtactttgctaggaagtatgagtgcatcttttgggtatatgaactatgaagaggtttaggataagctttataatgttttgcatggtcctttgacaaaagaaagtgaaagcaactgcaaaatctgtaatagcatacttt

SEQ ID NO: 3321 - DNA, 1056 bp, Prunus persica
ggccgctagcagagcacagagacatctcagcgggaagccatgggaagagtcatcagagctcagcgtaagggtgccgggtccgtcttcaagtcccacactcaccaccgcaagggtcctgcccggttccggagcctcgacttcggcgagcgcaacggctacctcaagggcgtcgtcactgagattatccacgacccgggtcgtggtgccccgctcgcccgagtcagcttccgccatcctttccgatacaagaagcagaacgagctcttcgtcgccgctgagggtatctacactggccagttcatctactgtgggaagaaggccaatctggtcgtcggaaatgttttgcctctcagatcgatcccagaaggagctgtagtctgcaacgtcgagcaccatgttggtgaccgtggaacccttgctagggcttctggtgactacgctgttgttatcagccacaaccctgataacgatacctccaggatcaagcttccttctggtgcgaagaagattgtgccaagtggctgcagggcaatgattgggcaagttgctggcggtggtaggactgaaaagccaatgctcaaggctggtaatgcgtaccacaaattcagagtgaagaggaactgctggccaaaggttcgtggtgtggctatgaacccagttgagcatcctcacggaggaggtaaccaccagcatattggacatgcaagtacagtcagacgtgatgctcctcctggccagaaggttggtctcattgctgcaaggagaacaggaagacttagaggacaagctgctgccactgcctccaaggctgacaaggcttaagaccaattttatatttatatgttctgtttttggaccgccaaatcttttaagagtgctcaacattaccatttttcctttttctgaatttgatattttggtactgtttactttatgtactagtttttatccgacactggtgggttcatttggcagaaattttgtttggtagatcctttatgcccaagtgttcaataatttcaaggctttatataattacaatttaaaacgttactc

SEQ ID NO: 3322 - DNA, 1013 bp, Carthamus tinctorius
gtgccaaccctagagagagagaggttagagagagagagagagttgcagaaatgggacgtgtgattagggcacagcgtaagggagcaggttcggtcttcaagtcccacacgcaccaccgcaagggtccggcgaggttcaggagcctcgacttcggcgagcgcaacggctacctcaagggagtcatcaccgagatcatccacgatcccggccgtggtgctccccttgctcgcgtcaccttccggcatccgttccggtacaagcaccagaaggagctcttcgtggccgccgaagggatgtacaccggacagttcgtgttttgcggtaagaaggctaacctgatggtcggtaacgtgcttcctcttagatctatccctgaaggagctgttgtgtgcaacgtcgagcatcatgtcggtgacagaggctccttcgctagggcttctggcgattacgccattgttatcagccacaatcctgataacggaactactagggtcaagctcccatccggtgccaagaaaattgtgccaagtgggtgtcgagccatgattgggcaagttgccggtggtggacgtaccgaaaagccaatgctgaaggctggtaacgcgtatcacaagttccgtgtgaagaggaactgctggcctaaggttcgtggtgtggctatgaatcccgttgagcatccccatggtggtggtaaccatcaacatatcggtcacgcaagtaccgtccgtcgtgatgcaccgcccggtcaaaaggttggtcttattgctgctagaaggaccggtcggctcagaggtcaagctgccgctactgctgccaaggataagtagagcaacatttctttggagtatgatggtatgtgttcttttttggatatttttcggatcaagaatactgtttttgtgtgttggttatccagaaattatcgtagttcagttttggctaagtgttacatttaaggattaatttacatattttgttatccatttctgaaagctatgcaattgtttgtttat

SEQ ID NO: 3323 - DNA, 887 bp, Salvia sclarea
ctgcaggaattcggcacgaggctgtttcacacacacacactgagcaagccggcagaatgggacgtgtgattagagcgcagcgtaagggagcgggttccgtcttcaaatcccacacccaccaccgcaagggaccggcgcgcttccgctccctcgacttcggcgaacgtaacggctacctcaagggtgtcgtcaccgagatcatccacgaccccggccgcggcgctcccctcgctcgcgtcaccttccgccaccccttccgcttccagcaccagaaggaactcttcgtcgccgccgagggtatgtacaccggccagttcgtctactgcgggaagaaggctaatctcgtcgtcggaaacgtcttgcccctcagatccattcccgaaggtgccgtcgtttgcaacgtggagcatcacgttggagatcgcggcgttttcgctagagcttctggagactatgcgattgtcatctctcacaacccggacaatggaaccacaagggttaagctcccatcaggtgcaaagaagattgtgcccagtggttgtcgtgccatggttgggcaggttgctggaggtggtagaactgagaaaccaatgttgaaggctggaaatgcttatcataagttcagagtgaagaggaactcatggcccaaggttcgtggtgttgcaatgaaccctgtggagcatcctcatggtggtggtaaccatcaacacattggtcatgctagcactgttcgtcgtgatgcaccacctggacaaaaggttggtcttattgctgccagaagaaccggtcgtctcaggggtcaagctgctgctacagctgctaaagctgataaggcctaagaattctgattttgctttcttctttatctaaatagaatttgaatcagg

SEQ ID NO: 3324 - DNA, 925 bp, Helianthus annuus
gcagagcacgcggggacctgccgtcgtctcaaccggagcaatgggtcgcgtcatccgagctcaacgtaagggagcaggctccgtcttcaagtcccacacacaccaccggaaaggcccagcccgtttccgttccctcgacttcggcgagcgcaacggctacctaaaaggggtcattaccgaaatcatccacgacccaggccgcggagctcccctggctcgcgttacgttccggcacccgttccggtacaagcaccagaaggaattgtttgtggccgctgaggggatgtacaccggccagtttgtgttttgtgggaaaaaggctaacttgatggtcggaaatgtgctgccgcttagatcgattccggaaggagctgtggtttgtaatgtggagcatcatgttggggatcgaggctcgtttgctagagccagtggggattatgcgattgttattagtcataatccggataatggtaccactagagtgaagcttccatccggggcaaagaaaattgtgccaagtggatgccgtgctatgatcggtcaagttgcaggtggaggacgtaccgagaagccgatgctcaaggccggtaacgcataccacaagttccgcgtcaagagaaactgctggcctaaggttcgtggtgttgctatgaaccccgtggagcatcctcatggtggtggtaaccatcaacatattggtcacgccagtactgttcgccgtgatgcaccacccggtcaaaaggttggtctcattgccgctaggaggactggtcgtctcagaggtcaagctgccgctactgccgccaaggctgataagtagtgaactgatgttacgggtgttgattttagctttttgttttttacctttgcatctgctactttcatgttttgtttttgacttgaatctgcaactgaaatgttgatc

SEQ ID NO: 3325 - DNA, 1085 bp, Helianthus annuus
cgtcgtctccaaaccctaaccctaaccaaatgggtagagtaatccgagcccaacgtaagggagcaggctccgtcttcaagtcccacacgcaccaccgcaagggtccggctcgtttccggagcctcgacttcggtgaacgcaacggctacttgaaaggtgtgatcactgaaattatccatgacccggggcgtggtgcgccgcttgctcgcgtgactttccgtcacccgttccgatacaagcaccagaaggagctgtttgtggcggctgagggtatgtatactggacagtttgtgttttgtgggaagaaggcgaatttgatggtggggaatgtgttgccgcttagatctattcctgaaggagctgtggtttgtaatgttgagcatcatgttggggatagaggctcgtttgctagagcttctggcgattatgctattgttatcagtcataatcctgataacggcaccactagggtgaagcttccatctggagccaagaaaattgtgccaagcggatgccgtgctatgattggtcaagttgctggtggaggacgtaccgagaagccaatgctgaaggccggtaacgcttaccacaagttccgtgtgaagagaaactgctggcccaaggttcgtggtgttgctatgaatccagttgagcatccccatggtggtggtaaccatcaacatattggtcatgccagtaccgtccgtcgtgacgcaccacctggtcaaaaggtcggtcttattgccgccaggaggactggtcgtctcagaggtcaagccgctgccactgctgccaaggctgataagtaataaactgggattatggatgcttttagttttgttatatctggttctgttattggtagttttctcaagcttatttgctactgttatgtttgttttcatacattggatctttttggaaagttttggagtaagatattgattattgaacattttgttgagcttatggtattgatgttgatttgtttgatgctaaacaaaaacaaaaaagagtaaatattaaacttgttgggcggctcgggtcaaatcgattttaatattagacaagcttatgcatgcggc

SEQ ID NO: 3326 - DNA, 969 bp, Helianthus annuus
cttcggcgggggtcccaacctgcgtgtaggttagagagagagagtttagagagagaaacaatcaacaatgggacgtgttatcagagcacaacgtaagggagcaggctccgtcttcaaatcccacacacaccaccgcaaaggcccagccagattccggagcctcgacttcggcgaacgcaacggttacctcaaaggagtcatcaccgaaatcatccacgatccaggccgcggtgcgccgcttgctcgcgtcaccttccgtcatccgttccgttacaagcaccagaaggagctcttcgttgccgccgaggggatgtacaccggtcagtttgtgttttgtggcaaaaaagctaatctgatggtcggaaatgtcctgccgcttagatctattccggaaggagctgtggtttgtaatgtggagcatcatgttggggatagaggttcgtttgctagggcttccggggattatgctattgttattagtcataatccggataacggtaccactagggtcaagcttccatctggagccaagaaaattgtgccgagcggatgcagagccatgattggtcaggttgccggaggtggtagaaccgagaagccgatgcttaaagctggtaatgcttatcacaagttccgcgtgaagagaaactgctggcccaaggttcgtggtgttgctatgaatccagttgagcatccccatggtggtggtaaccatcaacatattggtcatgcaagtacggtccgtcgtgatgcaccacctggtcaaaaggtcggtcttattgccgctaggaggactggtcgtctcagaggtcaagctgctgctactgccgccaaggctgataagtagagcacttgaatggattttggtatcaggtttgaaatttttacttatctgtttgttttgtttgaatttggacttttgagggttaatctacaatacttgatacaatgttattgttattttgcttt

SEQ ID NO: 3327 - DNA, 1018 bp, Helianthus annuus
cgcagagtacgcgggggtccccaaacttgcgtgtaggttagagagagagagtttagagagagaaacaaacaatgggacgtgttatcagagcacagcgtaagggagcaggctccgtcttcaaatcccacacacaccaccgcaaaggcccagccagattccggagcctcgacttcggcgaacgcaacggttacctcaaaggagtcatcaccgagatcatccacgatccaggccgcggtgcgccgcttgctcgcgtcaccttccgtcacccgttccgttacaagcaccagaaggagctcttcgttgccgccgaggggatgtacaccggtcagtttgtgttttgtggtaaaaaagctaatctgatggtcggaaatgtcctgccgcttagatctattccggaaggagctgtggtttgtaatgtggagcatcatgttggggatagaggttcctttgctagggcttcgggtgattatgctattgttattagtcataatccggataacggtaccactagggttaagcttccatctggagccaagaaaattgtgccgagcggatgcagagccatgattggtcaggttgccggaggtggtagaaccgagaagccgatgcttaaagctggtaatgcttatcacaagttccgcgtgaagagaaactgctggcccaaggttcgtggtgttgctatgaatccagttgagcatccccatggtggtggtaaccatcaacatattggtcatgcaagtacggtccgccgtgatgcaccacctggtcaaaaggtcggtcttattgccgctaggaggactggtcggctcagaggtcaagctgctgctactgccgccaaggctgataagtagagcacttgaatggattttggtatcaggtttgaaatttttacttatctgtttgttctgtttgaatttggacttttgagggttaatctacaatacttgatacaatgttattgttattttgcttttttattgatgagattttggtcgtatcatgggagtgtatgatttta

SEQ ID NO: 3328 - DNA, 1021 bp, Triphysaria pusilla
cacgaagaaatgggtcgtgttatccgggcacaacgtaagggagccgggtccgttttcaagtctcacacacaccaccgcaagggcccggcacgtttccggtccctagacttcggcgagcgcaatggctacctcaagggcgtcatcaccgaggtcatccacgaccctggccgtggcgcgccgctcgctcgcgttgttttccgccacccgttccgctttcagcatcagaaggagctattcgtcgccgcagagggtatgtacaccggacagttcgtatactgtggaaagaaggcgaatctcgtcgtcggcaatgttttgccactcggatctattcctgagggtgctgtcgtctgcaacgttgagcatcacgtcggtgatcgtggagtttttgctagggcatctggggattatgctattgttatctcccacaacccagacaatggcacttctaggatcaaacttccatcaggagccaagaaaattgtgccaagtggttgccgtgccatggtgggccaggttgcaggtggtggacgtactgagaagccaatgttaaaggctggaaacgcatatcacaagtacagagtaaagagaaactcgtggcccaaggttcgtggtgttgctatgaatccagttgagcatcctcatggaggtggtaaccatcaacatatcggtcatgcgagtacagtacgtcgtgatgcgccacctggacagaaggttggtcttattgctgctaggagaactggtcgtctccgtggtcaagctgctgctactgctgctaaggccgataagtaagagggcttagattagtaattttttgggtgatggaattatttttagtatctgttgaatttcaatttaattttaatcagattttgattgttgagattagtaatgagataatggtgatgaatttatggagagatgttttgatttttcagtgttatatactatttgtaattttttttgtgaactctcccttgttattctaactagtatttttgacccgtgcgattcacggggagta

SEQ ID NO: 3329 - DNA, 1196 bp, Lactuca sativa
gcttccattcgcctatttccaacctccctccatctgccgtcgttctccgaagcttaacaggagaaatgggtcgtgttatcagagcacagcgtaagggagcaggctccgtcttcaaatcccacacccaccaccgcaagggtccggcgaggttccgcagtctcgacttcggtgagcgcaatggttacctcaagggtgtcatcaccgaaatcatccacgatccaggtcgtggtgcccctcttgcacgcgtcactttccgtcatcctttccgttacaagcaccagaaggaactcttcgtcgccgccgaggggatgtacactggtcagttcgtcttttgtggaaagaaggctaacttgatggtcggtaacgttcttcctctcagatctatcccagaaggagctgtggtctgcaacgttgagcaccacgtcggtgaccgtggttcatttgccagggcttctggtgattacgccatcgttatcagtcacaaccccgataacggcaccactagagtgaagcttccatctggagccaagaaaattgtgccaagtggatgcagagctatgattggtcaagttgcaggaggagggcgtactgaaaagccaatgttgaaagcaggaaacgcgtatcacaaattccgtgtgaaacgtaactgctggcctaaggttcgtggtgtggctatgaaccctgtggagcatcctcatggtggtggtaaccatcaacatattggtcatgcaagtacggttagacgtgatgcaccacccggtcaaaaggttgggctcattgccgccaggaggactgggcggctcagaggtcaagctgctgccaccgctgccaaggctgataagtgatgaagttagattgctattatggttttggtttttttgttatgaatcattgggtactttttattgttagttattttgagtttattacttggaattgttattgttatgttgattgtcatacattttgttttatgggaaagttttgtggtagacttgtttttgtttgttgtttggtttggttgctaatttgttcgacaacacataatagtatttgaggcgtgacaagttccaccttccgtcctatgtttctccatttgactctttttttacccaatcatgaactaccttgttagagccttgttctacgcaacaactatgtatcctccttgctctttgtataagattggactaaag

SEQ ID NO: 3330 - DNA, 1336 bp, Lactuca sativa
attattccaaataaaattactagtaatacgcataaggataaaaagaaaaggctaatgttagccccctttcttttttaaatgtatcaaactcaacaaatcatttcaacaaactataaataataaaatggccgaggttgatacaaaggcccataaatcggcccatctaaattatccatacaacagaactcggcccatattatttcatactgtcgattgccaaaccctatatcaggatcttcactcccaagaacccgccgtcgtccccaaaccctagccaccgagtgtgtgcgtgagagagagagagagaggtaagagagaatcagaaatgggacgtgtgattagggcacagcgtaagggagcagggtcggtcttcaagtcccatacccaccaccggaaggggcctgccaggttccgcagcctcgactttggcgaacgcaatggttacctcaagggtgtcatcaccgaaatcatccacgatcccggccgtggtgctcctctggctcgcgtcacattccgtcatcctttccgctacaagcaccagaaggagctgtttgtcgccgctgagggcatgtacaccggccagttcgttttctgtgggaagaaagcgaatttgatggttggaaacgtccttcctctcagatctatccctgagggagctgtcgtttgcaacgtagaacatcatgtcggtgaccgtggttcgttcgccagagcttccggtgattacgccatcgttattagtcacaatcccgataacggcaccactagggtgaagctgccatcaggagcaaagaagatcgtgccgagtggatgtcgtgctatgatcggtcaggttgccggaggagggcgtactgagaagcctatgctgaaagctggtaacgcataccataaattccgtgtgaagagaaactgctggcctaaggttagaggtgttgccatgaatccagtggagcatccccatggtggtggtaaccatcaacacattggtcatgcaagtacggttcgccgtgatgcaccacctggtcaaaaggttggtcttatcgccgccagaagaactgggcgtctcagaggtcaagctgcagctactgctgctaaggctgataaataggttttttgatatttttgtttcagaatactgttatgttggtttgttgctgcgagtttatcatggttcagttttgtttgaaatttgactcttgaaggttagtctacatattcttgatgtctgttttacattctcatgagtaacttaatcatgtcttataacaatcgacgttgcttaaaactaaaatttagcaaatattatgacatattggctctcttgctttggtaaaaatca

SEQ ID NO: 3331 - DNA, 1094 bp, Fraxinus spp
cgtaggccccgtacggccggggcgtcttcctacttcccaccgtcccctcccctctcctcaacacgcaggcaactacgaatggggtcgtgtgatccgggcacagcgtaggagcaggatcatttcaagtctcacacacaccaccggaagggcccagccccgattccgttcactcgacttcggcgaacgcaatggctacctgaaaggggtagtgactgaaatcatccatgacccaggcctggtgctcctcttgctcgtgttaccttccgccaccccttccggtacaagcaccagaaggagcttttcgtcgccgctgaaggaatctacaccggtcagttcatttactgcggcaagaaggccaaccttgttgttgggaatgtcctgccgctcagatctattcctgaaggtgccgtcgtttgcaacgtggagcaccatgttggtgatcgtggcgtttttgctagggcctctggagattacgccattgttatctcgcacaacccagataatggaacaactagagttaagctcccatcaggagccaagaaaattgtgcccagtggctgccgtgccatgattggccaggttgctggaggaggacgtactgagaaacccctattgaaagctggaaatgcttatcacaagttcagagtcaagaggaactgctggcccaaggttcgtggtgttgctatgaatccagtggagcatccccacggtggtggtaaccatcaacatattggtcatgccagtactgtacgtcgtgatgctccacctggacaaaaggttggtcttattgctgctaggaggactggacggcttcgtggtcaagctgctgctactgcttctaaagctgataaggcttaggttaatgttatgggatgcagattttaaatctattactgtctttctttttgttgagtctggatcagatgttaaattgcgacatttttgtggtaaccatataatagattttgttgggatttttggtattgtgttgttttcggctaaatgatcttttttccaactatgctgttacatggagttgttttggctacattattctccatatatgcctttgaggctgaatctttaatcttaga

SEQ ID NO: 3332 - DNA, 1034 bp, Musa acuminata
aaccctaagcccagcgccacctctttgctgccgcagccgctgccgagatgggacgcgtgatccgtgcccagaggaagggagcggggtcagtgttccgctcccacactcaccaccgcaaggggccggcccgtttccggagcctcgacttcggggagcggaatggctacctcaagggcgtggtcaccgagatcctgcacgaccctggtcgtggcgcccccctcgcccgcgtcaccttccgccaccccttccggtataagctccaaaaggaactcttcatcgccgccgaggggatgtacactggccagttcgtctactgcggccgtaaggcctccctcatggtcggcaacgtcctccccctccgctccattcccgagggtgccgtcgtctgcaacgtggagcaccacgttggcgatcgcggcgtcctcgcccgcgcctccggcgattacgccattgtcatcagccacaaccccgataacggcaccagcaggatcaagctcccatcaggagccaagaagatcgtcccaagcaactgccgtgcaatgattggccaggtcgctggtggtggccgaaccgagaaacccctactcaaggcaggcaatgcctaccacaagttcagagtgaaacggaactgctggccgaaggttcgtggtgtggctatgaaccctgtggagcatccccacggaggaggaaatcaccagcacatcggacatgcctccaccgttcgccgtgatgctcctcctggacagaaggttggtctcatcgccgcaaggaggaccggtcgtctcaggggacaggctgccgcaaccgctgccaaggcagagaagacctcttaaattgctagtgagaaataggcatctggtgttttggttttctgtaagttttatttatcatctaagagaactatggtgacttgagtaatcttatgttggacccgttatggttttggagttagatttcaattgaccatcttgatctggatttcatcttgttgaaatgccactgttgatgcccgagcatgttaatggcatttatta

SEQ ID NO: 3333 - DNA, 948 bp, Capsicum annuum
ggtcgagtaatccgagcacaacgtaaaggagccggttcagtattcaaatcccatacccatcaccgtaaaggtccggcccgattccgaaccctagatttcggcgagcgtaacggttacctaaaaggcgtcatcactgacgtcattcacgatcctggtcggggcgccccgttagcccgggtcacatttcgtcatccgtttaggtataagcatcagaaggaattgttcattgctgctgaaggaatgtacactggacaatttgtttattgtgggaaaaaggcgaatttggttgttggtaatgtgttgccattgagatcgataccggaaggtgctgtggtgtgtaatgtggagcataaagttggggatcgaggtgtttttgcgaggtgttcgggggattatgctattgttattagtcataatcctgataatgggactactagagtcaagcttccatcaggatcgaaaaagattgtgcccagtggatgtcgtgccatgattggtcaggttgctggtggaggacgtactgagaaaccaatgctcaaagctggtaacgcttaccacaagtaccgtgtgaagaggaactgctggcctaaggtccgcggtgttgctatgaatcccgtggagcatcctcatggaggtggtaaccatcaacatattggtcatgctagcacagtacgtcgtgatgcacctcctggacaaaaggttggtcttattgctgcaagaagaactggtcggcttcgcggtcaagctgctgctactgctgccaaggctgacaagtgatgacgcttacgccatttgcttgttactcttttttatctttctgttgtttcctcatcgattttcgagtattcgaagctaaaaccattttgtagtgaagttgtagcatgctaaattttgttgggatgtttggtaatttttgttttgataaatccttgtttggtgcatttttac

SEQ ID NO: 3334 - DNA, 1129 bp, Amorphophallus konjac
ccgttccaagaaccctagccgccccggcatcccccccccgccctccccgccgccatgggacgcgtcatccgagctcagaggaagggtgctgggtcggtcttccgatcccacacccaccaccggaagggccccgcccgcttccggtcgctcgacttcggcgagcggaatggctacctcaagggcgtcgtcaccgagatcctccacgaccccggccgcggcgcgccgctggcccgcgtcaccttccgccaccccttccgctacaagcaccagaaggagctcttcgtcgccgccgagggcatgtacaccgggcagttcgtgttctgcggcaagaaggccaacctcatggtgggcaacgtcctccccctccgttccatcccggagggtgcggtcgtctgcaacgtcgagcaccacgtgggtgaccgcggctctttcgcccgggcctccggggactacgccatcgtcatcagtcacaaccctgataacggaacctccaggattaagctcccatctggagccaagaaggttgtcccaagtggatgccgtgccatgatcggccaggtggccggcggtggcagaaccgagaagcccatgctcaaggccggaaatgcattccacaagtacagggtgaagaggaactgctggcccaaggtccgcggtgttgctatgaacccagtggagcatcctcacggtggtggtaaccaccagcacattgggcatgccagcacagtccgccgtgatgctccccccgggcagaaggtcggtctcatcgctgccaggaggaccggtcgtcttcgtggccaggctgccgccacagctgccaaagcggagaagagtgcttaatccgagttccacctcctgttgttcacaagtttctttcattagtttttgttgcgtacatctgaacattcagggccgtgatgagatactagttttgtggtcttttagctaatgttttctatccggttggtttttgggtatgcaatattatagacttctggtttaagattagttctattttaaaaccttttttaatgtattcttgaatgtgtgcgaattgcaacggatgcgaatcatcttttcgtggtgattaattttctcagatgacttataaattcactgtcgattccag

SEQ ID NO: 3335 - DNA, 1011 bp, Arnica chamissonis
ctgcgtgtctgtgtgagagagagaatcggcaatgggacgtgttatcagagcacaacgtaagggagcaggttctatcttcaagtcccatactcatcaccgtaagggtccggccagattccggagcctcgatttcggcgaacgcaatggttacctcaaaggtgtcatcacagaaatcatccacgatcccggccgtggtgctcctcttgctcgcgtcactttccgtcatccgtttcgttacaagcaccagaaggagctgttcgtcgccgccgaggggatgtacaccggtcagtttgttttctgtggtaagaaggctaatttgatggtcggaaacgtccttcctctcagatctatccctgagggagctgtcgtttgcaacgtcgaacaccatgtcggtgaccgtggttcgtttgctagggcttctggtgattacgccattgtcataagccacaatcctgataacggcaccagcagggtgaagcttccatctggagcgaagaaaattgtgccaagcggttgtcgggccatgattggtcaggttgctggaggtggtagaaccgagaagccaatgcttaaagctggtaatgcttatcacaagttccgtgtgaagagaaactgctggcccaaggttcgtggtgttgccatgaatccagttgagcatccccatggtggtggtaaccatcaacacattggtcatgccagtacggttcgtcgtgatgcaccacctggtcaaaaggttggtcttattgccgctagaaggactgggcggctccgaggtcaagctgctgctagtgctgccaaggctgataaatagagcacttgaatggattttggtaacctttttaaaattctactcgtctgtttgtttcatttgaagtttcaacttttcagggttaatctacaagtcttgatactcttaccaaaaactattttaatcttttgctgttttctttgatcttcatgtctttagttattgcaatttgtggctgcgtttgatttatttataatgggtgt

SEQ ID NO: 3336 - DNA, 957 bp, Arnica chamissonis
ccggagaaatgggtcgtgtcatcagggcacaacgtaagggagcaggatccatatttaagtctcatacccaccaccgcaagggtccggccaggttccggagcctcgattttggtgaacgtaatggttacctgaagggtgtcattacggaaatcattcatgatcctggccgtggtgctcctcttgcccgcgtcactttccgtcatcctttccgttacaagcaccagaaggaacttttcgtcgccgccgagggcatgtacacaggtcaattcgtcttttgtggaaagaaggctaatttgatggttggaaacgtgcttcctctcagatctatccccgaaggagcggtcgtttgcaatgttgagcatcatgtcggtgatcgtggttcatttgctagggcctctggtgattacgccattgttatcagtcacaatcctgataacggcaccagcagagtgaagcttccctctggagccaagaaaattgtgccaagtggatgtcgtgctatgattggtcaggttgctggtggaggacgtaccgagaagccaatgctgaaagctggtaatgcttatcacaagttccgtgtgaagagaaactgctggcctaaggttcgtggtgttgctatgaatccagtggagcatccccatggtggtggtaaccatcaacatattggtcatgctagtactgttcgtcgtgacgcaccacctggtcaaaaggttggtcttattgctgctaggaggactggtcgtctcaggggtcaagccgctgcatctgctgccaaggctgataagtaataagctgctgttatggatgttggttttagttttgttatatctggatcggttacttctgtttttagtttgttccagtttttctgctactactatgtttgatcgatttatacatttaatcatgttggaaagttttgcagcatgtcactgagtatttatacatttattcaag

SEQ ID NO: 3337 - DNA, 1032 bp, Phaseolus coccineus
gatctatccttcttccatccacgcggcgcgcacaaacacacaggtatatccgaatgggaagggtaattcgcgcacagcgtaagggtgcgggctccgttttcaagtcccacacccaccaccgcaagggaccggcgaggttccgcagcctcgatttcggcgaacgcaatggctacctgaagggagtggtcaccgacattatccacgaccccggtcgcggtgcccctctcgccaaggtcactttccgccatcccttccgctacaagaagcagacggaacttttcgtttctgccgaaggtctatatactgggcagttcctctactgcggcaagaaggccactctcgtggttggcaacgtcttgcccctccgatccatccccgagggtgctgtcatctgcaacgtcgaacaccacgttggtgatcgcggtgtcttcgccagagcatccggtgactacgccattgttatcagccacaaccccgataatgacacctctaggatcaagcttccttctggttcaaagaagattgtgccgagtgcatgtagggcaatgattgggcaagttgcaggtggagggagaactgagaagcctcttcttaaggctggtaatgcttaccacaagtttagagtgaagagaaactgctggcctaaggtgcgtggtgtggctatgaacccagttgagcatcctcatggaggaggtaaccaccagcacattgggcatgctagtactgtcaggcgtgatgctcctcctggccagaaggttggtctcattgctgccaggaggactggtcgtcttagggggcaagctgctgccactgcttctaaagctgactagactacttaaggatattgttagagacatgcttaattacagattttcaaattttgtttctttgatattttatttttcaactgtttggcttcttttttgagcaccatgtccaccataaatacgaagcgtgtaatgtgtggtgttttatatttggttaaagatccgtttaatcctgctttttgtcaatcatttggtgatttcatct

SEQ ID NO: 3338 - DNA, 1623 bp, Theobroma cacao
atccttcacgctcatttctctactttcttccatcggccgcctgcaggaggtaggtctcctcatagcctcacacagtctcagcgcaaatgggtcgtgtcataagagctcagcgtaaaggtgcgggttccgtcttcaaggcgcacacccaccaccgcaagggtcctgcccggttccgcagcctcgacttcggtgagcgaaatggctacctcaagggtgtcgtcaccgaagtcatccacgacccgggccgtggcgcacccttagcccgcgtcgtcttccgtcaccctttccgttacaagaagcagaaggaactgttcgtcgctgccgagggcatgtacacgggacagttcgtgtactgtggtaagaaggctactctcatggtcggtaatgtgttgcctcttagatctatccccgaaggagctgtcgtttgcaacgtcgagcatcatgttggtgatcgtggggtttttgctaggtgttctggtgattatgccattgtaattagtcacaaccctgataacgacaccaccaggatcaagcttccatctggttccaagaagattgttccaagtggctgtcgtgctatgattggccaggttgcaggaggtggtaggactgagaaacctcttctcaaggctggtaatgcttaccacaagtttaaggtgaaaaggaactgctggcctaaggtgcgtggtgtggcaatgaacccagttgagcatccccatggtggtggtaaccatcaacacattggtcatgctagtactgttaggcgtgatgctccacctgggcagaaggttggtcttattgctgcaaggaggactggtaggctcagaggacaagctgctgctactgccgccaaggctgataaggcttaggcttaggatattacttgtttttagttctttgctcttcatatttacattcaagagtattcagcacatttatgctagaaattttgtttgaattatcagataatggtactgtttggagttgtttgagcgatggttatgttttcaatttggatttttactcaagtgtttgatgtcaatgattatgatccatgttctctctcaagctttcatatgatgctttgcatgctgtttatcaaatatatggaggatgtcaacttagttggctgaacggggcaagttctaagactgatcatagttgaggtaaggcagagatggctgtcaattacattttcgggattagatggagccaactttctgaactttttgggttggagtgagcgtttcatttatccggagactggcctttggacctttttgggttggagtgagagtttgattcatccggaaactggcctttagaccctatatcttggttcagccacgggaaggtatcaatttgttgttcttaactcaggattaatggttgaaaactgatcttgacttgaaattccatttgacaactttcatattttaaagaggaaatgaacaatattcattactaagtgctaaaaatatacagctgaatccttgatcgggggccagtgccacagaactagtagttcaagaatttgggcttaggccagaaaacaaggctatggttctattgggctaagcagtaagaattggatcaaggaaaaagtaaagaattcgaccgtca

SEQ ID NO: 3339 - DNA, 1076 bp, Castanea mollissima
ttcttagccgtcaaactcacacaaacacacacagtttttccccttcccccctcccccaaaatcaatgggtcgtgtaatcagagctcaacgtaagggtgctgggtccgtcttcaagtcccacacccaccaccgcaagggccccgccaggttccgcagcctcgacttcggcgagcgcaacggctacctcaagggcgtcgtcaccgagatcatccacgacccgggtcgcggtgccccgcttgcccgaatcaccttccgccaccccttccgctacaagaagcagaacgagctcttcgtcgccgccgagggcatgtacaccggccagttcgtctactgcgggaagaaggccacccttgtcgttgggaacgtgttgcccctgagatccattcccgaaggagctgtggtttgtaacgtcgaacaccatgttggagatcgtggggttttcgctaggtgttctggggactatgccattgttattagtcacaatcctgataacgacacttccagggtcaaactcccatctggtgctaagaagattgttccaagtggctgccgagcaatgattgggcaggttgccggtggtgggagaactgagaagccccttctcaaggctggtaatgcttaccacaaattcagagtgaagagaaactgctggcccaaggtgcgtggtgtggctatgaacccagttgagcatcctcatggaggaggtaaccatcaacatattggacatgctagcactgtcaggcgtgatgcacctcctggtcaaaaggttggtctcattgctgcaaggaggactggtcggcttagaggacaagccgctgcaactgcttctaaagctgacaaggcttaaaaagagtgttatatttttttttctgctgcttctcttgattatcatctaaagactagtcggtgaactttattgcagaaattttgttttggatcgtctttatttttcttttttcttttgaaattataagaattggtttgtgcacgttttgaaattagtccaattaaactgttcctattttctttgttctttgttaagttttcttttcttttttacctttattttattttac

SEQ ID NO: 3340 - DNA, 1128 bp, Castanea mollissima
attttgtctgagtcggccgtcaccagcagagctagagcccgaggacagagaaaaagtagcatgggtcgtgtaatcagagctcagcgtaagggtgctgggtctgtgttcaagtcccatacccaccatcgcaagggaccagcaaggttccgcagcctcgactttggtgagcgcaatgggtatctgaagggtgtggtcactgagatcattcatgacccgggtcgcggtgcaccgctcgcccggatcactttccgccaccccttccgatacaagaagcagaacgagctcttcgtggccgccgagggtatgtacactggtcagttcgtgtattgtgggaaaaaggctactcttgttgttggcaatgtgttgcctctcagatctatccctgaaggagctgtggtttgcaacgttgagcatcacgttggtgaccgtggtgtcttcgctaggtgttctggtgattacgctattgtcattagtcacaaccctgataacgacactagcagggtcaaactcccatctggtgctaagaagattgttccaagtggctgccgagctatgattgggcaagttgccggtggagggagaactgagaagccccttctcaaggctggtaatgcttatcacaagttcagagtgaagaggaattgctggcctaaggtacgtggtgtggcaatgaacccagtggagcatcctcatggaggaggtaaccaccagcatattggacatgcaagcactgttaggcgtgatgcacctcctggtcaaaaggttgggctcattgctgcaaggaggactggtcgactcagaggacaagcggctgctactgcttctaaagccgataaggcataagggtgcttagagattattattctttttctttttttctgttaattgtgtcttttagaaatctggattttcccatagtagattaaaatctagactagctggtgagctttgttgcagaaattttgtttgggttgtgataaacaccttatctattacatttggttggtgcactctgaaattagtccaaatagactttgtatttccgctgaatggatgaagagaactcttcactgatactatttgagtgtggattgtgctttatgccaattcttttctttggaaaaaaaa

SEQ ID NO: 3341 - DNA, 967 bp, Castanea mollissima
agtaaccatgggtcgtgtaatccgagctcaacgtaagggtgctgggtctgtgttcaagtcccacacccaccaccgcaagggaccagcgaggttccgcagtctcgactttggcgagcgcaatgggtacctgaagggcgtggtcactgagatcattcacgacccgggtcgcggtgcaccgctcgcccggatcactttccgccaccctttccgttacaagaagcagaacgagctcttcgtggctgccgagggcatgtacactggtcagttcgtgtattgtgggaaaaaggctactcttgttgttggcaatgtgttgcctctcagatctattcctgaaggagctgtggtttgcaacgttgagcaccacgttggtgaccgtggtgtcttcgctaggtgttctggtgattacgctattgtcattagccacaaccccgataacgacactagcagggtcaaactcccatctggtgctaagaagattgttccaagtggctgccgagctatgattgggcaggttgctggtggagggagaactgagaagcctcttctcaaggctggtaatgcttaccacaagttcagagtgaagagaaattgctggcccaaggtacgtggtgtggctatgaacccagttgagcatcctcatggaggaggtaaccaccagcatattgggcatgcaagtactgttaggcgcgatgcacctcctggtcaaaaggttggtctcattgctgcaaggaggactggtcggctcagaggacaagcagctgcaactgcttctaaagctgacaaggcttgaaaattttaggctgataagagtgcttaaaagagtgttatactttagatctgccgcatatcttgattgttatctaagactagttggtgaaccttattgtcaaaattttggttggattgtcgttatgttttatttttattacaattggtttatgcactttttgaaattattccaatttag

SEQ ID NO: 3342 - DNA, 982 bp, Cirsium arvense
gagatgggtagagtcatcagggcacagcgtaagggagcaggttccgtcttcaagtcacacactcaccaccgcaagggtccggcgaggttcaggagtctcgatttcggtgagcgaaatggttacctgaaaggtgttatcaccgaaatcatccacgatccaggacgtggtgctcctcttgctcgtgttaccttccgtcatccgttccgttacaagcatcagaaggagcttttcgtcgccgccgagggtatgtataccggccagttcgttttctgtggaaagaaggcgaatttgatggtcggtaatgttcttccactcagatctattcccgaaggagcggttgtgtgcaacgttgagcatcatgtcggtgatcgtggttcttttgctagggcttcaggcgattatgctattgttatcagtcacaaccccgataatggcaccactagagtcaagcttccatccggagccaagaagattgtgcctagcggctgtcgtgctatgattggtcaggttgctggtggtgggcgtacggagaaaccgatgctcaaagctggtaacgcttaccacaaattccgtgttaagagaaacagctggcccaaggttcgtggtgttgctatgaatcccgttgaacatcctcatggtggtggtaaccaccaacatattggtcatgccagtaccgtccgccgtgatgcaccacccggtcaaaaggttggtctcattgccgctaggagaactggtcgtctcagaggacaagctgctgccactgctgctaaggcagataagtaataaaacagttttctatggatgtttttgcttttggtttcattgctagtttttgtcagtttatttgctactactactactactactattttgttgaacatcatcatacattttatcaaccatttggaaagttttgcagtaatttactgattattgatggtgttttatttagatgttaattaatgtaattttttctagggaa

SEQ ID NO: 3343 - DNA, 959 bp, Cirsium arvense
acaacgagagagagagagcgagttagagagagagagggaagcagaaatgggtcgtgtgattagggcacagcgtaagggagcaggttccgttttcaaatcccacactcaccaccgcaaaggtccggcgaggttcagaagcctcgatttcggcgagcgcaatggctacctcaaaggtgttatcaccgaaatcatccatgatcccggccgtggtgctcctcttgctcgcgtcactttccgacatcctttccgttacaagcatcagaaggagcttttcgtcgccgccgaggggatgtacaccggtcagtttgtgttttgtggtaagaaggctaatttgatggtaggaaacgtgcttcctcttagatctattcctgaaggagctgttgtctgcaatgttgaacatcatgtcggtgaccgtggctcgtttgctagggcttctggtgattacgccattgttatcagtcataatcctgataacggcaccactagggtcaagctcccatctggtgccaagaaaatcgtgccaagcgggtgtcgtgctatgattggtcaagttgccggtggtggacgtaccgaaaagccgatgctgaaggctggtaacgcctaccacaagttcagagtcaagagaaacagctggcccaaggttcgtggtgtggctatgaacccagttgaacatccccatggtggtggtaaccatcaacacatcggtcacgcaagtacggttcgtcgtgacgcaccacccggtcaaaaggttggtcttattgccgctagaagaaccggtcgtctcagaggtcaagccgctgctactgccgctaaggccgacaagtaaaataacgtttatttggagtatgatggtaagtttttcttttttgttggatattttggtatcgagaattacttgtttttgttgtttttttggtatcgacatattattctttagttctagttttggtattttaagt

SEQ ID NO: 3344 - DNA, 1283 bp, Cucumis sativus
tcccttccccttccccttccccttccccacttccccaaaaccctaatttccattctcaatgggtcgtgtgatcagagctcaacgtaagggtgcgggatctgtcttccgctctcacactcaccaccggaagggcccggcccgtttccggtcactcgacttcggcgagcgtaatgggtacctgaaaggtgtggtcagtgaaatcattcacgatccgggcagaggtgcgccgttggctcgtgttaccttccgccatcccttccgctacaaacaccagaaggaacttttcatcgccgctgagggtatgtacactggtcagttcgtttactgtgggaaaaaggctaatcttgttgttggtaatgtgctccccgttagagccattcctgaaggagctgtggtttgtaatgtggagcaccatgttggcgacagaggtgtgtttgctagatgctctggtgattatgctattgttatcagccacaacccagataatgataccagcaggattaagctaccatctggagccaagaagattgtacccagtggatgccgtgctatgattggtcaggttgctggaggaggaagaacagagaagcctcttcttaaggcaggtaatgcttaccacaagttccgagtcaagcgtaactgctggccgaaggtgcgtggtgttgctatgaatccagttgaacatccccatggtggtggtaaccatcaacatattggtcacgccagtactgtccgccgtgatgctcctcctggtcaaaaggttggtctcattgctgccagaagaactggtcggctccgaggacaggctgctgctactgctgccaaggctgacaaggcttagagtaattcaatcggttcaagacttgttttccctaatccttagtccctttacattatgtttgattggatatgcattttgttgaagaccctatttagaagtttttgtttctgagttttgttacaaaaatccttttttgaacataatattcctctcccccttgtttcttgttgctgtgatgaatgtggtgaatttgatagcatgaacaccaacgtaatttctctaaaacaaaaaagatctatgttcttaggttttcgatgacaggtactcggagaacaatttgtagccaactactaaaattaatttataaggatattctaatttcttaaatagttaaatttttacaagaaaatatctaatctgtatcctggtttttttatagtctggttatgagacgattcatgtaacctagagaatggttggttcattcaactgaagtttgtga

SEQ ID NO: 3345 - DNA, 1047 bp, Cucurbita pepo
ttacagcgccacttcctccccttccccaaatccccaatccctaattcagatcctccaatgggtcgtgtcatcagagctcaacgtaagggtgccggatcagttttccggtctcacacccaccaccgcaagggtcctgcccgtttccgctctcttgatttcggggagcgaaatggttacctgaaaggtgtggtcagtgagattatccacgatcctggtaggggtgcgccgttggcccgcgtcaccttccgccaccctttccgctacaagcaccagaaggagctctttgtcgccgctgagggtatgtacactggtcagttcgtttactgtggaaagaaggctaacctcgtcgtcggtaatgtgcttcccatcagagccattcctgaaggtgctgtggtttgtaatgttgagcaccatgttggtgaccgaggtgtgttcgctagatgctctggtgattatgccattgttatcagtcacaacccagataatgataccagcaggattaagctaccatctggagccaagaagattgtcccgagtgggtgccgtgctatgatcggtcaggttgctggaggaggaagaacagagaagcctcttctgaaggcaggtaatgcttaccacaagttccgtgtgaagcgtaactgctggcccaaggttcgtggtgttgctatgaatccagttgaacatccccatggtggtggtaaccatcaacacattggtcatgccagtaccgtccgccgtgatgccccacctggtcaaaaggttggtctcattgctgccagaagaactggtcggctccgtggacaggctgccgccactgcttccaaggctgataaagcttagagcaatagtttcatgtgttggacgcttattttgcctaatccttagccttttttcattatgtttgattggatttgcattgtgttgaagaagaccatatttagaagtttttgtcccaagttttgttacaacatagatcctttttttaacataatcctctctcctatttctggttgctacaatgaacttgagaacttgaataccaattta

SEQ ID NO: 3346 - DNA, 1009 bp, Cynara scolymus
  misc_feature (17)..(18): n is a, c, g, or t
  misc_feature (474)..(474): n is a, c, g, or t
  misc_feature (949)..(949): n is a, c, g, or t
gagagagagagagaggnnagagagagagagatgggacgtgtgattagggcgcagcgtaagggagcaggctccgttttcaaatcccacactcaccaccgcaaaggtccggcgaggttcaggagtctcgatttcggcgaacggaatggttacctcaaaggtgttatcaccgaaatcatccacgatcccggccgtggtgctcctcttgctcgcgttactttccgacatcctttccggtacaagcatcagaaggaactctttgtcgccgccgaggggatgtataccggtcagtttgtgttttgtggtaagaaggctaatttgatggtcggaaacgtgcttcctcttagatctattcctgaaggagctgttgtgtgcaatgttgaacatcatgtcggtgaccgtggttcgtttgctagggcttctggtgattacgcgattgttatcagtcataatcctgataacggcaccaccagggtnaagcttccatctggtgccaagaaaatcgtgccaagcgggtgtcgggctatgattgggcaggttgctggtggtggacgtaccgagaagcctatgctgaaggctggtaacgcgtatcacaagttccgagtcaagaggaactgctggcccaaggttcgtggtgtggctatgaaccctgttgagcatccccatggtggtggtaaccatcaacatattggtcacgcaagtaccgttcgtcgtgatgcaccacccggtcaaaaggttggtcttattgccgctaggaggactggtcggctcagaggtcaagcggctgcaactgcctccaaggccgacaagtaaaacaccatttcgttggattatgatagtatggtctttttttttggatattttcgtttcaagaatcactgtttctgtgtgttgggtatcgagaaattatcgtagttcagttttggcttagtgttacatttgaggataattnacagattgtgatccatactgatactatgctattgttgtttttatagcactgaaatacttg

SEQ ID NO: 3347 - DNA, 957 bp, Flaveria ramosissima
ccgtcgtcttcaaaccctaaccggagcaatgggtcgagtcatcagagcccagcgtaagggtgcaggctccgtcttcaggtcccacacgcaccaccgcaagggtccggcgaggttccgcagcctcgacttcggtgagcgcaacggctacctcaaaggcgtcatcaccgagatcattcacgaccccggccgcggtgcgccgcttgctcgcgtcactttccgccacccgttccgatacaagcaccagaaggagcttttcgttgctgctgaggggatgtacactggtcaatttgtgttttgtgggaagaaggcgaatttgatggtgggtaatgtgctgccgcttagatctattcctgaaggagctgtggtgtgcaacgtcgagcatcatgttggtgatcgggggtcctttgctagggcttctggggattatgcgattgttattagtcataatcctgataatggtaccactagagtgaagcttccatctggagccaagaaaattgtgccaagtggatgccgtgcaatgattggtcaggttgctggtggaggacgtaccgagaagccaatgttgaaagctggtaatgcttatcacaagttccgtgtgaagagaaactgctggcctaaggttcgtggtgttgctatgaacccagtggagcatccccatggtggtggtaaccatcaacacattggtcatgctagtaccgttcgtcgtgatgcaccacctggtcaaaaggttggtcttattgccgctaggaggactggtcgtctcaggggtcaagctgccgccactgctgccaaggctgataagtaataaagtgctgtcatggatcttgattttagttttggtatctttggatctgttgcttctattgttagtttctttcagtttacctgctattgttgtgtttgttttcatacattcaatcatgttggaaagttttgcagtaagttactgattaa

SEQ ID NO: 3348 - DNA, 920 bp, Flaveria ramosissima
ccggagcaatgggtcgcgtcatcagagcccaacgtaagggtgcaggctccgtcttccgatcccacacgcaccaccgcaagggtccggcgaggttccggagcctcgacttcggtgagcgcaacggctacctcaaaggcgtcatcaccgacatcattcacgaccccggccgtggtgcgccgcttgctcgcgtcactttccggcacccgttccgctacaagcaccagaaggagcttttcattgctgctgaggggatgtatactggccagtttgtgttttgtgggaagaaggcgaatttgatggtgggaaatgtgctgccgcttagatctattcctgaaggagctgttgtgtgcaacgtggagcatcatgttggtgatcgggggtcgtttgctagggcttctggggattatgcgattgttattagtcataatcctgataatggtaccactagagtgaagcttccatccggagccaagaaaattgtgccaagtggatgccgtgctatgattggtcaggttgctggtggaggacgtaccgagaagccaatgctgaaagctggtaatgcttatcacaagttccgtgtgaagagaaactgctggcctaaggttcgtggtgttgctatgaaccctgtggagcatccccacggtggtggtaaccatcaacacattggtcatgctagtactgttcgtcgtgatgcaccacctggtcaaaaggttggtcttattgccgctaggaggactggtcgtctcaggggtcaagctgctgctactgctgccaaggctgataagtaataaacttctgttatggatcttgattttagttttggtatctttggaactgttacttttcttgttagtttgtttcagtttacctgctattgttgtgtttgttttcatacattcaatcatgttggaaagttttgc

SEQ ID NO: 3349 - DNA, 831 bp, Flaveria ramosissima
ccaccatcaacaacagcaaactcatctccaaaccctaaccctagccatgggtcgcgtcatcagagcccaacgtaagggagccggctccgtcttcaagtcccacacgcaccaccgcaagggtccggcgaggttccggagcctcgacttcggcgagcgcaacggctacctcaaaggcgtcatcaccgagatcatccacgaccccggccgcggtgctccgcttgctcgcgtcactttccgccacccgttccgatacaagcaccagaaggagctcttcattgctgctgaagggatgtacactggtcagtttgtgttttgtgggaagaaggcgaatttgatggtggggaatgtgctgccgcttagatctattcctgaaggagctgtggtgtgtaatgttgagcatcatgttggggatcgtgggtcgtttgcgagggcttctggggattatgcgattgttattagtcataatccggataatgggactactagagtgaagcttccatctggagcaaagaaaattgtgccaagtggatgtcgtgctatgattggtcaggttgcaggtggaggacgtacggagaagccaatgctgaaagctggtaatgcttatcacaagttccgtgtgaagagaaactgctggcccaaggttcgtggtgttgctatgaacccagtggagcatcctcatggtggtggtaaccatcaacatattggtcatgcaagtactgttcgccgtgatgcaccacccggtcaaaaggttggtctcattgcagctagaaggactggtcgtctcagaggtcaagctgccgccactgcagccaaagctgataagtaatgaac

SEQ ID NO: 3350 - DNA, 832 bp, Flaveria ramosissima
ttcacagagagtaaaccaacaaatcaacaatgggacgtgtaatcagagcacaacgtaagggtgcaggctccgtcttcaagtcccacactcaccaccgcaaaggtccggcgagattccggagcctcgatttcggcgaacgcaacggttacctgaaaggtgtcatcaccgagatcattcacgatcccggccgtggtgctccgcttgctcgcgtcactttccgtcatccgttccgttacaagcaccagaaggagctgtttattgccgccgaggggatgtacaccggtcagtttgtgttttgtggtaagaaggcgaatttgatggtcggaaatgtgcttccgcttagatctattcctgaaggagctgttgtgtgtaatgttgagcatcatgttggtgaccgtggctcgtttgctagggcttcgggtgattatgctattgttattagtcataatccggataacggcaccactagggtcaagcttccatctggagccaagaaaattgtgcccagtggatgtcgtgccatgatcggtcaggttgcaggaggtgggcgaacagagaagccaatgcttaaagctggtaatgcttatcacaagttccgtgtgaagagaaactgctggcccaaggttcgtggtgttgccatgaatccagttgagcatccccatggtggtggtaaccatcaacacattggtcatgcgagtaccgttcgccgtgatgcaccacctggtcaaaaggttggtcttattgccgctaggaggactgggcggctcagaggtcaagctgctgctactgctgccaaggctgataaatagagcacttgagtggattttggtat

SEQ ID NO: 3351 - DNA, 901 bp, Flaveria ramosissima
ttcacagagagtaaaccaacaaatcaacaatgggacgtgtaatcagagcacaacgtaagggtgcaggctccgtcttcaagtcccacactcaccaccgcaaaggtccggcgagattccggagcctcgatttcggcgaacgcaacggctacctgaaaggcgtcatcaccgagatcattcacgaccccggccgcggtgctccgcttgctcgcgtcactttccgtcatccgttccgttacaagcaccagaaggagctgtttattgccgcagaagggatgtacaccggtcagtttgtgttttgtggtaagaaggcgaatttgatggtcggaaatgtgcttccgcttagatctattcctgaaggagctgttgtgtgtaatgttgagcatcatgttggtgaccgtggctcgtttgctagggcttccggtgattatgctattgttattagtcataatccggataacggcaccactagggttaagcttccatctggagccaagaaaattgtgcccagcggttgccgtgccatgattggtcaggttgcaggaggtggtcgaacagagaagccaatgcttaaagctggtaatgcttatcacaagttccgtgtgaagagaaactgctggcctaaggttcgtggtgttgccatgaatccagttgagcatccccatggtggtggtaaccatcaacacattggtcatgccagtaccgttcgccgtgatgcaccacctggtcaaaaggttggtcttattgccgctaggaggactgggcggctcagaggtcaagctgctgctactgctgctaaggctgataaatagagcacttgagtggattttggtatctgttttaagtttactggtatgtttgtttatttgaggttggacttttgtagggttaagtcttgatctat

SEQ ID NO: 3352 - DNA, 889 bp, Flaveria ramosissima
ccggagcaatgggtcgagtcatcagagcccagcgtaagggtgcaggctccgtcttcaggtcccacacgcaccaccgcaagggtccggcgaggttccgcagcctcgacttcggtgagcgcaacggctaccttaaaggcgtcatcaccgagatcattcacgaccccggccgcggtgcgccccttgctcgcgtcactttccggcacccctttcgctacaagcaccagaaggagcttttcgttgctgctgaggggatgtacactggtcaatttgtgttttgtgggaagaaggcgaatttgatggtgggcaatgtgctgccgcttagatctattcctgaaggagctgtggtgtgcaacgtcgagcatcatgttggtgatcgggggtcctttgctagggcttctggggattatgcgattgttattagtcataatcctgataatggtaccactagagtgaagcttccatctggagccaagaaaattgtgccaagcggatgccgtgcaatgattggtcaggttgctggtggaggacgtaccgagaagccaatgctgaaagctggtaatgcttatcacaagttccgtgtgaagagaaactgctggcctaaggttcgtggtgttgctatgaaccccgtggagcatccccatggtggtggtaaccatcaacacattggtcatgctagtaccgttcgtcgtgatgcaccacctggtcaaaaggttggtcttattgctgctaggaggactggtcgtctcaggggtcaagctgccgccactgctgccaaggctgataagtaataaagtgctgtcatggatcttgattttagttttggtatctttggatctgttgcttctattgttagtttctttcagtttacctgctattgttgtgtttgttt

SEQ ID NO: 3353 - DNA, 992 bp, Zingiber officinale
  misc_feature (10)..(11): n is a, c, g, or t
  misc_feature (13)..(13): n is a, c, g, or t
  misc_feature (16)..(16): n is a, c, g, or t
  misc_feature (18)..(18): n is a, c, g, or t
  misc_feature (21)..(22): n is a, c, g, or t
  misc_feature (102)..(102): n is a, c, g, or t
  misc_feature (135)..(135): n is a, c, g, or t
  misc_feature (138)..(138): n is a, c, g, or t
  misc_feature (144)..(144): n is a, c, g, or t
  misc_feature (165)..(165): n is a, c, g, or t
  misc_feature (204)..(204): n is a, c, g, or t
  misc_feature (277)..(277): n is a, c, g, or t
  misc_feature (279)..(279): n is a, c, g, or t
  misc_feature (294)..(294): n is a, c, g, or t
  misc_feature (306)..(306): n is a, c, g, or t
  misc_feature (948)..(948): n is a, c, g, or t
  misc_feature (970)..(976): n is a, c, g, or t
ctcgtgccgnntncgncncgnngccgcttctacgctgctgcgatgggtcgcgtcatcagagcccagaggaagggagcaggttcggttttcaagtcccacacncaccaccggaaggggccggccaggttccggagnctngactanggggagcgcaatggatacctnaagggcgtggtgaccgacatcatccacgaccctggccgnggcgcccccctcgcccgcgttaccttccgacacccattccgcttcaagctccagaaggagctcttcatcgccncngagggcatgtacacnggccagttcgtntactgcggccgcaaagccaatctcatggtcggtaacgttctccccctccgctccattcctgagggcgccgtcgtctgcaacgtcgagcaccatgttggcgaccgcggtgtcctggcccgcgcttccggtgactacgctatcgtgatcagtcacaacccagacaatggaacaagcaggatcaagcttccatctggtgccaagaagattgtaccgagcaattgccgtgccatgattgggcaggtggctggtggtggtagaactgagaagccccttctgaaggctggcaatgcctatcacaagttcagagtgaagaggaactgctggcctaaggtccgtggtgtggccatgaacccagtggagcatccccacggaggaggtaaccaccagcacattggtcatgcctccactgttcgccgcgacgctccacccggccagaaggtgggtcttattgctgcaaggagaacaggtcgtctcaggggacaggctgccgcaactgcatccaaggcagacaaggtctagattgcatgtgctgaggactcaggtgtttggtattttctggttgtcattcctgtgttatgcaggttttacttaatcttatgttggatccgtttaggtattgtgacaaatttgatttataatcanctactttggttttgcggttcannnnnnngccattaaaaaaaagg

SEQ ID NO: 3354 - DNA, 1164 bp, Mimulus guttatus
cccaatcctccaaaaccctatttatattcctccgtcgttcattttcactctccaccgccgaacaaaaccctatttataatcctccgccgttcattttcactccccaccgccgaaaaacacactcacacacacagagaggagagagaaaaaatgggtcgtgtgatccgagcacagcgtaagggagcaggatccgtattcaagtcccacacccaccaccgcaagggcccggcccgattcagatccctcgacttcggcgagcgcaacggctacctgaagggcgtgatcaccgagattatccacgaccccggccgcggcgcgccgctcgcacgcattaccttccgccatccgttccggttccagcaccagaaggagcttttcgtcgcctccgagggcatgtacaccggccaattcatctattgcggaaagaaggccaacctcgtcgtcggaaacgtgttaccgctcagatcaattccggagggtgccgttgtttgtaacgtcgagcatcacgtcggtgatcgcggtgttctagctagggcttctggagattacgccattgttatctcccacaaccctgataatggaacctcaaggattaagcttccatcgggtgccaagaagattgtacccagtggatgccgggcaatgattggccaggtcgccggaggtggaagaaccgagaagcctatgctgaaggccggaaatgcttaccataagtacagagtgaagaggaactcatggccggtggttcgtggtgtggctatgaacccagttgagcatccccatggtggtggtaaccaccaacatatcggtcacgctagtacggtacgccgtgatgcgccacctggacagaaggtcggtcttattgccgccagaagaaccggtcgccttcgtggtcaagctgctgccacagcttctaaagctgataaggcttagattttttttacttattagtatttaatttatggatggagattttttctaaagttttgtttcgattttttattcgacttagatttgcattggtgaggtacttctcgtttgctgatgatatgtatacttggtttttttgttgggttatggagattattttttactcttgaatctggctttgaatcaagacagtatctttcagcgttatatatatttagctgtttcttttggttg

SEQ ID NO: 3355 - DNA, 1026 bp, Quercus alba
ctcacacaaacacacacagtttctcaccttccccttccccttcccccctcccccaaaatcaatgggtcgtgtaatcagagctcaacgtaagggtgctgggtccgtcttcaagtcccacacccaccaccgcaagggccccgccaggttccgcagcctcgacttcggcgagcgcaacggctacctcaagggcgtcgtcaccgagatcatccacgacccgggtcgcggtgccccgcttgcccgaatcaccttccgccaccctttccggtacaagaagcagaacgagctcttcgtcgccgccgagggcatgtacaccggccagttcgtctactgcgggaagaaggccacccttgtcgttgggaacgtgttgcccttgagatccattcccgaaggagctgtggtgtgtaacgtcgaacaccatgttggagatcgtggggttttcgctaggtgttctggggactatgctattgttattagtcacaatcctgataacgacacttccagggtcaaactcccatctggtgctaagaagattgttccaagtggctgccgagcaatgattgggcaggttgccggtggagggagaactgagaagccccttctcaaggctggtaatgcttaccacaaattcagagtgaagagaaattgctggcccaaggtacgtggtgtggctatgaatccagttgagcatcctcatggaggaggtaaccatcaacatattggacatgctagcactgtcaggcgtgatgcacctcctggtcaaaaggttggtctcattgctgccaggaggactggtcggcttagaggacaagctgctgcaactgcttctaaagctgacaaggcttaaaagagtgttatattttttatctgatgcttctcttgattatcatctaagactagttggtgaactttattgcagaaattttgttttggattgtcttctttttcttttttcttttttaaattataagaattggtttgtgcacgttttgaaattagtccaattaaactgttcctatttctgctgaa

SEQ ID NO: 3356 - DNA, 1127 bp, Elaeis guineensis
gaactcggcaccatataaatactctcttgagaaccccaaaccctcgcttcgtcccctctcctcctcctcatcgccgccgctctcagccgctttccgcctgcgctgccgccatgggacgcgtgatccgtgcccaaaggaagggagccggctcggtcttccgctcccatacccaccaccgtaagggcccggcccgcttccggagcctcgactacggcgagcgcaacggctacctcaagggcgtcgtcaccgacatcatccacgaccccggccgcggcgccccgctcgcccgcgtcacattccgccaccccttccgctacaagcaccagaaggagctcttcatcgccgccgagggcatgtacaccggccagtttgtctactgcggccgcaaggcttccctcattgtcggcaacgtgctgccgctccgctctatccccgagggtgcggtcgtgtgcaacgtcgagcaccacgttggcgaccgcggagtccttgcccgcgcctccggcgactacgccatcgttatcagccacaaccccgacaacggcacctccaggatcaagcttccttctggtgcaaagaaggttgtgccaagtggttgccgtgcaatgattggacaggttgctggtggaggtagaaccgagaagcccctcctcaaggctgggaatgcgtatcataaattccgtgtgaagaggaactgctggccaaaggttcgtggtgttgccatgaaccctgtggaacatcctcatggaggaggaaaccaccagcatattgggcatgcatcaactgtccgccgtgatgctcctcctggacagaaggttggtcttattgctgcgagaaggacaggacggcttcgaggacaggctgctgcaactgcttccaaagcagagaagactgcttagagagttgcttatattcttgcgcgcttattcttgttctttcatttgcttgagcaactgtcaatcgtaaattggaaactcatccagaggttttgtagctaaattcgagaatttgtttggtaatttgctgatttctgggcaagttgtcttttatgttgttatcatcatatttggaattgttgttcagtgaaattgaaatggtgcactgtttgttttgctttttaaaaaaaaaga

SEQ ID NO: 3357 - DNA, 1365 bp, Papaver somniferum
caatcttttttgctccagaaggaagcttaatccttgaagtaccattatcagggttatggctgataacaatagcataatcaccagaagctctagctaatgttcctctatcaccaacatgatgttcaacattacaaataacagctccttcagggatagatctcaatggcaaaacatttccaaccatcagattagctttctttccacagaacaaaaccctaattccgcctctgccaccaccatcttcatcaccaaatgggtcgtgtaatcagatctcaacgtaagggagctggttccatcttcaaatcccacacccaccaccgcaaaggaccagcaagattcaggagtttagatttcggtgaaagaaatggttacttgaaaggagtagttactgaaatcatccacgatccaggtcgtggtgcaccattagcaagagttactttcagacatccattcagatacaagcatcagaaggagctttttgttgctgctgagggtatgtatactggacagtttttgtattgtgggaagaaagctaatctgatggttggaaatgttttgccattgagatctatccctgaaggagctgttatttgtaatgttgaacatcatgttggtgatagaggaacattagctagagcttctggtgattatgctattgttatcagccataaccctgataatggtacttcaaggattaagcttccttctggagcaaaaaagattgtaccaagtggatgccgtgctatgattggccaagttgctggtggaggcaggactgagaagcccatgttgaaagcaggaaatgcttaccacaagtacagagtgaagagaaactcctggcccaaggttcgtggtgttgctatgaatcccgttgagcatcctcacggaggaggtaaccaccaacatattggacatgccagtaccgttcgtcgtgatgcacctcctggacaaaaggttggtctcattgctgctaggagaactggacgtcttcgtggacaggctgcttcagctgctgccaagacagataaagcttaagttctttgcttgtttttactgttttagtttgtttggatatcttgaatcaatctttcctagtttgactcgtgagaggtactgtgagaagaatacttttattgtttatttgtcttcagatattacttattagtgtgtagaatgatcagaatgaagtctctctgtgaactgcaagtttattgcttgagcaatatactgaatttaacaacacagtttgataatttcctctttgctaaagtcagttttttgcagttttaaagcatattttcttgaattaatgtactttgctaagaagtatgagtgcatctgtcggatatatccgtatatgaacta

SEQ ID NO: 3358 - DNA, 1200 bp, Eutrema halophilum
gctttaactggacttttattagacccatttaaggtagtaggtccatgatccatcttagcccactagggttttggaaggctatagtgtattcagaagaatataaacctgattttctctgttttgcaaatgctttaaccctagccgtaatctgaagaagacgaaggaaaatcatcctccatgggtcgtgtcatcagagctcaacgtaagggagcgggttccgtcttcaagtcccacactcaccaccgtaaaggtccggccaaattcaggagcctcgatttcggtgagagaaatggatatctcaagggagtcgtgacggagatcatccacgatccaggacgtggagctccgttggctcgcgtcgccttccgtcatcctttccgatacaagaagcagaaggagctcttcgtcgccgccgaaggaatgtacaccggtcagttcctttactgcggtaagaaagccactctcgtcgtcggaaatgttctcccgctcagatctatccccgaaggagctgttgtctgcaatgtcgagcatcatgttggtgatcgtggtgttttcgctagggcttctggtgattacgccattgttatcgctcacaaccctgataacgatacaagcaggattaagttgccatctggttcaaagaagattgtcccaagtggatgcagggccatgattggtcaagttgcaggaggtggaagaacagagaagccaatgctcaaggcaggaaacgcataccacaagtaccgtgtgaagagaaactgctggcctaaggtgcgtggtgtggctatgaacccagtggagcatcctcacggaggaggtaaccatcaacatattggtcacgccagtacggttcgtcgtgatgcaccacctggacaaaaggttggtcttattgctgcaaggaggactggtcgtctcagaggtcaagctgctgctcttgctgccaagcaagactaaggatgagaagaagagtcttcaagatgaaattgttcacttttttgggattattgttgagaccttgttttgaaacgttaagatttattataaagttctttgagacctctctctatcagatagaatctatgtcttcagtgttgaacctcaacattattatgccttttaaatttcatatcttcggtttcgatggtctgcttcttatttctttggttgaatttggtctgccataaggatctaaatttgata

SEQ ID NO: 3359 - DNA, 1019 bp, Tripterygium wilfordii
ctttcgctcaccctctaaaaaatcccaaccctagactctcagctcccgcggcgatgggtcgcgttattagagcgcaaaggaagggtgccgggtctgtattcaagtctcacacccaccaccgcaagggtcccgcttgttttcgctcgctagacttcggcgagcgcaacggttacctgaggggtgttgtctccgagatcatccatgatccgggtcgtggtgctccgcttgctcgtgttgtattccgccatcccttccgttacaagcatcagaaggagctcttcgtcgctgctgagggtatgtacactgggcaattcatctactgtggcaagaaggcgaacttgatggttggaaatgttcttcctctaagaggtattcccgagggtgccgtcgtctgcaatgttgagcatcatgttggtgaccgtggcgttctcgctagggcttctggtgattatgctattgttatcagtcacaaccctgataatggtactaccagagtcaagcttccttctggggcaaagaagattgtgccaagtgggtgcagagctatgattggccaagttgcgggtggtggcaggactgagaagccaatgctgaaggcaggtaatgcttatcacaaataccgtgtgaagaggaactgctggcctaaggttcgtggtgttgctatgaaccctgtggagcatccccacggtggtggtaatcaccagcatattgggcatgcgagtactgtttgcagacacgctcctccaggccagaaggttggtctcattgcggccaggaggacaggtcgtcttcgtggacaggctgcggctgctgcttcaaaatcagacaaggcctaaattgtttttcttctatgatttatctttccatatttttgacatcttgccaacgaagtgccaatgtggttcctattgttcttgttttcaagtttaggactgaattttgctgtctttgggatttaatggtctcttttttaatagattactttaaagttgccagttttgttctctaatttttatggg

SEQ ID NO: 3360 - DNA, 984 bp, Utricularia gibba
ggccgggtgatccgagcacagcgtaagggtgccggttccgttttcaggtcccacacgcaccaccgcaagggcccggcgcgcttccgctcccttgattttggtgagcgaaatggctatctgaagggtgttgttacggagatcattcacgacccaggccgtggtgctccgctggctcgtgtcacattccggcatcctttccgttaccagcatcagaaggagcttttcgttgccgctgaggggatgtacaccggtcagtttatttattgcgggaaaaaggcgaatcttgttgttggaaatgtgttgcctcttcgatctattccggaaggtgccgttgtttgcaacgttgagcatcatgtcggagatcgtggggtctttgctcgtgcctccggggactacgccattgtcatttctcacaaccccgataatgggacttcgaggattaagctgccttctggctccaaaaagatagttcccagtaactgtcgcgccatggttgggcaagtagctggcggaggaagaactgagaagcctctgttgaaggcagggaatgcatatcataagttcagagttaagaggaactcatggcctaaggttcgtggtgttgccatgaatcctgttgagcatcctcacggtggtggtaaccaccagcacatcggccacgccagtaccgtccgccgcgatgcaccaccgggacagaaggttggactgatcgctgctcggagaaccggccgtctccgtggtcaagctgctgctacagcagccaaagcagacaagtgatgagtcagttgcaagagtctcctgcttggcgttccagttttcatgttacttttccaacttgtctgaaaccttattttcattattcagttgtcagcgactcatgttatcccatcattcatatagctgatgaatccacattgtcatctcagatggttgcttatgaaacagctacacaacacaattcatccaaaaaaaaaaaaaacacgc

SEQ ID NO: 3361 - DNA, 910 bp, Ambrosia trifida
agagagagaaacaagaaatgggtcgtgtaatcagagcacaacgtaagggagcaggctccgtcttcaagtcccacacccatcaccgcaaaggcccagcacgtttccgcagcctagacttcggtgaacgtaacggctaccttaaaggtgtcatcacagagatcattcatgacccgggtcgtggagccccgcttgcccgggtcacgttccgtcacccctttaggtacaagcaccagaaggagctgtttgtggctgctgaagggatgtacacaggacagttgtgttttgtgggaagaaggctaacttaatggtcggtaatgtgttgcctcttcggtctattcctgaaggagctgtggtttgtaatgtggaacatcatgttggtgatcgtggttcgtttgctagagcttctggtgattatgctattgttattagtcataatcctgataatggtactactagggttaagcttccatctggagccaagaaaatcgtgccaagtgggtgcagagctatgattggtcaggttgcaggaggtggtagaaccgagaagccaatgcttaaagctggtaatgcttatcacaagttccgcgtgaagagaaactgctggcccaaggttcgtggtgttgctatgaatccagttgagcatccccatggtggtggtaaccatcaacatatcggtcatgcaagtactgtccgtcgtgatgcaccacctggtcaaaaggtcggtcttattgccgctaggagaactggacggctcagaggtcaagctgctgctactgctgccaaggctgataagtagagcgcttgaatggtttttggtatcaggtttgaagtttttacttatctgttggtttattttaagtttgggacttttgtatggttaatctacaatacttgatacaatgttattgtt

SEQ ID NO: 3362 - DNA, 931 bp, Eucalyptus grandis
agcaaaacttcgactacaaaatgcatccgcaaattcccagaattataattgtagaatacccaaaaccgagtccaacggaataccaaatgaagaaaaacaggaatatctcttcaagccttatcagccttggaagcagttgcggcggcttgtcctctgagccgaccagtcctccgagcggcgatgagaccaaccttctggccaggtggcgcgtcacgcctgactgtgctcgcgtgaccaatgtgttggtgattacctcctccgtgaggatgctcaactgggttcatggccacaccacgcaccttgggccagcagttcctcttcactctgaacttgtggtaagcattgccagccttaagaaggggcttctcagttcttcctccaccagcaacctgcccgatcattgctcggcagccacttggcacaattttcttcgacccggatggaagcttgattctgaagtgtcgttatcagggttgtggctgatcacgatcgcgtagtccccggaggccctggcgaagaccccgcggtccccgacgtggtgctcgacgttgcacacgacggcaccctcggggatggagcggaggggcaggacgttgccgacgacgagggtggccttcttgccacagtagacgaactggccggtgtacatgccctcggcggcgacgaagagctccttctgcttcttgtagcggaaggggtggcggaaggcgacgcgggcgagcggggcgccgcggcccgggtcgtgcacgatctcggtgacaacgcccttgaggtacccgttgcgctccccgaagtcgaggctccggaacctcgccggccccttccggtggtgggtgtgggacttgaagacggagcccgcacccttacgctgcgcccggatcacgcgacccatctcgccgtcgtcgggatttcggagctttggtggaggggg

SEQ ID NO: 3363 - DNA, 1284 bp, Musa acuminata
aatcctccccccttctcgcgctccccgtatcgccctccttcagcctattgcttcgccgccgagatgggacgcgtgatccgagcacagaggaagggagccgggtcggttttccgctcccacacgcaccaccgcaaggggcccgcgcggttccggagcctcgacttcggggagcgcaatggctaccttaagggcgtgatcaccgagatcttgcacgaccctggccgtggcgcccctcttgcccgcgtcaccttccgccatcccttccggtacaagctccagaaggagctcttcatcgccgccgaagggatgtacaccggccagttcgtctattgtggccgcaaggcctcccttatggtcggcaacgtccttcccctccgctccattcctgagggtgccgtcgtctgcaacgtcgaacaccacgttggcgaccgcggtgttctagcccgcgcctccggcgactacgcgatcgtcatcagtcacaaccctgacaacggcacctccaggatcaagctcccatctggagcaaagaagatcgttccgagcaattgtcgtgccatgatcggacaagttgctggtggtggtagaactgagaagcccctacttaaggctggcaatgcctaccacaagttcagagtgaagaggaactgttggccaaaggtccgaggtgtggctatgaaccctgtggagcatccccacggaggaggaaaccaccagcacattggacatgcctccaccgtccgccgtgatgctcctcctgggcagaaggtcggtctcattgctgcaaggaggactggtcgtctcaggggacaggctgctgccactgctgccaaggcagagaagacctcttagattgcttagtggaacagtgtctggtatattggtttctgatgagctcagtttgtcatttgagtattatggtgactttcttgtcatttattatgttggaggaccattatggatttcgagatattttattttaccttttcctgttatggattcgatattgttgaaatcctcttgttgatggcaacatcttaattgttaccactctttttatattgtttgagatccacagatgaaaacattatctgcaatgactggactggcctgttgtgaacaaaagcctattataacacagtgtggtaaattgtactgtgttttaaggaagaaatgctcctcattttggaatcttgattgataattaagatgaggttaacaacattctagaaaatgaaatttcattaggaagaaaggttttaaaagtgttctacaaactactacaca

SEQ ID NO: 3364 - DNA, 1105 bp, Medicago truncatula
ccgtaactatatatcatcaccaaaacctcaaaccctaacctctctgaacccatttccatatcttcgccgcacggtggttggagtcgtaggttcacgtttcgtgcgagatgggtagggttatcagggcacaacgtaaaggagcaggctccgttttcaagtcccacactcaccaccgcaaaggcccagcacgtttccgcagtcttgatttcggtgaaagaaacggttaccttaaaggagtagtgaacgaaatcattcacgacccaggtcgcggtgcaccactcgctaaggtcactttcagacacccttttaggtataagaaacagaaagagcttttcgttgctgctgagggactttacacaggacagtttatttattgtgggaaaaaagctactcttgttgttgggaatgttttgccattaaggatgattcctgaaggtgcggttatttgtaatgttgaacatcatgttggtgatcgtggtgcttttgctaggtgttctggtgattatgctattgttattagtcataatcctgataatgatacctctaggattaagctaccatcaggggcaaagaagattgttccaagtgagtgcagagctatgattgggcaagttgcaggtggaggaagaactgagaagccaatgcttaaggctggtaatgcttaccacaaatttagggtgaagaggaattgctggcctaaggttcgtggtgtggctatgaatccagttgaacatcctcacggaggaggtaaccaccagcatattggacatgctagtactgttaggcgtgacgctcctcctggacagaaggttggtctcattgctgctaagagaactggtcgtctcaggggacaagctgcttccgctgctgctaaggctgattaacttattagactatttgaagagattcttagggttttattttgttgcaagattttgaaattttgtttgattccttgtttgttcgaaactacttgggtattattttgagatccttttgccccatttatttatatgaaacttttatatgacaatggtttacatttgttttcaagttctattcaattcatagtttaccttcctattgggtttcatccggttcttaa

SEQ ID NO: 3365 - DNA, 975 bp, Helianthus annuus
accggagcatgggtcgcgtcatccgagctccacgtatgggagcaggctccgtcttcaagtcccacacacaccaccggaaaggcccagcccgtttccgttccctcgacttcggcgagcgcaacggctacctaaaaggggtcattaccgaaatcatccacgacccaggccgcggagctcccctggctcgcgttacgttccggcacccgttccggtacaagcaccagaaggaattgtttgtggccgctgaggggatgtacaccggccagtttgtgttttgtgggaaaaaggctaacttgatggtcggaaatgtgctgccgcttagatcgattccggaaggagctgtggtttgtaatgtggagcatcatgttggggatcgaggctcgtttgctagagccagtggggattatgcgattgttattagtcataatccggataatggtaccactagagtgaagcttccatccggggcaaagaaaattgtgccaagtggatgccgtgctatgatcggtcaagttgcaggtggaggacgtaccgagaagccgatgctcaaggccggtaacgcataccacaagttccgcgtcaagagaaactgctggcctaaggttcgtggtgttgctatgaaccccgtggagcatcctcatggtggtggtaaccatcaacatattggtcacgccagtactgttcgccgtgatgcaccacccggtcaaaaggttggtctcattgccgctaggaggactggtcgtctcagaggtcaagctgccgctactgccgccaaggctgataagtagtgaactgatgttacgggtgttgattttagctttttgttttttacctttgcatctgctactttcatgttttgtttttgacttgaatctgcaactgaaatgttgatcattacatcatgtttgaaagttttgtagtagtttttacttatttttatggatttattcttgttagccttttattacaatgcac

SEQ ID NO: 3366 - DNA, 1004 bp, Amsonia hubrichtii
ttcccctcaacccgccgccgctgctgctgcgatgggtcgtgtaatcagagctcagcgtaagggtgcgggatctgttttcaagtcccacacccaccaccgcaaaggccctgccaaattccgttcgctcgacttcggtgagcgcaatggttatctgaagggagtgattactgaaattatccatgatcccggccgtggtgcccctttggctcgtgttactttccgccaccctttcaggtttcagcaccagaaggagcttttcgtcgccgccgaagggatgtacactgggcagtttgtttactgcggtaagaaagctaccctcatggtcggaaatgtcttgcccctcagatctatccctgaaggagcagttgtctgcaacgttgagcacaagatgggtgaccgcggtgtctttgctagggcctcaggtgattatgctatcgttatcagccacaaccctgacaatggaaccactaggattaagctcccatcaggatccaagaagattgtccccagcggttgccgagccatgattggtcaggttgctggaggtggacgtactgagaagccactccttaaggctggaaatgcttaccacaaataccgtgtcaagaggaattgctggcccaaggttcgtggtgttgctatgaatccagttgagcatcctcatggtggtggtaaccatcaacacattggtcatgctagcacagttcgtcgtgatgcacctcctgggcaaaaggttggtctcattgctgcccgcagaactggtcgtcttcgtggtcaagctgctgcaactgctgcgaaggctgataagggtgcttagatgcagaaaaaatacctatttaatgtttttactcctttttctgttttagtggattttcttaatcagttggaaacaatactctagtactgaattttgtctggatttattgcaacaatttttgtttaagcatttacagtttggaatggtgtacttgttttcatcaattctggtcctattattttatttg

SEQ ID NO: 3367 - DNA, 980 bp, Arnica chamissonis
ccgggcaaatgggtcgtgttatcagggcacaacggaagggagcaggctccatcttcaagtcccatactcaccaccggaagggtccggcgaggttccgcagcctcgattttggtgagcgcaatggttaccttaaaggtgtcatcacagaaatcattcacgatcctggccgtggtgctcctcttgcgcgcgtcactttccgtcatccgttccgttacaagcatcagaaggaacttttcgtcgccgctgaaggcatgtacaccggtcaatttgtcttttgtggtaagaaggccaatttgatggttggtaacgtgcttcctctcagatctatccccgaaggagctgtcgtttgcaacgttgagcatcatgttggtgaccgtggttctttcgcaagggcttctggtgattacgccatcgttatcagtcacaatcctgaaaatggcaccagtagagtgaagcttccgtctggagcaaagaaaattgtgccaagtggatgtcgggccatgattggtcaagttgccggtggaggacgtactgagaagccaatgctgaaagctggtaatgcatatcacaagttccgtgtgaagagaaactgctggcctaaggttcgtggtgttgctatgaacccagtggagcatcctcatggtggtggtaaccatcaacatattggtcatgcaagtacagttcgccgtgatgcaccccctggtcaaaaggttggtctcattgcagctaggaggactggtcgtctcagaggtcaagctgccgcctctgcagccaaggctgataagtaatggaccagaaccagggatgatgattttggttttttaccattaaatctgttacttttttgttttgtttggttttttgcaacctgcaactgtgatgttcatcatcacatgttttatcttgttggaaagttttccattagttgactgactattatattagccatttattgttgctatttagtttgtttttaaatg

SEQ ID NO: 3368 - DNA, 969 bp, Arnica chamissonis
aatgggtcgtgttatcagggcacaacgtaaaggagcaggctccattttcaagtcccatactcaccaccgcaaaggtccggcgaggttccgcagcctcgattttggtgagcgcaatggttacctaaagggcgtcatcaccgagataattcacgatcctggccgtggtgctcctcttgcgcgcgtcactttccgtcatcctttccgttacaagcatcagaaggaacttttcgtcgccgccgaaggcatgtacaccggtcaatttgtcttttgtggtaagaaggccaatttgatggttggtaacgtgcttcctctcagatctatccccgaaggagctgtcgtttgcaacgttgagcatcatgttggtgaccgtggttctttcgcaagggcttctggtgattacgcgatcgttatcagtcacaatcctgaaaacggcaccagtagagtgaagcttccgtctggagcaaagaaaattgtgccaagtggatgtcgggccatgattggtcaagttgccggtggtggacgtactgagaaaccaatgctgaaagctggtaatgcatatcacaagttccgtgtgaaaagaaactgctggcctaaggttcgtggtgttgctatgaacccagtggagcatcctcatggtggtggtaaccatcaacatattggtcacgcaagtacggttcgccgtgatgcaccccctggtcaaaaggttggtctcatcgcagcaaggaggactggtcgtctcagaggtcaagctgccgcctctgcagccaaggctgataagtaatggaccagaaccagggatgttgattttggttttgtttggatttttgcaaccttgcaactgtgttgttcatcatcacatgttttatcttgttggaaagttttgcattagttgactgactattatattagccattttcttggacttattgttgctatttagttgtttttaaatgttgggtttgttagtag

SEQ ID NO: 3369 - DNA, 1001 bp, Catharanthus roseus
ctaattccgaaatgggtcgtgtgatcagagctcaacgtaagggagcagggtctgttttcaagtcccatacccatcaccggaaaggtgccgcaaaattccgttcacttgactttggtgagcgcaatggttacctgaaaggagtgatcaccgaaattattcatgatcccggccgtggtgctcctttagctcgtgttactttccgtcatcctttcaggtatcagcaccagaaggagctcttcgtcgctgctgaagggatgtacactggccagtttgtttactgcggtaagaaagctaaccttatggtaggaaatgtcttgccccttagatctatccctgaaggagctgttgtctgcaacgtggagcacaagatgggtgaccgcggtgtctttgctagagcttctggtgactatgctatcgttatcagtcacaaccctgataatggtaccactagggttaagctcccatcaggtgccaagaagattgtcccaagtgggtgccgagccatgattggtcaggttgctggtggtggccgtactgagaagccactccttaaggcaggtaatgcttatcacaagtaccgtgtgaagaggaactgctggcctaaggttcgtggtgttgctatgaatccagttgagcatcctcatggtggtggtaaccatcaacatatcggtcatgctagcacagtcagacgtgatgcaccaccagggcaaaaggttggtcttattgctgcccgtagaactggtcgtcttcgtggacaagctgcagctactgctgctaaagctgataaggcttagacatgctgaaaaattacttatgttatggttttacttttggttctgttttagtggagttgcttattcagttggaacattttggaagaaaacaatactgtagttctaaattttgtttgaatttattgcaagaatttttgtttaagcagttatgctttggatgtgagtttgtttcatgtggtaaatgatttattaagcagctttactatt

SEQ ID NO: 3370 - DNA, 898 bp, Cleome spinosa
ccatgggtcgtgtcatcagagctcagcgtaagggtgcgggttccgtcttcaagtctcacacccaccaccgcaaaggcccggcgaagttccgtagcctcgacttcggggagcgcaatggctacctgaagggagtcgtcaccgagatcatccacgacccgggccgtggcgcgcctctcgctcgtgtcgttttccgacacccgttccgttataagaagcagaaggagctcttcgtcgcggccgagggcatgtacactggtcagttcgtgtactgtggtaagagggcatcactcattgtcggaaacgtcctccctctcagatctatccccgagggagctgtcgtctgcaatgtggagcaccatgtcggtgatcgtggtgttttcgctagggcttctggtgattacgccatcgttattgctcacaacccagataacgacaccactagaatcaagcttccatccggttccaagaagattgtgccgagtggctgcagggcaatgatcggacaagttgccggtggtggaagaacagagaagccactccttaaggccgggaacgcataccacaagttccgcgtgaagaggaactgctggccgaaggttcgtggtgtggcaatgaacccagtcgagcatccccatggaggaggtaaccatcaacacattggtcatgccagtaccgtcagacgtgacgctcctcctggacagaaggtcggtcttatcgccgccaggagaactggtcgtctcagaggtcaagccgccgccactgcttccaaggccgacaaggcttagtagcgatctcttatccatatcttatctgcgtctctcttttttcagcatttttgtttgtgttttgattcagacttcgttcttgattcccaatattcacagttgttttagtaacg

SEQ ID NO: 3371 - DNA, 1162 bp, Gossypium hirsutum
ctcttatcttaaaaccccatttaactagtctcttcgcttccatcggccgcctcaacgagagaggtctcttcataatcacccaatgggtcgtgtcatccgagctcaacgtaagggtgcgggtactgttttcaagtcccacacccaccatcgcaagggtgccgctcgtttccgcagtctcgactttggtgaacggaatggctaccttaaaggtgtcgtcacggaagttatccacgacccgggccgtggtgctccattagtccgcgtcgtcttccgtcatccattccgttacaagaaacagaaggaactgttcgttgctgccgaaggcatgtacactggacagttcgtgtactgcggtaagaaggctactcttatggtcgggaacgtgttgcctcttagatctatccctgaaggagcagtcgtctgcaatgtcgaacatcacgttggtgatcgtggtgttttcgctagggcttctggtgattacgctattgttatcagtcacaatcctgataacgacaccaccaggatcaagcttccatctggttctaagaagattgttccgagtgggtgtcgtgcaatgattggccagattgcaggaggtggaaggaccgagaaacctcttcttaaggcgggcagtgcataccataagtacagggtgaagaggaactgctggcctaaggtgcgtggtgtggctatgaatccagttgagcatccccatggtggtggtaaccatcaacatattggtcatgctagtactgttaggcgtgatgctcctcctgggcagaaggttggtcttattgctgcgaggaggactggtaggctcagaggacaagccgctgccaccgcagccaaggctgataaggcttaagcgtagggtattacttattgttttagttcttttggcatttatatttaggttcattttgtttgaatttaataatgcttgtgttttcaatttggattgcttattcccaagttctttcatcacttgatgctaatttttctgatccttggttctctcatgtaaccttccataatgctgtttaccaaagcacttggatgttggggaaactgtaaaggcgaaaaggtggcctaatggagcccgtatcatagataattttgtagttaatatttgattggataaatcactaatcgatcgatatat

SEQ ID NO: 3372 - DNA, 1030 bp, Cucumis sativus
atcgctgcggtaacgaactgaaaatctccgatctcgcggagtcgccatgggaagagtcattcgtgctcaacgtaagggagcgggatccgtcttcaagtcccatacccatcatcggaagggcccggccaggttcagaagtcttgatttcggtgaacgaaatggttatctgaaaggagtcgtcactgagattattcacgaccctggccgtggagcgccacttgctcgtgtttccttccgtcatcctttcaggtacaagaaacagaatgagctgttcgttgcggctgagggtatgtacactggccaatttgtctactgtgggaagaaagcaaatcttgtggttggaaacgtcttgcccgttaggtcgatccctgaaggtgccgtcgtttgcaacgttgaacaccatgttggtgatcgtggtgtttttgccaggtgctcgggagactacgcgattgttatcagtcacaatcccgataacgacacatccaggatcaagcttccatccggtgcgaagaaaatagttccaagtgggtgccgtgccatggttggtcaggttgcaggcggaggcaggactgagaagcccctcttgaaggctggtaatgcttaccataaatttagagtgaagaggaactgctggcctaaggtccgtggtgttgcaatgaatcccgttgagcatcctcatggaggaggtaaccatcaacacattggacatgccagcacagtcagacgggatgcgcctcctggtcaaaaggttggtctcattgcagcacgaagaactggtaggctcagaggacaagctgcagcaactgccgctaaagccgataaggcatagacagtattataatctagattgttatttcggttttgagatcatttcattttacttttatctatcaatttttccaagactagtcgtgtacgaccaatattactttttgagtaactgttaagagttccttcgtttacaaatttgaaattttggtttgttttttcccgtatgagtttggtccgatatttatatatttggctgatt

SEQ ID NO: 3373 - DNA, 1158 bp, Cynara scolymus
  misc_feature (12)..(12): n is a, c, g, or t
  misc_feature (51)..(51): n is a, c, g, or t
  misc_feature (56)..(56): n is a, c, g, or t
  misc_feature (989)..(989): n is a, c, g, or t
cggggcgtcgtnaatcaaccctaaccggagaaatgggtagagtcatcaggncacancgtaagggagcgggttcagtcttcaagtcacacactcaccaccgcaagggtccggcgaggttccggagtctcgatttcggcgaacgcaatggttacctaaagggtgtcatcaccgaaatcattcacgatcctggacgtggtgctcctcttgctcgtgttactttccgtcatccgttccgttacaagcaccagaaggagctcttcgtcgccgccgagggtatgtacaccggccagttcgttttctgtggaaagaaggcgaatttgatggtcggtaatgttcttccactcagatctattcccgaaggagcggttgtatgcaacgttgagcatcacgtcggtgaccgtggttcttttgctagggcttccggcgattatgccatcgttatcagtcataaccctgataatggcactactagagtcaagcttccatccggagccaagaagattgtgcccagtgggtgtcgagctatgattggccaggttgctggtggtggacgtactgagaaacccatgctcaaagccggtaatgcttaccacaagttccgtgttaagagaaactgctggcctaaggtgcgtggtgttgctatgaaccccgttgagcatcctcatggtggtggtaaccaccaacatattggtcacgccagtactgttcgtcgtgatgcaccacccggtcaaaaggttggtctcattgccgctaggagaactggtcgtctcagaggacaagctgccgccactgcctccaaggctgataagtgataaaacagtgccatggatgttgcttttggtttcattgttagtttttgccagtttacttgctactgttatgttgatcatcatacatttggaaagttttgcagtaatttactgattattgatatattgatggtgctttatttagatgtctattaatgatctctgtatgcagatgttgantgtttatttgggttttgaatgtttattgatttagtagtaatgttagagcacctgaaggttctgttcttgactctgaaatctgaatgaaaaatgactgttttgccgaacaaaactacaataaaaatgcaaacatctcactgggaatagaataatgttggtgtcatttctg

SEQ ID NO: 3374 - DNA, 880 bp, Taraxacum officinale
gggagctcgggccattgtaccctaggttaataacttcataaacctacaaagtgtttccattctctctactccatctctctgcgccgtcgttccccccgaagctgaagaaatgggtcgtgtgatcagagcacaacgtaagggagcaggctccgtcttcaagtcccatacccaccaccgcaagggtccggccaggttccgcagtctcgacttcggtgaacgcaatggttacctcaagggtgtcatcaccgaaatcatccacgatcctggacgtggtgcccctcttgcccgcgtcactttccgtcatcctttccgttacaagcaccagaaggagcttttcgtcgccgccgaagggatgtacaccggacagttcgtcttctgtggaaagaaggctaacttgatggtcggtaacgttcttcctcttagatctatcccggaaggagctgttgtgtgcaacgttgaacaccatgtcggtgaccgtggttcatttgccagagcttctggtgattacgccatcgttatcagtcacaaccctgataacggcaccactagagtgaaacttccatctggagccaagaaaatcgtgccaagtggatgccgagccatgattggtcaagtagcgggaggaggccgtaccgaaaagccaatgctgaaagccggaaacgcgtaccacaaattccgcgtgaaacgtaactgctggcccaaggttcgtggtgtggctatgaaccctgtggagcatccccatggtggtggtaaccatcaacatatcggtcatgctagtacggttagacgtgacgcacctcctggtcaaaaggttgggcttattgccgctaggaggaccgggcggctcagaggtcaagccgccgccactgccgccaaggct

SEQ ID NO: 3375 - DNA, 1082 bp, Eucalyptus grandis
tcctccacctccacctccacctccatttccgacacccgcacacaggcacgcgcgccgcccctccgccgccgccgcgagaatgggtcgggtcatccgggctcagaggaagggtgccgggtccgtcttcaagtcccacacccaccaccgcaagggccccgcccgcttccgcagcctcgacttcggggagcgcaacgggtacctgaagggcgtcgtcaccgagatcctgcacgacccggggcgcggcgccccgctcgcccgcgtcgccttccgccaccccttccgctacaagaagcagaaggagctcttcgtcgccgccgagggcatgtacaccggccagttcgtctactgcggcaagaaggccaccctcgtcgtcggcaacgtcctgcccctccgctccatccccgagggcgccgtcgtctgcaatgtcgagcaccacgtcggcgaccgcggcgtcttcgcccgcgcgtccggggactacgccatcgtgatcagtcacaacccggataacgacaccaccagagtcaagctcccttccggctctaagaagattgttccaagtgggtgccgggcaatgatcgggcaggtcgcaggtggaggtaggactgagaagcctctcctcaaggctggcaatgcttaccacaaattcagagtcaagaggaactgctggcctaaggtacgtggtgtggcaatgaaccccgtcgagcatcctcacggaggaggtaaccaccaacacattgggcatgcgagcacagtcaggcgcgatgctcctcctggccagaaggttggtctcattgctgcaaggaggaccggtaggctcagaggtcaagctgcggctactgcttccaaggctgataagaccacttaaggagcatttctattttatcttttccttatttttctttctttggggattgtcttgttggggaccttttgtagttcacttccaaagattagctggtgccttttgtagacgaattttggacaactgcgagagtcgtggtcattttatatatgattgtttgtgttgcttgggagctttcaattatttgataagctgaatggcaattgctattatttaccta

SEQ ID NO: 3376 - DNA, 1055 bp, Ipomoea nil
gggcatcctccatcttcctccgtatattacagtctcatctcctttcctctccaaacccttcactccttttacactcggcggaagatgggtcgtgtaatcagagcgcagcgtaagggtgcgggttccgtattcaagtcccacacccaccaccgcaaaggacccgccaagttccggtccttggatttcggcgagcgcaatgggtacctcaagggtgtggtgtccgagattattcacgatccgggtcgtggcgcgccgcttgctcgcgtcactttccgccatcccttccgctaccagcaccagaaggagctcttcgttgccgccgaggggatgtacaccggccagtttgtctactgtggtaagaaggccaatctcatcgtcggaaatgttttgcctctcagatccattcccgaaggtgccgtagtgtgcaacgtcgagcacaaggtcggtgaccgcggtgtcttcgctaggtgttccggcgattacgctattgtcatcagtcacaaccccgacaatggaaccactaggattaagttgccatcaggatccaagaagattgtgcctagtggatgtcgtgctatgattggccaagttgccgggggtgggcgtactgagaagcccctccttaaagccggtaatgcctatcacaagttccgtgttaagaggaattgctggcctaaggttcgtggtgttgctatgaatcctgtggagcatcctcatggtggtggtaaccatcaacacattggtcatgctagcactgttcgtcgcgatgcaccacccgggcagaaagttggtctcattgctgcaaggaggactggtcgtcttcgtggtcaagctgcagctactgctgctaagtctgacaaaggttcttagattgattatttcttattcagaattcttgttagtttttatttttgttttccctggcctgatttacacattaagtgtggctttaaagcagttacagtataatttttcttgagttttctatcaaagttatgtttaaggattcagattctgatgctgtgcttccaactggttatgcttttctggaaact

SEQ ID NO: 3377 - DNA, 906 bp, Lotus japonicus
aagcgttgcaaaatgggacgtgtgatccgcgcacagcgtaagggagcaggctccgtcttcaaatcccacacccaccaccgcaagggaccagcgcgcttccgcagtctcgacttcggcgagcgcaacggctaccttcgcggcgtcgtcaccgacgtcatccacgaccccggtcgcggtgctccgctcgccaaggtctccttccgccacccgttccgctacaagaagcagaacgagctcttcgtcgcagctgagggtatgtacaccgggcaattcgtcttctgcgggaagaaggctaacctcgtcgttggtaatgttctgcctgttcgatccattcctgagggtgctgtgatctgtaatgttgaacaccatgtcggtgatcgcggcgtgtttgctaggtgctctggtgattacgctattgttatcagtcataaccctgataacgatacctcaaggatcaagcttccttctggtgcgaagaaaattgttcctagtgattgtagggcgatgattgggcaagttgcgggtggtggaagaactgagaagccgcttcttaaagcaggtaatgcttaccacaagtttagggtgaagagaaactgctggcctaaggtgcgtggtgttgctatgaaccctgttgagcatcctcatggaggaggtaaccaccagcatattgggcacgcaagtactgtcaggcgtgacgctcctcctggccagaaggttggtctcattgctgccaagaggactggtcgtctcagagggcaagctgctgctactgctgctaaagcagataaggcataatgatattgttaacattatatttagttgcttgtttttccaaatttttttttgatagttgtctgttaaactgtttgtgtaagaacaattccccccgataaaatatggagcttt

SEQ ID NO: 3378 - DNA, 1029 bp, Momordica charantia
taattcgatcctcccaatgggtcgtgttatcagagctcagcgtaagggtgccggatcagttttccggtctcacacccaccaccggaagggccctgcccggttccgctctctggacttcggcgagcgaaatggctacctcaagggcgtggtcagcgagatcatccacgatccgggcaggggcgcccctcttgcccgcgtcaccttccgccaccccttccgctacaagcaccagaaggagctcttcatcgccgccgagggtatgtacaccggccagttcgtctactgcgggaagaaggccaatcttgttgtcggtaatgtgctccccatcagagccatccctgaaggtgctgtggtttgtaatgtggagcaccatgtgggtgaccgaggtgtgttcgctaggtgctctggtgattatgctattgttattagccacaacccagataatgataccagcaggattaaacttccatctggagctaagaagattgtgcctagtgggtgccgtgctatgattggtcaggttgctggaggtggaagaacagagaagcctcttctcaaggcaggtaatgcttaccacaagttccgcgtcaagcgcaactgctggcctaaggttcgtggtgttgctatgaacccagttgaacatccccacggtggtggtaaccatcaacacattggtcatgccagtactgttcgccgtgatgccccacctggtcaaaaggttggtctcattgctgccaggagaactggtaggctccgtggacaggctgctgctaccgctgccaaggccgataaaggtgcttagagcaattcgacttgttcgacgtttgttttggctaatccgtagcgccttccattatgtttgatttagtttacattatgttgaagaccatatttagaagtttttgtcccaagttttgttacaagatcctttctgaacataatccttctctccctttgtttcttggttgctacaatgaatttgatggcatggaactatggaagacactaaggtatatcattcaaattgat

SEQ ID NO: 3379 - DNA, 1223 bp, Mimulus guttatus
ccccatttctcacttcaccactctcccgccgtcctcctccgcaccaccaccaaaaccctaaacagttctacagaaatgggtcgcgttatccgggcgcagcgtaagggagcgggttccatcttcaagtcacacacccaccaccgcaagggcccggcccgcttcaggtcactcgacttcggcgagcgcaatggctacctaaagggagtcattaccgaaatcatccacgatcccggacgcggcgcgccgcttgcacgcgtcaccttccgccacccgttccgcttccagcaccaaaaggagctttttgtcgccgccgagggcatgtacaccgggcagttcatatactgcggtaagaaggcgaatctggtcgttggaaacgttcttccgctcagatctattccggagggagctgttgtttgcaacgtcgagcaccacgttggggatcgtggctcttttgctaggtgctctggtgactatgctattgtcatttcccacaaccctgacaatggcaccactagggttaagctcccatctggagccaagaagattgtgccaagtggctgccgtgccatggttggccaagttgctggcggtggaaggacagagaagcccatgttgaaggctggaaacgcctaccacaaatacagagtcaagagaaactgctggcctgtggtgcgtggtgttgccatgaatccagtggagcatccccatggtggtggtaaccaccagcatattggtcacgccagtaccgttcgtcgtgatgcgccacctgggcaaaaggttggtctcattgctgccagaagaactggtcgtcttcgtggtcaagctgccgccactgctgccaagtccgacaagggttcttagactcttaatatttagtgatggagaattggtttttgttgctgtcttttattcggattaatatgaattatgttttgcatgttcaaactctatgttcttattttgaggatatactcggttttgtttggaatcttgatatgtttaagttttatttcagtacttgtttgaattttgttgaagtttagcatgtattttcctctcttatcttttctgtattaaaatagattgtttcaataaatattattaattctaaaaattatcatatagaatttgctttatctgctgataatttagaacctaagacaattagttttatagaattgtatcccaaaaagaaaataagatgtcaagctttttagaattat

SEQ ID NO: 3380 - DNA, 999 bp, Tropaeolum majus
cggccgggggaccctagtagcaattcttaaccccccaatcctttgtgtgtcgttcgagagagagagagggtgagtgaacgatgggtagagttatcagggcacaaagaaagggagctgggtctgtcttcaagtcccacacacaccatcgcaaggggcctgctcgcttccgaagtctcgactttggtgagcggaatggatacctcaagggagtagtgacggagatcattcacgatccaggtaggggtgctccacttgctcgtgtctccttccgtcatcctttccgttacaagaagcagaaggagttgttcgttgcttccgaagggatgtacactggacaatttttgtactgcgggaaaagagccaaccttgttgtcggcaacgttctacctctcagatctatcccagagggagcagtcgtctgcaacgtcgagcaccatgttggtgatcgtggtgtttttgctagggcatccggtgattatgctgttgtagttagccacaacccggataacgacacctctagaatcaagcttccatctggttctaagaagattgtacccagcggatgccgagccatgataggacaaattgctggtggtggaagaactgagaaacccatgctcaaggctggaaatgcataccacaagttcagagtgaagaggaattgctggcctaaggtgcgtggtgttgccatgaatcctgttgagcatccccatggaggaggtaaccatcaacatatcggtcatgctagtaccgttagacgtgatgctccacctgggcaaaaggtcggtcttattgctgccaggagaactggtcgtctcagaggacaagctgccgctactgcagccaaggaaaaggcttagaattggtcttgtttggctttgtttttttagatttatttttgaagaacattttgatacttggggaagttttgtatttgaatctgcagtttattgcatttttatttaatgacttttttggaatatagtttatatatgctct

SEQ ID NO: 3381 - DNA, 1168 bp, Quercus alba
tatatagggtctcttccctctaaaccctaattccctgttggtactcgcattttctctgagtcggccgtcacgaccagtgccagagccagaggacagagaaaaaggctacaatgggtcgtgtaatcagagctcagcgtaagggtgctgggtctgtgttcaagtcccatacccaccatcgcaagggaccagcaaggttccgcagcctcgactttggtgagcgcaatgggtacctgaagggcgtggtcactgagatcattcacgacccgggtcgcggtgccccgctcgcccggatcactttccgccaccccttccgatacaagaagcagaacgagctgttcgtggccgccgagggtatgtacactggtcagttcgtgtattgtgggaaaaaggctactcttgttgttggcaatgtgttgcctctcaggtctattcctgaaggagctgtggtttgcaacgtggagcatcatgttggtgaccgtggtgtcttcgctaggtgttctggtgattacgctattgtcattagtcacaaccctgataacgacactagcagggtcaaactcccatctggtgctaagaagattgttccaagtggctgccgagctatgattgggcaggttgctggtggagggagaactgagaagcctcttctcaaggctggtaatgcttaccacaagttcagagtgaagagaaattgctggcccaaggtacgtggtgtggctatgaacccagttgagcatcctcatggaggaggtaaccaccagcatattgggcatgcaagtactgttaggcgtgatgcacctcctggtcaaaaggttggtctcattgctgcaaggaggactggtcggctcagaggacaagcggctgcaactgcttctaaagctgataagggttcttagagattattattctttttttctgttaattgtgtcttttagatatctggattttcccatagtagattaaaatctagactagctggtgagctttgttgcagaaattttgtttgggttgtgataaacatcttatctatgacatttggtttatgcactctctgaaattagtccaaatacactatttgtatttccgctgatcaatggatgatggagagaactcttcactgattatatttgagtatggattgtgctttatgccaattcttttctttagt

SEQ ID NO: 3382 - DNA, 1001 bp, Quercus alba
tttctcagccgtctagtcgttcccagttcccatgggtcgtgtgatccgagctcaacgtaagggtgctgggtctgtgttcaagtcccacacccaccaccgcaagggaccagcgaggttccgcagtctcgactttggtgagcgcaatgggtacctgaagggcgtggtcactgagatcattcacgaccctggtcgcggtgcaccgctcgcccggatcactttccgccaccccttccgttacaagaagcagaacgagctgttcgtggctgccgagggcatgtacactggtcagttcgtgtattgtgggaaaaaggctactcttgttgttggcaatgtgttgcctctcagatctattcctgaaggagctgtggtttgcaacgtggagcaccatgtgggtgaccgtggtgtcttcgctaggtgttctggtgattacgctattgtcattagccacaaccctgataacgacactagcagggtcaaactcccatctggtgctaagaagattgttccaagtggctgccgagctatgattgggcaggttgccggtggagggagaactgagaagcctcttctcaaggctggtaatgcttaccacaagttcagagtgaagagaaattgctggcccaaggtacgtggtgtggctatgaacccagttgagcatcctcatggaggaggtaaccaccagcatattgggcatgcaagtactgttaggcgtgatgcacctcctggtcaaaaggttggtctcattgctgcaaggaggactggtcggctcagaggacaagcggctgcaactgcttctaaagctgacaagggttcttgaaaattttaggctgataagagtgcttaaaagagtgttatactttagatctgccgcgtatcttgattatcatctaagactagttgttgaaccttattgtcaaaattttggttggaatgtcgttatgttttatttttattacaattggtttatgcactttttgaaattattccaatttagttgttcc

SEQ ID NO: 3383 - DNA, 994 bp, Elaeis guineensis
gtcgtctccctctcgccgccaccgctcgttacagccgccatgggtagagtgatcagggcccagaggaagggagctggttcggtgttccgctcccacacccaccaccggaaggggccggcccgcttccggagcctcgactacggggagcgcaatggctatctcaagggcgtggtgaccgacatcatccacgaccccgggcgcggcgccccgctggcccgcgtcaccttccgccaccccttccgctacaagaagcagaaggagctcttcgtcgccgccgagggcatgtacacgggccagttcgtctactgcggccgcaaggcctccctcatggttggcaacgtcctgcccctccgctccatccctgagggtgccgtcgtctgcaacatcgagcaccacgttggtgaccgtggcgtcctcgcccgcgcctccggtgactacgccatcgtcatcagccacaaccccgacaacggcaccaccaggatcaagcttccctctggtgctaagaaggttgttcccagtggctgtcgagcaatgattgggcaggtagctggtggcggtagaaccgagaagcccttgctcaaggctggcaatgcctaccacaagttccgtgtgaagcgaaactgctggccaaaggttcgtggtgtggccatgaaccctgtggagcatccccatggaggaggaaaccaccagcatattggtcatgcatcaactgttcggcgcgatgcccctccaggacagaaggtgggtcttattgctgcaaggaggacaggtcggctcagggggcaggctgcagccacagcttccaaagcagataagagctcttaggttacaaacccactttcctattgcttgttatatgtttggtttcctcgggtctctagatacgctgaagacttcatctagctagttttctcattagtttattgagtcatgtgattaaaattatagaagaaccttgtttatgttaattacggacatatcgttgggtttggta

SEQ ID NO: 3384 - DNA, 1164 bp, Populus trichocarpa
gcctacaccttagaaaccctaatacacccatcgccgtatatattactctcataaacctcaccctcatctctcgaccctatcacacttcgccgtccctctccagagagccaagcacttcacacacaataaccacaaatgggtcgtgtaatccgtgctcaacgtaagggagcaggatctgtcttcaaatcccatacccaccatcgcaagggtccggcaaggttcagatctcttgatttcggtgaaaggaatggttacttgaaaggtgttgtcaccgaaatcattcacgacccaggtcgtggagcgccattagcccgggtttctttcagacacccctttaggtacaagaagcagaaggagctttttgttgctgctgagggtatgtataccgggcagtttgtgtactgtggcaagaaggcgaatttgatggttggaaatgttttgcctttgagatctgttcctgaaggagctgttgtttgtaacgtcgaacatcatgttggagatcgtggtgtttttgctagagcttctggggattatgctattgttatcagtcacaaccctgataatgacaccactaggatcaagctcccatctggttccaagaagatcgttccaagtggctgccgtggaatgattggacaggttgcaggtggaggaaggactgagaagcccatgctgaaggctggtaatgcttaccacaagttcagagtgaagaggaactgctggcctaaggtgcgtggtgtggctatgaatccagttgagcatcctcatggtggtggtaaccatcaacatattggtcatgctagcacagtcaggcgtgatgctcctcctggccaaaaggttggtctcattgctgctaggagaactggtcgtcttagaggacaagcagctgccaccgcttccaaggctgacaaggcttaaggagtttcactggcttcattgttttttgtttattgtcagcctattagattatttcagtacttgagatgtttccaatgaaagttttgtttggattcttaagtttccgatggtttctgtgcatgactatgttttaagatatagatatttttgaatttttgcttactttggatgttcagttatctggattatggcttgcgttgttgaattctagatctacttttagatggattgagtttcattccgcaa

SEQ ID NO: 3385 - DNA, 1074 bp, Populus trichocarpa
tatatagacacacactaagagtttagggtttcttagctcttgtcgctgccatcccgctctttccccttcggcggcttgctcttgcctccaccattcagttactcgcttcacacacaaccagcacaaatgggtcgtgtaattcgtgcccagcgtaagggagctggctctgttttcaaatcccacacccaccatcgcaagggtccggcaaggttcaggtctctggactttggtgaaagaaatggttacttgaaaggtgttgtcaccgaaatcattcatgacccgggtcgtggtgccccattagcccgagttaccttcagacatccctttaggtataagaagcagaaggagctttttgtcgctgctgagggtatgtatactggacagtttgtatactgtggaaagaaggctaacttgatggttgggaatgtcttgcctctgagatctgttcctgaaggggctgttgtttgtaacgtggaacatcatgttggagaccgtggtgtttttgctagagcttctggggattatgctattgttatcagtcacaatcctgataatgataccaccaggatcaagctcccatctggctccaagaagatcgttccaagtggctgccgtggaatgattggacaggttgccggtggaggaaggaccgagaagcccatgctgaaggctggtaatgcttaccacaagttcagagtgaagaggaactgctggcctaaggtgcgtggtgtggctatgaatcctgttgagcatcctcatggtggtggtaaccatcaacatatcggtcatgctagcacagtcaggcgtgatgctcctcctggtcaaaaggttggtctcattgctgctaggagaactggtcgtcttagaggacaggctgctgcctctgccgccaaggctgacaaggtttaatgattttcattggcgtcattgtttttggttattgtcactgcctgttagattatttcagcacttactgggatgtttctaatgaaagttttgtttggatattcaagtatccgacgtcttttgtttttgactgttttaagataatagatattttgaattcgtgctcta

SEQ ID NO: 3386 - DNA, 985 bp, Senecio madagascariensis
tggatcccccgggctgcaggttggcgtcttcaaaccctaaccctaatcaccatgggacgagtcatccgagctcagcgtaagggagctggttctgtcttcaaatcccacacccaccatcgcaaaggccccgctcgtttccgcagtctcgacttcgtcgagcgaaacggttacctaaaaggtgtcatcaccgaaatcatccatgaccccggacgcggtgcgccgttagctcgcgtcactttccgtcacccgttccgttacaagcaccagaaggagctttttgtggcggctgaaggcatgtacaccggtcaatttgtcttctgtggaaagaaggcgaatctgatggtcggaaatgtgcttccgcttagatctatccctgaaggagctgttgtttgcaatgtcgagcatcatgttggtgatcgaggctcatttgctagagcttctggtgattatgctattgttattagtcacaatcttgacaacggcacttctagagtgaagcttccatctggagcaaagaaaattgtacccagtggatgtcgtgctatgattggtcaagttgctggtggaggacgtactgagaagcctatgcttaaagctggaaatgcttatcacaagttccgtgtcaagagaaactgctggcctaaggttcgtggtgtggctatgaatccagttgagcatcctcatggtggtggtaaccatcaacatattggtcacgctagtaccgttcgtcgtgatgcaccacccggtcaaaaggttggtctcattgctgcaaggaggactggtcgtctcaggggtcaagctgctgcttctgctgccaaggctgataagtgataaacttttgctatggatgttgaatttagttttgagatgtttgaatctgttacttttattgttagttttttccagattgtctgctacttttatgttgatcatcatacgttttatcttgttggaaagtttgcagtaatttactgattattcataa

SEQ ID NO: 3387 - DNA, 1155 bp, Sequoia sempervirens
cgaaaatgggtcgcgtgatcagagcacagaggaagggagcaggttccgtcttcaaatcccacacacatcacagaaagggccctgcacgctttcgcagtttggactacggcgagcgaaatgggtacctgaaaggcattgttacagaagtcgttcacgaccccgggcgcggcgcccccctctgccgcgtcagcttcaggcatcccttccgttacaggcagcagaaggagctattcgtcgccgccgagggtatgtatactggtcagtttatttactgcggtaagaaggccaatttgactgtggggaatgtcttgcctctgagatctattcctgagggcgctgttgtttgcaacgtggagcagcatgttggcgatcgtggctcctttgccagggcttctggagattatgccatcgtcatcagccataaccctgataatggcacttccagggtaaaacttccatctggagctaagaagattgttccaagtagttgcagagccatgattgggcaagttgcaggtggcggaaggacagaaaaaccaatgctgaaagctggcaatgcatatcacaaatatagggtcaaaagaaactgttggcccaaggttcgtggtgtggcaatgaaccctgttgagcatcctcatggtggtggtaaccatcaacacattgggcatgccagtactgtgcgtcgcgatgctcccccaggacaaaaagttggtctcattgctgctaggagaactggtcgtctacgcgggcaggctgcaactgcagctgcaaagacggacaaggcttagcctgcacacctactcaatcagaattaaacaattatagagttactgattatgcaagaatttcttttggtttcttttttccattaggtagatttgtgtcaacaatttatgtcgaccaggttgtaaaccatgttttccattattgtttcttatcattcgtggtttactcttgattcaaagttttgggaaagacttcaaactaggttgtaatcctcgtttacttttatcttttgaggctaatttttgtgctgtcatattaattgacctagttattttttattcttctttgaatgcttgtttttagttttcaggtcatagaaatggtgaaaagatttataatttctcagtatcataagctgtgagctttcta

SEQ ID NO: 3388 - DNA, 951 bp, Tabernaemontana elegans
aatccgccatgggtcgtgtaatcagagctcaacgtaagggagcagggtctgtattcaaatcccacacgcaccaccgcaaaggcccagccaaattccgtacactcgacttcggtgagcgcaatggttacctgaagggagttatcactgacatcattcacgatcccggccgtggtgctcctttggctcgcgtcactttccgccaccctttcaggtatcagcagcagaaggagcttttcatcgccgccgaagggatgtacactgggcagtttgtttactgcggcaagaaagctactcttgtggtcggaaatgtcttgcccctcagatccatccctgaaggagctgttgtctgcaacgtcgagcacaagatgggtgaccgcggtgtctttgctagggcttctggagactatgctatcgttatcagccacaaccctgataatggaaccacaaggattaagctcccatctggtgccaagaagattgtcccaagtgggtgccgtgccatgattggacaggtagccggaggcggacggactgagaagcctctccttaaggctggcaatgcttatcacaagtaccgtgtcaagaggaactgctggcctaaggttcgtggtgttgccatgaatcctgttgagcatccccatggtggtggtaaccatcaacatattggtcatgctagcacagttcgccgcgatgcaccacctgggcagaaggttggtcttattgctgcccgtagaactggtcgtcttcgtggtcaagcggctgctactgctgctaaagctgataagggtgcttagatgcagaaaagttatgttatggtgttattttttgttctgtttttagtggacttgcttattcagttggcacattttggaggcaaacaatactttagtactaaattttgtttggatttattgcgagaatttttatttaagcagttacagtatggaatgg

SEQ ID NO: 3389 - DNA, 1085 bp, Triphysaria pusilla
tctaaagggtgtcgtcaccgaggtcatccacgacccaggccgtggcgcgccgctagcacgggtccttttccgtcatcctttccgccaccagcaccagaaggagcctccactcgctcgccgttcttttttccttcctcctcaggcaactcacacagaaaaatgggtcgtgtgatcagggctcagcgtaagggagcaggctccgtcttcaagtcccacacccaccaccgcaagggccctgcccgattccgttccctcgacttcggcgagcgcaacggctacctaaagggtgtcgtcaccgaggtcatccacgacccaggccgtggcgcgccgctagcacgggtccttttccgtcatcctttccgccaccagcaccagaaggagctcttcgtcgccgccgagggcatgtacaccggccagttcgtgtactgtggtaagaaagccaaccttgtcgtcggtaacgtcttgcctatcagatctattcctgagggtgcagtcgtctgcaacgtcgaacatcatgttggggatcgaggtgttttcgctagggcttctggtgactatgctatcgttatctctcacaatcctgacaatggcacttcgaggattaagctcccctccggagccaagaaaatagtgccaagtggttgtcgtgctatggttgggcaggttgcgggaggtggacgtactgagaagccaatgttgaaggctggaaatgcgtaccacaagttcagagtgaagaggaactcatggcccaaggttcgtggtgttgctatgaatccagttgagcatcctcatggtggtggtaaccatcaacacattggtcacgccagtactgttcgtcgtgatgccccacctggacagaaggttggtcttattgctgcaaggaggactggtcgtctccgtggtcaagctgctgccacagctgctaaggccaaggaatgaggagtttgctcctgttactgtcttattttcagtttctattgaatcacattttgaatgttgaaagaccttattatgatggtatactagattttgtttggattctgaatgtcttatttaatgcatctaatatttggttacatttgatt

SEQ ID NO: 3390 - DNA, 1284 bp, Citrullus lanatus
ataacaccgcctgcgcctctcttccccttccccttccccatatctccgaaaaccctaattcccatcctccaatgggtcgtgttatcagagcacaacgtaagggagctggatcagtcttccgctctcacactcaccacaggaagggcgctgcccgtttccgctccctcgacttcggcgagcgaaatggttacctgaaaggtgtggtcagcgaaatcattcacgatccgggcagaggtgctccgttggcccgcgttactttccgccatcccttccgttacaagcaccagaaggaactgttcatcgccgctgagggtatgtacactggtcagtttgtgtactgtgggaaaaaggctaatcttgttgttggtaatgtgcttcccattagagccattcctgaaggtgctgtggtttgtaatgttgagcaccatgttggtgaccgaggtgtgttcgctagatgctctggtgattatgctattgttatcagccacaacccagataatgataccagcaggattaagctaccatctggagccaagaagattgtacctagcgggtgccgtgctatgattggtcaggttgctggaggaggaagaacagagaagcctcttctcaaggcaggtaatgcttaccacaagttccgtgtcaagcgtaactgctggcccaaggtacgtggtgttgctatgaatccagttgaacatccccatggtggtggtaaccatcaacacattggtcacgccagtactgtccgccgtgatgccccgcctggtcaaaaggttggtctcattgctgccagaagaactggtcggctccgaggacaggctgctgctactgctgccaaggccgacaaggcttagagcaattcaacctattcgcatattttgcctaatccttagatccattttcattatgtttgattggatttgcattatgttgaagaccatatttagaagtttttgtcctgagttttgttacaaatgtcctttttgaacataattgctctctaccttgtttcttgttgctatgatgaatttgatagcatgaacatcaaggtcatatctctcataaaggatctataatttaggtttttgatgacaggttctgggaagaacaatttctagccaactactgaaagcaatttacaaggatatcttaatttctaatatagttaatctttttataagatcttttcaacagaactacatctatggttctttaatactatgaatatctggtcacgagacaattcaactaacctataaggactggtttatttaattgaagctt

SEQ ID NO: 3391 - DNA, 819 bp, Flaveria ramosissima
atgggtcgcgtcatccgagccaacgtaagggagccggctccgtcttcaagtcccacacgcaccaccgcaagggtccggcgaggttccggagcctcgacttcggcgagcgcaacggctatctcaaaggcgtcatcaccgagatcatccacgaccccggccgcggtgctccgctcgctcgcgtcactttccggcacccgttccgatacaagcaccagaaggagctcttcattgctgctgaagggatgtacactggtcagtttgtgttttgtgggaagaaggcgaatttgatgggtggggaatgtgctgccgcttagatctattcctgaaggagctgtggtgtgtaatgttgagcatcatcgttggggatcgtgggtcgtttgcgagggcttctggggattatgcgattgttattagtcataatccggataatgggactactagagtgaagcttccatctggagcaaagaaaattgtgccaagcggatgtcgtgccatgattggtcaggttgcaggtggcggacgtacggagaagccaatgctgaaagctggtaatgcttatcacaagttccgtgtgaagagaaactgctggcccaaggttcgtggtgttgctatgaacccagttgaacatcctcatggtggtggtaaccatcaacatattggtcatgcgagtactgttcgccgtgatgcaccacccggtcaaaaggttggtctcattgccgctaggaggactggtcgtctcagaggtcaagctgccgccactgcagccaaggctgataagtaatagaaccaatagtatggatgttaatcttagtttttttt

SEQ ID NO: 3392 - DNA, 1053 bp, Vaccinium corymbosum
ccagccattacgccggggactccaccctctcctctctccttctccgccgctcccagatcctaacccagaaatgggtcgagtaatcagagctcagcgtaagggacccggatccgtattcaagtcccacacccaccaccgcaagggcccggcccggttccgcagcctcgacttcggcgagcgaaacgggtacctcaagggcgtcataacagagatcatccacgacccgggtcggggcgccccgttggcccgcgtcacgttccgacacccgtttcggttcaagcaccagaaggagctgttcatcgccgctgaagggatgtacactggtcaattcgtgttttgcgggaagaaggcgaatctgacggtgggaaatgttttgccgttgaggtcgattcctgagggaggagtggtttgtaacgttgagcatcatgtgggtgatcgtggggtcttggctagggcgtctggggattatgctattgttattagtcacaatcctgataacgatacttccaggatcaagcttccatctggggcaaagaagattgtgcctagtggctgccgagctatgattggtcaagttgccggtggaggcaggaccgagaagccacttctgaaggcagggaatgcatatcacaagtacagagtcaagagaaattgctggcctaaggttcgtggtgttgctatgaatccagtggagcatcctcacggaggtggtaaccaccagcacattgggcacgccagtacggtccgtcgtgacgctcctcctggccagaaggttggtctcatcgccgctaggaggactggtaggcttaggggacaagctgctgccactgctgccaaagcagacaagacttcttagagcgtggtgctataagagattccggtctttcataacttgcagtttgaattttatggttaatgttggttgtggaacttatgcacttaattccaccttattcgtgagactctctgcaattcctagtattatggaacttaaattgagtattggaacggagttttatatgttgtttcatggagtgtcacaattttcttttt

SEQ ID NO: 3393 - DNA, 926 bp, Medicago truncatula
gagatgggtagggttatcagggcacaacgtaaaggagcaggctccgttttcaagtcccacactcaccaccgcaaaggcccagcacgtttccgcagtcttgatttcggtgaaagaaacggttaccttaaaggagtagtgaacgaaatcattcacgacccaggtcgcggtgcaccactcgctaaggtcactttcagacacccttttaggtataagaaacagaaagagcttttcgttgctgctgagggactttacacaggacagtttatttattgtgggaaaaaagctactcttgttgttgggaatgttttgccattaaggatgattcctgaaggtgcggttatttgtaatgttgaacatcatgttggtgatcgtggtgcttttgctaggtgttctggtgattatgctattgttattagtcataatcctgataatgatacctaggattaagctaccatcaggggcaaagaagattgttccaagtgagtgcagagctatgattgggcaagttgcaggtggaggaagaactgagaagccaatgcttaaggctggtaatgcttaccacaaatttagggtgaagaggaattgctggcctaaggttcgtggtgtggctatgaatccagttgaacatcctcacggaggaggtaaccaccagcatattggacatgctagtactgttaggcgtgacgctcctcctggacagaaggttggtctcattgctgctaagagaactggtcgtctcaggggacaagctgcttccgctgctgctaaggctgattaacttattagactatttgaagagattcttagggttttattttgttgcaagattttgaaattttgtttgattccttgtttgttcgaaactacttgggtattattttgagatccttttgccccatttatttatatgaaacttttatatgaca

SEQ ID NO: 3394 - DNA, 1213 bp, Amborella trichopoda
ctagggtttcctcaaagggtcctcagccttatcgctttctctttttattctctctctgtgcttctctcccttaaggtctctgcagcttataggaacaagaatcataaggagcatcaacaccacaattagatatcatgggtcgtgtcatcagagcccagaggaagggtgccggctctgtgttcaagtcccacacccaccatcgcaagggcccagctcgtttccgtagtctcgactatggtgagcgcaatggttacctcaagggggtcgtgactgatgtcattcatgaccctggtcgtggagcaccactctgcaaagtctcatttcgccacccatttcgctacaagatccagaaggagctctttgtggcagcagagggaatgtacacaggtcagtttgtgtactgtggtaagaaggccaatctgattgttgggaatgtactccccttgcgttcaatccctgagggtgcggtcgtgtgcaacgttgagcaccatgctggggaccgtggatcctttgccagggcatctggggactattgcattgtgatcagccacaaccctgacaatggtaccaccaggatcaagctcccatcaggtgcaaagaaagtagtaccaagcgggtgccgtgccatgattggtcaagtagcaggcggtggaaggacagagaagcctctcctcaaggctgggaacgcataccacaagttcagagtgaagcgcaactgctggcctaaggtgcgtggtgtggccatgaacccagtcgagcatccccatggtggtggtaaccatcaacacattggtcatgccagtactgttaggagggatgctccccctggtcaaaaggttggtcttattgctgctagaagaactgggcgtcttcgtggacaggctgctgccactgcttccaaggccgacaaaggagcataatgcatttctttctcttgctgtttctcatttagtgttctttgttgccccctgtttctcttttgacattttgtctcgaattttgttgtttttgggagggcgagactaagaggattcttagtttagtggacatttatcagattttggttcatttgaatgcatgttttggttgaagatgttgagacttttcatctcttttgatagctcaagttgttatgactttatatccctcttggaggttgcatttataagtaatttagttaaaagtttcctcttttgtgaggcacttgtgatct

SEQ ID NO: 3395 - DNA, 1086 bp, Amborella trichopoda
  misc_feature (925)..(925): n is a, c, g, or t
  misc_feature (941)..(941): n is a, c, g, or t
  misc_feature (960)..(960): n is a, c, g, or t
cgagggaatcataaggagcatcaacaccacaattagatatcatgggtcgtgtcatcagagcccagaggaagggtgccggctctgtgttcaagtcccacacccaccatcgcaagggcccagctcgtttccgtagtctcgactatggtgagcgcaatggttacctcaagggggtcgtgactgatgtcattcatgaccctggtcgtggagcaccactctgcaaagtctcatttcgccacccatttcgctacaagatccagaaggagctctttgtggcagcagagggaatgtacacaggtcagtttgtgtactgtggtaagaaggccaatctgattgttgggaatgtactccccttgcgttcaatccctgagggtgcggtcgtgtgcaacgttgagcaccatgctggggaccgtggatcctttgccagggcatctggggactattgcattgtgatcagccacaaccctgacaatggtaccaccaggatcaagctcccatcaggtgcaaagaaagtagtaccaagcgggtgccgtgccatgattggtcaagtagcaggcggtggaaggacagagaagcctctcctcaaggctgggaacgcataccacaagttcagagtgaagcgcaactgctggcctaaggtgcgtggtgtggccatgaacccagtcgagcatccccatggtggtggtaaccatcaacacattggtcatgccagtactgttaggagggatgctccccctggtcaaaaggttggtcttattgctgctagaagaactgggcgtcttcgtggacaggctgctgccactgcttccaaggccgacaaaggagcataatgcatttctttctcttgctgtttctcatttagtgttctttgttgccccctgtttctcttttgacattttgtctcgaattttgttgtttttgggagggngagactaagaggattnttagtttagtggacatttntcagattttggttcatttgaatgcatgttttggttgaagatgttgaggcttttcatcttttttgatagctcaagttgttatgactttatatccctcttggaggttgcatttataagtaatttagtt

SEQ ID NO: 3396 - DNA, 1049 bp, Malus domestica
gcggccgctagcagcagacaacactcaccggagccatgggaagagtcatcagagctcagcgtaagggtgccggttccgtcttcaagtcgcacacccaccaccgcaagggtccggcccgattccggagcctcgacttcggcgagcgcaacggctacctcaagggcgtcgtcaccgagatcatccacgacccgggtcgcggtgccccgttggcccgtgtcagcttccgccaccccttccgttacaagaagcagaacgagctcttcgtcgccgccgagggcatctacaccggccagttcatttactgcgggaagaaggccaatttggtggtcggaaatgtgttgcctctcagatcgatcccggagggagctgtggtttgcaacgtcgagcaccatgtcggcgaccgtggaaccctagctagggcttctggtgattacgccgttgttatcagccacaaccctgataacgatacttccaggatcaaattgccctcgggtgccaagaagattgttcccagcgggtgccgtgctatgattgggcaggtagcagggggaggaagaactgaaaagccaatgctcaaggctggtaatgcttaccacaagttcagagtgaagaggaactgctggcctaaggttcgtggtgtggctatgaacccagttgagcatcctcacggaggaggtaatcaccagcatattggacatgcaagcacagtcaggcgtgatgctcctcctgggcagaaggttggtctcattgctgctaggagaactggtcgtctcagaggacaagctgctgcgaacatctctaaggcagataagtgatgagattacattttcgattttatctacattcgccgtgtttggaccgtgttatattttattcaacactagtttggagcattttgtggaggaaattttgtttggatggatcctttaatgtctgttgcttaatattcagtttaacagtctcaagatctgcaagttttggtaatgttgtggttttggtgcatattgaagctctaaacccttattattcatgaaattatattcaaaaaa

SEQ ID NO: 3397 - DNA, 1040 bp, Malus domestica
gctatcctgagccttataaacgcagacacaaattctagggtttttgggaacaccatttcgcgccgccgttagtagcagaaaaatcactcaccggcgctatggggagggtcatccgagctcagcgtaagggtgcgggttcggtgttcaagtctcacacccaccaccgaaagggtccggcgcgcttccggagcctcgacttcggcgagcgcaacggctacctcaagggtgtcgtcaccgagatcatccacgatcccggtcgcggtgccccgttggcccgcgtcagcttccgccatccgttcagatacaagaagcagaacgagctcttcgtcgccgccgagggaatctacaccggtcagttcatctactgtgggaagaaggccaatttggtcgtcggaaatgtgttgcctctcagatcgattccggagggagccgtcgtctgcaacgtcgagcaccatgtcggcgaccgcggaaccctcgctagggcgtctggtgattacgccgttgttatcagccacaaccctgacaacgatacttccaggatcaaattgccatctggtgccaagaagattgttcccagcggatgccgtgctatgattgggcaggtagcaggtggaggaagaacagaaaagccaatgctcaaggctggtaacgcttaccacaagttcagagtgaagaggaactgctggcccaaggttcgtggtgtggctatgaacccagtcgagcatcctcacggaggaggtaatcaccagcatattggacatgctagcacagtcaggcgtgacgctcctcctgggcagaaggttggtctcattgccgctaggaggactggtcgtctcagagggcaagctgctgccaacatatctaaggcagacaagtgatgagattacatcttcgtttatatcatgttttattttatccaagactagtttggtgcattttgtggaagaagttttgtttggttggattatttaatgtttgttgcttaacatactatgagttaaagaaatgttggtaaatgggttaaatatgatccaagctcg

SEQ ID NO: 3398 - DNA, 993 bp, Malus domestica
ggagcaatggggagagtcatcagagctcagcgtaagggtgccggctccgtcttcaagtcccacacccaccaccgcaagggtccggcgcgcttccggagcctcgacttcggcgagcgcaacggctacctcaagggcgtcgtcaccgagatcatccacgaccccggacgcggtgccccgttggcccgcgtcagcttccgccaccccttccgttacaagaagcagaacgagctcttcgtcgccgctgagggaatctacaccggccagttcatttactgcgggaagaaggccaacttggtggtcggaaatgtgttgcctctcagatcgatcccggagggagccgtcgtctgcaacgtcgagcaccatgtcggcgaccgtggaaccctagctagggcttctggtgattacgccgttgttatcagccacaaccctgataacgatacttccaggatcaaacttccgtctggagccaagaagattgttccaagtgggtgccgtgctatgattgggcaggttgcaggaggaggaagaacagaaaagccaatgctcaaggctggtaatgcttaccacaagttcagagtgaagaggaactgctggcccaaggttcgtggtgtggctatgaacccagtcgagcatcctcacggaggaggtaaccaccagcatattggacacgctagcactgtcaggcgtgacgctcctcccgggcagaaggttggtctcattgccgccaggaggacgggtcgtctcagaggacaagctgctgcaaacatctctaaggcagacaagtgaagaggcttttaagggatttacgttttctttgtttcctaagtttgctgtttcggaactgttttaatttacattcagtactagattggtgcatttttgttcggtctgaaccttttatgctttgatcaatgtatcatggttgtaacagtcaaaaccttttcatgttgtcatatggttcttgttctgtccgctgaagttccagttgtacgt

SEQ ID NO: 3399 - DNA, 891 bp, Arabidopsis lyrata
attcgccgtaatctggagaagacgaagacgaagcaaatctccgtaattatccatgggtcgtgttatcagagctcaacgtaagggagctggttccgtcttcaaatcccacactcaccaccgtaaaggtccggccaaattcagaagcctcgatttcggcgagagaaatggttatctcaaaggtgtcgtgacggagatcattcacgatccaggacgtggtgctccattagctcgtgtagctttccgtcatcctttccgattcaagaagcagaaggagcttttcgttgctgctgaaggtatgtacaccggtcagtttctttactgtgggaagaaagctactctcgtcgtcggaaatgttcttcctctcagatctatccctgaaggagctgttgtttgtaacgttgagcatcatgttggtgatcgtggtgttttcgctagagcttctggtgattacgccattgttattgctcacaatcctgataacgacaccagcaggattaagttgccatcgggttcgaagaagattgtaccaagtggatgcagggctatgattggtcaagttgcaggtggtggaagaacagagaagccaatgcttaaggctggtaacgcataccacaagtaccgtgtgaagagaaattgctggcctaaggttcgtggtgtggctatgaatccagttgagcatcctcacggaggaggtaaccatcaacatattggtcatgcaagtactgttcgtcgtgatgcaccacctggacaaaaggttggtcttattgctgcaaggaggactggtcgtctcagaggtcaagctgctgctcttgcttccaaggcagactaaggagagaaggattcaagatgaaacttttcacttttttgggatttttgttgagaccttgtttt

SEQ ID NO: 3400 - DNA, 918 bp, Brassica juncea
catgggtcgtgtcatcagagctcaacgtaagggagcaggctccgtcttcaagtcccacacccaccaccgcaagggccccgccaagttcaggagcctcgacttcggcgagagaaatggttacctcaagggtgtcgtcacggagatcatccacgacccgggacgtggtgctccgttagctcgcgtctccttccgtcatcctttccgttacaagaagcagaaggagctcttcgtcgccgccgaaggtatgtacaccggacagtttctgtactgcggtaagaaggccactctcgttgtcggaaatgttctgcctctcagatctatccctgagggagctgttgtctgcaatgtcgagcaccatgttggtgatcgtggggtgttcgctagagcttctggtgattacgctatcgttattgctcacaatcccgacaacgacacaacaagggttaagttgccatctggttcgaagaagattgtaccaagtggttgcagggctatgattggtcaagttgctggtggtggaaggacggagaagccgatgctcaaggcgggtaacgcgtaccacaagtaccgtgtgaagagaaactgctggcctaaggttcgtggtgtggctatgaatccagttgagcatcctcacggaggaggtaaccatcagcacattggtcacgcaagtacggttaggcgtgatgcaccaccagggcagaaggttggtcttattgctgctaggaggactggtcgtctcagaggtcaagctgctgcttctgctgccaaggctgactagttttaagatacttgtttgagttttgttgtatttccttttggaccttgttgtgttctgaaatctcaaaacgattttgttataatcttgtccttctctgtcgaagttattatgcctttgcaattttcatttcacatttttta

SEQ ID NO: 3401 - DNA, 1183 bp, Centaurea maculosa
  misc_feature (27)..(28): n is a, c, g, or t
  misc_feature (42)..(43): n is a, c, g, or t
  misc_feature (96)..(96): n is a, c, g, or t
  misc_feature (114)..(114): n is a, c, g, or t
  misc_feature (171)..(171): n is a, c, g, or t
  misc_feature (177)..(177): n is a, c, g, or t
  misc_feature (279)..(279): n is a, c, g, or t
  misc_feature (285)..(285): n is a, c, g, or t
  misc_feature (366)..(366): n is a, c, g, or t
  misc_feature (384)..(384): n is a, c, g, or t
  misc_feature (403)..(403): n is a, c, g, or t
  misc_feature (426)..(426): n is a, c, g, or t
  misc_feature (429)..(429): n is a, c, g, or t
  misc_feature (483)..(483): n is a, c, g, or t
  misc_feature (489)..(489): n is a, c, g, or t
  misc_feature (491)..(491): n is a, c, g, or t
  misc_feature (498)..(498): n is a, c, g, or t
  misc_feature (504)..(504): n is a, c, g, or t
  misc_feature (510)..(510): n is a, c, g, or t
  misc_feature (540)..(541): n is a, c, g, or t
  misc_feature (543)..(543): n is a, c, g, or t
  misc_feature (555)..(555): n is a, c, g, or t
  misc_feature (609)..(609): n is a, c, g, or t
  misc_feature (659)..(659): n is a, c, g, or t
cgggggcgccaaccctagagagagagnnagagagagagaganngagttgcagaaatgggacgtgtgattagggcacagcgtaagggagcaggttcngtcttcaagtcccacacncaccaccgcaagggtccggcgaggttcagaagcctcgatttcggcgagcgcaatggntacctnaaaggagtcatcaccgagatcatccacgatcccggccgtggtgctccccttgctcgcgtcactttccggcatccgttccggtacaagcaccagaaggagctnttcgtngccgccgaaggcatgtacaccggccagtttgtgttttgcggtaagaaggctaacctcatggtcggaaacgtgcttcctctnagatctattcctgaaggngctgttgtttgcaacgtcnagcatcacgtcggtgatagaggntcnttcgctagggcttctggtgattacgccattgttatcagtcacaatcctgataanggaacnantagggtnaagctnccatcnggtgccaagaaaatcgtgccaagtgggtgnngngccatgattggncaggttgccggtggtggacgtaccgagaagccaatgctgaaggctggtaacgcntatcacaagttccgtgtgaagaggaactgctggcctaaggttcgtggtgnggctatgaatcccgttgagcatccccatggtggtggtaaccatcaacatattggtcacgcaagtaccgttcgtcgtgacgcaccacccggtcaaaaggttggtcttattgctgctaggaggactggtcggctcagaggtcaagctgccgctactgctgctaaggataagtagaacaacatttctttcgagtatgatggtatgtgttttttttggatattttcttcggatcaagaattactgtcttcgtgtgttggttatccagaaattatcgtagttcagttttgtctaagtgttacatttaaggattaatttacagattttgttatccatttctgaaagctatgctattgtttgtttgtttccgttaatggagagtggaggtgcacaaatagtcgatgtctgtagcccagccatggttagaagagcctggacttaggctgtgtttggcaaacataagctagctgataagctagtccatccaaacatgtaccagaagctagctttttgaaacgttactttgagc

SEQ ID NO: 3402 - DNA, 797 bp, Cirsium arvense
gaaaaatgggtagagtcatcagagcacagcgtaagggagcaggctccgtcttcaaatcccacactcaccaccgcaaaggtccggcgaggttcagaagcctcgatttcggcgagcgaaacggctacctgaaaggagtcatcaccgagatcatccacgatcccggccgtggtgctccgttggctcgcgtcaccttccggcatccgttccggtacaagcaccagaaggagctgttcgtggccgccgaagggatgtacaccggccagttcgtgttctgtggaaagaaggcgaatttgatggttggaaacgtgcttccgcttaggtctattcctgaaggagctgttgtgtgtaatgtggagcatcatgttggagatcgtggttcgtttgctagggcttctggtgattatgcgattgtgatcagtcataatccggataatggaaccactagagtcaagcttccatcaggagccaagaagatcgtacccagtgggtgccgagccatgattggccaggttgctggcggtggacgtactgagaagcccatgctcaaagctggtaacgcttaccataaattccgtgttaagagaaactgctggcctaaggttcgtggtgtggctatgaatcccgttgagcatccccatggtggtggtaaccatcaacatattggtcacgccagtaccgtccgtcgtgatgcaccacccggtcaaaaggtcggtctcattgccgctaggaggactggtcgtcttagaggtcaagctgccgctactgcctccaaggagaagtgataagtcaagtctatg

SEQ ID NO: 3403 - DNA, 1020 bp, Cleome spinosa
aacttgaggatagcagaaacggtcgtcgtcggcggcgatgggtcgtgtaatccgtgcacagcgtaagggtgctggttcggtcttcaagtcccacacgcatcaccgtaaaggtccggctaagtttcggagcctggacttcggggaacgtaatggttatctgaagggtgtcgtgacggagatcatccacgatccaggtcgtggagctcctctcgctcgcgtcgttttccgtcatccttttcggtacaagaagcagaaggagctgttcgtggcggccgagggtatgtataccggtcagttcgtctactgtggtaagagggcatctcttgttgttggcaacgttcttcctcttaggtccattcctgagggagctgtcgtttgcaatgtcgagcaccatgtcggtgatcgtggtgtgttcgctagagcttccggcgattacgccattgttatcgcccacaatcctgataacgataccactaggatcaagctcccgtctgggtcaaagaagattgtgccgagcggctgcagagccatgattggccaagttgcgggtggaggaaggactgagaagcccctcctcaaggctggaaatgcataccacaagttcagagtgaagagaaactgctggccgaaggtacgtggtgttgcgatgaatccagttgaacatccccatggaggaggtaaccaccagcacattggtcacgccagtacagtcagacgcgatgcccctcctggtcaaaaggtgggtctcatcgctgccaggagaaccggccgtctcagaggtcaagccgctgccacagctgccaaggccgactaggcttgattgtttcacaggtaacagtctcccctgctctctcttggttttgtttattgggttgttactgttttttttctcagaggcttttttagggccactctctcttgtattttactttagaacaaagtttttggacattggaactttgttaactttttgttctttgtattctgtggtatgaagaaagagtgttgcgttaaaaaaaa

SEQ ID NO: 3404 - DNA, 1073 bp, Coffea canephora
cagccgccccattcccctgtcccctcaacccgaacccccaaaatgggtcgtgtgatccgagctcaacgtaagggagcacgctccgtcttcaaatcccacacccaccaccgcaagggccccgcccgcttccgttctctggactttggcgagcgcaacggctacttgaaaggagtcgtcaacgaaatcattcacgacccgggtcgcggtgccccgttagcccgtgtcagtttccgccaccctttccgtcaccagcaacagaaggagttgttcgttgccgccgaaggaatgtttactgggcaattcgtttactgcgggaagaaagctactttgatggtcggaaatgttttgcccctcagatccatccctgaaggagctgtggtttgcaacgtggagcataagatgggtgaccgtggtgtctttgctagagcctctggtgattatgctatcgttatcagtcacaaccctgataacggaaccactaggatcaagcttccatctggagctaagaagattgtgcccagtgggtgccgtgctatgattggtcaggttgctggaggtggacgtactgagaagccccttcttaaggctggtaatgcttaccacaagtaccgtgtgaagaggaactgctggcctaaggttcgtggtgttgctatgaatcctgtggaacatcctcatggtggtggtaaccatcaacatattggtcatgctagcacagttcgccgtgatgcaccacctggtcaaaaggttggtcttattgccgcacgtaggactggtcgtctccgaggtcaagctgccgctacagctgccaaagctgataaggcttaagcgaattaaaggatgcagagatttttatttttgttatcattttccgttgtgttgtgttctagagagacttgcctattcagttcagatgttgacattgtcattgcaagagtatagcactaaattttggttggatctttggttatgatttttgtttcagcggttcttattagatgaatgttccatatttggttcaatttgttggcttaatagtactttgaaaactgggtacactgtggtgcacctaatgt

SEQ ID NO: 3405 - DNA, 1044 bp, Eschscholzia californica
agagagagagagagatgggtagagtgattcgagctcaacgtaagggagcaggatcagtcttcaagtcacatactcaccaccgtaaaggtccggccagattccgcagtctcgattttggagagagaaatggatacctcaagggagtcatcactgaaatcattcacgatccaggtcgtggtgcgccgctagctcggatcactttccgtcaccctttccgatacaagcaccagaaagaactctttgtagcggcggaagggatgtatactggtcaatttgtttactgtgggaagaaggcaaatctcatggttggtaatgttcttccacttagatcaatccctgaaggagctgttgtctgtaacgtcgaacatcatgttggtgatagaggtgttttagctagggcttctggtgattacgctattgttatcagtcataaccctgataatggaacctccaggattaagcttccatcaggatctaagaagattgtaccaagtgggtgccgtgccatgataggtcaggtagctggtggtggtagaacagagaagcctatgttgaaggctggaaacgcatatcacaagttcagagtgaagaggaactcatggcccaaggttcgtggtgttgctatgaatccagtagagcatcctcatggtggtggtaaccaccaacatatcggtcacgccagtacggttcgacgtgatgcacctccaggacaaaaggttggtctcattgctgccagaagaactggacgtctccgtggtcaagctgctgcatctgcttctaaggctgattaggcttagaagtcttatataaagtatatggtgtttccccttttaatttaagagacaagttctgtttttcaagttgacatttaatgttagtttaagagaggatatgttgaagttttgcttgggaactagtccatgcttttggttcgaatcactagatatttctctttgatgttagtggttgtcttttgatgctaatggttgttggtcatttgggtacgtctgcaaactatggttaatgtagcaaatgtggatacag

SEQ ID NO: 3406 - DNA, 1042 bp, Eschscholzia californica
aagagagagagagagatgggtagagtgattcgagctcaacgtaagggagcaggatcagtcttcaagtcacatactcaccaccgtaaaggtccggccagattccgcagtctcgattttggagagagaaatggatacctcaagggagtcatcactgaaatcattcacgatccaggtcgtggtgcgccgctagctcggatcactttccgtcaccctttccgatacaaacaccagaaagaactctttgtcgcggcggaagggatgtatactggtcaatttgtttactgtggaaagaaggcaaatctcatggttggtaatgttcttccacttagatcaatccctgaaggagctgttgtctgtaacgtcgaacatcatgttggtgatagaggtgttttagctagggcttctggtgattacgctattgttatcagtcataaccctgataatggaacctccaggattaagcttccatcaggatctaagaagattgtaccaagtgggtgtcgtgccatgataggtcaggtagctggtggtggtagaacagagaagcctatgttgaaggctggaaacgcatatcacaagttcagagtgaagaggaactcatggcccaaggttcgtggtgttgctatgaatccagtagagcatcctcatggtggtggtaaccaccaacatatcggtcatgccagtacggttcgacgtgatgcacctccaggacaaaaggttggtcttattgctgccagaaggactggacgtctccgtggtcaagctgctgcatctgcttctaaggctgattaggcttagaagtcttatataaagtatatggtgtttccccttttaatttaagagacaagttctgtttttcaagttgacatttaatgttagtttaagagaggatatgttgaagttttgcttgggaactagtccatgcttttggttcgaatcattagatatttctctttgatgttagtggttgtcttttgatgctaatggttgttggtcatttgggtacgtctgcaaactatggttaatgtagcaaatgtggata

SEQ ID NO: 3407 - DNA, 995 bp, Euonymus alatus
ggggcggccgttctcctttacctcacccctcaaaaccctagtttctcagtttctgtcagcgatgggtcgagttatccgtgcccaacgaaagggtgccggctccattttcaagtcgcacacccaccaccgcaagggtcctgctcgtttccgttctctcgactatggcgagcgcaacggatacctgaggggtgttgtctctgaaatcatccacgatccgggtcgtggtgctcctcttgctcgtgttgtgttccgccacccattccgttacaagcatcagaaggagctcttcgtcgccgctgagggtatgtacaccggccaattcatctactgtggcaagaaggctaacttgatggttggaaatgttcttcccctcagagctattcctgagggtgctgtcgtctgcaatgttgagcaccatgttggtgaccgtggcgttttggctagggcttctggtgactatgctattgttatcagtcacaaccctgataatggaacttccagaatcaagcttccttctggagcaaagaagattgtgccaagtgggtgcagagctatgattggtcaggttgcaggtggtggcaggactgagaagccaatgctgaaggcaggtaacgcatatcacaaataccgcgtgaagcgaaactgctggcctaaggttcgtggtgttgccatgaatccagttgaacatccccatggtggtggtaaccaccagcatattgggcatgctagtaccgttagccgttatgctccgcctgggcagaaggtgggtcttattgctgcaagaaggactggtcgtcttcggggacaagctgctgctgctgcttcaaaatctgactagggttcttaaattgttttgctttggattttgtgtttgggaactatgttatttttgacatctagcaagtggagtatttgtgttgttcctacggaggttcttgtttccaagttttggaatttggaatgatgttgatcgtctttgggatttaactgttata

SEQ ID NO: 3408 - DNA, 983 bp, Euonymus alatus
aaccctagcgctagactctcatattctttgccatgggtcgcgtcatccgagcacagcgtaagggtgccggctcgattttcaagtcccacacccatcaccgcaagggtccggcgcgttttcgctcgctcgacttcggtgagcgcaacggttacttgaggggtgtggtatcggagatcattcacgatccgggtcgcggtgctccgcttgctcgtgtcgtgttccgccatcccttccgttacaagcatcagaaggagctcttcgtcgccgctgagggtatgtacaccggccaattcatctactgtggcaagaaggctaacttgatggttggaaatgttcttcccctcagagctattcctgagggtgctgtcgtctgcaatgttgagcaccatgttggtgaccgtggcgttttggctagggcttctggtgactatgctattgttatcagtcacaaccctgataatggaacttccagaatcaagcttccttctggagcaaagaagattgtgccaagtgggtgcagagctatgattggccaggttgcaggtggtggcaggactgagaagccgatgctgaaggcaggtaatgcttatcacaagtaccgcgtgaagaggaactgctggcctaaggttcgtggtgtggctatgaatcctgttgagcatccccatggtggtggtaaccaccaacatattgggcatgctagcactgtttctcgctttgctcctcccggtcagaaagttggtcttattgctgcccgaaggacaggtcgtctgcgaggacaagctgccgctgctgcttcaaaagcagactagggtgcttaagtttgtttgctattttgatttgtcttcgcatactatgttatttttggtatcttgcaggttgattactattgtgttcctatcgaagggtcttgtttccatgtctaggacttctgtttgttgtcgtgggatttaatggtttatcttttacaatatattactttcaag

SEQ ID NO: 3409 - DNA, 873 bp, Flaveria ramosissima
cgagtcatcagagcccagcgtaagggtgcaggctccgtcttcaggtcccacacgcaccaccgcaagggtccggcgaggttccgcagcctcgacttcggtgagcgcaacggctacctcaaaggcgtcatcaccgagatcattcacgaccccggccgcggtgcgccgcttgctcgcgtgactttccggcacccgttccgatacaagcaccagaaggagcttttcgttgctgctgaggggatgtatactggtcaatttgtgttttgtgggaagaaggcgaatttgatggtgggcaatgtgctgccgcttagatctattcctgaaggagctgtggtgtgcaacgtggagcatcatgttggggatcggggctcgtttgctagggcttctggggattatgcgattgttataagtcataatcctgataatggtaccactagagtgaagcttccatctggagccaagaaaattgtgccaagtggatgccgtgcgatgattggtcaggttgctggtggaggacgtaccgagaagccaatgctgaaagctggtaatgcttatcacaagttccgtgtgaagagaaactgctggcctaaggttcgtggtgttgctatgaacccagtggagcatccccatggtggtggtaaccatcaacacattggtcatgccagtaccgttcgtcgtgatgcaccacctggtcaaaaggttggtcttattgccgctaggaggactggtcgtctcaggggtcaagctgccgccactgctgccaaggctgataagtaataaagtgctgtcatggatcttgaatttagttttggtgtctttggatctgttacttctattgttagtttctttcagtttacctgctattgttgtgtttgt

SEQ ID NO: 3410 - DNA, 977 bp, Cucumis melo
aggatcgctgcggtaccgaactgaaaatctccgatctcgcggagccgccatgggaagagtcattcgtgctcaacgtaagggagcgggatctgtcttcaggtcccatacacatcatcggaagggtccggccaggtttagaagtcttgatttcggcgaacgaaatggttatctgaaaggagtcgtcactgagattattcacgatcctggccgtggagcgccacttgctcgagtttccttccgccatcctttcaggtataagaaacagaatgagctgttcgttgcggccgagggtatgtacactggccaatttgtttactgcgggaagaaagcaaatcttgtggttggaaatgtcttgcccatcaggtcgatccctgaaggtgccgtcgtctgcaacgttgaacaccatgttggtgatcgtggtgtttttgccaggtgttcgggagactacgctattgttatcagtcacaatcccgataacgacacatccaggatcaagcttccatccggtgcgaagaaaatagttccaagtgggtgccgtgccatggttggtcaggttgcaggtggaggcaggactgagaagcccctcttgaaggctggtaatgcttaccataaatttagagtgaagaggaactgctggccgaaggtccgtggtgttgcaatgaatcccgttgagcatcctcatggaggaggtaaccatcaacacattggacatgccagcacagtcagacgggatgctcctccgggtcaaaaggttggtctcattgcagcaagaagaactggtaggctcagaggacaagctgcagcaactgccgctaaagccgataaggcatagacagtattataatttagattgttacttcggttttgagatcatttcattttacttttatctatcaatttttccaagactagtcgtgtacgaccaatataactttttgagaaactgttatcgagttcctgtcttcacaaatttgaaa

SEQ ID NO: 3411 - DNA, 1020 bp, Tropaeolum majus
gcccacaaaccctatatctccatcccgaccccctaaccattttcgcagcacagaactacatttcttcccaatgggtagagtcatcagagcacagaggaagggagcagggtctgtattcaagtcccacactcaccaccgtaagggtcctgcacgtttccgtagtctcgatttcggtgagcgaaatggatacctcaagggtgttgtgaccgagattatccatgaccctggtagaggtgctccattggctcgtgtctctttccgccaccccttccgttacaagaagcagaaggagctttttgttgcatctgaaggtatgtataccggtcagtttctgtactgtggaaagcgggcgaatctcgttgttggaaacgttctgcctcttagatccattccagagggagcggtagtttgcaatgttgagcaccatgtgggtgaccgcggtgtctttgccagagcatctggtgattacgcagttgttgtcagccacaatcctgataatgacacttccagaatcaagctcccatcaggttcaaagaagatcgtccccagtggttgccgtgctatgatcggtcaaattgccggaggaggaagaacagagaagccaatgctcaaggcgggtaacgcttaccacaaattcagagtgaagaggaactgctggcctaaggttcgtggtgttgctatgaatccagttgagcatccccacggaggaggtaaccaccagcacattggtcatgcctctacagtcagacgtgatgcaccaccaggacaaaaggttggtcttattgctgcaaggaggaccggtagactcagaggacaagccgccgcaaccgcctcaaaggagaaagcttaagcctaatattttgttttggtttcttccatcttttcttagatcttatttaaagaagactactttatgctactttgaattagtttttggaagttttgttctgaatttatgctctccttatttaaaaatgctttgaatataattacatgttttgattccaaaaaaaaaaaaaa

SEQ ID NO: 3412 - DNA, 966 bp, Nicotiana benthamiana
  misc_feature (153)..(153): n is a, c, g, or t
  misc_feature (165)..(165): n is a, c, g, or t
  misc_feature (503)..(503): n is a, c, g, or t
  misc_feature (519)..(519): n is a, c, g, or t
  misc_feature (541)..(541): n is a, c, g, or t
  misc_feature (584)..(584): n is a, c, g, or t
gcacgagggagagagaggagacggcgaaatgggtcgtgtgatcagagcacaacgtaagggagcagggtcagtcttcaagtcccatacccaccaccggaaaggccctgcccgattccgttccctggacttcggcgaacggaatggttacctcangtggtgtcatancggaggttattcatgatccaggtaggggtgccccattggcgcgtatcactttccgtcacccgttccgttacaagcaccagaaggaactgttcgtggctgctgagggtatgtacactggccagttcgtttactgtgggaagaaggctactctcatggttgggaatgttctcccactcagatctgtccctgaaggagctgtcgtctgcaatgtggaacacaaggttggtgaccgtggcgtttttgccagatgctctggtgattatgctattgtcatcagtcacaaccccgataacggaaccactaggattaagcttccatcaggatccaagaagattgtncccagtgggtgtcgtnccatgattggtcaagtagctgnaggaggacgtactgagaaaccaatgcttaaggctggtaacgcntaccacaagtaccgggtaaagaggaactgctggcccaaggttcgtggtgttgccatgaaccctgtggaacatcctcatggtggtggtaaccatcaacatattggtcatgctagtactgtccgtcgtgatgcaccacccggccaaaaggtcggtcttattgctgcaaggaggactggtcgtcttcgtggtcaagctgctgctacaactgccaaggctgacaaagcttaaaaagtttagcttgctactgtttttccctacttgtttcctgattaagactttttatttaactatttggtgctgaatattatactaaattttgtggggatattgagtagcaaattttgttttagatatccatatttggggccaagtttcccaaaga

SEQ ID NO: 3413 - DNA, 994 bp, Carica papaya
accctaaaccttctttctctcatttctcagtttcacgcccgtccaaatggggcgagttattcgtgctcagaggaagggtgccggctccgttttcaagtcccacacgcaccaccggaagggacctgcccgcttccgtagtctggacttcggcgagcgcaatggttacttaaaaggtgtggtgacggagatcctgcacgatcctggccgtggtgcccctcttgctcgcatcacttttcgccatcctttccgctacaagaagcagaaggagcttttcatcgccgctgaaggtatgtatactggccagtttgtgtactgcggtaagaaggctaacttgatggtcggaaacgttcttcctctacgatcaatccctgaaggtgccgttgtctgcaacgtcgagcaccacgtcggtgatcgtggcgttctcgctagggcttctggtgattacgctattgtcatcagtcacaaccccgataacgacactaccaggatcaagctcccatctggttctaagaagattgttccaagtgggtgccgagccatgattggtcaggttgctggtggaggaaggactgagaagcctcttctcaaggctggaaatgcttatcacaagttcaaggtgaagaggaactgctggcctaaggtccgtggtgtagctatgaacccagttgagcatcctcacggaggaggtaaccaccagcatattggtcatgccagtaccgttagacgtgatgctcctcctggccagaaggttggtcttattgctgcaaggagaacaggtcgtctcagaggacaagctgcagctactgccgcaaagtcggacaaggcttagagagtggtattccttggctgcttgcattttttggtttacgttggttagagatctttataagacaatctgctaagctgtagaagttttgttgaattgcgaagctacactgaaattgaactattttatgagttgatttgaaatatagctacatgttttgttgggata

SEQ ID NO: 3414 - DNA, 2187 bp, Papaver somniferum
aactaagaagaatattgtatttttaagtacataatcaacagagtgaccacatataatagtacattacaagaaaataactgaaaggacatgcacacaatcgtctagaaacaaagcaaatggtaaaacaacaatcaatctttgacaataacaaaagaggccttcacctctatttcgttgaactagtctgacaaaaaccaatatcttcaccctccttatttatgttttccgccgaagaggatctatttagaattgggttggggtgctataacaaatactatgagtagagataccgtagcttaagaggatgcatccttttccgtctttgttgggttgaacgcttgctgttccgcgcagctaaggttatcattatctgtagctgcatctgctgcaccaactcccatcagatcaaggtaatagcggtagtgggaaacgatgacgttcatgtcatcgatatcaccttgaccacaaatttgatcaccatagagaatgttcattgtggttccgaaaccaggaagcctcttggccaaagtgtcgttcttggtaggcttccagtctccaacaaaagcttggtggggtgaaggttggtttttcttgattggtgtcatccacttccacatagcagcttggaaggcaatggtggcgttttgttctaggtattcaggatggttcaacagatccacctttattccatcaccgatagctccgtagttgaagttccagtaaacaggaagagcaccacgaccatagtattcagcaccaggagcacaaggatagagataaccatctctacagtaagactggctaggactcatctcccgtttgtaacaaagtccccaagctaaaggaccaccagtagcaacaccataaccacaagaacttttagcaccaacatgacctaaaaatgctgcaacttctttcatttgcatcttttcccaccagtagtaccaaatccaagtctttgaaaatcaatagaagcggtaataaatgactgataatcataaaagccaacagcttgagctgtgggtgcgtttctctttgagaataagttctcaaattgataagattggaagaaatctgaaattgtttgattacaacagtaaattgaattcttgcattcccatttattagtactggtacaaagtttctcctttgcttccacatttacagagactactgaaattaccaccattatcatgaaaacccatttgatacccatttctttaaaatcccagtgaagggatttggatttgagtttgcttgtactggagattttgctttggatgaaagaaagaaagaaagaggaaaaatggaggtgaagaagaagaaaaggagctggatctgtattcaagtcccatactcatcatcgtaagggacctgcaagattcaggagtttagattttggtgaaagaaatggttacttgaaaggtgtagttactgaaatcattcatgatccaggacgtggtgcaccgttagccagagttactttccgtcatccatttaggtacaagcatcagaaagagttgtttgttgcagctgagggtatgtatactggtcagtttttgtactgtgggaagaaagctaatctgatggttggtaatgttttgccattgagatcaattcctgaaggagctgttgtttgcaatgttgaacatcatgttggtgatagaggtactttggctagagcttctggtgattatgctattgttatcagtcacaaccctgataacggaacctcaagaatcaagcttccttctggtgccaagaagattgtaccaagtggctgccgtgctatgattggccaagttgctggtggaggtaggactgagaagcccatgttaaaggcaggaaatgcataccacaagtacagagtgaagagaaacagctggcctaaggttcgtggtgtggctatgaatccagttgagcatccccatggaggaggtaaccatcaacatattggacatgccagtactgttcgtcgtgatgcacctcctggtcaaaaggttggtctcattgctgccaggagaactggtcgtcttcgtggacaggctgctgctactgctgctaaggcagataaggcttaagttagattataatattttctggatctcttttttgatacattttgttgctaagtcttggataatagtctacattgagggaagtagtttcagaaagaattgaagttgt

SEQ ID NO: 3415 - DNA, 968 bp, Sequoia sempervirens
cgaaaatgggtcgcgtgattagagcgcagaggaagggagcaggttccgtgttcaaatcccacacacatcacagaaagggacctgcgcgctttcgcagtttggattacggcgagcgaaatgggtacctgaaaggcattgttacagaagtcgttcacgaccccgggcgcggcgctcccctctgccgcgtcaacttcaggcatcccttccgttacaggcagcagaaggagctatttatcgccgccgagggtatgtatactggccagtttatttactgcggtaagaaggccaatttgactgtggggaatgtcttgcctctgagatctattcctgagggcgctgttgtttgtaacgtggaacagcatgtgggcgatcgtggctcctttgccagggcttctggagattatgccatcgtcatcagtcacaaccctgataatggaacttccagggtaaaacttccatctggagctaagaagattgtgccaagtagttgcagggccatgattgggcaggttgctggtggtggaaggacagaaaagccaatgctcaaagctggaaatgcatatcacaaatatagggtcaaaagaaactgttggcccaaggttcgtggtgtggcaatgaaccctgttgagcatcctcatggtggtggtaatcatcaacacattgggcatgccagtaccgtgcgtcgtgatgctcccccaggacaaaaagttggtctcattgctgctaggagaactgggcgtctacgcgggcaggctgcaacagcagctgcaaagacagacaaggcttagcatgcacgcctactcaatcataattaaataattatagagttactgattatgcaagaatgccatttaatttctttttttcttcaggttgttttgtgtcatcaatttatggggaccaggctataaaccttgtttcccattattgtttcttatcattaggggtttactcttgattcaaaatcg

SEQ ID NO: 3416 - DNA, 1099 bp, Fragaria vesca
gcagagagaaccagagagagtaagagagagatgggacgagtcatcagagctcagcgtaagggtgccggctccgtcttcaagtcccacacccaccaccgcaagggccccgcccgcttccgctccctcgacttcggcgagcgcaacggctacctcaagggcgtcgtcaccgacatcatccacgaccccggccgtggcgcaccgctcgctcgtgtcagcttccgtcatcctttccgctacaagaagcagaacgagctcttcgtcgccgctgagggcatttacaccggtcagtttatttactgcggtaagaaggctaatttggtcgtcgggaatgttttgccgatcagatctatccccgagggagccgtcgtctgcaacgtcgagcaccacgtcggcgaccgtggtaccctcgctagggcttctggtgattatgctgttgttatcagccacaatcctgataacgatacttccaggatcaagcttccatctggtgccaagaaaattgttccaagtggatgccgtgctatgattgggcaggttgcagggggtggaagaacagagaagcctatgctcaaggctggtaatgcctaccacaagttcagggtgaagagaaactgctggcctaaggtgcgtggtgtggctatgaatcccgttgagcatcctcacggaggaggtaaccaccagcatattggtcatgctagcacagtcaggcgtgatgctcctcctgggcagaaggttggtctcattgctgccaggagaactggtcgtctcagaggacaagctgcagcaactgcctccaaggagaagtagagttgattttacatctacatgttatgtttatttgagtgccattaggaagaaaactaccgcttcttttgatctaaatttactgttttggaagaaccgcataattttaccgtagactacctaccgagtgcattttgtggtatgagttgctcttctgttccatccttttatgccttttcttggagatatctgttttttttacttccatgagttagtaatctttagtgtttgatacttgtcttaagcttctgtatttctttgcgagtattaaacaaatctttcatgacacaatgta

SEQ ID NO: 3417 - DNA, 1066 bp, Fragaria vesca
gagtgccgcccccctgttactctttcactacagagagagcaaaaccctagctcttccgccaccaatgggacgcgtcatcagagctcaacgtaagggtgcgggttccgtcttcaagtcccacacccaccaccgcaaaggccccgcccgcttccgctccctcgacttcggcgagcgcaacggctacctcaagggcgtcgtcaccgacatcatccacgaccccggacgcggtgcgccgctcgctcgcgtcagcttccgtcatcctttccgctacaagaagcagaacgagctgttcgtcgccgccgagggcatttacaccggccagtttatttactgcggtaagaaggccaatttggtcgtcggaaatgtgctgccgatcagatctattcccgagggagctgtggtgtgtaacgtggagcatcatgttggggaccgcggaaccctagctagggcgtctggggattatgctgtggttatcagtcacaaccctgataatgatacctcgagaatcaagcttccttctggtgccaagaagattgttccaagtgggtgccgtgctatgattggtcaagttgcaggtggaggcagaactgagaagcctatgctcaaggccggtaatgcttaccacaagttcagagtgaagaggaactgctggcctaaggtgcgtggtgtggctatgaatcctgttgagcatcctcatggaggaggtaaccaccagcatattggtcatgctagcacagtcaggcgtgatgctcctcctgggcagaaggttggtctgattgctgccaggagaactggtcgtctcagaggacaagctgccgcaacagcctccaaggagaagtagggttgatttttacattttagatgttctgtttatttggttctgttttggtaccggatattttgcgcaatatatttttatcatgttctatcttgtgctttctgttggagaaattttgtttatcaagaatcaggattcctataatttcactactattgtttattttctctttaagtattactgtattagattttatcgcattctgtgtgaggttctttccgggatgct

SEQ ID NO: 3418 - DNA, 1109 bp, Triphysaria pusilla
ggggcccgccgtttatattcctcgtctccccaaaccacactcttccacacacaaaaaaatgggtcgtgtgatcagggctcaacgtaagggagcaggctccgtcttcaagtcccacacccaccatcgcaagggtccggcccgcttccgttccctcgacttcggcgagcgcaatggctacctcaagggtgtcgtcaccgaggtcctccacgatccaggtcgtggtgcgccgctagcacgcgttttgttccgccatcctttccgccaccagcaccagaaggagctctttgtcgccgccgagggcatgtacaccggtcaatttatttattgcggtaagaaggccaacctcgtcgtcggcaacgtcttgcctgtcagatctatccctgagggtgctgttgtctgcaacgtcgagcatcatgttggggatcgcggtgttttcgctagggcttccggtgattatgctattgttatctctcacaaccctgacaatggcacttctaggattaagctcccatccggagccaagaaaattattccaagtgggtgccgtgctatggttggccaagttgccggaggtggacgtactgagaagccaatgttgaaggccggtaacgcataccacaagttcagagtgaagaggaactcgtggcccaaggttcgtggtgttgctatgaatccagtggagcatcctcatggtggtggtaaccatcaacacattggtcatgccagtactgttcgtcgtgatgcaccacctggacagaaggttggtcttattgctgccaggagaactggtcgtctccgtggtcaagctgctgccacagctgctaaggccaaggaatgaggagtttggttatggttaagagtattttttttcagtttgttttgaatcagattttgaatgttgaaagaccttgttatcttgatgctatactagattttgtttggattccaaatgttttgttcagtttgatttttatcatctcaatctttccattttgatttactctttgattttaactatattgaaatctagttggaaagaatgcatttcttctatctgcatcgtttaacatatttttatacatgcgagatttatcagaaaatttatagtc

SEQ ID NO: 3419 - DNA, 904 bp, Utricularia gibba
gtcgggtgatccgcgcgcagcgtaagggtgcgggttccgttttcaagtcacatacgcaccaccgtaaggggccggcgcgattccgttcccttgatttcggcgagcgaaatggatacctgaagggcgttatcacggagatcatccacgatccaggccgtggtgctcccttggcccgtgtcactttccgccacccttttcgttaccaacatcagaaggagcttttcgttgctgctgaagggatgtacactggtcagtttatttactgcggaaaaaaggcgaatcttgtcgtcggcaatgtactgcctcttagatctattccagagggtgccgttgtttgcaacgtcgaacatcacgttggagatcgtggggtttttgctcgcgcttccggggactatgctattgtcatttctcacaaccccgacaatggaacttccaggattaagctaccttccggttccaaaaagatagtccccagtaactgtcgcgccatggtcggccaagtagccggcggaggaagaacagagaagcccctgttgaaggcaggccatgcttaccataaattcagggtgaaaaggaactcctggcccaaggttcgtggtgttgccatgaatcccgtcgagcatcctcacggtggtggcaaccaccagcacattgggcacgccagcaccgtccgccgtgatgcgcctccgggacagaaggtcgggctcatcgcagctcgcagaaccggccgtctccgtgggcaagctgctgctactgcagctaaagctgacaagtgacgagattgtcttgtttggtgttgcagtttccttacttttgcgcctaatctaaaaccttttttccattgttgatttgtctgcaactcatgccattctgttcatgattctgcttgccatcttgagcatcg

SEQ ID NO: 3420 - DNA, 1011 bp, Valeriana officinalis
atctttccatcgcctccaaactagagacagccttcatatttccatcgcctccaaactagacagccacagagagagagaaatgggtagagtgatcagagctcagcgtaagggtgctggttccgtcttcaaatctcacacgcaccaccgcaagggtcccgccaggttcaggagtctcgattttggagagcgtaacggttatctgaaaggtgttatcagtgagatcatccatgatccaggacgtggtgctccgttagccaggattaccttccgtcatcccttccgtttcaaacaccagaaggaactcttcgtcgccgccgagggtatgtacaccggccagttcgttttctgcgggaagaaggccaatctcatggtcggaaatgtccttcctctccgatctattcctgaaggagctgttgtgtgcaacgttgaacaccatgttggtgaccgtggtactttggctagagcttctggtgactacgccattgttatcagccacaaccctgataatggtacctctaggatcaagcttccatcaggagcgaagaagatcgtgccaagtggttgcagagctatgattggacaggtagctggtggaggaagaactgagaagccgatgttgaaggccggaaatgcataccacaagtacagagtgaagcgtaactgctggcccaaggttcgtggtgtggctatgaatccagttgagcatccccatggtggtggtaaccatcaacatattggtcatgctagtactgttcgtcgtgatgctcctcccggtcaaaaggttggtcttattgctgccaggaggactggtcgtctccgtggtcaagctgcagccagtgcttccaaagctgataagtagacaagttgttttgttttcattcttcacttgtttttccagactttctttgtttggctttctccattgatcgctacatttcttcactaagagtagtgtttttgtccacagaatttagttttaattctggttttgtttggcatgataatgttttg

SEQ ID NO: 3421 - DNA, 928 bp, Vinca minor
tcccaaaccctaactccgtcacacctaccgccgccgccatgggtcgtgttatccgagcacagcgtaagggagcaggctccgtcttcaagtcccacactcaccaccgtaaaggtccggcgaaattccgatcactcgattttggagagcgcaatggttacttgaaaggagtaatcaccgagatcattcacgatccaggacgtggtgctccgttagctcgcgtcactttccgtcatcctttccgttttcagcatcagaaggagcttttcgttgctgctgaaggaatgtacactggacaatttgtttactgtggtaagaaagctaatctaatggtgggtaatgttttgccactcagatctatccctgaaggagctgttgtttgtaacgttgagcataagatgggtgaccgtggtgttttcgctagagcttctggtgattatgctattgttatcagtcataatcccgataatggaacaactaggattaagctcccatcaggttctaagaagattgtcccaagtgggtgccgtgccatgattggtcaggttgctggaggtggacgtactgagaagccaatgcttaaggctggaaatgcatatcacaagtaccgtgtcaagaggaacagctggcctaaggttcgtggtgttgctatgaatccagttgagcatcctcatggtggtggtaaccatcaacatattggtcacgccagtactgttcgacgtgatgcaccacctgggcaaaaagttggtctcattgctgctaggagaactggtcgtcttcgtggacaagctgctgctagtgctgctaaagctgataaggcttgagagttgcttagttgcagaaaagttatttattattctggttctgttttagtgaacttattaagttggaactttttgaagtaaaaaaatactgtagtgctaaaatttgt

SEQ ID NO: 3422 - DNA, 865 bp, Vinca minor
cgcaatgggtcgtgtaatccgtgcccaacgtaagggagcaggttctgttttcaagtcccacacacaccaccgtaaaggtccggccaaattccgttcactcgatttcggcgagcgcaatggttacctaaaaggagttatcaccgagataattcacgatcccggccgtggtgctccgctagctcgcgtcactttccgccatcctttccgttttcagcaccagaaagagcttttcgttgccgccgaaggaatgtacactggtcaatttgtttactgcggtaagaaagctaatctaatggtcggtaatgttttacccctcagatctatccctgaaggtgctgttgtctgtaacgttgagcataagatgggtgaccgtggtgtctttgctagagcttctggtgattatgctattgttatcagtcacaatcctgataatggaaccactaggattaagctcccatccggttctaagaaaattgtcccaagtggttgccgtgccatgattggtcaggttgcaggaggtggacgtactgagaagccaatgcttaaggctggaaatgcatatcacaagtaccgtgttaagaggaacagctggcctaaggttcgtggtgttgctatgaatccagttgagcatcctcatggtggtggtaaccatcaacatattggtcacgccagtactgttcggcgtgatgcaccgcctgggcaaaaggttggtctcattgctgctaggagaactggtcgtctccgtggacaagctgccgcctctgctgccaaggctgataaggcataagggtgtgcttagatgcagaaccgttacttattttatgcttttacatattattctgaaggcaaaaaatactttagtgct

SEQ ID NO: 3423 - DNA, 1003 bp, Citrullus lanatus
gtctaaaccctaagtttctctataatcgctgcggtagcgaactgaaaatctccgatctcgcggagccgccatgggaagagtcattcgtgctcagcgcaagggagcgggatccgtcttcaagtcccatacccatcatcggaagggcccggccaggttcagaagtctcgatttcggtgaacgaaatggttatctgaaaggagtcgtcactgagattattcacgaccctggccgtggagcgccacttgctcgagtttcattccgccaccctttcaggtacaagaaacagaatgagctgttcgttgcggccgagggtatgtacactggccaatttgtttactgtgggaagaaagcaaatctcgtggttggaaatgtcttgcccataagatcgattcctgaaggtgctgtcgtctgcaacgtcgaacatcatgttggtgaccgcggtgtttttgccaggtgctcgggtgactatgccattgttattagtcacaatcccgataatgacacttccaggatcaagcttccatccggttcaaagaaaatagttccaagtgggtgccgtgccatggttggacaggttgcaggtggaggtaggactgagaagccccttttgaaggctggtaatgcttaccataaatttagagtgaagaggaactgctggcctaaggtccgtggtgttgcaatgaatcccgttgagcatcctcacggaggaggtaaccatcaacatattggacatgccagcacagtcaggcgggatgcgcctcccggtcaaaaggttggtcttattgcagccagaagaactggtaggctcagaggacaagctgcagcaactgccgctaaagctgataaggcttagacagtatcataatttagattgttacagttacttcggttttgaggtcatttcattttgttttcatccatcaatttttccgagactagtcgtgtacgcccgatataactttttgagaaattgttatttagttctggtgtttacattttgaaa

SEQ ID NO: 3424 - DNA, 797 bp, Scabiosa columbaria
atgggtcgagtcatcagagctcaacgtaagggtgccggttccgtcttcaaatcccacacacaccaccgcaaaggtccggcgaggttccgtagtctcgacttcggcgagcgcaatggttacctgaaaggagtcatcactgaaatcatccatgatccaggtcgtggtgctccgttggctcgaatcactttccgtcatcctttccggttcaagcaccagaaggaactcttcgttgccgccgaggggatgtataccggtcaatttgttttctgcgggaagaaggctaatcttatggtcggtaatgttcttcctctaagatctatccctgaaggagctgttgtttgtaacgttgaacatcatgttggtgaccgtggtgtgttagctagagcttctggtgattacgccattgttatcagtcataatcctgataatggaacctcaaggatcaaactgccttcgggagcaaagaaaatcgtaccaagtgggtgccgtgctatgattggtcaggttgctggtggtggacgtaccgagaaaccaatgctcaaggctggaaacgcataccacaagtaccgtgtgaaacgtaactgctggcccaaggttcgtggtgtggctatgaatccagtggagcatccccatggtggtggtaaccatcaacatattggtcatgcaagtactgtccgtcgtgatgcgccacctggtcaaaaggttggtctcattgctgctaggaggactggtcgtctccgtggtcaagccgctgctactgcttccaaagaaaggcttagagataagtttgagatatg

SEQ ID NO: 3425 - DNA, 1004 bp, Eutrema halophilum
atcgaaaccgaagatatgaaatttaaaaggcataataatgttgaggttcaacactgaagacatagattctatctgatagagagaggtctcaaagaactttataataaatcttaacgtttcaaaacaaggtctcaacaataatcccaaaaaagtgaacaatttcatcttgaagactcttcttctcatccttagtcttgcttggcagcaagagcagcagcttgacctctgagacgaccagtcctccttgcagcaataagaccaaccttttgtccaggtggtgcatcacgacgaaccgtactggcgtgaccaatatgttgatggttacctcctccgtgaggatgctccactgggttcatagccacaccacgcaccttaggccagcagtttctcttcacacggtacttgtggtatgcgtttcctgccttgagcattggcttctctgttcttccacctcctgcaacttgaccaatcatggccctgcatccacttgggacaatcttctttgaaccagatggcaacttaatcctaaacaaacctgcttgtatcgttatcagggttgtgagcgataacaatggcgtaatcaccagaagccctagcgaaaacaccacgatcaccaacatgatgctcgacattgcagacaacagctccttcggggatagatctgagcgggagaacatttccgacgacgagagtggctttcttaccgcagtaaaggaactgaccggtgtacattccttcggcggcgacgaagagctccttctgcttcttgtatcggaaaggatgacggaaggcgacgcgagccaacggagctccacgtcctggatcgtggatgatctccgtcacgactcccttgagatatccatttctctcaccgaaatcgaggctcctgaatttggccggacctttacggtggtgagtgtgggacttgaagacggaacccgctcccttacgttgagctctgatgacacgacccatggaggatgattttccttcgtcttcttcag

SEQ ID NO: 3426 - DNA, 944 bp, Malus domestica
agaaaaatcactcaccggcgctatggggagggtcatccgagctcagcgtaagggtgcgggttcggtgttcaagtctcacacccaccaccgaaagggtccggcgcgcttccggagcctcgacttcggcgagcgcaacggctacctcaagggtgtcgtcaccgagatcatccacgatcccggtcgcggtgccccgttggcccgcgtcagcttccgccatccgttcagatacaagaagcagaacgagctcttcgtcgccgccgagggaatctacaccggtcagttcatctactgtgggaagaaggccaatttggtcgtcggaaatgtgttgcctctcagatcgattccggagggagccgtcgtctgcaacgtcgagcaccatgtcggcgaccgcggaaccctcgctagggcgtctggtgattacgccgttgttatcagccacaaccctgacaacgatacttccaggtaggatcaaattgccatctggtgccaagaagattgttcccagcggatgccgtgctatgattgggcaggtagcaggtggaggaagaacagaaaagccaatgctcaaggctggtaacgcttaccacaagttcagagtgaagaggaactgctggcccaaggttcgtggtgtggctatgaacccagtcgagcatcctcacggaggaggtaatcaccagcatattggacatgctagcacagtcaggcgtgacgctcctcctgggcagaaggttggtctcattgccgctaggaggactggtcgtctcagagggcaagctgctgccaacatatctaaggcagacaagtgatgagattacatcttcgtttatatcatgttttattttatccaagactagtttggtgcattttgtggaagaagttttgtttggttggattatttaatgtttgttgcttaacatactatgagttaaagaaatgttggtaaa

SEQ ID NO: 3427 - DNA, 975 bp, Malus domestica
gcgcggccgctagcagcagacaacactcaccggagccatgggaagagtcatcagagctcagcgtaagggtgccggttccgtcttcaagtcgcacacccaccaccgcaagggtccggcccgattcaggagcctcgacttcggcgagcgcaacggctacctcaagggcgtcgtcaccgagatcatccacgacccgggtcgcggtgccccgttggcccgtgtcagcttccgccaccccttccgttacaagaagcagaacgagctcttcgtcgccgccgagggcatctacaccggccagttcatttactgcgggaagaaggccaatttggtggtcggaaatgtgttgcctctcagatcgatcccggagggagctgtggtttgcaacgtcgagcaccatgtcggcgaccgtggaaccctagctagggcttctggtgattacgccgttgttatcagccacaaccctgataacgatacttccaggtaggatcaaattgccctcgggtgccaagaagattgttcccagcgggtgccgtgctatgattgggcaggtagcagggggaggaagaactgaaaagccaatgctcaaggctggtaatgcttaccacaagttcagagtgaagaggaactgctggcctaaggttcgtggtgtggctatgaacccagttgagcatcctcacggaggaggtaatcaccagcatattggacatgcaagcacagtcaggcgtgatgctcctcctgggcagaaggttggtctcattgctgctaggagaactggtcgtctcagaggacaagctgctgcgaacatctctaaggcagataagtgatgagattacattttcgattttatctacattcgccgtgtttggaccgtgttatattttattcaacactagtttggagcattttttggaggaaattttgtttggatggatcctttaatgtctgttgcttaatattcagtttaacagtttcaagatc

SEQ ID NO: 3428 - DNA, 931 bp, Brassica rapa
tgaaaattgcaaaggcataataacttggacagagaaggacaagattataacaaaatctttttgagatttcagaacacaacaaggtccaaaaggaaatacaacaaaactcaaacaagtatcttaaaactagtcagccttggcagcagaagcagcagcttggcctctgagacgaccagtcctcctagcagcaataagaccaaccttctgccctggtggtgcatcacgcctaaccgtacttgcgtgaccaatgtgctgatggttacctcctccatgaggatgctcaactggattcatagccacaccacgaaccttaggccatgagtttctcttcacacggtacttgtggtaagcgtttcctgccttgagcatcggcttctcagtccttcctccaccagcaacttgaccaatcatggccctgcaaccactaggaacaatcttcttggaaccagatggcagcttgatccttagtgtcgttgtcagggttgtgcgaaataacaatagcgtaatcaccagaagctctagcgagcccaccacgatcaccgacatgatgctcgacgttacagacaacagctccttcggggatagctctaagcgggagaacatttccgacaacgagagtggctctcttaccgcagtacaggaactgtccggtgtacataccctcggcggcgacgaagagctccttctgcttcttgtaacggaaaggatgacggaacgcgacgcgagctagcggcgcaccacggccgggatcgtggatgatctcggtcacgacgcccttgaggtatccatttctctcgccgtagtcgaggctacggaacttggctggacccttgcggtggtgggtgtgggacttgaagacggaacctgctcccttacgttgagctctgatgacacgacccattgatcgatggaggctcgacggcgcagatta

SEQ ID NO: 3429 - DNA, 949 bp, Cucurbita pepo
atcctccaatgggtcgtgtgatcagagcacaacgtaagggaggctggatcggtcttccgatctcacacccaccaccggaagggtcctgcccgtttcaggtccctcgatttcggcgagcgaaatgggtacctgaaaggtgtgatcagcgaaatcatccacgatccgggtagaggtgcaccgttggcccgtgtcaccttccgacaccccttccgctacaagcaccagaaggaacttttcattgccgctgagggtatgtacactggtcagtttgtttactgtgggaagaaggctaatctcgttgttggtaatgtgcttcccatccgagccattcctgaaggtgctgtggttgtaatgtggagcaccatgtgggtgaccgtggtgtgttcgctaggtgctctggtgattatgctattgttattagccacaacccggataatgatactagcaggatcaagctaccatcaggagccaagaagattgtaccaagtgggtgccgtgctatgatcggtcaggttgctggaggaggaagaacagagaagccacttctcaaggcaggtaatgcataccataagttccgtgtgaagcgcaacagctggcccaaggttcgtggtgttgctatgaacccagttgaacatccccatggtggtggtaaccatcaacacattggtcacgccagtaccgttcgtcgtgatgccccacctggtcaaaaggttggtctcattgctgcgagaagaactggtcgtctccgtggacaggctgctgctactgctgctaagtccgacaaaggttcttagagcaactcattctgttttaagcttattttgcttaatacttagcccctttcattatgtttgatctgtttcgcattatgttgaagaccatatttaggagtttttgtttgagttttgttacaagatcctttttgaacatattcctctctcccttgttt

SEQ ID NO: 3430 - DNA, 1054 bp, Citrullus lanatus
ttccaagaatgaaccaaacatatcaaagatcgcacaaaactcatacggtggaaaaccaaaacaaaatttcaaaatgtaaacaccagaactaaataacaatttctcaaaaagttatatcgggcgtacacgactagtctcggaaaaattgatggatgaaaacaaaatgaaatgacctcaaaaccgaagtaactgtaacaatctaaattatgatactgtctaagccttatcagctttagcggcagttgctgcagcttgtcctctgagcctaccagttcttctggctgcaataagaccaaccttttgaccgggaggcgcatcccgcctgactgtgctggcatgtccaatatgttgatggttacctcctccgtgaggatgctcaacgggattcattgcaacaccacggaccttaggccagcagttcctcttcactctaaatttatggtaagcattaccagccttcaaaaggggcttctcagtcctacctccacctgcaacctgtccaaccatggcacggcacccacttggaactattttctttgaaccggatggaagcttgatcctgatgtgtcattatcgggattgtgactaataacaatggcatagtcacccgagcacctggcaaaaacaccgcggtcaccaacatgatgttcgacgttgcagacgacagcaccttcaggaatcgatcttatgggcaagacatttccaaccacgagatttgctttcttcccacagtaaacaaattggccagtgtacataccctcggccgcaacgaacagctcattctgtttcttgtacctgaaagggtggcggaatgaaactcgagcaagtggcgctccacggccagggtcgtgaataatctcagtgacgactcctttcagataaccatttcgttcaccgaaatcgagacttctgaacctggccgggcccttccgatgatgggtatgggacttgaagacggatcccgctcccttgcgctgagcacgaatgactcttcccatggcggctccgcgagatcggagattttcagttcgctaccgcagcgattatagagaaa

SEQ ID NO: 3431 - DNA, 846 bp, Brassica juncea
ggccgtaaactcaagaagacgaaacaacatcacattccaccatgggtcgtgtcatcagagctcaacgtaagggagctggttccgtcttcaagtcccacactcaccaccgcaagggtcccgccaagttcaggagcctcgacttcggcgagagaaacggttacctcaagggtgttgtcacggagatcatccacgatccaggtcgtggtgctccgttagctcgcgtcgccttccgtcatcctttccgttacaagaagcagaaggagctcttcgtcgccgccgagggtatgtacaccggacagttcttgtactgcggtaagaaagccactctcgttgtcggaaatgttttgcctctcagatctatccctgaaggagctgttgtctgcaatgttgagcaccatgtcggtgatcgtggtgtcttcgctagagcttctggtgattacgctatcgttatttctcacaacccagacaacgacacgaccagggttaagttgccatctggttcgaagaagattgtcccaagtggttgcagggctatgattggtcaagttgctggaggtggaaggacagagaagccaatgctcaaggcgggtaacgcgtaccacaagtaccgtgtgaagagaaactgctggcctaaggttcgtggtgtggctatgaaccctgttgagcatcctcatggaggaggtaaccatcaacatattggtcacgccagtactgttcgtcgtgatgcaccccctgggcaaaaggttggtcttattgctgcaaggagaactggtcgtctcagaggtcaagctgctgctcttgcttccaagcaagaataaggagacgagtcttgaagatgaaattgtt

SEQ ID NO: 3432 - DNA, 1003 bp, Beta vulgaris
tccccttcactttctctctcctcccttcaccacttccgccatgggaagagttatccgtgctcaacgtaagggagcaggttctgtgttcaaatcccacacccaccatagaaaaggtgctgcgaagtttcgaacccttgacttcggtgaacgtaatggatacttaaaaggtgttatcactgaaattatccatgacccaggacgtggtgcaccacttgctcgcgtaactttccgtcatcctttcaggtataagcatcagaaggagttgtttgttgctgcagaaggaatgtattctggtcagtttgtttattgtgggaagaaagcaaatttaatggtgggaaatgttcttcctttgagatctattcctgaaggagctgttgtttgtaatgttgaacatcatgttggtgatcgtggtgttcttgctcgtgcttctggggattatgctattgttatttctcacaaccctgataatgatacttctaggatcaagctcccatccggttcgaagaagattgtcccaagtggttgccgtgctatgattggtcaagttgctggtggaggtcgtactgagaagccccttcttaaggcaggaaatgcttaccacaagtacagagtcaagagaaactgctggcccaaggttcgtggtgttgctatgaatccagttgagcatccccatggtggtggtaaccaccagcatattggtcatgcctctactgtgcgtagagatgcaccaccagggcaaaaggttggtctcattgctgccaggaggactggtcgtcttcgtggtcaagctgccgccaatgtttccaagagcgacaaggcttaagttatctaggcatgttatcgtcatttttgatgttgttttcttttattaagagtatctattttgaagactgcagtattaaggatatactactgagttttgttcacaattttaggattggattttgtcatggtggtacttcggataaatttcacaattcccagtgcctttttagctcagtac

SEQ ID NO: 3433 - DNA, 990 bp, Rosa hybrid cultivar
cccttgttactctttcactccatagacagagagaacgaaaccctaggtcgagccagagccaccgtcaatgggtcgcgtcatcagagctcagcgtaagggagcgggctccgtcttcaagtcccacacccaccaccgcaagggcccggcccgcttccgctccctcgactacggcgagcgcaacggctacctcaagggcgtcgtcaccgacatcatccacgaccccggtcgcggtgccccgctcgctcgcgtcagcttccgtcatcctttccggtacaagaagcagaacgagctcttcgtcgccgccgaggggctctacaccggccagtttatttactgcgggaagaaggccaatttggtcgtcggaaatgtgttgccggtcagatctattcccgagggagctgtggtgtgtaatgtcgagcaccacgtcggcgaccgcggaaccctagctagggcttcgggggattacgctgtgattatcagtcacaaccctgataatgatacctcaagaatcaagcttccttctggtgccaagaagattgttccaagtggttgccgtgccatgattggtcaagttgcaggtggaggcagaactgagaagcctatgctcaaggccggtaatgcttaccacaagttcagagtgaagaggaactgctggcctaaggtgcgtggtgtggctatgaatcctgttgagcatcctcacggaggaggtaaccaccagcatattggtcatgctagcacagtcaggcgtgatgctcctcctgggcagaaggttggtctcattgctgccaggagaactggtcgtctcagaggacaagctgctgcgactgcctccaaggagaaggcttagagttgaatttactttttacattttctgcttatttgattgttctgtttttgtacgggctattttgctcaatagatttttatcatgtactagtgtgtgcttcatgttgttggaaaaattttgtttgtcaagagttggaattccta

SEQ ID NO: 3434 - DNA, 999 bp, Rosa hybrid cultivar
tgggtcgcgtcatcagagctcagcgtaagggtgccgggtcggtcttcaagtcccacacccaccaccgcaagggtccggcccgcttccgctccctcgacttcggcgagcgcaacggctacctcaagggcgtcgtcaccgacatcatccacgaccccggccgcggtgcccccctcgctcgcgtcagcttccgtcatcctttccgctacaagaagcagaacgagctcttcgtcgccgccgagggcctttacaccggtcagtttatttactgcggtaagaaggccaatctcgtcgtcggcaacgttttgccggtcagatctatccccgagggagctgtgatctgcaacgtcgagcaccacgtcggcgatcgtggaaccctcgctagggcttctggtgattatgctgttgttatcagccacaaccctgataacgatacctccaggatcaagcttccatctggtgccaagaagattgttccaagtggctgccgtgctatgattgggcaggttgcaggtggtggaagaacagagaagcctatgctcaaggccggtaatgcctaccacaagttcagggtgaagagaaactgctggcctaaggtgcgtggtgtggctatgaatccagttgagcatccccacggaggaggtaaccaccagcatattggacatgctagcacagtcaggcgtgacgctccccctgggcagaaggttggtctcattgctgccaggagaactggtagactcagaggacaggctgcagcttttgcttccaaggataaggcttaagatttatatgctaaagcttataagtgtcattaggaaggagaccaccgtttcttttgatctaaatttactgttttggaagaacctctttatttttattcaagactatcgagtgcattttgtggtataaattttgtttggttactaaaaaaaaaaaaaacaaaaaaaaaaaacaaaaaaaaactaacgagacttagttacttactactagagacggacgtgg

SEQ ID NO: 3435 - DNA, 1040 bp, Malus domestica
ctcccaagacctataaaatcaaacacaaatcctagggttttcggaacaccatttcgcgcggccgctagtagcagaaaatcactcgccggagctatggggagggttatccgagctcagcgtaagggtgcgggctccgttttcaagtcgcacacccaccaccgcaagggtcctgcccgcttccggagcctcgacttcggcgagcgcaacggctacctcaagggtgtcgtcaccgagatcatccacgatcctggtcgcggtgccccgttggcccgcgtcagcttccgccatccgtttaggtacaagaagcagaacgagctcttcgttgccgccgagggaatctacaccggtcagttcatctactgcgggaagaaggccaatttggtggtcgggaatgtgttgcctctcagatcgatcccggagggagctgtcgtctgtaacgtcgagcaccatgttggggaccgcggaaccctcgctagggcgtctggtgattacgctgttgttatcagccacaaccctgacaacgatacctccagggtcaagcttccgtctggagccaagaagattgttccaagcgggtgccgtgctatgattgggcaagttgcaggtggaggaagaacagaaaagccaatgctcaaggctggtaatgcttaccacaagttcagagtgaagaggaactgctggcccaaggttcgtggtgtggctatgaacccagtcgagcatcctcatggaggaggtaatcaccagcatattggacatgctagcacggtcaggcgtgacgctcctcctgggcagaaggttggtctcattgctgctaggaggactggtcgtctcagaggacaagctgctgctaacatatcgaaggcagacaagtgaagaggcttatgagggattacgttttctttgttacctaagtttgctgttttgggaccgttttaatttatatcgcagtactagattggtgcatttttgtgcggtttgaacctttcatgctttgatcaagatatcatgatattaacagtcaaacgttttactagttgtca

SEQ ID NO: 3436 - DNA, 965 bp, Arabidopsis lyrata
ttcattttcctcactctcaagttggatctcaaaaccctaatttctaatcatcgccgtcgagagcttccatgggtcgtgtcatcagagctcaacgtaagggtgcgggttccgtcttcaaatcccacactcaccaccgcaaaggtccggctaagttccgtagcctcgatttcggcgagcgaaatggttacctcaagggcgtcgtgacggagatcatccacgatcctggtcgtggtgctcctcttgctcgcgtcactttccgtcatcctttccgtttcaagaaacagaaggagctcttcgtcgccgctgaaggtatgtacaccggccagttcttgtactgcggtaagaaagctactctcgtcgtcggaaatgttcttcctcttagatctatccctgaaggagctgttgtgtgtaacgttgagcaccatgttggtgatcgtggtgttctcgctagagcttctggtgattacgccattgttattgctcacaaccctgacaacgacactactaggattaagttgccatcgggttcgaagaagattgtcccgagtggatgcagggctatgattgggcaagttgctggaggtggaagaactgagaagccgatgctcaaggcaggaaacgcgtaccacaagtaccgtgtgaagagaaactcatggcctaaggttcgtggtgtggctatgaatccagtggagcatcctcatggaggaggtaaccatcagcacatcggtcacgccagtacggttaggcgtgatgcacctcctggacagaaggttgggcttattgctgcaaggaggactggtcgtctcagaggtcaagctgctgcttcagctgccaaggcagactagagttaaacataataaactttgtttctcatgttttcatttcaagttttgttgtctgtgtttgcttttgaaccttgttctgaaatcctgaaagatttttatgataaacctttctctcttctc

SEQ ID NO: 3437 - DNA, 1001 bp, Artemisia annua
agacgcactcaagcaggtggtatcaacgcagtactccgacggggatttccatcttattattcaccagccgtcacagaaaccctaaaaatgggtcgagtcatccgagcacaacgtaagggagcaggctccgtcttcaagtcccacacccaccaccgcaagggacccgcccgtttcagatcactcgacttcggagaacgcaatggctacctcaagggtgtcatcaccgaaatcatccacgacccaggtcgtggtgccccacttgctaaagtgaccttccgtcacccattcagatacaagcatcaaaaggagctctttgtagcagctgagggtatgtacacaggacagtttgtgttctgtgggaagaaggcgaatttaatggttgggaatgttttgcctattggtatgattcccgagggaggtgttgtttgtaatgtggaacaccatgttggagataggggttctttcgcgagagcgtctggggattatgctattgttattagtcacaatcctgataatggtacctcaagagtgaagcttccatctggtgccaagaaaattgtcccaagtggatgtcgtgctatgattggtcaggttgctggtggaggacgtactgagaagcccatgctcaaggctggtaacgcttaccacaagttccgtgtgaagagaaactcctggcccaaggttcgtggtgttgctatgaatccagttgagcatccccatggtggtggtaaccatcaacatattggtcatgcaagtaccgtccgtcgtgatgcaccacccggtcaaaaggttggtcttattgctgctaggaggactggtcgtctcagaggtcaagctgctgctgcagccatgaaggctgataagtgataaattactgctatgaatcttgattttagttttggaacctttgcatctgctactttcgttgttagtttattcgtgtttatctatgttgaacaacatacattatattttgttgggaagttttgcagtaagatact

SEQ ID NO: 3438 - DNA, 1089 bp, Brassica rapa
ctcactctcgacttcggtctcaaaccctaattgtaatctgcgccgtcgagcctccatcgatcaatgggtcgtgtcatcagagctcaacgtaagggagcaggttccgtcttcaagtcccacacccaccaccgcaagggtccagccaagttccgtagcctcgactacggcgagagaaatggatacctcaagggcgtcgtgaccgagatcatccacgatcccggccgtggtgcgccgctagctcgcgtcgcgttccgtcatcctttccgttacaagaagcagaaggagctcttcgtcgccgccgagggtatgtacaccggacagttcctgtactgcggtaagagagccactctcgttgtcggaaatgttctcccgcttagagctatccccgaaggagctgttgtctgtaacgtcgagcatcatgtcggtgatcgtggtgggctcgctagagcttctggtgattacgctattgttatttcgcacaaccctgacaacgacactactaggatcaagctgccatctggttccaagaagattgttcctagtggttgcagggccatgattggtcaagttgctggtggaggaaggactgagaagccgatgctcaaggcaggaaacgcttaccacaagtaccgtgtgaagagaaactcatggcctaaggttcgtggtgtggctatgaatccagttgagcatcctcatggaggaggtaaccatcagcacattggtcacgcaagtacggttaggcgtgatgcaccaccagggcagaaggttggtcttattgctgctaggaggactggtcgtctcagaggccaagctgctgcttctgctgccaaggctgactagttttaagatacttgtttgagttttgttgtatttccttttggaccttgttgtgttctgaaatctcaaaaagattttgttataatcttgtccttctctgtccaagttattatgcctttgcaattttcatttcacattttttaaatatatttgtgcatctctcgttttgttctaaaattaaattatatattcgtggtaatactttctggatgctaatcgaatcttgcgtcagtttgtaacaacattctaaaa

SEQ ID NO: 3439 - DNA, 1144 bp, Brassica napus
atcatccacaatgggtcgtgtcatcagagctcaacgtaagggagcaggttccgtcttcaaatcccacactcaccaccgtaaaggccccgccaagttccgcagcctcgactacggcgagagaaatggatacctcaagggcgtcgtgacggagatcatccacgatcccggccgtggtgcgccgctcgctcgcgtcgccttccgtcatcctttccgttacaagaagcagaaggagctcttcgtcgccgccgaaggcatgtacaccggacagttcttgtactgcggtaagaaagcgacgctcgttgtcggaaatgttctcccgcttagagctatccctgaaggagctgttgtctgtaacgtcgagcatcatgtcggtgaccgtggtgtgctcgctagagcttctggcgattacgccatcgtgatttcgcacaaccctgacaacgacactactaggatcaagttgccatctggttcgaagaagattgttccgagtggatgcagggccatgattggtcaggtcgctggtggtggaagaacggagaagccgatgctcaaggcgggaaacgcgtaccacaagtaccgtgtgaagagaaactcgtggcctaaggttcgtggtgtggctatgaatccagtggagcatcctcacggaggaggtaaccatcagcacattggtcacgccagtacggttaggcgtgatgcaccaccagggcagaaggttgggcttattgctgctaggaggactggtcgtctcagaggtcaagctgctgcttctgccgccaaggctgattaaggtttaataagagagatatatatatttgtttttgtttgagttttttgctgcttttccttgtgaaccctccttgtgttctgaaatctcgtttttgttataatcttgtgagtacacttctcaagaaaagcaaacctaagttgctactgtttgcccatgtgaggttttgttatcctgattacactagtcagtcatgacaataatcgatatgcacagctttggagctttcatgctatagatcttgtgctgattgaaattgaaatcatggaccaatatatatccacattacaaaagcaaaagataacacaagaaaactaaaaaaaaaaaaacaaaatgaagtactacgaaccgaaaggacca

SEQ ID NO: 3440 - DNA, 991 bp, Brassica napus
tgcggaccggtccggaattctcgggtcgaacacgcgtccgaaaccctaattgtaatcttcgccgtcgagcctccatccatcaatgggtcgtgtcatcagagctcaacgtaagggagcaggttccgtcttcaagtcccacacccaccaccgcaagggtccagccaagttccgtagcctcgactacggcgagagaaatggatacctcaagggcgtcgtgaccgagatcatccacgatcccggccgtggtgcgccgctagctcgcgtcgcgttccgtcatcctttccgttacaagaagcagaaggagctcttcgtcgccgccgagggtatgtacaccggacagttcttgtactgcggtaagaaagccactctcgttgtcggaaatgttctcccgcttagagctatccccgaaggagctgttgtctgtaacgtcgagcatcatgtcggtgatcgtggtgtgctcgctagagcttctggtgattacgctattgttatttcgcacaaccctgacaacgacactactaggatcaagctgccatctggttccaagaagattgttcctagtggttgcagggccatgattggtcaagttgctggtggaggaaggactgagaagccgatgctcaaggcaggaaacgcttaccacaagtaccgtgtgaagagaaactcatggcctaaggttcgtggtgtggctatgaatccagttgagcatcctcatggaggaggtaaccatcagcacattggtcacgcaagtacggttaggcgtgatgcaccaccagggcagaaggttggtcttattgctgctaggaggactggtcgtctcagaggtcaagctgctgcttctgctgccaaggctgactagttttaagatacttgtttgagttttgttgtatttccttttggaccttgttgtgttctgaaatctcaaaaagattttgttataatcttgtccttctctgtcgaagttattatgcctttgcaattttcatttcac

SEQ ID NO: 3441 - DNA, 919 bp, Cleome gynandra
ctgcttgcagaaaccgtcgtcggcgatgggtcgtgtaatccgtgctcagcgtaagggtgctggctccgtcttcaagtcccacacccaccaccgcaaaggtccggccaagtttcgaagcctcgacttcggtgaacgcaatggttatctcaagggtgtcgtgacggagatcatccacgatccaggccgtggagctcctctcgctcgcgttgttttccgacatcctttccgttacaagaagcagaaggagctgtttgttgccgccgagggtatgtataccggtcaattcatttactgtggtaagagggcgtctctcgttgtaggaaacgttcttccacttaggtcaattcctgagggagctgtggtttgcaatgtggagcaccatgtgggtgatcgtggtgtgctcgctagagcttccggtgattacgccattgttattgcccacaatcctgataacgataccaccaggatcaagttaccgtcaggttccaagaagattgtgcctagcgggtgcagggccatggttgggcaagtggctggtggagggagaactgagaagcctctcctcaaggccggaaatgcgtaccacaagttcagagtgaagaggaactgctggccgaaggtgcgtggtgtggctatgaatccagttgaacatccgcacggaggaggtaaccaccaacacattggtcacgccagtacagtgagacgtgatgcaccacctggtcaaaaggtgggtctcattgctgccaggaggactggtcgtctcagaggtcaagctgctgccacagctgccaaggctgattaggctttgattttaagaacgggggatatctatgaattcgtgggttattattacttttagaacaagttttggcgtttgaaagaaggaattgtgatggttataaaaaacatgtttactctt

SEQ ID NO: 3442 - DNA, 1043 bp, Cucurbita pepo
cggtagcgaactgaagatctccgaccttgcggagacgacatgggaagagttattcgtgctcagcgtaagggagcgggatccgtcttcaagtcccacacccatcaccggaagggtccggccaggttcagaagtcttgacttcggcgaacggaatggctatttgaaaggagtcgtctctgagattattcacgatcctggccgtggagcaccgcttgctcgagttaccttccgccatcctttcaggtacaagaaacagaatgaactgttcgttgcggctgagggtatgtacactggccaatttgtttactgcgggaagaaggcaaatctcatggtcggaaatgtcttgccccttagatcgattcctgaaggtgccgtcgtttgtaacgtcgaacaccatgtcggtgaccgcggtgttttcgctagatgttccggagattacgcgattgttatcagccataatcccgataacgacacttccaggatcaagcttccatcaggttcaaagaaagtagttccaagtgggtgtcgtgccatggtcggtcaggttgcaggtggtggtagaactgagaagccccttcttaaggctggtaatgcttaccacaaatttagagtgaagagaaactgctggcctaaggtccgtggtgttgcaatgaatccggtcgagcatcctcacggaggaggtaaccatcaacacatcggacacgccagcactgtcaggcgggatgcacctcctggtcaaaaggttggtctcattgctgcaaggagaactggtagactcagaggacaagcagcagccactgcttctaaagctgataaggcttaaacagtattataatttagattacgacttggttcctgaggtcatttcattttacttccatcgttcaatttgtgtactctcctcctccattgtaacttttgagaaaacatttttttgttccgttgttttcccctcctaaacatctgcccttctactatttgttggcttcattacgttatatattatcagaaggatttattccgggccgttgtccattaaaatac

SEQ ID NO: 3443 - DNA, 993 bp, Euonymus alatus
cggccgttctcctttacctcacccctcaaaaccctagtttctcagtttctgtcagcgatgggtcgagttatccgtgcccaacgaaagggtgctggctccattttcaagtcgcacacccaccaccgcaagggtcctgctcgtttccgttctctcgactatggcgagcgcaacggatacctgaggggtgttgtctctgaaatcatccacgatccgggtcgtggtgctcctcttgctcgtgttgtgttccgccacccattccgttacaagcatcagaaggagctcttcgtcgccgctgagggtatgtacaccggccaatttatctactgtggcaagaaggctaacttgatggttggaaatgttcttcccctcagagctattcctgagggtgctgtcgtctgcaatgttgagcaccatgttggtgaccgtggcgttttggctagggcttctggtgactatgctattgttatcagtcacaaccctgataatggaacttccagaatcaagcttccttctggagcaaagaagattgtgccaagtgggtgcagagctatgattggtcaggttgcaggtggtggcaggactgagaagccgatgctgaaggcaggtaatgcttatcacaagtaccgcgtgaagaggaactgctggcctaaggttcgtggtgtggctatgaatcctgttgagcatccccatggtggtggtaaccaccaacatattgggcatgctagcactgtttctcgctttgctcctcccggtcagaaagttggtcttattgctgcccgaaggacaggtcgtctgcgaggacaagctgccgctgctgcttcaaaagcagactagggtgcttaaatttgtttgctattttgatttgtcttcgcatactatgttatttttggtatcttgcatgttgattactattgtgttcctatcgaagggtcttgtttccatgtctaggacttctgtttgttgtcgtgggatttaatggtttatcttttacaa

SEQ ID NO: 3444 - DNA, 906 bp, Euonymus alatus
ccccttccctcgcaagaactctaagcctccgttgtcagtgatgggtcgtgttattagggcgcaacgtaagggtgcgggatccatattcaagtcccacacgcaccaccgtaagggtcccgcccgttttcgatcactcgacttcggcgaacgcaacggttacctgaggggtgttgtctctgagataatacacgatccgggtcgcggtgctccgctcgctcgtgttacgtttcgtcatcccttccgttacaagcatcagaaggagctctttgtcgccgctgagggtatgtacactggccaattcatctactgtggcaagaaggctaatttgatggtcggaaatgttcttcctctaagagctattcccgagggtgccgtcgtttgcaatgttgagcaccatgttggtgaccgtggcgttttagctagggcttctggtgattatgctattgttatcagtcacaaccctgataatggaaccaccagagtcaagcttccttctggagcaaagaagatcgtgccaagtgggtgcagagctatgattggtcaggttgcaggtggtggcaggactgagaagccgctgttgaaggcgggtaacgcttatcacaaataccgtgtgaagcggaactgctggcctaaggttcgtggtgttgctatgaatccggttgagcatccccatggtggtggtaatcaccagcatatcgggcatgctagtactgtttcccggtttgctcctcctggccaaaaggttggtcttattgctgcgaggaggacaggtcgtcttcgaggacaggccgctgccgccgcttcaaaatcggactagggttcttagattgttttgctactttgatttgtatttcgatattatgatatttttttgacattttgcaagtggaatgccaattttgttcc

SEQ ID NO: 3445 - DNA, 1110 bp, Ipomoea batatas
catccctctcaactctctgccctaagtcgcagcggccttctctccgagatgggacgagtgatcagagctcaacgtaagggtgccggatcggttttcaagtcccacacccaccaccgcaagggccccgcccgcttccgctccctcgacttcggcgagcgcaatggctacctcaagggtgtggtgtctgagatcatccacgaccccggtcgcggcgccccgctcgctcgcgtcaccttccgtcaccctttccgcttccagcaccagaaggagcttttcgtcgccgccgagggcatgtacaccggccagttcgtctactgtggtaagaaggctaacctcatcgtcggcaacgtgctgcctctcagatccatccccgaaggtgccgtcgtttgcaatgtcgagcacaaggtcggcgaccgcggtgtcttcgccaggtgctctggcgattacgttattgttatcagtcacaaccccgataatggaactaccaggattaagctgccatcaggatcaaagaagattgttcccagtgggtgcagggccatgattggtcaggttgctggaggtggaagaacagagaaaccactcctcaaagctggaaatgcttatcacaagttccgcgttaagaggaactgctggcctaaggtccgtggtgttgccatgaatcccgtggagcatcctcacggtggtggtaaccaccagcacattggtcatgccagcactgtccgtcgtgatgctccaccagggcaaaaggttggtctcattgctgcaaggaggactggtcgtctccgtggtcaagctgccgccactgcttccaaggccgataaggcataaattaacccttgattgtgctgcagaatttgaacttattatcagctttttcctttcttcctgtacttccagacttttgttatgcagtggattatactaaattttgtttgggattttaattaagcagtagtaagttttgttcagtggttcatatttggacaattactagtgatgttttcttgaattaaaaaaaaaaaaaaaggaaaaaaaaaacctcgtgccgtattctttggatcgtactagcaccgacgcgccggcgcgcgtgtccgacggttgtctttt

SEQ ID NO: 3446 - DNA, 1004 bp, Momordica charantia
atcgccgcggcagcaaactgaaaatctccgatctcccggagccgccatgggaagagtcatccgtgctcagcgtaagggagcgggctccgttttcaagtctcacacccatcatcggaagggtccggccagattccgaagtctcgacttcggcgaacgaaatggttatctgaaaggagtcatcactgagattgttcacgacccaggccgtggagcgccgcttgctcgagttaccttccgccatcctttcaggtacaagaaacagaatgaactgttcgttgcggctgagggtatgtacactggccagtttgtttactgcggaaagaaggcgaatctcatggttgggaatgtcttgcccctaagatcgatccctgaaggtgccgtcgtctgcaacgtcgaacaccatgttggtgaccgtggcgtttttgcaagatgttcgggagactacgcgattgttattagtcacaatcctgataacgatacttccaggatcaagcttccatctggttccaagaaagtagttccaagcgggtgccgtgctatggtcggtcaggttgctggtgggggtaggactgagaagccccttcttaaggctggtaatgcttaccacaaatttagagttaagaggaactgctggcctaaggttcgtggtgttgccatgaatcccgttgagcatcctcacggaggaggtaaccaccaacacattggacatgccagcactgtcaggcgtgatgcacctcctggtcaaaaggttgggctcattgccgccaggagaactggtaggctcagaggacaagccgcagcaactgctgccaaagctgacaaggcttagacggttttatatttatttagatcattacttgtttttgagaacttccattttactcccaacttttgagaaggtgttgattacaattgaaaattttgttttgttttcttccatatgtgatgagtttggtccaaatatacttgttttttgtatttcacatcatcgttagagtggaaga

SEQ ID NO: 3447 - DNA, 1004 bp, Carica papaya
agcggcaaaccctaaacctacacctcccacctctcacttctgacggcaaaatggggcgagtcattcgtgctcagaggaagggtgcgggctctgttttcaagtcccacactcaccaccgtaagggtcctgcccgcttccgtagtcttgatttcggcgagcgcaatggttacttgaaaggtgtggtgacggagatcgtgcacgatcctggccgtggcgcccctcttgctcgcatcacattccgtcaccctttccgctacaagaagcagaaggagcttttcatcgctgcagagggtatgtacacgggccagtttgtctactgcggtaagaaggcgaacctcatggttggaaatgtcctccctctccgatctatcccagaaggtgccgttgtctgcaatgttgagcaccatgtcggtgatcgtggcgtccttgccagagcttctggtgattacgctattgtcatcagtcacaaccccgataacgataccaccaggatcaagcttccatcaggttctaagaagattgttccaagtgggtgccgtgctatgatcggtcaggttgctggtggtggaaggactgagaagccccttctcaaggcaggtaatgcttatcacaagttcaaggtgaagaggaactgctggcctaaggtccgtggtgtggcaatgaacccagttgagcatcctcatggtggaggtaaccaccagcatattggtcatgccagcactgttagacgggatgctcctcctggccagaaggtcggtcttattgctgcaaggaggactggtcgtctcagaggacaagctgcagctactgctgccaaggcagacaaagcttagagagtgtcattgtttgttttgcttgcattttttcggtttactttttgttagatttatttctaagacgattaattggctacgctgtagaatttttgttgaattgtgaagctgcagttaaaatgaactatcttatgagttggtttgaaatatagttacaagttcttttgtgct

SEQ ID NO: 3448 - DNA, 985 bp, Plantago ovata
ctcatccctccgtcaatctcatcccatgggtcgtgtcatccgagcacagcgtaaaggagccggatccgtcttcagatcccacacgcaccaccgcaagggtccggcgaggttccgcacactcgatttcggcgagcgcaatggataccagaaaggtgtcgtcaccgagatcatccacgaccccggccgtggtgctccactcgcgcgcgtgactttccgccatccgttcaggtaccagcaccagaaggagctcttcgttgctgccgaaggcatgtacaccggccagttcattttctgcggtaagaaggcgaatctcgtcgtcggaaatgttctgccgctcagatctattccagaaggagctgtcgtttgcaacgtcgagcatcacgttggtgatcgtggatcctttgctagggcttctggtgactatgctgttgtcatctctcacaatccggataatggaacttctaggatcaagcttccatcaggagccaagaagattgttcccagcggctgccgtgctatgattggtcaggtagcaggaggagggagaactgaaaagccaatgttgaaggctgggaatgcgtatcataagttcagagtgaagaggaactgctggccggtggttcgtggtgttgccatgaatcctgttgagcatccccatggtggtggtaaccatcaacatattggtcatgcttctactgttcgccgtgatgctcctcccgggcaaaaggttggtcttattgctgccaggaggactggtcgtctacgtggacaagctgcttccgcagctgccaaggagaaggcttagatttatactattccttgatggctttaatttcgtgtcctggtggttttccgtttctgtttttgaatgttagacaaatttttcaagatgatatagtatatgatgtcttgaattttgatgttaatttttatttcagttgttttaatttaatggatttggatgttgtccggagatgatctttca

SEQ ID NO: 3449 - DNA, 1122 bp, Pseudotsuga menziesii
gaaacagaaaccctagtattgtattggagcgatggggagggtaatcagagcgcagaggaagggagcggggtctgtcttcagatcccatacgcatcacaggaagggccctgcacgttttcgcagtctcgactacggggagcgcaatggctacattaagggcattgtctccgatgtcatccacgacccgggacgcggtgccccgctctgcagggtgactttcagacatcccttccgctacaggcaccagaaggagcttttcatcgcagccgagggtatgtacacaggccagttcatttactgcggtaagaaggccaatctcatcgtgggaaacgtgttgcctctcagatctattcccgagggagccgtcgtctgcaatgtggagcaacacgtcggggaccgtggttcatttgccagagcttcgggagactacgctatagtcgtcagtcacaacgttgataatggcactagcaggatcaagctaccttctggagccaagaaaatagtgccaagcagttgcagagctatgattggccaggttgctggtggtggaaggactgaaaagcccatgctcaaggctggaaatgcatatcataagtacagagtcaagagaaattgctggcccaaggttcgtggtgttgctatgaacccggttgaacatcctcatggtggtggtaaccatcaacatattggtcatgccagtaccgtgcgtcgtgatgcaccacctgggcagaaagttggtcttattgctgcaagaagaactggtcgtttacgtggccaagctgcatcagctgcttcgaaggttgataaaaccacttagtgtgttccatgaacattcttgtgtggaagaggtatcatttatgcctatgtgtatttggaaagatttattgtcatccaaatttggcctttgtgggtccacatttttgagtattcctttgattgaagttttgttcagtaattttattgatgaacattttagaataccggttttaggattagcatttggaggatggtagaacctgggcctagcctttgctattacaagaaagaaagaaacctttatttatttatctgctcacaatatctgggtagatatatctggtgttatgaattttatgttttggc

SEQ ID NO: 3450 - DNA, 1203 bp, Sequoia sempervirens
ggaagagcgagggtttggagaggaagatgcgttcactcctggcggcgtagcgtgggaagatcgagggcttggagaggaagaggcgttcactcgtggcctttacaaaactaatttttgtagtaataccttcttcgataactatctggagctagcacgaaaatgggtcgggtgatcagagcgcagaggaagggagcaggttccgtgtttaaatcccacacacatcacagaaagggccctgcgcgctttcgcagtttggactacggcgagcgaaatgggtacctgaagggtattgttacagaagtcgttcacgacccggggcgcggcgcccccctctgccgcgttaacttcaggcatcccttccgttacaggcagcagaaggagctattcatcgccgccgagggtatgtatactggccagtttatttactgcggtaagaaggccaatctgactgtggggaatgtcttgcctttgagatctattcccgagggcgctgtggtttgcaacgtggagcagcatgtgggcgatcgtggctcctttgccagggcttctggagattatgccatcgttatcagtcacaaccccgataatggcacttccagggtaaaacttccgtctggagctaagaagattgtgccaagtagttgcagagccatgattggacaggtagctggtggcggaaggacagaaaagcctatgttgaaagctggcaatgcatatcacaaatatagggtcaaaagaaacagttggcccaaggttcgtggtgtggcaatgaaccctgttgagcatcctcatggtggtggtaaccatcaacacattgggcatgccagtaccgtgcgtcgtgatgcccccccaggacaaaaagttggtctcattgctgctaggagaactggtcgtctgcgcggacaggctgcaacagcagctgcaaagacagataaggcttagcacgcacacgtactcaatcggaattgaacaattagagagtttctcattgtttcctatcattaatggtttattgttgattcaaattttgggaaagacttcaagctaggttgtaatcctcgtttacttttatcgttgactttgttatttttccttatttgaaagaatgcttatagctttcagatcataaatggaaaaaaatgataattttcagtatcttaaactgcaatctctcgtttattaataagtactaatttcaaggag

SEQ ID NO: 3451 - DNA, 1142 bp, Taxus baccata
caacgcagagtacgcggggaatctcagaagtcgatcgaatttcggcactcagcgtcaagatgggtcgcgtaatccgtgcgcagagaaagggagcaggttccgtgttcaaatcccacacccatcacaggaagggaccagcgcggtttcgaagtttggactatggcgaacgaaacgggtacctgaagggcattgttgcagaggttgttcacgaccctgggcgcggcgcccctttatgcagggtcaattttaggcaccccttccgctacagacagcagaaggagctctttattgccgccgagggtatgtatactggtcagtttatttactgcggcaagaaggccaatttgacggtggggaatgttttgcctctgagatctattcccgagggtgctgtcgtttgcaatgtggagcagcacgtcggcgatcgcgggtcgtttgctagagcttctggagattatgccattgttattagtcacaatcctgataatggcacttccaggataaagcttccatctggtgctaagaagattgtgccaagtagctgcagagctatgattggtcaggttgctggtggtggaagaacagaaaagccaatgctgaaagctggcaatgcgtatcacaaatatagggtgaaaagaaactgttggcccaaggttcgtggtgtggcaatgaaccctgttgaacatcctcatggtggtggtaatcaccaacatattgggcatgctagtaccgttcgtcgtgatgctccaccagggaaaaaggttggtctcattgctgctagaagaactggtcgtttgcgtggacaggctgcaacagctgctgcaaagacagacaaggcttagtttgttgacccccttaggtactgcaggcattttaagtaaacaattagagagctttgaaaaatgcacaatggtgaactgcattttattttcctttttttcttcaggttgctttgtggcagccatctgtgaggactgggttgtaatacatgtttactgtttttgcttttatccattattggttatctcttttcaaaatcacatgaaagacttcagtttttaaaatggttgtaagttcttagtttacctctataggttgactcaaattgttagcaacttgggtgtcatatcaagcaaatttgt

SEQ ID NO: 3452 - DNA, 1026 bp, Tripterygium wilfordii
agttacttcttctattctttcagcacgcgatgggtcgagtaattcggtcgcaacgtaagggtgcggggtctgtcttcaagtcccacacccaccaccgcaagggtccggcccgtttccgctccctcgacttcggcgagcgcaacggttacctgaggggtgtagtctccgagatcatccacgatccgggtcgcggtgctccccttgctcgtgttgtgttccgccatcccttccgttacaagcatcagaaggagctattcgtcgccgctgagggcatgtacaccggccaattcatctactgtggcaagaaggctaacttgatggtaggaaatgtccttcctcttagagctattcctgagggtgccgttgtctgcaatgttgagcaccatgttggtgaccgtggcgttcttgctagagcctctggtgattatgctattgttatcagtcacaaccctgataatggaactaccagagtcaagcttccctctggagcaaagaagattgtgccaagtgggtgcagggctatgattggtcaggttgcaggtggtggcaggactgagaagccacttctgaaggcaggtaatgcatatcacaaataccgtgtgaagaggaactgctggcctaaggttcgtggtgttgcgatgaatcctgtcgagcatccccatggtggtggtaaccaccagcatattgggcacgctagtacagttagccgctttgctccacctggtcaaaaggtgggtctcattgcagccaggaggacaggtcgtcttcggggacaagctgccgctgctgcttcaaaatctgataagggttcttagattgttgtgctattttgatttgtctttccggactatgttatgtttgacatcttgcaagtggagtagtaatgtggttcctattgttgtttttgttttcgagtttaagacaaacgatttgttttctttgggatttaatggttgtgtttttaaatagattactagcaagaacgaatattgtttggttttgaaatgttagctttcttgattgtag

SEQ ID NO: 3453 - DNA, 787 bp, Brassica juncea
cgaacaaccatccacccaccatgggtcgtgtcatcagagctcaacgtaagggagcgggttccgtcttcaagtcccacactcaccaccgcaagggcccgccaaattcagaagcctcgacttcggcgagagaaacggatacctcaagggcgtcgtcacggagatcatccacgatccaggacgcggtgctccgttagcccgcgtcgcgttccgtcatcctttccgttacaagaagcagaaggagctcttcgtcgccgccgagggtatgtacacggggcagtttctttactgcggtaagaaagccactctcgtcgtcggaaatgtgcttcctctcagatctatccccgagggagctgttgtctgcaacgtcgagcatcatgttggtgatcgtggggttttcgctagagcttctggtgattacgctatcgttatcgctcacaatcccgacaacgacacaacaagggttaagttgccatctggttcgaagaagattgttccaagtggttgcagggctatgattggtcaagttgctggtggtggaaggacggagaagccgatgctcaaggcgggtaacgcgtaccacaagtaccgtgtgaagagaaactgctggcctaaggttcgtggtgtggctatgaatccagttgagcatcctcatggaggaggtaaccatcagcacattggtcacgcaagtacggttaggcgtgatgcaccaccagggcagaaggttggtcttattgctgctaggaggactggtcgtctcagaggtcaagctgctgcttctgctgccaag

SEQ ID NO: 3454 - DNA, 966 bp, Malus domestica
agaaccatatgacaacatgaaaaggttttgactgttaaaacctactctcagcatataacggttcaaaccgaacaaaaatgcaacaatctagtactggatataaattaaaacggtcccgaaacagcaaacttaggtaacaaataaaacgtgatcccttaaaagcctcttcacttgtctgccttagagatgtttgcagcagcttgtcctctgagacgacccgtcctcctggcggcaatgagaccaaccttctgcccgggaggagcgtcacgcctgacagtgctagcgtgtccaatatgctggtggttacctcctccgtgaggatgctcgactgggttcatagccacaccacgaaccttgggccagcagttcctcttcactctgaacttgtggtaagcattaccagccttgagcattggcttttctgttcttcctcctcctgcaacctgcccaatcatagcacggcacccacttggaacaatcttcttggctccagacggaagtttgatcctgtatcgttatcagggttgtggctgataacaacggcgtaatcaccagaagccctagctagggttccacggtcgccgacatggtgctcgacgttgcagacgacggctccctccgggatcgatctgagaggcaacacatttccgaccaccaagttggccttcttcccgcagtaaatgaactggccggtgtagattccctcagcggcgacgaagagctcgttctgcttcttgtaacggaaggggtggcggaagctgacgcgggccaacggggcaccgcgaccggggtcgtggatgatctcggtgacgacgcccttgaggtagccgttgcgctcgccgaagtcgaggctccggaagcgcgccggacccttgcgatggtgggtgtgggacttgaagacggagccggcacccttacgctgagctctgatgactctccccattgctcctactcggctgcgaaatg

SEQ ID NO: 3455 - DNA, 1045 bp, Brassica juncea
aacctcaacaacaagaagaagacgaatccaccatgggtcgtgtcatcagagctcaacgtaagggagcaggctccgtcttcaagtcccacactcaccaccgcaagggccccgccaagttcaggagcctcgatttcggcgagaggaacggttacctcaagggcgtcgtcacggagatcatccacgaccctggacgcggtgctccgttagctcgcgtctcgttccgtcaccctttccgttacaagaagcagaaggagctattcgtcgccgccgaaggtatgtacaccggacagttcttgtactgcggtaagaaggccactctcgtcgtcggaaatgttctgcctctcagatctatccccgagggagctgttgtctgcaacgtcgagcatcatgttggtgaccgtggggtgctcgctagagcctctggagattacgctatcgttatttcacacaaccctgacaacgacacgacaagggtcaagttgccatctggttcgaagaagattgtcccaagtggatgcagggccatgattggtcaagttgctggaggtggaagaaccgagaagccgatgctcaaggcgggtaacgcgtaccacaagtaccgtgtgaagaggaactgctggcctaaggttcgtggtgtggctatgaaccctgttgagcatcctcacggaggaggtaaccatcagcatattggtcacgctagtactgttcgccgtgatgcaccccctgggcaaaaggttggtcttattgctgcaaggaggactggtcgtctcagaggtcaagctgctgctcttgcttccaagcaagaataaggagagagggtttcaagatgatggaactgtttacttttgttggatttttgctgagaccttgttttgaatcctttagaatttctataatcttctttgatacctttgtcttcagaattaaacctccacaagtccacattatcattttaaatttcaggattcggttttgatttcttggtgtcaagattatcatctatatggatctaattatagacaccattattatataaagatctggt

SEQ ID NO: 3456 - DNA, 827 bp, Brassica juncea
gatcggccgtaaactcaagaagacgaaacaacatcacattccaccatgggtcgtgtcatcagagctcaacgtaagggagctggttccgtcttcaagtcccacactcaccaccgcaagggtcccgccaagttcaggagcctcgacttcggcgagagaaacggttacctcaagggtgttgtcacggagatcatccacgatccaggacgtggtgctccgttagctcgcgtcgccttccgtcatcctttccgttacaagaagcagaaggagctcttcgtcgccgccgagggtatgtacaccggacagttcttgtactgcggtaagaaggccactctcgttgtcggaaatgtactccctctcagatctatccctgagggagctgttgtctgcaacgttgagcaccatgtcggtgatcgtggtgtgctcgctagagcttctggtgattacgctatcgttatttctcacaaccctgacaacgacacgaccagagttaagttgccgtctggatcgaagaagattgtcccaagtggttgcagggccatgattggtcaagttgctggaggtggaaggactgagaagccaatgctcaaggcgggtaacgcgtaccacaagtaccgtgtgaagagaaactgctggcctaaggttcgtggtgtggctatgaaccctgtggagcatcctcacggaggaggtaaccatcagcatattggtcacgccagtactgttcgtcgtgatgcaccccctgggcagaaggttggtcttattgctgcaaggagaactggtcgtctcagaggtcaagctgctgctcttgcttccaagcaagaataaggaga

SEQ ID NO: 3457 - DNA, 866 bp, Brassica juncea
ggccgtaaactcaaagaagacgaaacaacttcacacaatccacaatgggtcgtgtcatcagagcccaacgtaagggagcaggttccgtcttcaagtcccacactcaccaccgcaagggccccgccaagttcaggagcctcgacttcggcgagagaaatggttacctcaagggtgtcgtcacggagatcatccacgatccgggacgtggtgctccgttggcccgcgtcgccttccgtcatcctttccgttacaagaagcagaaggagctcttcgtcgccgccgaaggtatgtacaccggacagttcttgtactgcggtaagaaggccactctcgttgtcggaaatgtactccctctcagatctatccctgagggagctgttgtctgcaacgttgagcaccatgtcggtgatcgtggtgtgctcgctagagcttctggggattatgctatcgtcatttctcacaaccctgacaacgacacgaccagggttaagttgccatctggatcgaagaagattgtcccaagtggatgcagggctatgattggtcaagttgctggaggtggaaggaccgagaagccaatgctcaaggctggtaacgcgtaccacaagtaccgtgtgaagagaaactgctggcctaaggttcgtggtgtggctatgaaccctgttgagcatcctcacggaggaggtaaccatcagcatattggtcacgctagtactgttcgccgtgatgcaccccctgggcaaaaggttggtcttattgctgcaaggaggactggtcgtctcagaggtcaagctgctgctcttgcttccaagcaagaataaggagagagggtttcaagatgatggaactgtttacttttgttggaa

SEQ ID NO: 3458 - DNA, 1329 bp, Abies balsamea
agatgattctatgttcattgttctaaattcgcttaaaacgaaattataatcaattttttataatcaaaattagggtttatggggagtgaggaaaaacttctacccacattagggttagggtttatccgcaactagggtttgtattgacgaaaccctttcccatcgctgctgttttcatttgcggaggcgcaccagaactaaactccccgtcttgtgaaacctctcgtctgcagatatgggtcgagttattcgtgcacagagaaaaggagcaggttccgtgttcagatcccacactcatcacaggaagggccctgcacggttcagaagtctcgactacggcgagcgcaatggctacatcaggggaatcgtgacggatgtcatacacgacccgggccgcggcgcccctctctgcaaggtaaccttcaggcatgcgttccgttacaagcatcagaaggagctcttcgtagcggctgagggtatgtacacgggccagttcgtttactgcgggaaaaaggccaatttgactgtgggcaacgtgttgcccttgaggtctattccggagggagctgttgtctgcaacgtggaacagcatgttggtgatcggggttcgtttgctagggcttctggggactacgccatcgtcgtcagccacaaccctgataacggcactaccagggtgaagcttccctctggagctaagaagattgtgccaagtagttgtagagctatgattggtcaagttgccggaggtggaagaacagaaaaaccaatgctcaaggctgggaatgcataccacaaatacagggtcaaaagaaactgttggcccaaggttcgtggtgtggctatgaacccagttgagcatcctcatggtggtggtaaccatcaacatattggtcatgccagtactgtacgtcgtgatgcaccaccagggcaaaaagttgggcttattgctgccagaagaactggtcgtctacgtggacaggctgcttcagcagctgcaaagacagacaactaatattagtccgtttttgtttgcaaggattttatggtcctatattagagttttattttttcgtagtgtgattatacaagggttttgatcctttattttaattcaggtagtagaagtaattgtttacagaggccaggaaacacaaaactgattattgttttttgtttgtttatgttacctttctatgttgcaacaatctaggagaaccaagtaataatctgaattttattttacatgattgtttatctcagtgagcagtttgctcacaccactgcatgacattctagacttgcaatagttagagagttgtgaatagt

SEQ ID NO: 3459 - DNA, 1262 bp, Abies balsamea
gtccaaactcccctcacaactgctcagtaaagcttcccgtctccttaaaatccgaaaatgtccagactgaagaaaattcttgtagcggagtgttttatcgggggcgggtcgaagtagaaaccctagtagtgtagtgtagtgtagtttagtgtaacgatggggagggtaattagagcacagaggaagggagcggggtccgtgttcagatcccacacgcaccacaggaagggtcctgcccgctttcgcagcctcgactatggggagcgcaatggctacatcaagggtatcgtctcagatgtcatacacgacccggggcgcggtgccccgctctgcagggtgacctttaggcaccccttccgctacaggcaccagaaggagctcttcatcgcggccgagggtatgtacactggccagttcgtttactgcggtaagaaggccaatctcattgtaggcaacgtgttgcctctcagatctattcctgagggagccgtcgtctgcaatgtcgagcaacatgtcggggatcgtggctcatttgccagagcttcgggagactacgctatcgttgtcagtcacaaccttgacaatggcaccagcaggatcaagctaccttctggagccaagaaaatagtgccaagcagttgtagagctatgattggtcaggttgctggtggtggaaggactgaaaagcccatgctcaaggctgggaatgcataccataagtacagagtcaagagaaattgctggcctaaggttcgtggtgttgctatgaacccagttgaacatcctcatggtggtggtaaccatcagcatattggtcatgccagtaccgtgcgtcgtgatgcaccacctgggcaaaaagttggtcttattgctgcaagaagaactggtcgtttacgtggacaagctgcatcagctgctgcaaagactgacaaaaccagttagtgtgttccataagtttgggtggaagaggtattgtttatgcgatatgcatatttggacaatttggtatgttcacaaacaaaacagttggtttactcccattgcaaagatttattgtcgctcagatttggcctttgtgtgtctaaatttctgagtatttctttgtttaatgaagttttgttcaagcattcttttgaaacattttaggatgccggttttagcatcagcatttgtaggatgatagaacctaggccggcctttactattacaatgaggaaagatacctttcgatatttgtctgctcacaatgtgttactcagttc

SEQ ID NO: 3460 - DNA, 1016 bp, Antirrhinum majus
  misc_feature (451)..(451): n is a, c, g, or t
  misc_feature (499)..(499): n is a, c, g, or t
  misc_feature (535)..(535): n is a, c, g, or t
  misc_feature (1016)..(1016): n is a, c, g, or t
gcctcccccaaaccctacaatgggtcgagtcatcagagcgcagcgtaaaggagcaggctccgtcttcagatcccacacacaccaccgcaaaggcccggcccgattccgcacattggactttggcgagcgcaacggctaccaaaagggcgtagtgaccgagatcatccacgatccgggccgcggtgcgccgctggcccgagtgactttccggcacccgttccggtaccagcatcagaaggagctgttcgttgccgctgagggtatgtatactggtcaatttgtgtattgtggtaagaaggcgaatctggttgttggtaatgtgttgccgctcagatctattcccgagggagcggttgtttgtaatgtggagcatcatgttggtgatcgtggatcgttcgctagggcttctggtgattacgcggttgtgatctcgcataatcctgataatggnacgactagagttaagctcccatcaggtgccaagaagattgtgccaagnggttgccgtgccatggttgggcaagttgctggaggnggaagaactgagaagcccctcttgaaggctggaaatgcttatcacaagttcagagtgaagagaaacagctggcccaaggttcgtggtgttgctatgaatcccgttgagcatcctcatggtggtggtaaccatcaacacattggtcacgccagtaccgttcgtcgtgatgcaccacctggtcaaaaggttggtctcattgctgctagaagaaccggtcgtctcagaggtcaagctgctgccacggctgccaagtccgataagggttcttaggctactaccattttttgatcttgagtttaattttgatgtctcagtttttcggtttagactgaatcttgacttagcattttgaattgcgatgttttttttgaagatatatagtagattgtgttgggattttggatgccaagttttaagtgcttgttagaacatgcttttgtccaagacattagtaattcttagtatatctttgcttgagccn

SEQ ID NO: 3461 - DNA, 970 bp, Arabidopsis thaliana
ttcattttcctcactctcaagttggatctcaaaaccctaatatctgaacttcgccgtcgagagcatccatgggtcgtgtcatcagagctcaacgtaagggtgcgggttccgtcttcaaatcccacactcaccaccgcaaaggtccggctaagttccgtagcctcgatttcggcgagagaaatggttacctcaagggcgtcgtgacggagatcatccacgatcctggtcgtggtgctcctcttgctcgtgtcactttccgtcatcctttccgtttcaagaaacaaaaggagctcttcgtcgccgccgaaggtatgtacaccggtcagttcttgtactgcggtaagaaagctactctcgtcgttggaaatgttctccctcttagatctattcctgaaggagctgttgtctgcaacgtcgagcatcacgtcggtgatcgtggtgtcctcgctagagcttctggtgattacgccattgttatcgctcacaaccctgacagcgacactactaggattaagttgccatcgggttcgaagaagattgtcccaagtggatgcagggctatgattggacaagttgctggaggtggaagaactgagaagccgatgctcaaggcaggaaacgcgtaccacaagtaccgtgtgaagaggaactcatggcctaaggttcgtggtgtggctatgaatccagtggagcatcctcatggaggaggtaaccatcagcacattggtcacgccagtactgttaggcgtgatgcacctcctggacagaaggttggtcttattgctgcaaggaggactggtcgtctcagaggtcaagctgctgcttcagctgccaaggcagactagagttaaaagagataaactttgtttctcttgttttctatgtttcaagttttgttgtctgtgtttccttttgaacctcattctgaaatcctaaaagatttttatgataaacctttctctcttctcga

SEQ ID NO: 3462 - DNA, 978 bp, Arabidopsis thaliana
attcgccgtaatctgaagaagacgaagcaaatcctcccacaaagaatcatccatgggtcgtgttatcagagcacaacgtaagggagctggttccgtcttcaaatcccacactcaccaccgtaaaggtccggccaaattcaggagtctcgatttcggggagagaaatggttatctgaaaggtgttgtgacggagatcattcacgatccaggacgtggtgctccattggctcgtgtagctttccgtcatcctttccgattcaagaagcagaaggagcttttcgttgctgctgaaggtatgtataccggtcagtttctttactgtgggaagaaagctactctcgtcgtcggaaatgttcttcctctcagatctattcctgaaggagctgttatttgtaacgttgaacatcatgttggtgatcgtggtgttttcgctagagcttctggtgattacgccattgttatcgctcacaatcctgataacgacactagcaggattaagttgccatcgggttcgaagaagattgtgccaagtggatgcagggccatgattggtcaagttgcaggtggtggaagaacagagaagccgatgctcaaggctggtaacgcataccacaagtaccgtgtgaagagaaactgctggcctaaggttcgtggtgtggctatgaatccagttgagcatcctcacggaggaggtaaccatcaacatattggtcacgctagtactgttcgtcgtgatgcaccaccaggaaaaaaggttggtcttattgctgcaaggaggactggtcgtctcagaggtcaagctgctgctcttgcttccaaggcagactaaggagaggaggattcaagatgaaattgttcacttttttgggattttttgttgaaaccttgttttgaaacctttagatttactactatcatgttctttgatacgtttgcctatcaggtagaatctgcatttcagggataaatcttaacttt

SEQ ID NO: 3463 - DNA, 992 bp, Brassica juncea
caatgggtcgtgtcatcagagcccaacgtaagggagcaggttccgtcttcaagtctcacactcaccaccgcaagggccccgccaagttcaggagcctcgacttcggcgagagaaatggttacctcaagggtgtcgtcacggagatcatccacgatccgggacgtggtgctccgttggcccgcgtcgccttccgtcatcctttccgttacaagaagcagaaggagctcttcgtcgccgccgaaggtatgtacaccggacagttcttgtactgcggtaagaaggccactctcgttgtcggaaatgtactccctctcagatctatccctgagggagctgttgtctgcaacgttgagcaccatgtcggtgatcgtggtgtgctcgctagagcttctggtgattacgctatcgttatttctcacaaccctgacaacgacacgaccagagttaagttgccgtctggatcgaagaagattgtcccaagtggttgcagggccatgattggtcaagttgctggaggtggaaggactgagaagccaatgctcaaggcgggtaacgcgtaccacaagtaccgtgtgaagagaaactgctggcctaaggttcgtggtgtggctatgaaccctgtggagcatcctcacggaggaggtaaccatcagcatattggtcacgccagtactgttcgtcgtgatgcaccccctgggcagaaggttggtcttattgctgcaaggagaactggtcgtctcagaggtcaagctgctgctcttgcttccaagcaagaataaggagagaaagcttcaagatgatgaaattgttcacttttgtttttgggtttttgctgtgaccttgttttgaaaccttaagacttgctataatgttatttgagacctttctctatcatttagaatctatgttttcagagtttaaccttcgcactattgtgcatttgaaagtagtgtcttctgtttgaattatctctcattcaagaaaactaattc

SEQ ID NO: 3464 - DNA, 980 bp, Brassica juncea
gatttttctctcgccgtaaactcaaagaagacgcaggatcatcgtcaccacaatctaccatgggtcgtgtcatcagagctcaacgtaagggagctggttccgtcttcaagtcccacacccaccaccgcaagggccccgccaagttcaggagcctcgacttcggcgagaggaacggttacctcaagggtgtcgtcacggagatcatccacgatccgggtcgtggtgctccgttggcccgcgtctccttccgccatcctttccgttacaagaagcagaaggagctcttcgtcgccgccgaaggtatgtacaccggacagtttctgtactgcggtaagaaggccactctcgttgtcggaaatgttctgcctctcagatctatccctgagggagctgttgtctgtaatgttgagcaccatgtcggtgatcgtggtgtgctcgctagagcttctggggattatgctatcgtcatttctcacaaccctgacaacgacacgaccagggttaagttgccatctggatcgaagaagattgtcccaagtggatgcagggctatgattggtcaagttgctggaggtggaaggacagagaagccaatgctcaaggctggtaacgcgtaccacaagtaccgtgtgaagagaaactgctggcctaaggttcgtggtgtggctatgaaccctgttgagcatcctcacggaggaggtaaccatcaacatattggtcacgctagtactgttcgtcgtgatgcaccacctgggcaaaaggttggtcttattgctgcaaggaggactggtcgtctcagaggtcaagctgctgctcttgcctccaagcaagaataaggagagaaatcttcatgatgatgaagttgtttacttttgttggatttttgctgagaccttgtgttgagtcctttagtttttctataatctttcttgagacctttgtcttgagaattaaacctccacattatcagtttaaatttc

SEQ ID NO: 3465 - DNA, 993 bp, Brassica juncea
gatttttctctcgccgtaaactcaaagaagacgcaggatcatcgtcaccacaatctaccatgggtcgtgtcatcagagctcaacgtaagggagctggttccgtcttcaagtcccacacccaccaccgcaagggccccgccaagttcaggagcctcgacttcggcgagaggaacggttacctcaagggtgtcgtcacggagatcatccacgatccgggtcgtggtgctccgttggcccgcgtctccttccgccatcctttccgttacaagaagcagaaggagctcttcgtcgccgccgaaggtatgtacaccggacagtttctgtactgcggtaagaaggccactctcgttgtcggaaatgttctgcctctcagatctatccctgagggagctgttgtctgtaatgttgagcaccatgtcggtgatcgtggtgtgctcgctagagcttctggggattatgctatcgtcatttctcacaaccctgacaacgacacgaccagggttaagttgccatctggatcgaagaagattgtcccaagtggatgcagggctatgattggtcaagttgctggaggtggaaggacagagaagccaatgctcaaggctggtaacgcgtaccacaagtaccgtgtgaagagaaactgctggcctaaggttcgtggtgtggctatgaatccagttgagcatcctcacggaggaggtaaccatcaacatattggtcacgctagtactgttcgtcgtgatgcaccacctgggcaaaaggttggtcttattgctgcaaggaggactggtcgtctcagaggtcaagctgctgctcttgcttccaagcaagaataaggagagagggtttcaagatgatggaactgtttacttttgttggatttttgctgagaccttgtgttgagtcctttagtttttctataatctttcttgagacctttgtcttgagaattaaacctccacattatcagtttaaatttccttattcagtttt

SEQ ID NO: 3466 - DNA, 824 bp, Brassica juncea
gccgtaaactcaaagaagacgcaggatcatcgtcaccacaatctaccatgggtcgtgtcatcagagctcaacgtaagggagctggttccgtcttcaagtcccacactcaccaccgcaagggtcccgccaagttcaggagcctcgacttcggcgagagaaacggttacctcaagggtgttgtcacggagatcatccacgatccaggacgtggtgctccgttagctcgcgtcgccttccgtcatcctttccgttacaagaagcagaaggagctcttcgtcgccgccgagggtatgtacaccggacagttcttgtactgcggtaagaaagcaactctcgttgttggaaatgtgcttccgctcagatctatccctgaaggagctgttgtctgcaatgtcgagcaccatgtcggtgatcgtggtgtgttcgctagagcttctggtgattacgctatcgttattgctcacaatcccgacaacgacacaacaagggttaagttgccatctggttcgaagaagattgtgccgagtggttgcagggctatgattggtcaagttgctggtggtggaaggacggagaagccgatgctcaaggcgggtaacgcgtaccacaagtaccgtgtgaagaggaactgctggcctaaggttcgtggtgtggctatgaaccctgttgagcatcctcacggaggaggtaaccatcaacatattggtcacgccagtaccgttcgtcgtgatgcaccacctgggcaaaaggttggtcttattgctgcaaggaggactggtcgtctcagaggtcaagctgctgctcttgcttccaagcaagaataa

SEQ ID NO: 3467 - DNA, 930 bp, Brassica oleracea
  misc_feature (240)..(240): n is a, c, g, or t
  misc_feature (243)..(243): n is a, c, g, or t
  misc_feature (252)..(252): n is a, c, g, or t
  misc_feature (261)..(262): n is a, c, g, or t
  misc_feature (264)..(264): n is a, c, g, or t
  misc_feature (279)..(279): n is a, c, g, or t
  misc_feature (303)..(303): n is a, c, g, or t
  misc_feature (309)..(309): n is a, c, g, or t
  misc_feature (360)..(360): n is a, c, g, or t
atgggtcgtgtcatcagagctcaacgtaagggagcaggttccgtcttcaagtcccacactcaccaccgcaagggccccgccaagttcaggagcctcgacttcggcgagagaaatggttacctcaagggtgtcgtcacggagatcatccacgatccaggacgtggtgctccgttggctcgcgtcgccttccgccatcctttccgttacaagaagcagaaggagctcttcgtcgccgccganggnatgtacacnggacagttnntntactgcggtaagaangctactctcgttgtcggaaatgtncttccnctcagatctatccctgagggagctgttgtctgcaatgttgagcaccatgtnggtgatcgtggtgtcctcgctagagcttctggtgattacgctatcgttatttctcacaaccctgacaacgacacgaccagggttaagttgccgtctggatcgaagaagatcgttccaagtggatgcagggccatgattggccaagttgctggaggtggaaggacagagaagccgatgctcaaggcgggtaacgcataccacaagtaccgtgtgaagaggaactgctggcctaaggttcgtggtgtggctatgaacccagttgagcatcctcacggaggaggtaaccatcagcatattggtcacgccagtactgttcgtcgtgatgcaccccctgggcagaaggttggtcttatcgctgcaaggagaactggtcgtctcagaggtcaagctgctgctcttgcttccaagcaagaataaggagagaaagcgtcaagatgatgaaattgttcacttttgtttttgggttttcgctgagaccttgttttgaaaccttaagacttgctataatgttatttgagacctttctctatcaattagaatctatgttttcagacctaacctccaccgcga

SEQ ID NO: 3468 - DNA, 900 bp, Brassica oleracea
  misc_feature (294)..(294): n is a, c, g, or t
atgggtcgtgtcatcagagctcaacgtaagggagcgggttccgtcttcaagtcccacactcaccaccgcaagggccccgccaaattcaggagcctcgatttcggcgagagaaacggttacctcaagggcgtcgtcacagagatcatccacgatccaggacgcggagctccgttggctcgcgtcgcgttccgtcatcctttccgttacaagaagcagaaggagctcttcgtcgccgccgagggtatgtacacggggcagtttctgtactgcggtaagaaagcaactctcgtcgtnggaaatgtgcttcctctcagatctatccctgaaggagctgttgtctgcaacgtcgagcaccatgtcggtgatcgtggggtgttcgctagagcttctggtgattacgctatcgtcatcgctcacaatcccgacaacgacacaactagggttaagttgccatctggttcgaagaagattgtaccaagtggttgcagggctatgattggtcaggttgctggtggtggaaggacggagaagccgatgctcaaggcgggtaacgcgtaccacaagtaccgtgtgaagagaaactgctggcctaaggttcgtggtgtggctatgaacccggttgagcatcctcacggaggaggtaaccatcaacatattggtcacgctagtactgttcgtcgtgatgcgcctcctgggcaaaaggttggtcttattgctgcaaggaggactggtcgtcttagaggtcaagctgctgctcttgcttccaagcaagaataaggagaataagctgcatgatgaaattcttcacttttttggattgtgtttaagaccttgttttgaaatgtatggatactcggctgcgacctttctctattaattagaatctatgttttttttttt

SEQ ID NO: 3469 - DNA, 981 bp, Brassica oleracea
ggccgtaaactcaagaagaaggaagatcatcatcatccatgggtcgtgtcatcagagctcaacgtaagggagcaggctccgtcttcaagtcccacacccaccaccgcaagggccccgccaagttccgtagcctcgacttcggcgagagaaatggttacctcaagggcgtcgtcaccgagatcatccacgatccgggtcgtggtgctccgttagctcgcgtcgccttccgtcatcctttccgttacaagaagcagaaggagctcttcgtcgccgccgagggtatgtacaccggacagttcttgtactgcggtaagaaggccactctcgtcgtcggaaatgttctgcctctcagatctatccccgagggagctgttgtctgcaacgtcgagcaccatgttggtgatcgtggtgtgctcgctagggcttctggtgattacgctatcgtcatctctcacaatcccgacaacgacacgaccagggttaagttgccatctggatcgaagaagattgtcccaagtggatgcagggccatgattggtcaagtcgctggtggtggaagaaccgagaagccgatgctcaaggcgggtaacgcataccacaagtaccgtgtgaagaggaattgctggcctaaggttcgtggtgtggctatgaaccctgttgagcatccccacggaggaggtaaccatcaacatattggtcacgccagtaccgttcgtcgtgatgcaccacctgggcaaaaggttggtcttattgctgcaaggaggactggtcgtctcagaggtcaagctgctgctcttgcctccaagcaagaataaggagataaatcttcaggatgatgaagttgtttactttttttgttggatttttgctgagaccttgttttgaatcctttagattttctataatcttctttgagacctttgtcttgagaattaaacctccatattatcagtttaaatttcgttattcagttttgatttc

SEQ ID NO: 3470 - DNA, 1210 bp, Brassica rapa
catttcctcgttgtcacagatctcgaaccctcacttccttgctcccgccgtaaactcaacaagactcagatccacccaccatgggtcgtgtcatcagagctcaacgtaagggagcgggttccgtcttcaagtcccacacccaccaccgcaagggccccgccaaattcagaagcctcgacttcggcgaaagaaacggatacctcaaaggtgtcgttaccgagatcatccacgatccaggacgcggtgctccgttagcccgcgtcgcgttccgtcatcctttccgttacaagaagcagaaggagctcttcgtcgccgccgagggtatgtacacggggcagtttctttactgcggtaagaaagctactcttgtcgtcggaaatgtgcttcctctcagatctatccccgagggagctgttgtctgcaacgtcgagcatcatgttggtgatcgtggggttttcgctagagcttctggtgattacgctatcgttattgcccacaatcccgacaacgacacaacaagggttaagttaccatctggttcgaagaagattgtaccaagtggttgcagggctatgattggtcaagttgctggtggtggaaggacggagaagccgatgcttaaggcgggtaacgcgtaccacaagtaccgtgtgaagagaaactgctggcctaaggttcgtggtgtggctatgaatccagttgagcatcctcacggaggaggtaaccatcagcatattggtcacgctagtactgttcgtcgtgatgcaccacctgggcaaaaggttggtcttattgctgcaaggaggactggtcgtctcagaggtcaagctgctgctcttgcttccaagcaagaataaggagaagaagctgcatgatgaaattcttcacttttttggattgtgtttaagaccttgttttgaaatgtatggatactcggttgcgacctttcctattatttagaatctatgttttttttttttgcgttaagaaacgtcgatcctcttggcaaataaaacatgcaaatacaagaactttagtggtaactgaacaagtatttgctgtgatctttgtaaggagactaaaacggtttaatgaatctgattccaaccagaatacatatgctcgtagactatatatcaacatctttaaagctgttcccacgaggagacaacataacgtccttaagggagatatgcaaacacattaagaa

SEQ ID NO: 3471 - DNA, 1109 bp, Brassica rapa
aaccctagttccttgctctcgccgtaaactcaaagaagacgaaacaacttcacacaatccacaatgggtcgtgtcatcagagcccaacgtaagggagcaggttccgtcttcaagtctcacactcaccaccgcaagggccccgccaagttcaggagcctcgacttcggcgagagaaatggttacctcaagggtgtcgtcacggagatcatccacgatccgggacgtggtgctccgttggcccgcgtcgccttccgtcatcctttccgctacaagaagcagaaggagctcttcgtcgccgccgaaggtatgtacaccggacagttcttgtactgcggtaagaaggccactctcgttgtcggaaatgtactccctctcagatctatccctgagggagctgttgtctgcaacgttgagcaccatgtcggtgatcgtggcgtgctcgctagagcttctggtgattacgctatcgttatttctcacaaccctgacaacgacacgaccagagttaagttgccgtctggatcgaagaagattgtcccaagtggttgcagggccatgattggtcaagttgctggaggtggaaggactgagaagccaatgctcaaggcgggtaacgcgtaccacaagtaccgtgtgaagagaaactgctggcctaaggttcgtggtgtggctatgaaccctgtggagcatcctcacggaggaggtaaccatcagcatattggtcacgccagtactgttcgtcgtgatgcaccccctgggcagaaggttggtcttattgctgcaaggagaactggtcgtctcagaggtcaagctgctgctcttgcttccaagcaagaataaggagagaaagcttcaagatgatgaaattgttcacttttgtttttgggtttttgctgagaccttgttttgaaaccttaagacttgctataatgttatttgagacctttctctatcaattagaatctatgttttcagagtttaaccttcgcactattgtgcatttgaaagtagtgtcttctgtttgaattatctctcattcaagaaaactaattctccatgctttggaactcgtcactttctcttcttgtctaaggagatgtagtttaaaa

SEQ ID NO: 3472 - DNA, 1044 bp, Brassica napus
ggaacccttacttccatcctcccgccgtagactctcaggaacaccaccatccttccaccatgggtcgtgtcatcagagctcaacgtaagggagcgggttccgtcttcaagtcccacactcaccaccgcaagggccccgccaaattcaggagcctcgatttcggcgagagaaacggttacctcaagggcgtcgtcacagagatcatccacgatccaggacgcggagctccgttggctcgcgtcgcgttccgtcatcctttccgttacaagaagcagaaggagctcttcgtcgccgccgagggtatgtacacggggcagtttctgtactgcggtaagaaagcaactctcgtcgtcggaaatgtgcttcctctcagatctatccctgaaggagctgttgtctgcaacgtcgagcaccatgtcggtgatcgtggggtgttcgctagagcttctggtgattacgctatcgtcatcgctcacaatcccgacaacgacacaactagggttaagttgccatctggttcgaagaagattgtaccaagtggttgcagggctatgattggtcaggttgctggtggtggaaggacggagaagccgatgctcaaggcgggtaacgcgtaccacaagtaccgtgtgaagagaaactgctggcctaaggttcgtggtgtggctatgaacccggttgagcatcctcacggaggaggtaaccatcaacatattggtcacgctagtactgttcgtcgtgatgcgcctcctgggcaaaaggttggtcttattgctgcaaggaggactggtcgtcttagaggtcaagctgctgctcttgcttccaagcaagaataaggagaataagctgcatgatgaaattcttcacttttttggattgtgtttaagaccttgttttgaaatgtatggatactcggctgcgacctttctctattaattagaatctatgtttttttttttttttgcgtcaagccttgacacttagttttcctacattttcagttcgtttgatccttttgttgttatccgaaatttgccggaaaaa

SEQ ID NO: 3473 - DNA, 992 bp, Brassica napus
aaagaagacgaaacaacttcacacaatccacaatgggtcgtgtcatcagagcccaacgtaagggagcaggttccgtcttcaagtcccacactcaccaccgcaagggccccgccaagttcaggagcctcgacttcggcgagagaaatggttacctcaagggtgtcgtcacggagatcatccacgatccgggacgtggtgctccgttggcccgcgtcgccttccgtcatcctttccgttacaagaagcagaaggagctcttcgtcgccgccgaaggtatgtacactggacagttcttgtactgcggtaagaaggccactctcgttgtcggaaatgtactccctctcagatctatccctgagggagctgttgtctgcaatgttgagcaccatgtcggtgatcgtggggtgctcgctagagcttctggggattacgctatcgttatttctcacaaccctgacaacgacacgaccagggttaagttgccatctggatcgaagaagattgtcccaagtggatgcagggccatgattggtcaagttgctggaggtggaaggacagagaagccaatgctcaaggcgggtaacgcgtaccacaagtaccgtgtgaagagaaactgctggcctaaggttcgtggtgtggctatgaaccctgtggagcatcctcacggaggaggtaaccatcagcatattggtcacgccagtactgttcgtcgtgatgcaccccctgggcagaaggttggtcttattgctgcaaggagaactggtcgtctcagaggtcaagctgctgctcttgcttccaagcaagaataaggagagaaagcttcaagatgatgaaattgttcacttttgtttttgggtttttgctgagaccttgttttgaaaccttaagacttgctataatgttatttgagacctttctctatcaattagaatctatgttttcagagtttaacttttgcactattgtgcatttgaaagttaagtgtcttctgt

SEQ ID NO: 3474 - DNA, 1003 bp, Brassica napus
aaactcaagaagaaggaagatcatcatcatccatgggtcgtgtcatcagagctcaacgtaagggagcaggctccgttttcaagtcccacactcaccaccgcaagggccccgccaagttcaggagcctcgacttcggcgagagaaatggttacctcaagggtgtcgtcaccgagatcatccacgatccgggacgtggtgctccgttagctcgcgtcgccttccgccatcctttccgttacaagaagcagaaggagctcttcgtcgccgccgaaggtatgtacaccggacagttcttgtactgcggtaagaaggcgactctcgtcgtcggaaatgttctgcctctcagatctatccccgagggagctgttgtctgcaacgtcgagcaccatgttggtgatcgtggtgtgctcgctagggcttctggtgattacgctatcgtcatctctcacaaccccgacaacgacacgaccagggttaagttgccatctggatcgaagaagattgtcccaagtggatgcagggccatgattggtcaagtcgctggtggtggaagaaccgagaagccgatgctcaaggcgggtaacgcataccacaagtaccgtgtgaagaggaattgctggcctaaggttcgtggtgtggctatgaaccctgttgagcatccccacggaggaggtaaccatcaacatattggtcacgccagtaccgttcgtcgtgatgcaccacctgggcaaaaggttggtcttattgctgcaaggaggactggtcgtctcagaggtcaagctgctgctcttgcctccaagcaagaataaggagataaatcttcaggatgatgaagttgtttactttttttgttggatttttgctgagaccttgttttgaatcctttagattttctataatcttctttgagacctttgtcttgagaattaaacctccatattatcagtttaaatttcgttattcagttttgatttctaactcgtttatagtgttaccgtaaagc

SEQ ID NO: 3475 - DNA, 925 bp, Brassica napus
agaagaagaaagatcatcatcatccatgggtcgtgtcatcagagctcaacgtaagggagcaggctccgtcttcaagtcccacactcaccaccgcaagggccccgccaagttcaggagcctcgacttcggcgagagaaatggttacctcaagggtgtcgtcaccgagatcatccacgatccaggtcgcggtgctccgttagctcgcgtctccttccgtcatcctttccgttacaagaagcagaaggagctcttcgtcgccgccgaaggtatgtacaccggacagttcttgtactgcggtaagaaggccactctcgttgtcggaaatgttctgcctctcagatctatccccgagggagctgttgtctgcaacgtcgagcaccatgttggtgatcgtggtgtgctcgctagggcttctggtgattacgctattgttatctctcacaatcccgacaacgacacgaccagggttaagttgccatctggttcgaagaagattgtcccaagtggatgcagggccatgattggtcaagtcgctggtggtgggagaactgagaagccgatgctcaaggcgggtaacgcgtaccacaagtaccgtgtgaagaggaactgctggcctaaggttcgtggtgtggctatgaaccctgttgagcatcctcacggaggaggtaaccatcaacatattggtcacgctagtaccgttcgtcgtgatgcaccacccggacaaaaggttggtcttattgctgcaaggaggactggtcgtctcagaggtcaagctgctgctcttgcctccaagcaagaataaggagagaaatcttcatgatgatgaagttgtttacttttgttggatttttgctgagaccttgtgttgaatcctttagtttttctataatctttcttgagacctttgtcctgagaattaaacctc

SEQ ID NO: 3476 - DNA, 1080 bp, Brassica napus
tcggccttatggccgggggaaccctcacttccttgctcccgccgtaaactcaacaagactcagatccacccaccatgggtcgtgtcatcagagctcaacgtaagggagcaggttccgtcttcaagtcccacacccaccaccgcaagggccccgccaaattcagaagcctcgacttcggcgaaagaaacggatacctcaaaggtgtcgttaccgagatcatccacgatccaggacgcggtgctccgttagcccgcgtcgcgttccgtcatcctttccgttacaagaagcagaaggagctcttcgtcgccgccgagggtatgtacacggggcagtttctttactgcggtaagaaagctactcttgtcgtcggaaatgtgcttcctctcagatctatccccgagggagctgttgtctgcaacgtcgagcatcatgttggtgatcgtggggttttcgctagagcttctggtgattacgctatcgttattgctcacaatcccgacaacgacacaacaagggttaagttaccatctggttcgaagaagattgtaccaagtggttgcagggctatgattggtcaagttgctggtggtggaaggacggagaagccgatgctcaaggcgggtaacgcgtaccacaagtaccgtgtgaagagaaactgctggcctaaggttcgtggtgtggctatgaatccagttgagcatcctcacggaggaggtaaccatcaacatattggtcacgctagtactgttcgtcgtgatgcaccacctgggcaaaaggttggtcttattgctgcaaggaggactggtcgtctcagaggtcaagctgctgctcttgcttccaagcaagaataaggagaagaagctgcatgatgaaattcttcacttttttggattgtgtttaagaccttgttttgaaatgtatggatactcggttgcgacctttctctattatttagaatctatgttttttttttgcgttaagaaacgtcgatcctcttggcaaatactttagtggtaactgaacaagtatttgcagtgatctttgtaaggagactagaagggtttaatgaatctgattcca

SEQ ID NO: 3477 - DNA, 1005 bp, Brassica napus
atatttttatgtatgcaattgttgatttccctctggccgtaaactcaagaagaaggaagatcatcatcatccatgggtcgtgtcatcagagctcaacgtaagggagcaggctccgtcttcaagtcccacacccaccaccgcaagggccccgccaagttcaggagcctcgacttcggcgagagaaatggttacctcaagggtgtcgtcaccgagatcatccacgacccgggacgtggtgctccgttagctcgcgtctccttccgtcatcctttccgttacaagaagcagaaggagctcttcgtcgccgccgagggtatgtacaccggacagttcttgtactgcggtaagaaggcgactctcgttgtcggaaatgttctgcctctcagatctatccccgagggagctgttgtctgcaacgtcgagcaccatgttggtgatcgtggtgtgctcgctagggcttctggtgattacgctattgttatctctcacaaccctgacaacgacacgaccagggttaagttgccatctggttcgaagaagattgtcccaagtggttgcagggccatgattggtcaagttgctggtggtggaaggactgagaagccgatgctcaaggcgggtaacgcgtaccacaagtaccgtgtgaagaggaactgctggcctaaggttcgtggtgtggctatgaaccctgttgagcatcctcacggaggaggtaaccatcaacatattggtcacgccagtaccgttcgtcgtgatgcaccacctgggcaaaaggttggtcttattgctgcaaggaggactggtcgtctcagaggtcaagctgctgctcttgcctccaagcaagaataaggagataaatcttcaagatgatgaagttgtttacttttgttggatttttgctgagaccttgtgttgaatcctttagtttttctataatctttcttgagacctttgtcctgagaattaaacctccacattatcagtttaaatttccttattcagttt

SEQ ID NO: 3478 - DNA, 1334 bp, Cedrus atlantica
tgatgaattggttcaccgagattgagacccacttcagaggcatggttggctgctttcattttttggtaggcgcaacagagctaaactccccgtgttgtgaatcttcgcttgtctgcagatatgggtcgcgttattcgtgcacagagaaaaggagcaggttccgtgttcagatcccacacccatcacaggaagggccctgcacggttcagaagcctcgactacggcgagcgcaatgggtacatcaggggaatcgtgacggacgttatacacgacccaggccgtggcgcccccctctgtaaggtgaccttcaggcacgccttccgctacaagcatcagaaggagctcttcgtagcagctgagggcatgtacacgggccagttcgtttactgcgggaaaaaagccaatttgactgtgggtaacgtgttgcccttgaggtctattccggagggagctgttgtctgcaacgtggaacaacatgtcggcgatcgaggttcgtttgctagggcttccggggactatgccatcgtcgtcagccacaaccctgataacggcactaccagggtgaaacttccctctggagctaagaagattgtgccaagtagttgtagagctatgattggtcaagttgctggaggtggaagaacagaaaaaccaatgctcaaggctggtaatgcataccacaaatacagggtcaaaagaaactgttggcccaaggttcgtggtgtggctatgaacccagttgagcatcctcatggtggtggtaaccatcaacatattggtcatgctagtactgtacgtcgtgatgcaccaccagggcaaaaagttgggcttattgctgccagaagaactggtcgtctgcgtggacaggctgcctcagcagctgcaaagacagacaactaatcttagtctgtttctatttgcaaggatttcatggtcctattttagtgttttatttttcataatgtgattgtataagggttttgatcctttattttaattcaggtagtagaagtaattgttcacagaggtcaggaaacacaaaactgcatatcgaaattttgtttgtttattttacctttctatgttgcaacaatttacgacaaccaagtaataatttcagttttcctttacatgattgtttatcagtgagcagcttgctcacatcactgcatgatattttagacttgcaatagttatacgagctatgaatagttacgaccaaacttaacatatcaatcgtatttgttgttgtaagaatcttttcaaatgctcgtttatgatgtactggtccaatgaacgaataattctctgagcaagacaaagtacttcttggt

SEQ ID NO: 3479 - DNA, 814 bp, Cleome gynandra
tccatttcgtcgcttctccttccccagctcctcccgccgtcccaatgggtcgtgtcatcagagctcaacgtaagggtgcgggttccgtcttcaagtctcacacccaccaccgcaagggtccggcgaagttccgtagcctcgacttcggcgagcgcaatggttacctgaagggtgttgtcaccgaaatcattcacgacccgggtcgtggcgcgcctctcgctcgcgtcgtcttccgtcacccgttccgttacaagaagcagaaggagctcttcgtcgctgccgagggaatgtacactggtcagttcgtttactgtggtaagagagcctctctcgtcgttggaaacgtcctccctctcagatctatccccgagggagctgtcgtctgtaacgtcgagcaccatgtcggtgatcgcggtgttttcgctagggcttctggtgattacgccatcgttattgctcacaatcccgacaatgacaccactagaatcaagcttccatctggttccaagaagattgtcccaagtggctgcagggctatggttggtcaagtcgcgggtggtggaagaacagagaagcctcttctcaaggctggtaatgcctaccataagttccgtgtgaagaggaactgctggcctaaggttcgtggtgtggctatgaacccagttgagcatcctcatggaggaggtaaccatcaacacattggtcacgccagtaccgtcagacgggatgcacctcctggtcaaaaggttggtctcattgctgctaggaggactggtcgtctcagaggtcaagctgctgctacagctgccaaggc

SEQ ID NO: 3480 - DNA, 1004 bp, Cleome gynandra
aagcagtggtatcaaacgcagaggtacgcggggctagctcttacattttacttcatctccttgtcccgattctcccgccgtcgacgctatgggtcgtgtcatcagagctcagcgtaagggtgcgggttccgtcttcaagtctcacacccaccaccgcaaaggtccggcaaagttccggagcctcgacttcggcgagcgcaatggttacctgaagggtgtcgtcaccgagatcatccacgacccgggacgtggtgcacctctcgcccgtgttgttttccgacacccgttccgttacaagaagcaaaaggagctgttcgtagccgccgagggtatgtacactggtcagttcgtgtactgtggtaagagagcctctctcgttgttgggaacgttctcccgctcagatctatccctgagggagctgttgtctgcaacgtcgagcaccacgtcggtgatcgtggtgttttggctagagcatctggtgattacgccatcgtcattgcccacaacccagacaacgataccactagaatcaagcttccatctggttcaaagaagattgtcccaagtggctgcagggccatgattggccaagtcgctggaggtggaagaaccgagaagcctctcctcaaggctggtaatgcgtaccacaagttccgtgtgaagagaaactcttggcctaaggttcgtggtgtggctatgaacccagtcgagcatcctcacggaggaggtaaccatcaacacattggtcatgccagtacggtcagacgtgatgctcctcctggacagaaggttggtcttattgcagccagaaggactggtcgtctcagaggtcaagctgctgccacagctgccaaggctgactaggttaagagatcaatttgcaatccatttcgtggcatttttgttgtgtttcgattcagactgttctgagatcccgcaattacgactgttctccatgttgaacttacatctgcacttacaactcaatgctagtggtttactt

SEQ ID NO: 3481 - DNA, 1179 bp, Cryptomeria japonica
  misc_feature (91)..(91): n is a, c, g, or t
  misc_feature (694)..(694): n is a, c, g, or t
gacagtgtgggagaggaagaggagtgggagaggagaggcgtttcactactgttctgttcaaagtggatttttatagaaaatgggtcgcgtnatcagagcgcagaggaagggagcaggttccgtgttcaagtcgcacactcatcacagaaagggccctgcgcgctttcggagtttggattacggcgagagaaatgggtacctgaagggcatcgttacagaagttgttcacgatccggggcgcggcgcacccctctgccgtgtaaattttaggcatcccttccgttataggcagcagaaggaacttttcatcgctgctgaggggatgtatacaggtcagttcatttattgtggcaagaaggcaaatctcaccgtgggaaatgtcttgcctttgagatctattcccgagggcgctgtagtttgcaacgtggagcagcacgtcggcgatcgtggctcctttgccagggcttctggagactacgccatcgttatcagccacaaccctgataatggcacttccagggtaaaacttccgtctggagctaagaagattgtgccaagtagttgccgggcaatgattgggcaggttgccggtggtggtaggacagaaaaaccgatgctgaaggctggtaacgcgtatcataaatttagggttaaaagaaactgttggcccaaggtacggggtgttgccatgaancctgtggaacatccccatggtggaggtaaccaccaacatattgggcatgccagtactgtgcgtcgtgatgcaccaccaggacaaaaagttggtcttattgctgctaggagaactggtcgtctgcgtggacaagctgcaacagcagcttcaaagacagataaggcttagtatcagacctagagttactgattatgcaagaatgtcgtagtttcttttctttttaaggttgctttctgtcatcaatttttgtgaaacaggttgtaaactttgtttccaattattgttttttatcattagtggtttattgttaattcaaaattttgagagagacttaaaactgggttgtaatcctcgtttgttgttactgtttgaggcaaattttaatgctatcatattaatcgaatttgtcatttttggatattctttgaactactgttttaagttttcagatcatggaaatagaaaaaaaatgagaatttctcggt

SEQ ID NO: 3482 - DNA, 1085 bp, Euonymus alatus
ccctttccctcgccctcgccctcgccccctagaaaccctaacgctagactctcatattctttgccatgggtcgcgtcatccgagcacagcgtaagggtgccggctcgattttcaagtcccacacccatcaccgcaagggtccggcgcgttttcgctcgctcgacttcggtgagcgcaacggttacttgaggggtgtggtatcggagatcattcacgatccgggtcgcggtgcgccgcttgctcgtgttgtgttccgccatcccttccgttacaagcatcagaaggagctctttgtcgccgctgagggtatgtacaccggacaattcatctactgtggcaagaaggctaacttgatggttggaaatgttcttcctcttagagctattcccgagggtgccgtcgtctgcaatgttgagcaccatgttggtgaccgtggtgttttggctagagcctctggtgattatgctattgttattagtcacaaccctgataatggaactaccagagtcaagcttccttctggatcaaagaagattgtgccaagtgggtgcagagctatgattggtcaggttgcaggtggtggcaggactgagaagccaatgctgaaggcaggtaacgcatatcacaaataccgcgtgaagcgaaactgctggcctaaggttcgtggtgttgccatgaatccagttgaacatccccatggtggtggtaaccaccagcatattgggcatgctagtactgttagccgctatgctccgcctgggcagaaggtgggtcttattgctgcaagaaggactggtcgtcttcggggacaagctgctgctgctgcttcaaaatctgactagggttcttaaattgttttgctatttggattttgtctttgggaactatgttatttttgacatctagcaagtggagtatttctgttgttcctatagaggttcttgtttccaagttttggaatgatgtttatcgtctttgggatttaactgttatattttgcaatagaatactttccagttatcggttttgtcctaatttatactggcattaacgtatattgtttgtagtgcaggaggtttccatgc

SEQ ID NO: 3483 - DNA, 1001 bp, Linum usitatissimum
acacccctttcattcgccgctgctcatttctcttcacccacacacacaggtacaatgggaagagtcatccgagctcagcgtaagggtgccggttccgtcttcaagtcccacactcaccaccgcaagggaccggctcgcttccgctccctcgacttcggcgagaggaacggctacctcaagggcgtcatcaccgaggtcatccacgatcccggtaggggtgcgccgctcgtcagggtcagcttccgccaccctttccgctaccagaagcagaaggagctcttcgtcgccgccgagggtatgtacactggccagttcgtgtactgcggtaagaaggccaatcttatggtcggtaacgtcttgcccctcagatctatccccgagggaggcgttgtctgcaacgtcgagcaccacgttggtgatcgcggtgccttcgctaggtgctctggtgattacgccatcgtcatcagtcacaaccctgacaacgacaccactagggtgaagctcccatctggtgcaaagaagattgttccaagtggatgccgtgctatgattggtcaagttgcaggaggaggaaggactgagaagcctatgctgaaggctggaaatgcgtaccacaagttcagggttaagaggaactgctggcctaaggttcgtggtgtcgctatgaatccagttgagcatcctcatggtggtggtaaccatcagcacattggtcacgctagtaccgtcaggagggatgcaccccctgggcagaaggttggtcttattgctgccaggagaactggtcgtctcagaggtcaagctgccgcatctgctgccaagacagacaaggcttagatatctttatgagttttttctcgatatcttggaattgctatcctggattaggtttaattttgaagacatttatcatgttttgtgtttgttattgtcagacttcgaagttgggtattaaggttttgttctgtgacgatattttgaaattatatgctgcttggttt

SEQ ID NO: 3484 - DNA, 1149 bp, Allium cepa
ctctccataccctcaaagcagccgccgccatgggtagagtaatcagagcgcagcgcaagggagctggtggaatattcaaatcgcacacccaccatcgcaagggaccggcccgcttccgctccctcgacttcagcgaacgcaatgggtatctcaaaggcgtcatcaccgacatcatccacgaccccgggcgaggtgcacctcttgcacgcgtgaggttcagacatccgtttaggtacaagcacgagaaggagctgttcgtcgccgctgaaggaatgtacaccggtcagtttgtttattgtggaaagaaggcgaatctgatggtcggaaacgtgcttccgcttagcagtattcccgagggagcggttatttgcaacgtcgagcatcatgttggcgatagaggtgttttggctagagctagtggtgattacgctattgttatcagtcataatcctgataatggcacttccaggataaagctgccatcaggggcaaagaagatagtgccaagcggatgcagagcaatgatagggcaagtagcaggaggagggaggaccgagaagccgcttctgaaagcaggaaatgcttaccacaagtacagagtgaagaggaactgctggcccaaggtacgtggtgtggctatgaatccagtggagcatcctcatggtggtggtaaccatcagcatatcggtcatgcttccactgtccgccgtgatgcaccacctggacagaaggtcggtctcattgctgctagaagaactgggcgtctcagaggacaggctgctgcttctgcttccaaggctgataagtaaaccttttcctattttacctgtttacatgcacttttcttttatgttcaagtttgtaggacttatttgtcaccatgaggttgtgctttcttatttaagattcccttttatgaaatttgtatctctattctggattatgatttttgctgatctgatacaatgcaaaatctggatatgtgatgtgattctattctgtagttagagaaatgtctcaagtgaagccaaagcaaatactacgttatcatcttggcgatagttagcaccctcattaaattttgaccgagcttcatttcttgttggtataccattttggtttcctactgcttttgtccatatgacttca

SEQ ID NO: 3485 - DNA, 963 bp, Allium cepa
  misc_feature (924)..(924): n is a, c, g, or t
  misc_feature (926)..(926): n is a, c, g, or t
  misc_feature (944)..(944): n is a, c, g, or t
ctctccataccctcaaagcagccgccgccatgggtagagtaatcagagcgcagcgcaagggagctggtggaatattcaaatcgcacacccaccatcgcaagggaccggcccgcttccgctccctcgacttcagcgaacgcaatgggtatctcaaaggcgtcatcaccgacatcatccacgaccccgggcgaggtgcacctcttgcacgcgtgaggttcagacatccgtttaggtacaagcacgagaaggagctgttcgtcgccgctgaaggaatgtacaccggtcagtttgtttattgtggaaagaaggcgaatctgatggtcggaaacgtgcttccgcttagcagtattcccgagggagcggttatttgcaacgtcgagcatcatgttggcgatagaggtgttttggctagagctagtggtgattacgctattgttatcagtcataatcctgataatggcacttccaggataaagctgccatcaggggcaaagaagatagtgccaagcggatgcagagcaatgatagggcaagtagcaggaggagggaggaccgagaagccgcttctgaaagcaggaaatgcttaccacaagtacagagtgaagaggaactgctggcccaaggtacgtggtgtggctatgaatccagtggagcatcctcatggtggtggtaaccatcagcatatcggtcatgcttccactgtccgccgtgatgcaccacctggacagaaggtcggtctcattgctgctagaagaactgggcgtctcagaggacaggctgctgcttctgcttccaaggctgataagtaaaccttttcctattttacctgtttacatgcacttttcttttatgttcaagtttgtaggacttatttgtcaccatgaggttgtgctttcttatttaagattcccttttatgaaattngnatctctatctggatatgntttttgctgatctgataaa

SEQ ID NO: 3486 - DNA, 1017 bp, Raphanus sativus
gggccgtaaacttcagaagacgaaagaacatcacaatccaccatgggacgtgtcatcagagctcaacgtaagggagctggttccgtcttcaagtcccacactcaccaccgcaagggccccgccaagttcaggagcctcgacttcggcgagaggaacggttacctcaagggtgtcgtcacggagatcatccacgatccaggacgtggtgctccgttagcccgcgtcgccttccgtcatcctttccgttacaagaagcagaaggagctcttcgtcgccgccgagggtatgtacaccggacagtttctgtactgcggtaagaaggccactctcgttgtcggaaatgttcttcctctcagatctatccctgagggagctgttgtctgcaacgtcgagcaccatgtcggtgatcgtggtgtgctcgctagagcttctggggattacgctatcgtgatttcacacaaccctgacaacgacacgaccagggttaagttgccatctggatcgaagaagattgtcccaagtggatgcagggctatgattggtcaagttgctggaggaggaaggacagagaagccaatgctcaaggcgggtaacgcgtaccacaagtaccgtgtgaagagaaactgctggcctaaggttcgtggtgtggctatgaaccctgttgagcatcctcacggaggaggtaaccatcagcatattggtcacgccagtactgttcgtcgtgatgcaccccctgggcaaaaggttggtcttattgctgcaaggagaactggtcgtctcagaggtcaagctgctgctcttgcttccaagcaagaataaggagaagaggattgaagatgatgaatctgttcacttttgtttttgggtttttgctgagaccttgttttgatactttaagatttgctataatgttatttgcgacctttctctatcaagtagaatctatgttttcggagttaaccttcgcattattatgcatttgaaatttaagaaacaatctccatgctttgcaaccta

SEQ ID NO: 3487 - DNA, 1028 bp, Raphanus sativus
  misc_feature (23)..(23): n is a, c, g, or t
ccatgggtcgtgtcatcagagcncaacgtaagggagcgggttccgtcttcaagtcccacactcaccaccgcaagggtcccgccaaattcaggagcctcgacttcggcgagagaaacggatacctcaagggcgtcgtcacggagatcatccacgatccgggacgcggagctccgttggctcgcgtcgcgttccgtcatcctttccgttacaagaagcagaaggagcttttcgtcgccgccgagggtatgtacaccgggcagtttctctactgcggtaagaaagcaactctcgtcgtcggaaatgtgcttcctctcagatctatccccgaaggagctgttgtctgcaacgtcgagcaccatgtcggtgatcgtggggttttcgctagagcttctggggattacgctatcgttattgctcacaatcccgacaacgacaccactagggttaagttgccatctggttcgaagaagattgtgccgagtggatgcagggctatgattggtcaagttgctggtggtgggaggactgagaagccgatgcttaaggcgggtaacgcgtaccacaagtaccgtgtgaagagaaactgctggcctaaggttcgtggtgtggctatgaatccagttgagcatcctcacggaggaggtaaccatcagcatattggtcacgctagtactgttcgtcgtgatgcgcctcctgggcaaaaggttggtcttattgctgcgaggaggactggtcgtctcagaggtcaagctgctgctcttgcttccaagcaagaataaggagaggaggcttgaggatgaaatcgctcaatgtttttggatcgtgtttaagaccttgttttgaaaccttaaggagaggagacagtgttctttgagacctttctcgatctatttcttcagtttattggtttccattttcattttgcgtgcctctttcatactaatactcaaaacataaagatgtaacatctgccaactttgagagaaacagtctatttgttgttgaaactacttcagctttgcaaactt

SEQ ID NO: 3488 - DNA, 958 bp, Raphanus sativus
  misc_feature (796)..(796): n is a, c, g, or t
  misc_feature (800)..(800): n is a, c, g, or t
  misc_feature (802)..(803): n is a, c, g, or t
  misc_feature (806)..(806): n is a, c, g, or t
  misc_feature (811)..(811): n is a, c, g, or t
  misc_feature (822)..(822): n is a, c, g, or t
  misc_feature (893)..(893): n is a, c, g, or t
  misc_feature (901)..(901): n is a, c, g, or t
  misc_feature (909)..(910): n is a, c, g, or t
  misc_feature (922)..(922): n is a, c, g, or t
gaagaagaagacgaatccatgggtcgtgtcatcagagctcaacgtaagggagcaggctccgtcttcaagtcccacactcaccaccgcaagggccccgccaagttcaggagcctcgatttcggcgagagaaatggttacctcaagggtgtcgtcacggagataatccacgatccgggtcgcggtgctccgttagcccgcgtcgccttccgtcatcctttccgttacaagaagcagaaggagctcttcgtcgccgccgaaggtatgtacaccggacagttcctctactgcggtaagaaggccactctcgtcgtcggaaatgttctgcctctcagatctatccccgagggagctgttgtctgcaacgtcgagcaccatgtcggtgaccgtggtgtgctcgctagagcttctggagattacgctatcgttatttcacataaccctgacaacgacacgacaagggttaagttgccatctggatcgaagaagattgtcccaagtggatgcagggccatgattggtcaagttgctggtggtggaagaactgagaagccaatgctgaaggcaggtaacgcttaccacaagtaccgtgtgaagaggaactgctggcctaaggttcgtggtgtggctatgaaccctgttgagcatcctcacggaggaggtaaccatcaacatatcggtcacgccagtactgttcgtcgtgatgcaccacctgggcaaaaggttggtcttattgctgcaaggaggactggtcgtctcagaggtcaagctgctgctcttgcctccaagcaagaataangagngnnagnttcangatgatgaaantgtttacttttgttggatttttgctgagaccttgttttgaatcctttagattttctttaatcttctttganacctttgncttcaggnncaaacctccacnttatcattttaaatttcaggattcagttttgatttc

SEQ ID NO: 3489 - DNA, 976 bp, Raphanus sativus
gggccgtaaactcaagaagaaggaagaagaagacgaatccatgggtcgtgtcatcagagctcaacgtaagggagcaggctccgtcttcaagtcccacactcaccaccgcaagggcccagccaagttcaggagcctcgatttcggcgagagaaatggttacctcaagggtgtcgtcacggagatcatccacgatccgggtcgcggtgctccgttagcccgcgtcgccttccgtcatcctttccgttacaagaagcagaaggagctcttcgtcgccgccgaaggtatgtacaccggtcagttcttgtactgcggtaagaaggcgactctcgttgtcggaaatgttctgcctctcagatctatccccgagggagctgttgtctgcaacgtcgagcaccatgtcggtgatcgtggtgtgctcgctagagcttctggagattacgctatcgttatttcacacaaccctgacaacgacacgacaagggttaagttgccatctggatcgaagaagattgtcccaagtggatgcagggccatgattggtcaagttgctggtggtggaagaactgagaagccgatgctcaaggccggtaacgcgtaccacaagtaccgtgtgaagaggaactgctggcctaaggttcgtggtgtggctatgaaccctgttgagcatcctcacggaggaggtaaccatcaacatatcggtcacgccagtactgttcgtcgtgatgcaccacccgggcaaaaggtcggtcttattgctgcaaggaggactggtcgtctcagaggtcaagctgctgctcttgcttccaagcaagaataaggagagaaagtttcaagatgatgaagttgtttacttttgttggatttttgctgagaccttgttttgaatcctttagattttctttaatcttctttgaggcctttgtcttcaggatcaaacctccacattatcattttaaatttcaggattcagttttga

SEQ ID NO: 3490 - DNA, 1019 bp, Raphanus sativus
  misc_feature (729)..(729): n is a, c, g, or t
  misc_feature (822)..(822): n is a, c, g, or t
gggccgtaaactcaagaagaggaaggaagatcatcatccatgggtcgtgtcatcagagctcaacgtaaaggagcaggctccgtcttcaagtcccacactcaccaccgcaagggccccgccaagttcaggagcctcgatttcggcgagagaaatggttacctcaagggtgtcgtcacggagatcatccacgatcctggtcgcggtgctccgttagcccgcgtcgccttccgtcatcctttccgttacaagaagcagaaggagctcttcgtcgccgccgaaggtatgtacaccggacagttcctctactgcggtaagaaggccactctcgtcgtcggaaatgtcctgcctctcagatctatccccgagggagctgttgtctgcaacgtcgagcaccatgtcggtgaccgtggtgtgctcgctagagcttctggtgattacgctatcgttatttcacacaaccctgacaacgacacgacaagggttaagttgccatctggatcgaagaagattgtcccaagtggatgcagggccatgattggtcaagttgctggtggtggaagaactgagaagccgatgctcaaggcgggtaacgcgtaccacaagtaccgtgtgaagaggaactgctggcctaaggttcgtggtgtggctatgaatcctgttgagcatcctcacggaggaggtaaccatcaacatatcggtcacgccagtaccgtccgtcgtgatgcaccncccgggcaaaaggttggtcttattgctgcaaggaggactggtcgtctcagaggtcaagctgctgctcttgcctccaagcaagaataaggaggngaagcttcatgatgatgaaactgtttacttttgttggatttttgctgagaccttgttttgaatcctttagattttctttaatcttctttgagacctttggcttcaggatcaaacctccacattatcattttaaatttcaggattcagttttgatttctttgatctcagattatcatctataaggatctaattataga

SEQ ID NO: 3491 - DNA, 1072 bp, Raphanus sativus
ggtctcaaaccctaattgtagtcttcgccgtctagcatccatccatccatgggtcgtgtcatcagagcccaacgtaagggagcaggttccgtcttcaagtcccacacccaccaccgcaagggtccagccaagttccgcagcctcgactacggcgagagaaatggatacctcaagggcgtcgtgacggagatcatccacgatcccggccgtggtgcgccgctagctcgcgtcgcgttccgtcatcctttccgttacaagaagcagaaggagctcttcgtcgccgccgagggtatgtacacgggacagttcttgtactgcggtaagaaagccactctcgttgtcggaaatgttctcccccttagagcaattcctgaaggagctgttgtctgtaacgtcgagcatcatgtcggtgatcgtggtgtcctcgctagagcttctggtgattacgctatcgttatttcacacaaccctgacaacgacactactagggtcaagttgccatctggttcgaagaagattgttccgagtggatgcagggccatgattggtcaagttgcaggtggtggaaggaccgagaagccgatgctcaaggcaggaaacgcgtaccacaagtaccgtgtgaagaggaactcatggcctaaggttcgtggtgtggctatgaatccagttgagcatccccatggaggaggtaaccatcagcacattggtcacgccagtactgttagacgtgatgcacctcctggacagaaggttggtcttattgctgctaggagaactggtcgtctcagaggtcaagctgctgcttctgctgccaaggccgactaggtttcataaaatatttttgtttgcgttttgctgtctttcctttcggaccttgttgtgttctgaaatctcaaaaatattttgttataatcttgtccttctctgtcgaagttattattatgtctttacaattttcatttcgcaagtgttgattatatttgttcatttttcgttttgttctctaattaaactacatatatttctggtcgaagttgggatgctaattgaatcttggtctttttgtaacgga

SEQ ID NO: 3492 - DNA, 1043 bp, Silene vulgaris
ctcccccaaaccgcagccaaatccccaaatctccccaaaaatgggtcgcgtcatccgggcacaacgtaagggagcaggctcaatcttcaaatcccacacacaccaccgcaagggagcagccaaactccgcaccctcgatttcggtgaacgaaacggttacctgaaaggagtcatcaccgacatcatccatgatccaggtcgtggtgcccccctagctaaggtcaccttccgacatcccttcaggtataagcatcagaaggaactgtttgttgctgcagaagggatgtatactggacagtttctgtattgtgggaagaaagctaatctgatggttggaaatgtgttgcctttgaggagtattcctgaaggtgctgttgtttgtaatgttgaacatcatgttggtgatcgtggtgtttttgctagagcttctggtgattatgctattgttatttctcataatcctgataatgatacctctagggtcaagcttccatcaggtgccaagaaggtagtcccaagtggttgccgtgctatgattgggcaaattgccggaggcggtcgtactgagaagccacttctaaaggctggaaatgcttaccacaagttcagagtgaagagaaactgctggcccaaggttagaggtgttgctatgaatccagttgagcatcctcatggtggtggtaaccatcaacacattggtcacgccagtactgtccgtagggatgccccacccggtcaaaaggttggtcttattgctgctcgcaggactggtcgtcttcgtggtcaagctgcttctgctgcttccaagagtgacaaggcttaagttttactttgttttctgttttgatcatctagtttggagattgcttgctaagattgtttgtactcagatttgtttagaaactctgttctggtttttaccatctgttattgcctgaaatacaattgttgctgaatgaatcgatcaactgggtttactcttataagttatcagttttgtaacattctgaaagctacatgttctccattgctctcaatgttaa

SEQ ID NO: 3493 - DNA, 1241 bp, Picea glauca
tactcgcgttaggttttttttatagtgggagggagggttggagcagaaactatagtagtgtagtgtagcgatggggagggtgatcagagcacagaggaagggagcggggtccgtgttcagatcccacacgcaccacaggaagggtcctgcccgctttcgcagcctcgactatggagagcgcaatggctacattaagggcattgtctctgatgtcatccatgacccagggcgcggtgccccgctctgcaaggtaactttcaggcaccccttccgctacaggcaccagaaggagcttttcgtcgcagctgagggtatgtacacgggccagttcgtttactgcggtaagaaggccaatcttatcgtgggcaacgtgctgcctctcagatctattcccgagggagccatcgtctgcaatgtggagcaacatgtcggggaccgtggttcatttgcccgagcttcgggagactacgctatcgtcgtcagtcacaattttgataatggcactagcagaatcaagctaccttctggagccaagaaaatagtgccaagcagttgcagagctatgattggtcaggttgctggtggtggaaggactgaaaagcccatgctcaaggctgggaatgcataccataaatacagagtcaagagaaattgctggcccaaggttcgtggtgttgctatgaacccagttgaacatcctcatggtggtggtaaccatcagcatattggtcatgccagtaccgtgcgtcgtgatgcaccacctgggcagaaagttggtcttattgccgcaagaagaactggtcgtttacgtggacaagctgcaacagccgcttcaaagactgacaaaaccagttagtgtgttccatggctgctattatgtggaagaggtgttgtttatcccgtatgcatttttgaattgtttggtatcttcacaaacaaaagagttggtttactctcattacaaagatttattgtccctcagatttggcctttgtgggtctaaagttctgagtatttctttgtttaatgaagttttgttcaagaattttatttgatgaacattttagatcactggttttagcatatcagcatttgtaggctgattgaacctaggccggcctttgctattatgatgaggaaagatacctttctttatttgtctgctcacaatgtgttattcagttgggtagatatatctaattttttgatttaatattttggccagtaaggattttcttgtt

SEQ ID NO: 3494 - DNA, 1032 bp, Eutrema halophilum
atcttcatcattttcgagttcggtctcaaaccctaatcacaatcttcgccgtcgagaagcatccatgggtcgtgtcatcagagctcagcgtaagggagcgggttccgtcttcaaatcccacactcaccaccgtaagggtccggctaagttccgcagcctcgatttcggcgagcgtaatggttatctcaagggagtcgtgacggagatcattcacgatcctggccgtggagcgccgcttgctcgcgtctctttccgccatcctttccgttacaagaagcagaaggagcttttcgtcgccgcagaaggtatgtacaccggccagtttctgtactgcggtaagaaagccactctcgtcgtcggaaatgtcctcccgcttcgagctattcccgaaggagccgtcgtctgcaacgtcgagcaccacgtcggagatcgtggtgttctcgctagagcttccggcgattacgcaatcgttattgctcacaaccctgacagtgacactactaggatcaagttgccatctggttcgaagaagattgtcccgagtggatgcagagccatgattggtcaagtagctggtggtggaagaaccgagaagccgatgctcaaggcaggaaacgcgtaccacaagtaccgtgtgaagagaaactcatggcctaaggttcgtggtgtggctatgaaccctgttgagcatcctcacggaggaggtaaccatcagcacattggtcacgccagtacggtcaggcgtgacgcaccaccaggacagaaggttggtcttattgctgctaggaggactggtcgtctcagaggtcaagctgctgcttctgccgccaaggccgactaggtttaaagattgtatgctgttttcttggagtttttgctgtgtgttttccctttgaaacttgtgttctgaaatctcaaagattttgttataatcttgtcttctttcttcaagcttatattatgcattttgcaagttttcgtttcactaaatttcattatatttaagcattttattttcttttctcctctcta

SEQ ID NO: 3495 - DNA, 956 bp, Thellungiella halophila
gcggtctcaaaccctaatcacaatcttcgccgtcgagaagcatccatgggtcgtgtcatcagagctcagcgtaagggagcgggttccgtcttcaaatcccacactcaccaccgtaagggtccggctaagttccgcagcctcgatttcggcgagcgtaatggttatctcaagggagtcgtgacggagatcattcacgatcctggccgtggagcgccgcttgctcgcgtctctttccgccatcctttccgttacaagaagcagaaggagcttttcgtcgccgcagaaggtatgtacaccggccagtttctgtactgcggtaagaaagccactctcgtcgtcggaaatgtcctcccgcttcgagctattcccgaaggagccgtcgtctgcaacgtcgagcaccacgtcggagatcgtggtgttctcgctagagcttccggcgattacgcaatcgttattgctcacaaccctgacagtgacactactaggatcaagttgccatctggttcgaagaagattgtcccgagtggatgcagagccatgattggtcaagtagctggtggtggaagaaccgagaagccgatgctcaaggcaggaaacgcgtaccacaagtaccgtgtgaagagaaactcatggcctaaggttcgtggtgtggctatgaaccctgttgagcatcctcacggaggaggtaaccatcagcacattggtcacgccagtacggtcaggcgtgacgcaccaccaggacagaaggttggtcttattgctgctaggaggactggtcgtctcagaggtcaagctgctgcttctgccgccaaggccgactaggtttaaagattgtatgctgttttcttggagtttttgctgtgtgttttccctttgaaacttgtgttctgaaatctcaaagattttgttataatcttgtcttctttcttcaagcttatattatgcattttgcaagt

SEQ ID NO: 3496 - DNA, 857 bp, Vinca minor
gcccaccacccaccaccaccttccgccatgggtcgtgttatccgagcacagcgtaagggagcaggttctgtcttcaagtcccacactcaccaccgtaaaggtccggccaagttccgatcactcgatttcggcgaacgcaatggttacttgaaaggagttattaccgagatcattcacgatccaggacgtggtgctccgttagctcgcgtcactttccgtcatcctttccgttttcagcatcaaaaagagcttttcgtcgccgctgaagggatgtatactggtcaatttgtttactgcggtaaaaaagctaatctaatggttggaaatgttttaccactcagatctatccctgaaggagctgttgtttgtaacgttgagcataagatgggtgaccgtggtgtttttgctagagcttctggtgattatgctattgttattagtcacaacccagacaatggaaccactagggttaagctcccatcaggttctaagaagattgtcccaagtgggtgccgtgccatgattggtcaggttgctggaggtggacgtactgagaagccaatgcttaaggctggaaatgcgtaccacaagtaccgtgttaagaggaacagctggcctaaggttcgtggtgttgctatgaatccagttgaacatcctcatggtggtggtaaccatcagcatattggtcacgccagtactgttcgccgtgatgcaccacctggtcaaaaggttggtctcattgctgctaggagaactggtcgtcttcgtggacaagctgccgcctctgcttccaaggctgataaggcataagggtgtgcttagatgctttatgcttttatatatggtttctgttttac

SEQ ID NO: 3497 - DNA, 1048 bp, Brassica juncea
cagtctcaaaccctatcctcaatcttcgccgtcaagcatccacaatgggtcgcgtcatcagagctcagcgtaagggagcaggctccatcttcaaatcccacactcaccaccgcaaaggccccgccaagttccgcagcctcgactacggcgagagaaacggatacctcaagggcgtcgtcacggagatcatccacgatcccggccgtggcgcgccgctcgctcgcgtcgctttccgtcatcctttccgttacaagaagcagaaggagcttttcgtcgccgccgaaggcatgtacaccggacagttcctgtactgcggtaagaaagcgacactcgttgtcggaaatgttctcccgctcagggcgatccctgaaggagctgtcgtctgtaacgtcgagcatcacgtcggtgatcgcggtgtgctcgctagagcttctggggattacgctatcgtgatttcgcacaaccctgacaacgatactaccaggatcaagttgccatctggttcgaagaagattgttccgagtggatgcagggccatgattggtcaagttgctgggggtggaagaacggagaagccgatgctcaaggcaggaaacgcgtaccacaagtaccgtgtgaagagaaactcgtggcctaaggttcgtggtgtggctatgaatccagttgagcatcctcatggaggaggtaaccatcagcacattggtcacgcgagtacggtcaggcgtgatgcaccaccagggcagaaggttgggcttattgctgctaggaggactggtcgtctcagaggtcaagctgctgcttctgctgccaaggctgactaggtttaataagatatgtttgtttttgtttgagttttgctgcgtttccttttgaacctctccttgtgttctgaaatctacaattctcaagaatagcaaaccaaagttgctactgtttgcctatgtgaggttttgttttcgtgagtacaagtcagccggtttggcatgatgatcgatatgcaccagctttggagctttcatgctatagcttttgtgcagattgaaattga

SEQ ID NO: 3498 - DNA, 1068 bp, Brassica juncea
tgggtcgtgtcatcagagctcaacgtaagggagcaggttccgtcttcaaatcccacactcaccaccgcaaaggtccagccaagttccgtagcctcgacttcggcgagagaaatggatacctcaagggagtcgtgacggagatcatccacgatcctggccgtggtgcaccccttgctcgcgtcgctttccgtcatcctttccgttacaagaagcagaaggagctcttcgtcgccgccgaaggtatgtacaccggacagttcttgtactgcggtaagaaggcgactctcgtcgtcggaaatgttctgcctctcagatctatccccgagggagctgtcgtctgcaacgtcgagcaccatgtcggtgatcgtggtgtgctcgctagggcttctggtgattacgctatcgtcatctctcacaaccccgacaacgacacgaccagggttaagttgccatctggttcgaagaagattgtcccaagtggttgcagggccatgattggtcaagttgctggtggtggaaggactgagaagccgatgctcaaggcgggtaacgcgtaccacaagtaccgtgtgaagaggaactgctggcctaaggttcgtggtgtggctatgaaccctgttgagcatcctcacggaggaggtaaccatcaacatattggtcacgccagtaccgttcgtcgtgatgcaccacctgggcaaaaggttggtcttattgctgcaaggaggactggtcgtctcagaggtcaagctgctgctcttgcttccaagcaagaataaagagagtaggagaaaattgcacactattcctgaactttcttttcagaccttgttttgaaatctatagatattcgagtgagacctttctctattattttgaatctatgttttttgcattaaatcttgacattattatgtcctcggttttgaattttgctacattttcagttctcgcttggtcttttttcagctatccaaattttgcgaatttgcgtatcgctcatttcgaaacaacaagacttattaataaacctatctcagtcaatcttaaagatgatgaataacgaagttc

SEQ ID NO: 3499 - DNA, 959 bp, Brassica juncea
ggccgtaaactcaaagaagacgaaacaacttcacacaatccacaatgggtcgtgtcatcagagcccaacgtaagggagcaggttccgtcttcaagtctcacactcaccaccgcaagggccccgccaagttcaggagcctcgacttcggcgagagaaatggttacctcaagggtgtcgtcacggagatcatccacgatccgggacgtggtgctccgttggcccgcgtcgccttccgtcatcctttccgttacaagaagcagaaggagctcttcgtcgccgccgaaggtatgtacaccggacagttcttgtactgcggtaagaaggccactctcgttgtcggaaatgtactccctctcagatctatccctgagggagctgttgtctgcaacgttgagcaccatgtcggtgatcgtggtgtgctcgctagagcttctggtgattacgctatcgttattgctcacaatcccgacaacgacacaacaagggttaagttaccatctggttcgaagaagattgtaccaagtggttgcagggctatgattggtcaagttgctggtggtggaaggacggagaagccgatgcttaaggcgggtaacgcgtaccacaagtaccgtgtgaagagaaactgctggcctaaggttcgtggtgtggctatgaatccagttgagcatcctcacggaggaggtaaccatcagcatattggtcacgctagtactgttcgtcgtgatgcaccacctgggcaaaaggttggtcttattgctgcgaggaggactggtcgtctgagaggtcaagctgctgctcttgcttccaagcaagaataaggagaagaagctgcatgatgaaattcttcacttttttggattgtgtttaagaccttgttttgaaatgtatggatactcggttgcgacctttctctattatttagaatctatgttttttgtttcatcgatatttctatt

SEQ ID NO: 3500 - DNA, 880 bp, Brassica oleracea
  misc_feature (716)..(716): n is a, c, g, or t
  misc_feature (733)..(733): n is a, c, g, or t
  misc_feature (770)..(770): n is a, c, g, or t
  misc_feature (810)..(810): n is a, c, g, or t
  misc_feature (831)..(831): n is a, c, g, or t
  misc_feature (869)..(869): n is a, c, g, or t
atgggtcgtgtcatcagagctcaacgtaagggagcaggttccgtcttcaaatcccacactcaccaccgtaaaggccccgccaagttccgcagcctcgactacggcgagagaaatggatacctcaagggcgtcgtgacggagatcatccacgatcccggccgtggtgcgccgctcgctcgcgtcgccttccgtcatcctttccgttacaagaagcagaaggagctcttcgtcgccgccgaaggcatgtacaccggacagttcttgtactgcggtaagaaagcgacgctcgttgtcggaaatgttctcccgcttagagctatccctgaaggagctgttgtctgtaacgtcgagcatcatgtcggtgaccgtggtgtgctcgctagagcttctggcgattacgccatcgtgatttcgcacaaccctgacaacgacactactaggatcaagttgccatctggttcgaagaagattgttccgagtggatgcagggccatgattggtcaggtcgctggtggtggaagaacggagaagccgatgctcaaggcgggaaacgcgtaccacaagtaccgtgtgaagagaaactcgtggcctaaggttcgtggtgtggctatgaatccagtggagcatcctcacggaggaggtaaccatcagcacattggtcacgccagtacggttaggcgtgatgcaccaccagggcagaaggttgggcttattgntgctaggaggactggtngtctcagaggtcaagctgctgcttctgccgccaaggntgattaaggtttaataagagagatatatatatttgttttngtttgagttttttgctgcttntccttgtgaaccctccttgtgttctgaaatctcgtttntgttataatct

SEQ ID NO: 3501 - DNA, 1005 bp, Brassica rapa
tcaggacaatataaaccctaatttcaatcttcgccgtcaagcatcatcatcatccacaatgggtcgtgtcatcagagctcaacctaagggagctggttccgtcttcaaatcccacacccaccaccgcaaaggccccgccaagttccgcagcctcgactacggcgagagaaatggatacctcaaggacgtcgtgacggagatcatccacgatcccggccgtggcgcgccgctcgctcgcgtcgccttccgtcatcctttccgttacaagaagcagaaggagctcttcgtcgccgccgaaggcatgtacaccggacagttcttgtactgcggtaagaaagcgacgctcgttgtcggaaatgttctcccgcttagagctatccctgaaggagctgttgtctgtaacgtcgagcatcatgtcggtgatcgcggcgtgctcgctagagcttctggtgattacgctatcgtgatttcgcacaaccctgacaatgatactactaggatcaagttgccatctggttcgaagaagattgttccgagtggatgcagggccatgattggtcaagtcgctggtggtggaagaacggagaagccgatgctcaaggcgggaaacgcgtaccacaagtaccgtgtgaagagaaactcgtggcctaaggttcgtggtgtggctatgaatccagtggagcatcctcacggaggaggtaaccatcagcacattggtcacgcgagtacggttaggcgtgatgcaccaccagggcaaaaggttggtcttattgctgctaggaggactggtcgtctcagaggtcaagctgctgcttctgccgccaaggctgattaggtttcataagatatatatatttgttttgtttgagttttgctttgtttccttgtgaaccctccagtccctccttgtgttctgaaatctcgtttttgttataatcttgcgagtacacttctcaagaatagcaaacctaagttgtactgtttgcccaagtgaggttttgttat

SEQ ID NO: 3502 - DNA, 1191 bp, Humulus lupulus
cttcaaccaggtcgccgcccaaaaaacctaattctcagaaatgggacgagtcattcgtgcgcagcgtaagggtgcgggatcggtcttcaagtcccatacccaccaccgtaagggtccggccaggttcaggtctctcgacttcggcgagcgcaatggttacctgaagggtgtggtcactgacatcatccacgacccaggaagaggtgccccactcgcccgagtcaccttccgtcaccctttccggtacaagcaccagaaggagcttttcatcgccgcagagggtttgtactctggccaattcatctactgtggaaagaaggccaatctcgttgtgggtaatgttcttcctctcagatctctccctgaaggtaccgtcatttgcaacgtcgagcaccacgtcggtgaccgaggtgtccttgctagggcttctggggactacgccgtcgttatcagtcataacccggacaatggaacctccagagtcaagcttccatctggtgccaagaagattttgccaagtggttgcagagctatgattggtcaggttgcaggaggaggtagaactgagaaacctatgttgaaggcaggaaatgcttatcacaaattcagggtgaagaggaacagttggcctaaggttcgtggtgttgctatgaaccctgttgagcatccccatggtggtggtaaccatcaacatattggtcacgctagtaccgttcccagagacgctgctcccgggcaaaaggttggtctcattgccgccagaaggactggtcggcttcgaggacaagctgctgctgctgcttcaaagtctgacaagggttcttagacatttttatgtgcctatggaaatctttcattgtgcattttgctctcttcgatactactgttttattattctgcttaggattggcttcagtttctggattagaactacagttttgcattatgataatcatgtgttctattgttttgcttttgttggaaagtactgcttggcattttttaatttacgtcacttgttagttttgccagttttccaattatcattacacctattgaagccaagtaatcctcctatcgatgctttttgcaacgttgcagaaaaaattaacatgctaaacattttgaatcctgcttcaagtgtgctaattgcaatagaacttatttataaacatgcttcaggattttatc

SEQ ID NO: 3503 - DNA, 1197 bp, Humulus lupulus
ggaagtgtgtcatttcttcttcgccgcccaaaaaacctaattctcagaaatgggacgagtcattcgtgctcagcgtaagggtgcgggatcagtcttcaagtcccatacccaccaccgtaagggtccggccaggttcaggtctctcgacttcggcgagcgcaatggttacctgaagggtgtggtcactgacatcatccacgacccaggaagaggtgccccactcgcccgagtcaccttccgtcaccctttccggtacaagcaccagaaggagcttttcatcgccgcagagggtttgtactctggccaattcatctactgtggaaagaaggccaatctcgttgtgggtaatgttcttcctctcagatctctccctgaaggtaccgtcatttgcaacgtcgagcaccacgtcggtgaccgaggtgtccttgctagggcttctggagactacgccgtcgttatcagtcataacccggacaatggaacctccagagtcaagcttccatctggtgccaagaagattttgccaagtggttgcagagctatgattggtcaggttgcaggaggaggtagaactgagaaacctatgttgaaggcaggaaatgcttatcacaaattcagggtgaagaggaacagttggcctaaggttcgtggtgttgctatgaaccctgttgagcatccccatggtggtggtaaccatcaacatattggtcacgctagtaccgttcccagagatgctgctcccgggcaaaaggttggtcttattgccgccaggaggactggtcgtcttcgaggacaagctgctgctgctgcttcaaagtccgacaagggttcttagacattgtccagttttatgtgcctattgaaatctttcattgtggacattttgctctcttcggtactactattttattattctacttaggattggcttcagtttctggattagaactacaattttgcgttatgataattacatgtgttttatttttttgcttttgttggaaagtactgatgagttttgctcataatgcgattttagcatgcttggcatttttataatttaggggaattcactttgttagctttgccgggttttcctgtttcgatactctgttctaaattctcatctgggtgtcttaaacgcttcagaaacatactctgcagaaaaaataaacatgaagaacacttcttgaaaca

SEQ ID NO: 3504 - DNA, 1158 bp, Silene vulgaris
acatcaaaaactcgccgccactcactccatcatcaaaaatgggtcgcgtcatccgcgcacagcgtaagggagcaggatccatcttcaaatcccacacacaccaccgcaagggagccgccaagctccgcaccctcgacttcggcgaacgcaacggttacctcaaaggagtcatcaccgacatcatccatgatccaggacgtggtgcccccctagctaaggtcaccttccgacatcccttcaggtataagcatcagaaggaactgtttgttgctgcagaagggatgtatacagggcagtttctgtattgtgggaagaaagctaatctgatggttggaaatgtgttgccattgaggagtattccagaaggtgctgttgtttgtaatgttgaacatcatgttggtgatcgtggtgtttttgctagagcttctggtgattatgctattgttatttctcataatcctgataatgatacctctagggtcaagctcccatcaggtgccaagaaggtagtccccagtggctgccgtgccatgattggccaaattgctggtggaggaagaacagagaaaccacttctgaaggctggaaatgcataccacaagttccgtgtgaagagaaactgctggcccaaggttaggggtgttgctatgaatccagttgagcatcctcatggtggtggtaaccatcagcacattggtcatgccagtactgtttgcagggacgctccacctgggcaaaaggttggtctcattgctgccaggaggactggtcgtctacgtggtcaagctgcttctgctgcctccaagagtgacaaggcttaagttatttagacatgctattaccttttatgctttctttgttcccgtttaagattatctgttttgaagaactcagtcctaagaacatactccctcccacttattataagtgtcccatttgtgggatggcacaaaaattaaggtatattagttgtttaatattttggtatgggtaggggtaagaggaatattagttgtttaatagttagtaaggtaattaggtttgggtagtagtgggtggtggggtagtaaggtgaaaaagcaagggtagttaggacttttcacaaccaaaaaagttactaaatatggcaaatgggacacttttgcgaatagacgaaaa

SEQ ID NO: 3505 - DNA, 1379 bp, Picea glauca
ttcacataatacaaaattagtgttcgtggggtttgcggaaatgttccacccacattagggttagggtttatccgcaactagggtttgtaggggatttgcatcttgacgaaaccctttaccattcctgctcctttcagtttgggaggtgcagcagatctaaactttccgtgttgtgaatctcccttgtctgcagacatgggtcgcgttattcgtgcacagagaaaaggagcaggttccgtgttcacatcccacacccatcacaggaagggacctgcacggttcagaagcctcgactacggtgaacgcaatggctacatcaggggaatcgtaacggatgtcatacacgaccccggccgcggtgctcccctctgcaaggtcaccttcaggcacgcattccgttacaggcatcagaaggaactcttcgtagcggccgagggtatgtacacgggccagtttgtttactgcggaaagaaggccaatttgactgtgggtaacgtgttgcccttgaggtctattccggagggagccgttgtctgcaacgtggagcagcatgtcggcgatcggggttcgtttgctagggcttctggggactacgccatcgtcgtcagccacaatcctgataacggcactaccagggtgaagcttccctctggagctaagaagattgtgccaagtagttgtagagctatgattggtcaagttgctggaggtggaagaacagaaaaaccaatgcttaaggctggcaatgcataccacaaatacagggtcaaaagaaattgttggcccaaggttcgtggtgtggctatgaacccagttgagcatcctcatggtggtggtaaccatcaacatattggtcatgctagtaccgtacgtcgtgatgcaccaccagggcaaaaagttgggcttattgctgccagaagaactggtcgtctgcgtggacaggcggcatcagcagctgcaaagacagacaactaatcttagtttgtttccatttgcaaggatttcatggtcctattttagtgttttattttttcgtaatgtgattgtacaagggtttttgatccttttttaattcaggtagtagaagtaattgtttacagaggtcacgaaacacaaaactgcataccggtattttgtttgtttattttacctttctatgttgcaacgatctatgtcaaccaagtaataatctcaattttcttttacatgattggttatacttgcagcttgctcacaccactgcatgatattttagacttgcaatagttatacaatcttatgaatagtttatcacaaaacttctttatattgtaattgttattgtaagaaacttttcatatgctcatatatgatctaattgtgcattccccgtgaacaag

SEQ ID NO: 3506 - DNA, 1261 bp, Picea glauca
tttgaggaaattttccacccacattagggttagggtttatccgcaactagggtttgtaggggatttgcatcttgacgaaaccctttaccattcctgctcctttcagtttgagaggcgcagcagatctaaactttccgtgttgtgaatcttccttgtctgcagacatgggtcgcgttattcgtgcacagagaaaaggagcaggttccgtgttcacatcccacacccatcacaggaagggacctgcacggttcagaagcctcgactacggtgagcgcaatggctacatcaggggaatcgtaacggatgtcatacacgaccccggccgcggcgctcccctctgcaaggtgaccttcaggcatgcatttcgttacaggcatcagaaggagctcttcgtagcggccgagggtatgtacacgggccagtttgtttactgcggaaagaaggccaatttgactgtgggtaacgtgttgcccttgaggtctattccggagggagccgttgtctgcaacgtggagcagcatgtcggcgatcggggttcgtttgctagggcttctggggactacgccatcgtcgtcagccacaatcctgataacggcactaccagggtgaagcttccctctggagctaagaagattgtgccaagtagttgtagagctatgattggtcaggttgctggaggtggaagaacagaaaaaccaatgctcaaggctggcaatgcataccacaaatacagggtcaaaagaaattgttggcccaaggttcgtggtgtggctatgaacccagttgagcatcctcatggtggtggtaaccatcaacatattggtcatgctagtaccgtacgtcgtgatgcaccaccagggcaaaaagttgggcttattgctgccagaagaactggtcgtctgcgtggacaggcggcatcagcagctgcaaagacagacaactaatcttagttcgtttctatttgcaaggatttcatggttctattttagtgttttatttttttgtaatgtgattgtacaagggtttttgatccttttttaattcaggtagtagaagtaattgtttacagaggtcatgaaacacaaaactgcataccggtattttgtttgtttattttacctttctatgttgcaacgatctatgtcaaccaagtaataatctcaattttcttttacatcattggttatacttgcagcttgctcacaccactgcatgatattttagacttgcaatagttatacaagcttattaatagtttatc

SEQ ID NO: 3507 - DNA, 1158 bp, Picea glauca
cccacattagggttagggtttatccgcaactagggtttgtaggggatttgcatcttgacgaaaccctttaccattcctgctcctttcagtttgagaggcgcagcagatctaaactttccgtgttgtaaatcttccttgtctgcagacatgggtcgcgttattcgtgcacagagaaaaggagcaggttccgtgttcacatcccacacccatcacaggaagggacctgcacggttcagaagcctcgactacggtgagcgcaatggctacatcaggggaatcgtaacggatgtcatacacgaccccggccgcggcgctcccctctgcaaggtgaccttcaggcatgcatttcgttacaggcatcagaaggagctcttcgtagcggccgagggtatgtacacgggccagtttgtttactgcggaaagaaggccaatttgactgtgggtaacgtgttgcccttgaggtctattccggagggagccgttgtctgcaacgtggagcagcatgtcggcgatcggggttcgtttgctagggcttctggggactacgccatcgtcgtcagccacaatcctgataacggcactaccagggtgaagcttccctctggagctaagaagattgtgccaagtagttgtagagctatgattggtcaggttgctggaggtggaagaacagaaaaaccaatgctcaaggctggcaatgcataccacaaatacagggtcaaaagaaattgttggcctaaggttcgtggtgtggctatgaacccagttgagcatcctcatggtggtggtaaccatcaacatattggtcatgctagtaccgtacgtcgtgatgcaccaccagggcaaaaagttgggcttattgctgccagaagaactggtcgtctgcgtggacaggcggcatcagcagctgcaaagacagacaactaatcttagttcgtttctatttgcaaggatttcatggttctattttagtgttttattttttgtaatgtgattgtacaagggtttttgatccttttttaattcaggtagtagaagtaattgtttacagaggtcatgaaacacaaaactgcataccggtattttgtttgtttattttacctttctatgttgcaacgatctatgtcaaccaagtaataatctcaattttcttttaca

SEQ ID NO: 3508 - DNA, 1070 bp, Picea glauca
agcttgggaggcgcagcagatctaaactttccgtgttgtgaatcttccttgtctgcagacatgggtcgcgttattcgtgcacagagaaaaggagcaggttccgtgttcacatcccacacccatcacaggaagggacctgcacggttcagaagcctcgactacggtgaacgcaatggctacatcaggggaatcgtaacggatgtcatacacgaccccggccgcggtgctcccctctgcaaggtcaccttcaggcacgcattccgttacaggcatcagaaggaactcttcgtagcggccgagggtatgtacacgggccagtttgtttactgcggaaagaaggccaatttgactgtgggtaacgtgttgcccttgaggtctattccggagggagccgttgtctgcaacgtggagcagcatgtcggcgatcggggttcgtttgctagggcttctggggactacgccatcgtcgtcagccacaatcctgataacggcactaccagggtgaagcttccctctggagctaagaagattgtgccaagtagttgtagagctatgattggtcaagttgctggaggtggaagaacagaaaaaccaatgcttaaggctggcaatgcataccacaaatacagggtcaaaagaaattgttggcccaaggttcgtggtgtggctatgaacccagttgagcatcctcatggtggtggtaaccatcaacatattggtcatgctagtaccgtacgtcgtgatgcaccaccagggcaaaaagttgggcttattgctgccagaagaactggtcgtctgcgtggacaggcggcatcagcagctgcaaagacagacaactaatcttagttcgtttctatttgcaaggatttcatggttctattttagtgttttatttttttgtaatgtgattgtacaagggtttttgatccttttttaattcaggtagtagaagtaattgtttacagaggtcatgaaacacaaaactgcataccggtattttgtttgtttattttacctttctttgttgcaacgatctatgtcaaccaagtaataatctcaattttctttta

SEQ ID NO: 3509 - DNA, 981 bp, Brassica juncea
tcgggagccgtaacctcaagaagaagaagaagacgaatccaccatgggtcgtgtcatcagagcccaacgtaagggagcaggctccgtcttcaagtcccacactcaccaccgcaagggccccgccaagttcaggagcctcgatttcgacgagagaaacggttacctcaagggcgtcgtcacggagatcatccacgaccctggacgcggtgctccgttagctcgcgtctcgttccgtcaccctttccgttacaagaagcagaaggagctcttcgtcgccgccgaaggtatgtacaccggacagttcttgtactgcggtaagaaggccactctcgttgtcggaaatgttctgcctctcagatctatccctgagggagctgttgtctgcaatgttgagcaccatgtcggtgatcgtggtgtgctcgctagagcttctggggattatgctatcgtcatttctcacaaccctgacaacgacacgaccagggttaagttgccatctggatcgaagaagattgtcccaagtggatgcagggctatgattggtcaagttgctggaggtggaaggacagagaagccaatgctcaaggctggtaacgcgtaccacaagtaccgtgtgaagagaaactgctggcctaaggttcgtggtgtggctatgaatccagtggagcatcctcacggaggaggtaaccatcaacatattggtcacgccagtactgttcgtcgtgatgcaccccctgggcaaaaggttggtcttattgctgcaaggagaactggtcgtctcagaggtcaagctgctgctcttgcttccaagcaagaataaggataagagtcttgaagatgaaattgttcacttttgttttttgtttttttgctgagaccttgttttgaaaccttaagatctgctataatgttatttgagacctttctctatcaagtggaattcatgttttcgaagttgatccgtggtattattttgcaatt

SEQ ID NO: 3510 - DNA, 1046 bp, Malus domestica
tgacaactagtaaaacgtttgactgttaatatcatgatatcttgatcaaagcatgaaaggttcaaaccgcacaaaaatgcaccaatctagtactgcgatataaattaaaacggtcccaaaacagcaaacttaggtaacaaagaaaacgtaatccctcataagcctcttcacttgtctgccttcgatatgttagcagcagcttgtcctctgagacgaccagtcctcctagcagcaatgagaccaaccttctgcccaggaggagcgtcacgcctgaccgtgctagcatgtccaatatgctggtgattacctcctccatgaggatgctcgactgggttcatagccacaccacgaaccttgggccagcagttcctcttcactctgaacttgtggtaagcattaccagccttgagcattggcttttctgttcttcctccacctgcaacttgcccaatcatagcacggcacccgcttggaacaatcttcttggctccagacggaagcttgaccctgttagaaccagtatcgttgtcagggttgtggctgataacaacagcgtaatcaccagacgccctagcgagggttccgcggtccccaacatggtgctcgacgttacagacgacagctccctccgggatcgatctgagaggcaacacattcccgaccaccaaattggccttcttcccgcagtagatgaactgaccggtgtagattccctcggcggcaacgaagagctcgttctgcttcttgtacctaaacggatggcggaagctgacgcgggccaacggggcaccgcgaccaggatcgtggatgatctcggtgacgacacccttgaggtagccgttgcgctcgccgaagtcgaggctccggaagcgggcaggacccttgcggtggtgggtgtgcgacttgaaaacggagcccgcacccttacgctgagctcggataaccctccccatagctccggcgagtgattttctgctactagcggccgcgcgaaatggtgttccgaaaaccctaggatttgtgtttgattttataggtcttgggag

SEQ ID NO: 3511 - DNA, 1048 bp, Brassica juncea
atcccactagggctttgtaagacatttccacatataaaacctgatttttctcgtcgtcacagatcctgaaccctacttccttgctcccgccgtcacctcaggatcaccatccatccaccatgggtcgcgtcatcagagctcaacgtaagggagcgggttccatcttcaagtcccacactcaccaccgcaagggtcccgccaaattcaggagcctcgatttcggcgagagaaacggatacctcaagggcgtcgtgacggagatcatccacgatccgggacgcggagctccgttggctcgcgtcgcgttccgccatcctttccgttacaagaagcagaaggagctcttcgtcgccgccgagggtatgtacaccgggcagtttctttactgtggtaagaaagcaactctcgttgttggaaatgtgcttccgctcagatctatccctgaaggagctgttgtctgcaatgtcgagcaccatgtcggtgatcgtggtgtgttcgctagagcttctggtgattacgctatcgttattgctcacaatcccgacaacgacaccacgagagttaagttgccatctggttcgaagaagattgtgccgagtggttgcagggccatgattggtcaagttgctggtggtggaaggactgagaagccgatgctcaaggcgggtaacgcgtaccacaagtaccgtgtgaagaggaactgctggcctaaggttcgttgtgtggctatgaaccctgttgagcatcctcacggaggaggtaaccatcaacatattggtcacgccagtaccgttcgtcgtgatgcaccacctgggcaaaaggttggtcttattgctgcaaggaggactggtcgtctcagaggtcaagctgctgctcttgcctccaagcaagaataaggagagaaatcttcatgatgatgaagttgtttacttttgttggatttttgctgagaccttgtgttgagtcctttagtttttctataatctttcttgagacctttgtcttgagaattaaacctccacattatcagtttaaatttccttattca

SEQ ID NO: 3512 - DNA, 851 bp, Ocimum basilicum
cgggcacagagaaagggagcgggatcggtgttcaagccccacacccaccaccggaagggcccggctcgattccgctctctcgacttcggcgagcgcaacggctacctcaaaggtgtcgtttctgagatcattcacgaccccggccgcggcgccccccttgcccgcgtcaccttccgccaccccttccgctaccagcaccagaaggagctcttcgtcgccgccgagggcatgtacaccggcatgttcgtgtactgcggtaagaaggccaaccttgtcgtcggaaacgtcttacccctcagatccattcctgaaggagctgtcgtctgcaacgtcgagcaccatgttggtgaccgtggcgttttcgctagggcttctggtgactatgcgatcgtcatctctcacaatcccgataatggaaccactagaatcaagctcccatcaggagccaaaaagattgttccaagtggatgccgtgccatggttggtcaggttgccggaggtggacgtactgaaaagcccatgttgaaggccggaaatgcataccacaagtttagagtgaagaggaattcatggcccaaggttcgtggtgttgccatgaacccagtggagcatccccatggtggtggtaaccaccagcacattggtcatgctagtactgtgcgtcgtgatgcaccgcctggccagaaagttggtcttattgccgccagaaggactggtcggctccgtggtcaagctgctgctacagctgccaaggagaaggcttgagcttagtcttgctcttgtttttgtgttactatgagttatgaaagattgtttctgttttattcttataaagacttgtgtttgacttc

SEQ ID NO: 3513 - DNA, 878 bp, Brassica napus
cgtgtcatcagagctcaacgtaagggagcaggttccgtcttcaagtcccacactcaccaccgcaagggccccgccaagttcaggagcctcgacttcggcgagagaaatggttacctcaagggtgtcgtcactgagatcatccacgatccgggacgtggtgctccgttggctcgcgtcgccttccgtcatcctttccgttacaagaagcagaaggagctcttcgtcgccgccgaaggtatgtacacaggacagttcttgtactgcggtaagaaagctactctcgttgtcggaaatgttcttccactcagatctatccctgagggagctgttgtctgcaatgttgagcaccatgtcggtgatcgtggtgtcctcgctagagcttctggggattacgctatcgttatttctcacaaccctgacaacgacacgaccagggttaagttgccgtctggatcgaagaagatcgttccaagtggatgcagggccatgattggccaagttgctggaggtggaaggacagagaagccgatgctcaaggcgggtaacgcataccacaagtaccgtgtgaagaggaactgctggcctaaggttcgtggtgtggctatgaacccagttgagcatcctcacggaggaggtaaccatcagcatattggtcacgccagtactgttcgtcgtgatgcaccccctgggcagaaggttggtcttatcgctgcaaggagaactggtcgtctcagaggtcaagctgctgctcttgcttccaagcaagaataaggagagaaagcgtcaagatgatgaaattgttcacttttgtttttgggttttcgctgagaccttgttttgaaaccttaagacttgctataatgttatttgagaccttt

SEQ ID NO: 3514 - DNA, 1099 bp, Citrus sinensis
aaaacacacacacatatatatatattcatcagcctgccgcacaagctcagtctctttcgccctctaaagaaatgggtcgtgtgattcgcgcacagcgtaagggtgcaggttcggtcttcaagtcccacacccaccaccgtaagggtccggcccagttccgcagcctcgacttcggtgagcgtaatggttacctcaagggtgtcgtcgcagagattattcacgatccgggtcgtggtgccccgctggcccgagttacctttcgtcacccttttcgctacatgaaacaaaaggagcttttcattgccgctgagggtatgtacacgggtcagttcgtgtactgcggcaagaaagccactctgatggttggtaatgtgttgcccgttagatctatccctgaaggagctgtcgtttgcaacgttgagcatcatgttggtgatcgcggtgttctcgctagagcttctggtgattatgccgttatcatcagtcataaccccgataatgacaccaccagggtcaagcttccatctggtgccaaaaagattattccaagtggctgcagagctatgattgggcaggttgccggcggagggaggactgagaagccccttctcaaagctggtaatgcataccacaaattcagagtgaagcgaaactgctggcctaaggtgcgtggtgtggccatgaacccagtggagcatcctcatggaggaggtaaccaccagcacattggtcatgctagcactgttaggcgtgatgctccccctggccagaaggttggtcttattgcagccaggaggactggtcggctcagaggacaagctgctgccactgcagccaaggccgacaaggcttaaatcctttgtgttaccacaaatcgtctctctatcgcgatctgtcattttacttttcctgctgcatcattaccttggaaaaatttgttcagatttggatctctgggatgatcctgatgttaaattatgttggcttaaagtttagcttaatttgctcttatcctaaactttagttgattttgatatttttggatatattaatggatgccttcatcgaattaagtatatggaaatgttgtttttatctg

SEQ ID NO: 3515 - DNA, 1132 bp, Citrus clementina
acaaaaccctactataaaagccgtacaagaacaaaccctaattgcatcttcccaaaaacacacacatatatatatatattcatcagcccgccgcacaagctcagtctctttcgccctctaaagaaatgggtcgtgtgattcgcgcacagcgtaagggtgcaggttcggtcttcaagtcccacacccaccaccgtaagggtccggcccagttccgcagcctcgacttcggtgagcgtaatggttacctcaagggtgtcgtcgcagagattattcacgatccgggtcgtggtgccccgctggcccgagtcacctttcgtcacccttttcgctacatgaaacaaaaggagcttttcattgccgctgagggtatgtacacgggtcagttcgtgtactgcggcaagaaagccactctgatggttggtaatgtgctgcccgttagatctatccctgaaggagctgttgtttgcaacgttgagcatcatgttggtgatcgcggtgttttggctagagcttctggtgattatgccgttatcatcagtcataaccccgataatgacaccaccagggtcaagcttccatctggtgccaaaaagattattccaagtggctgcagagcgatgattgggcaggttgccggcggagggaggactgagaagccccttctcaaagctggtaatgcataccacaaattcagagtgaagcgaaactgctggcctaaggtgcgtggtgtggccatgaacccagtggagcatcctcatggaggaggtaaccaccagcacattggtcatgctagcactgttaggcgtgatgctcctcctggccagaaggttggtcttattgcagccaggaggactggtcggctcagaggacaagctgctgccactgcagccaaggccgacaaggcttaaatcctttgtgttacaacaaatcgtctctctatcgcgatctgtcattttacttttcctgctgcatcattaccttagaaaaatttgttcagatttggatctttgggatgatcctgatgttaaattatgttggcttaaagtttagcttaatttgctcttatcctaaactttagttgattttgatatttttggatatattaatggatgccttcatcgaattaagtata

SEQ ID NO: 3516 - DNA, 1053 bp, Fagopyrum esculentum
gagatcggccgctatgggtagggttatcagagctcagcgtaagggagcggggtctgtgttcaagtcccacacccaccaccgcaagggagcggccaagctccgcacgctcgacttcggcgagcgtaatggataccttaagggggtgatcaccgaaatcatccacgaccctgggcgtggtgcgcccctcgcaaaggtaaccttccgccaccccttccggttcaagcaccagaaggagctcttcgtcgccgccgagggtatgtacaccggtcagttcatctactgcggtaagaaggctaacctcatggtcggaaacgtcttgcctttgaggtctatccctgaaggagctgtcgtatgcaatgttgaacaccatgtcggtgaccgtggaaccctcgctagggcttctggagattacgctattgttatcagtcacaaccctgataacgatacctctaggattaagcttccatctggtgcaaagaagattgtcccaagtggttgccgtgccatgattggtcaagttgcaggtggaggacgtacagagaagccattgctcaaggccggaaacgcataccacaagttcagagtgaagaggaacagctggcccaaggttcgtggtgttgctatgaatccagttgagcatccccatggaggtggtaaccatcagcatatcggtcatgccagtaccgttcgcagagactctgctcctggacagaaggtcggtcttattgctgccagaaggactggtcgtctccgtggtcaagctgcttccgctgcatctaagtccgacaaggcttagattaggcttcatagaaaccggtgaatcatttttggtacttgttgttatcgttgctaccttttatttttaatgttgcagtcttggatgttactaggtatgtcgatttgcaagtattgctgcttatcaaacaaacgtttaagttaccaaatttatgacttttgtttaactgcattgtcatttctaattacccttcatactgttgtttacattatcgttgttttattgtgttaacaagactcattggtggagtgttcata

SEQ ID NO: 3517 - DNA, 1130 bp, Humulus lupulus
gatatgagtaattgggtcagtctaacaagtaatagtctcgcacttcttcttcttcgccgtcgcctctcaaaaccctaaccctagcgatgggacgagtcattcgggcacagcgtaagggtgccggatcggtgttcaagtcccacacccaccaccgtaagggtccagctcggttcaggtctctggacttcggcgagcgcaatggttacctgaaaggagtcgtgactgacatcatccacgacccagggcgcggtgccccactggcccgagtcacattccgtcacccattcaggtacaagcaccagaaggagcttttcatcgccgcagagggcttgtactctggtcagttcatctactgtgggaagaaggccaatctcgtcgttggtaatgtccttcctcttagatctcttcctgaaggtaccgtcatttgcaacgttgagcaccacgtcggtgaccgtggtgttctcgctagggcatctggtgactacgccgtcgtcatcagtcacaacccggataatggaactagcagagttaagcttccatccggagctaagaagattttgccaagtggctgccgagctatgattggtcaggttgcgggtggaggcaggaccgagaaaccaatgttgaaggcaggaaatgcatatcacaaattcagagtcaaaaggaacagctggcctaaggttcgtggtgttgctatgaaccctgtggagcatcctcatggtggtggtaaccaccagcacattggtcacgccagtaccattgcaagagacgctgctcccgggcagaaggtcggtctcattgctgccaggaggactggtcgtctccgagggcaagctgccgccgctgcttccaaatccgacaagggttcttaggaaaaggtccatttttgaaattttcagcggtaactttcgaacacttttgtactgttttattagtcttcttaggagtggagctcagtttttggaatagggataccattttgaattattataatctatttgtatttctttttaatttgcttttgtgggaaggtactgctgagttgaaatatttttgccttaatgtaatgaaactttgtttgacatgttttgagtttagtgggaatgcgtgctagtttttgccagttttgt

SEQ ID NO: 3518 - DNA, 1257 bp, Pseudotsuga menziesii
aaaactagggtttatggaatttgaggaaaagttctgcccacattagggttagggtttatccgccactagggtttgtatgggatttgcatcttgacaaaaccattaccgttccttctgctttcgattgcggaggcacagcagatctaaactaccggtgttgtgagcagatatgggtcgcgttattcgtgcacagagaaaaggagcaggttccgtgtttacatcccacacacatcacaggaagggccctgcacggtttagaagcctcgactacggcgagcgcaatggctacatcaggggaatcgtgacggacgtcatacacgacccgggccgcggcgctcccctgtgcaaggtgacgttcaggcatgcattccgttacaagcatcagaaggagctcttcgtagcggcggagggtatgtacacgggccagttcgtttactgcggaaagaaggccaatttgactgtaggtaacgtgttgcccttgcggtctattccggagggagccgtggtctgcaacgtcgaacaacatgtgggcgatcgtggttcatttgctagggcttctggggactacgccatcgtcgtcagccacaaccctgataatggcatgaccagggtgaagcttccctctggagctaagaagatcgtgccaagtagttgtagagctatgattggtcaagttgctggaggtgggagaacagaaaagccaatgctcaaggccggcaatgcattccataaatacagggtcaaaagaaactgttggcccaaggttcgtggtgtggctatgaacccagttgagcatcctcatggtggtggtaaccatcaacatattggtcatgctagtactgtacgtcgtgatgcaccaccagggcaaaaggttgggcttattgctgccagaagaactggtcgtctgcgtggacaggctgcatcagcagctgcaaagacagacaactagtcatttagttgtagtttgtttctatttgcaaggatttcatggtccaattttagtctcttattttttcgtaatgtgtacaagggttttgatcctttttagttcaggtagtagaagtaattgtttacagaggccaggaaacacactaaactacatactgatgttttgtttgtttattttacctttctatgtttcaacaatctacatcaaccaagtaataatctgagttttcttttacatgattgtttataagtgagcagcctgctcacaccactgcatgatattttagatttgcattagttataataact

SEQ ID NO: 3519 - DNA, 1182 bp, Zostera marina
aatttcccatctccattatcattcacacgtcgtcctcgccgccgtttcaacaaatttactcctttcaccatgggtcgcgttatccgtgctcagcgtaagggagccggttccattttccgatcccatactcaccatcgaaagggacctgctcagtttcgatctcttgacttcggcgagcgcaatggctacattaagggtgtcataaccgacatcattcatgaccctggtcgtggtgccccgctcgctcgcgttacattcagacatcctttccggtacagacaccagaaggagctattcgttgctgcagaggggatgtatactggtcagtttgtctactgtggaaagaaggccaacctaatggttggtaatgtacttcccattcgatccattcctgagggagctgttgtatgtaacgttgagcatcacgtcggagatcgtggttcctttgctagatgctctggcgattatgcgattgtcatcagtcacaatcctgacaatggaacttctaggatcaagcttccatctggtgctaagaaaattgttgccagtggatgtcgtgcgatggtcggacaagttgctggtggaggaagaactgaaaaaccaatgctgaaggctggaaatgcgtaccacaaatacagggtaaagagaaactgctggccaaaggttcgtggtgtggccatgaatcccgttgagcatccccatggaggaggaaaccaccagcacattggtcatgccagtactgtcagacgcgatgcacctccgggacaaaaggttggtcttattgctgccaggagaaccggacgtctccgtggtcaagccgcagccactgcttcgaaagcggaataaaagtcatagtatctttatatgtatttacttgtgtttgatttcagttttttagtatgatgagaggaggatatcgggaaggattttgtttgtttattcacagttcacatcgacttaattttctgtttgttgtttattttgaatgttattttgttaaaacttgttctatcaaaaacggtgaaagaaagtagtctttagtcttgatttttctaatcattaatgggttgtaagttgaattcagagtgaaggctcggctgattgtttgctttcattcggttagtggtgagtatcaattaccaaacatgtctaaaatcctaatgataaatataatcgaaataa

SEQ ID NO: 3520 - DNA, 1045 bp, Carpinus betulus
tgggattaccctactacggccgcgcctcactcacacaaaccctaggaaaccaaatgggtcgcgtaatccgagcacagcgtaagggtgctggttccgtcttccgttctcacacccatcaccgtaagggtccggcccagttccgatccctcgactacggcgagcgcaacggctatatccgcggcgtggtcaccgagatcatccacgatccagtcggggcgctccgctggcccgggtgcagttccgccaccccttccggtacaagctccagaaggagctcttcgtggccgccgagggcatgtacaccggccagttcgtgtactgcggaaagaaggccaacctcatggtcggcaacgtgctgcccctcggggccatccctgaaggtgcggtggtgtgcaacgtcgagcaccatgtgggcgaccgtggggtcttggctagggcctctgggggactatgccattgtgatcagtcacaatcctgataatggaacttccagaatcaagcttccttctggcgccaaaaagattgttccaagtaattgccgagctatggttggtcaggttgctggtggaggaaggaccgagaagcccatgttgaaggcaggaaatgcctatcacaaattcagggtgaagaggaactgctggcccaaggttcgtggtgttgccatgaatcctgtggagcatcctcatggtggtggtaaccatcagcatattgggcatgcaagtactgttcgccgagatgctcctcccggacagaaggttggtcttattgcagccagaaggactggtcggctccgtggacaagctgctgccacggcttcaaaagctgacaagagtgcttagagtgttacttttcaaaacctttagaactcttatgttagagatgatggttactttgaagtttctgtttcccgctttgagagttacattttatgttgttgccttgttggattattaggtccatcattttataaagggtttattcaaattgattgcttctgttagtttatgaagttttgatgggtgtttttaggaagaagatcgcacta

SEQ ID NO: 3521 - DNA, 934 bp, Artemisia annua
aaccctaaaccatccagaaatgggtcgagtcatccgtgctcagcgtaagggagcagggtccatcttcaagtcccacacccaccaccgcaagggcccagcacgtttccgctcactcgacttcggagaacgaaacgggtacctcaagggagtcatcaccgagatcatccacgacccaggtcgcggagcacccttggctaaggtcacattccgtcacccgttcaggtacaagcaccagaaggagctttttgtggcggctgaagggatgtatactgggcagtttgtgttttgtgggaagaaggcgaatttgatggtggggaatgtgttgcccattgggatgatacctgaaggaggagttgtgtgtaatgtggagcatcatgttggtgataggggttcttttgctagggcttctggggattatgctattgttattagtcataatcctgataatggtacctcaagggttaagcttccatctggagccaagaagattgtccccagtggttgccgtgctatgattggtcaggttgcaggtggaggacgtactgagaactcaaggcaggtaacgcatatcacaaattccgtgtgaagagaaactgttggcctaaggttcgtggtgttgctatgaatcccgtggagcatccccatggtggtggtaaccatcaacatattggtcatgctagtactgttcgtcgtgatgcaccacctggtcaaaaggttggtcttattgctgctagaagaactggtcgtcttagaggtcaagctgctgctgctgccatgaaggctgataaatagagcacttgattggtttatctgctttttgatatttttttaccttcgtttcttagaagttttcatagtctagttttgttataagcgggttttagagattcagtctacagtttgttgtctaagactaatttttatgctatttatt

SEQ ID NO: 3522 - DNA, 904 bp, Epimedium sagittatum
ggagtgatcagagctcaactaagggagcaggttctgtattcaaatcccatacccaccaccggaaaggccctgcacggtttcgcagcctcgactttggagagcgaaatggctacctcaaaggggtggtcacagagatcattcacgacccaggtcgtggagccccgcttgcccgagtcaccttccgtcacccctttcgctacaagcaccagaaggagctctttgttgctgcagagggtatgtatacgggtcagtttgtgtattgtggaaagaaggcgaatctgatggtgggaaatgttcttcctctcaattcgattcctgaaggagctgttgtgtgcaacgttgaacatcatgttggtgatcgtgggactttggctagagcttctggggattatgctattgttatcagtcataatcctgacaatggaaccagcaggattaaactcccttctggagccaagaagattgtaccaagtggttgccgggccatgattggccaagtcgcaggtggaggaagaactgagaagcctatgctgaaagcaggaaatgcctatcacaagtacagagtcaagaggaactgctggcccaaggttcgtggtgttgctatgaatccagtggagcatcctcatggtggtggtaaccaccaacatattgggcatgccagtactgttcgtcgtgacgctccacctggaaaaaaagtgggtcttattgctgcaaggaggactggtcgtctcagaggacaagccgctgccacagcatccaaagcagacaagtcttagggattatgttggtttacacatatttctgcagatgtttttcttgagatctctgttgattttaatcatacctattagttcagttgtaaggtgtgctttaaaagattttggttgcaaactaaggggccatt

SEQ ID NO: 3523 - DNA, 1313 bp, Beta vulgaris
ccctcacaaaaaaaaccctctccttcactttctctctcctcccttcaccacttccgccatgggaagagttatccgtgctcaacgtaagggagcaggttctgtgttcaaatcccacacccaccatagaaaaggtgctgcgaagtttcgaacccttgacttcggtgaacgtaatggatacttaaaaggtgttatcactgaaattatccatgacccaggacgtggtgcaccacttgctcgcgtaactttccgtcatcctttcaggtataagcatcagaaggagttgtttgttgctgcagaaggaatgtattctggtcagtttgtttattgtgggaagaaagcaaatttaatggtgggaaatgttcttcctttgagatctattcctgaaggagctgttgtttgtaatgttgaacatcatgttggtgatcgtggtgttcttgctcgtgcttctggggattatgctattgttatttctcacaaccctgataatgatacttctaggatcaagctcccatccggttcgaagaagattgtcccaagtggttgccgtgctatgattggtcaagttgctggtggaggtcgtactgagaagccccttcttaaggcaggaaatgcttaccacaagtacagagtcaagagaaactgctggcccaaggttcgtggtgttgctatgaatccagttgagcatccccatggtggtggtaaccaccagcatattggtcatgcctctactgtgcgtagagatgcaccaccagggcaaaaggttggtctcattgctgccaggaggactggtcgtcttcgtggtcaagctgccgccatggttcacaaagcacaagcttaatttatcgggctggtttcccccttttgagggggttcctttctaaaaatctcttttgaaactcccttttaggaaacccccggacttgtctcaattttcgatggaattgcctcgggtacttccaaaatttccaaccccccggcttttaccctaaaaaaaaaaaaaaaaacccgtcttttttttttttcctcccctgcgattctcccccaactttcctcgtttccgccaaccccccgcttgacttctcccctaatcctcaccccctttcaagcccttcttacccaataagtctctccttccttccctccgacctctcaggacccctctccccatttttgtgcactcccccctctaccacggcgacccctctctcacgttacataacttctcttcgtctcttacccctaacccactctcctccttgctctctcatatcttatatccgctctcccttcccctctactgtcccacctgccac

SEQ ID NO: 3524 - DNA, 764 bp, Centaurea maculosa
cggggggtgagtctcagagcacagcgtaagggagcaggctccgtcttcaagtcccacactcaccaccgcaaaggtccggcgaggttcagaagcctcgatttcggcgagcgaaacggctacctgaaaggagtcatcaccgagatcatccacgatcccggccgtggagctccgttggctcgcgtcaccttccggcatccgttcaggtacaagcaccagaaggagctgttcgtggccgccgaagggatgtacaccggccagttcgtgttctgtgggaagaaggcgaatttgatggttggaaacgtgcttccgcttaggtctattcctgaaggagctgttgtgtgtaatgtggagcatcatgttggagatcgtggttcgtttgctagggcttcgggagattatgcgattgtgattagtcataatccggataatggaaccactagagtcaagcttccatcaggagccaagaagatcgtgcccagtgggtgtcgagccatgattggccaggttgctggcggtggacgtactgagaaaccgatgctcaaagccggtaacgcttaccacaaattccgtgttaagagaaactgctggcccaaggttcgcggtgtggctatgaaccccgttgaacatccccatggtggtggtaaccatcaacatattggtcacgccagtaccgtccgccgtgatgcaccacccggtcaaaaggtcggtctcattgccgctaggaggactggtcgtcttagaggtcaagccgctgccaccgcctc

SEQ ID NO: 3525 - DNA, 964 bp, Cephalotaxus harringtonia
gtcgtgtgatccgtgcgcagagaaagggagcaggttccgtgttcaaatcccacacccaccacaggaagggccctgcgcgctttcgaagcttggactacggcgaacgaaatgggtacctgaagggcatcgttgccgaagtcattcacgaccctggacgcggcgcccctctgtgccgtgtgaacttcaggcacccattccgttacaggcagcagaaggagctctttattgctgctgagggtatgtatacaggccagtttatttactgtggcaagaaggctaatttgaccgtggggaatgttttgcctctgagatctattcccgagggtgctgttgtttgcaatgtggagcaacacgttggcgatcgtgggtcgtttgctagggcttctggggattatgccattgtcatcagtcacaatcctgacaatggaacttccagggtaaagcttccatcgggtgctaagaagattgttccaagtagttgcagagctatgattggtcaggttgctggtggtggaagaacagaaaagcctatgctcaaagctggcaatgcctatcacaaatatagggttaaaagaaactgttggcccaaggttcgtggtgtggcaatgaaccctgttgaacatcctcatggtggtggtaaccatcaacatattgggcatgctagtactgtgcgtcgtgatgctcctccagggaaaaaggttggtcttattgctgctagaagaactggtcgtttgcgtggacaggctgcaacagcagcttcaaagacggataaggtttagtgtgcttgccacattaagcagtcagtattttaagtaaaaaaattatgtgctctgaaaatggacaaatggcatactgttttattttctttttttcaggttgctttgtggcaacaatctttgaggacttggttgtaatccacaattacttttttgtttttatccattagcggctaactatctaaaaa

SEQ ID NO: 3526 - DNA, 1198 bp, Cryptomeria japonica
  misc_feature (9)..(9): n is a, c, g, or t
tttttttcnaagtagacattggaaacatattagggttttcaaaaccctagacttggttatattttttatcgggttgagaaaaattggttcgtcctaggaaaacagcccttatctcctcctttagccaacgtatttcgcgttcgctagaaaatgggtcgcgtgatcagagcgcagaggaagggagcaggctccgtgttcaaatcccacacgcatcacagaaagggccctgcgcgctttcgtagtttggactacggtgaacgaaatgggtacctgaagggcatcgttacagaagtcgttcacgacccggggcgcggcgctcccctttgccgcatcaacttcaggcatccctttcgttacaggcagcaaaaggagctattcattgcggccgagggtatgtatactggtcagtttatttactgcggtaagaaggccaatctgactgtggggaatgtcttgcctctgagatctattcctgagggtgctgtggtttgtaacgtggagcagcatgtgggcgatcgtggctcctttgccagagcttctggagattatgccatcgtcattagtcacaaccctgataatggcacttccagggtaaaacttccatctggagctaagaagattgtgcctagtagttgcagagccatgattgggcaggttgctggcggtggaagaacagaaaagccaatgctcaaagcaggaaatgcttatcacaaatttagggtcaaaagaaactgttggcccaaggttcgtggtgtggcaatgaaccctgttgagcatcctcatggtggtggtaaccatcaacacattgggcatgccagtacagtgcgtcgtgatgctcctccaggacaaaaagttggtctcattgctgctaggagaactggtcgtctgcgtggacaggctgcaacggcagcttcaaagacagaaaagacttagcatgcacacctactcaatcagaattaaacaattatagagtttagtttcttttcttctttaggttgctttgtgtcatcaacttatgtggaccaggttgtaaactatgtttcccattattgtttcttatcattagtggtttattgttgattcaaaattttgggaaagacttcaaactaggttgtaatcctcgtttacttttattgttcgaggctattttttgttctgtcatattaattgactttgttatatttgattcttctttgaa

SEQ ID NO: 3527 - DNA, 1100 bp, Distylium racemosum
gcgttctgggcgtcctttttaaaccctcgtctagggttttatttgcgggagccctagtttttatttcttttcaattgttgtgatcaaaggaggaggaggaggagcagcagcgagggatgggaagggtaatcagggcgcagaggaagggagcgggctccgtgttcagagcccacacccaccacaggaaggggcctgcgcagttcaggagtctcgactattcggagaggaatggatatataaagggcatcgttactgatgtgttgcacgacccggggcgtggcgcgccgctgtgcagggtgacgtttaggcacccgttccgttacaagcaccagaaggagctcttcgtggccgccgagggcatgtacaccggccagttcgtctactgcgggaagaaggccaacctcaccgtaggcaacgtcctgccgctccgatctattccagagggagccattgtctgcaacgtggagcagcacgccggtgatcgtggctctttcgccagagcttctggtgactatgctatcgtcatcagtcacaatcctgacaacgggacttccaggatcaagctaccctctggtgctaagaagatagtgccaagcagttgcagagctatgattggccaggttgctggtggtggtaggactgaaaaaccaatgctcaaggctggcagagcataccacaagtatagagtgaagagaaactgttggcccaaggttcgtggtgtggctatgaatcctgttgagcatcctcatggtggtggtaaccatcaacatattggtcatgccagtactgtgcgtcgtgatgcaccaccagggcagaaggttggtcttattgctgccaggagaacaggtcgtctacgtggacaagctgcaacggcagcttccaagactgataaagggtcgtaggctgtttcatcagagaattgtgccagaagggtttacatttaggcatttgttggacaattttggtcaatgcagacaatgcgattgtggaagtgttagttcaccatttggttgtaggtcaaaactcttacttttgtgggtatacagtagtgactatgtttacttcatgcttctttgttgatgagttatattatatattgt

SEQ ID NO: 3528 - DNA, 1176 bp, Pinus pinaster
ttagggtttttctgtatcgggggagggagggttgtagaggaaactctagtagtgtagtgtagcaatgggaagagtgatcagagcacagaggaagggagcgggttcggtgttcagatcccacacgcatcacaggaagggacctgcacgctttcgcagcctcgactatggggagcgcaatggctacatcaagggcattgtctccgatgttattcatgacccagggcgaggtgccccgcttttgagggtgactttcaggcatcccttccgctataggcaccagaaggaactttacatcgcagccgagggtatgtatacgggccagttcatttattgcggtaagaaggccaatctcaccgtgggcaacgtgctgcctctcaaatctattcctgagggagctatcgtctgcaatgtggagcaacatgtcggagaccgtggttcgtttgcccgagcttcgggagactacgctatcgtcgtcagtcacaactttgataatggcactagcaggatcaagctaccttctggagccaagaaaatagtgccgagcagttgcagagcaatgattggtcaagttgctggtggtggaaggactgaaaagcccatgctcaaggctggaaatgcataccataagtacagagtcaagagaaatagctggcccaaggttcgtggtgtggctatgaacccagttgaacatcctcatggtggtggtaaccatcagcatattggtcatgccagtactgtgcgccgtgatgcaccacctgggcagaaagttggtcttattgctgcaagaagaactggtcgtttacgtggacaagctgcatcagctgctgcaaagaccgacaaaaccagttagtgtgttcctcgtctgttattaggtggaagaggtgttgtttatgccgtatgtgtatttggacattttggtatgttcacaaacaagagtaagatttattgccactcagatttgtcctttgtgggactgaaattccgagtatttctttgtttactgaagttttgttcaagaattttgtttggtgaacatttttagatcactggtttaagcgtcaacatttgtaggatgatagaacctaggccggcccttgctattacaatgaggaaagatacatttctttgtcgctcagtgttatattcagttgggtaattacatctatgtttccattt

SEQ ID NO: 3529 - DNA, 984 bp, Fagopyrum esculentum
ggggggctaacaacttatttaggcttcatcgtctcccccaagaaaccctcatttttcagatcggccgctatgggtagggttatcagagctcagcgtaagggagcggggtctgtgttcaagtcccacacccaccaccgcaagggagcggccaagctccgcacgctcgacttcggcgagcgaaatggataccttaagggggtgatcaccgagatcatccacgaccctgggcgtggtgcgccactcgcaaaggtcaccttccgccacccttccggttcaagcaccagaaggagctcttcgtcgccgccgagggtatgtacaccggtcagttcatctactgcggtaagaaggctaacctcatggtcggaaatgtgttgcctttgaggtctatccctgaaggagctgtcgtatgcaatgttgaacaccatgtcggtgaccgtggtaccctcgctagggcttctggagattacgctattgttatcagtcacaaccctgataacgatacctctaggattaagcttccatctggtgcaaagaagatcgtcccgagcggttgccgtgccatgatcggtcaagttgcaggtggaggacgtacagagaagccattgctcaaggcaggaaacgcataccacaagttcagggtgaagaggaacagctggcccaaggttcgtggtgttgctatgaatccagttgagcatccccacggaggtggtaaccaccagcatattggtcatgccagtaccgttcgcagagactctgctcccggacagaaggtcggtcttattgctgccagaaggactggtcgtcttcgtggtcaagctgcttccgctgcttctaagtccgacaaggcttagtgtagacttcatagaaaccggtgaatcatttttggtccttgttgttatcgttaatgatgcagactcagatgttgctagttattcactttgcaagaattgctgcttgtcaaacaaactttcaattacgagtctc

SEQ ID NO: 3530 - DNA, 783 bp, Flaveria ramosissima
cctagccctaaccatgggtcgcgtcatcagagcccaatgtaagggagccggctccgcttcaagtccacacgcaccaccgcaaggtcggcgaggtccggagcctcgacttcggcgagcgcaacggctacctcaaaggcgtcatcaccgacatcatccacgaccccggccgcggcgccccgctcgctcgcgtcactttccggcacccgttccgatacaagcaccagaaggaactcttcgtagccgccgaggggatgtacactggtcagtttgtgttttgtgggaagaaggcgaatttgatggtgggaaatgtgctgccgcttagatctattcctgaaggagctgtggtttgtaatgtggagcatcatgttggggatcgtgggtcgtttgcgagagcctcgggggattatgcgattgttattagtcataatccggataatggtactactagagtgaagcttccatctggagcaaagaaaattgtgccaagcggatgtcgtgccatgattggtcaggttgcaggtggaggacgtaccgaaaagccaatgctgaaagctggtaatgcttatcacaagttccgtgtgaagagaaactgctggcctaaggttcgtggtgttgctatgaacccagtggagcatcctcatggtggtggtaaccatcaacatattggccatgccagtactgttcgccgtgatgcaccacccggtcaaaaggttggtctcattgcagctagaaggactggtcgtctcagaggtcaagccgccgccactgcagccaaggccgata

SEQ ID NO: 3531 - DNA, 995 bp, Picea glauca
cgtcgtttaggtttttttatagtggagggaggttggagcagaaactatagtagtgtagtgtagcgatggggagggtgatcagagcacagaggaagggagcggggtccgtgttcagatcccacacgcaccacaggaagggtcctgcccgctttcgcagcctcgactatggagagcgcaatggctacattaagggcattgtctctgatgtcatacatgacccagggcgcggtgccccgctctgcaaggtaacttcaggcaccccttccgctacaggcaccagaaggagcttttcgtcgcagctgagggtatgtacacgggccagttcgttactgcggtaagaaggccaatcttatcgtgggcaacgtgctgcctctcagatctattcccgagggagccatcgtctgcaatgtggagcaacatgtcggggaccgtggttcatttgcccgagcttcgggagactacgccatcgtcgtcagccacaatcctgattaacggcactaccagggtgaagcttccctctggagctaagaagattgtgccaagtagttgtagagctatgattggtcaggttgctggaggtggaagaacagaaaaaccaatgctcaaggctggcaatgcataccacaaatacagggtcaaaggaaattgttggcccaaggttcgtggtgtggctatgaacccagttgagcatcctcatggtggtggtaaccatcaacatattggtcatgctagtaccgtacgtcgtgatgcaccaccagggcaaaaagttgggcttattgctgccagaagaactggtcgtctgcgtggacaggcggcatcagcagctgcaaagcagacaactaatcttagttcgttcctatttgcaaggatttcatggttctattttagtgttttattttttgtaatgtgattgtacaagggtttttgatccttttttaattcaggtagtagaagtaattgtttacagaggtcatgaaacacaaaactgcataccg

SEQ ID NO: 3532 - DNA, 1047 bp, Eutrema parvulum
aaaagcttttaaccctagttcctggccctcgctcgccgtaaactgaagaagaagaccaaggaagatcatcatccatgggtcgtgtcatcagagctcaacgtaagggagcgggttccgtcttcaagtcccacactcaccaccgtaaaggtccggccaaattcaggagcctcgatttcggcgagaggaatgggtacctcaagggtgttgtgacggagatcatccacgatccaggacgtggagctcccttggctcgcgtcgccttccgtcatcctttccgttacaagaagcagaaggagctcttcgttgccgccgaaggtatgtacaccggtcagtttctctactgcggtaagaaagccactctcgtcgtcgggaatgttcttcctctcagatctatccctgaaggagctgttgtctgcaacgtcgagcatcatgtcggtgatcgtggtgttttcgctagggcctctggtgattacgctatcgttatcgctcacaaccctgacaacgacaccagcaggtttaaatagaaattgcttcgaagaagattgtcccaagtggatgcagggccatgattggtcaagttgctggtggtggaagaacagagaagccaatgctcaaggcaggtaacgcataccacaagtaccgtgtgaagagaaactgctggcctaaggttcgtggtgtggctatgaatccagttgagcatcctcacggaggaggtaaccatcaacatattggtcacgccagtaccgttcgtcgtgatgcaccacctggacaaaaggttggtcttattgctgcaaggaggactggtcgtctcagaggtcaagctgctgctcttgcctccaagcaagaataaggagtcgaagcttgaagatgaaattgttcacttttgttggatttttgctgatgagaccatgttttgaaaccttaagatttactataatgttctttgagaccttttcttatcaagtagaatctatgtcttcaggtttgcaccttgactgctttaaattattcgttattggttttggttttctggttcgttttgttttt

SEQ ID NO: 3533 - DNA, 929 bp, Scabiosa columbaria
tgggtcgtgtgatcagagctcaacggtaagggagcaggctccgtcttcaagtctcacacacaccacgtaagggtccggccagattccgcagtctcgacttcggcgagcgaaatggttacctcaaggggagttatcaccgaaatcatccacgatccaggtcgtggtgctccactcgccagaattaccttccgccatcccttccgtttcaagcatcagaaggaactcttcgtcgccgccgaggggatgtacaccggacaatttgttttctgtggtaagaaagctaatctaatggttggaaatgttcttcctcttagatctatccctgaaggagctgttgtttgcaacgttgaacaccatgtcggtgatcgtggtgtgttggctagagcttctggtgattatgctattgttatcagccacaatcctgacaatggaacctcaaggattaagctcccatcaggagccaagaagattgtgccaagtggatgccgtgcaatgataggtcaggttgcaggaggtggaagaacagagaagccaatgctgaaggctggaaacgcatatcacaagtacagagtgaagagaaactgctggcctaaggtgcgtggtgtggctatgaatccagttgagcatcctcatggtggtggtaaccatcaacatattggtcacgccagtactgttagacgcgatgcaccacctggtcaaaaggttggtcttattgctgcaaggaggactggtcgtcttcgtgggcaggctgctgctactgcttcaaaggagaaggcttagttgtttaactctgaaaagaaatcttggttatgtttgtttgtttttgtgacaatttgtttgttatgttgagaaagatctatcatatatatttctcccatcaactgaaattttgcttcgtagttttctttgtcataatatttgtagtggtc

SEQ ID NO: 3534 - DNA, 1287 bp, Cannabis sativa
accaaaattttgactcttatgtaaatatactcttaagcatttcttcttcttcgccgtcgccagtcaaaaccctaatcctaaccctaaccgtagcaatgggacgagtcattagggcacagcgtaagggtgccggatctgtgttcaagtcccacacccaccaccgtaagggtccggcccggttcaggtctctggacttcggcgagcgcaatggttacctgaaaggagtggtcaccgatatcatccacgacccggggcgaggtgccccacttgcccgagtcacgttccgtcatccattcaggtacaagcaccagaaggagcttttcatcgccgcagagggcttgtattccggtcagttcatctactgtgggaagaaggctaatctcgtcgttggtaatgtccttcctcttcgatctcttcctgaaggtactgttatttgcaacgttgagcaccacgttggtgaccgtggtgttctcgctagggcatctggtgattacgccgttgttatcagtcacaacccggataatggaactagcagagttaagcttccatccggagctaagaagattttgccaagtggatgcagagctatgattggtcaggttgccggtggaggcaggaccgagaagccaatgttgaaggccggaaatgcgtaccacaagttcagagtgaagaggaatagctggcctaaggttcgtggtgttgctatgaaccctgtggagcatcctcatggtggtggtaaccaccagcacattggtcatgccagtacaattgcaagagacgctgcacctgggcaaaaggtcggtctcattgctgccaggaggactggtcgtctccgaggacaagctgccgccgctgcttccaaagccgactagggctttttcgaaggtttttttgttgttgttgttgttgttgtgtgggcactttttactaatcaatactagagtgtcttttgttattagtcttcttaggaatgaagttcagtttctggaatagagataccatttagcattatcataatctatttgtgtttcttttttgttttgctgaaacttttttgccttaaatgtaataaaactttgtatcgaatggttgagtttagtgggcatgcttgccagttttgggtacactcagcaatgctgtactctattgtctgatgatgtttataggaactttgagtgaaccatacgaatatgttttagattcaattttattatttttggcctatgaataaattaagtaaacatgtgagacataaaagtggttctgatccccacaggtagattaaag

SEQ ID NO: 3535 - DNA, 805 bp, Brassica oleracea
  misc_feature (771)..(771): n is a, c, g, or t
cggtctcaaaccctaattgtaatcttcgccgtcgagcctccatccatcaatgggtcgtgtcatcagagctcaacgtaagggagcaggttccgtcttcaaatcccacacccaccaccgcaagggtccagccaagttccgtagcctcgactacggcgagagaaatggatacctcaagggcgtcgtgaccgagatcatccacgatcccggccgtggtgcgccgctagctcgcgtcgcgttccgtcatcctttccgttacaagaagcagaaggagctcttcgtcgccgccgagggcatgtacaccggacagttcttgtactgcggtaagaaagccactctcgttgtcggaaatgttctcccgcttagagctatccccgaaggagctgttgtctgtaacgtcgagcatcatgtcggtgatcgtggtgtgctcgctagagcttctggtgattacgctattgttatttcgcacaaccctgacaacgacactactaggatcaagctgccatctggttccaagaagattgttccgagtggttgcagggccatgattggtcaagttgctggtggaggaaggactgagaagccgatgctcaaggcaggaaacgcttaccacaagtaccgtgtgaagagaaactcatggcctaaggttcgtggtgtggctatgaatccagttgagcatcctcatggaggaggtaaccatcagcacattggtcacgcaagtactgttaggcgtgatgcaccaccagggcagaaggttggtcttattgctgctangaggactggtcgtctcagaggtcaagctgctgct

SEQ ID NO: 3536 - DNA, 1094 bp, Fagus grandifolia
cgtcttcaagtcccacacccaccaccgcaagggtccggcgaggttccgcagtctcgacttcggcgagcgcaacgggtacctgaaaggagtggtgacggagatcattcacgacccgggtcgcggtgctccgttggccaaggtcactttccgccacccgttccgttacaagaagcagaacgagctgttcgtggcggcagaggggatttacactggacagttcgtgtactgtggaaagaaagctactttggtggttgggaatgttttgcctctcagatcgatccctgaaggagctgtggtttgtaacgtggagcatcacgttggtgaccgtggtgttttcgctagggcttctggtgattacgccattgttatcagccacaaccctgataacgacacttctagggtcaagctcccatctggtgctaagaagattgttccaagtggatgccgagctatgattgggcaggttgcaggtggagggagaactgagaagcccatgctcaaggctggtaatgcttaccacaagttcagagtgaagagaaactgctggcccaaggtacgtggtgtggctatgaacccagtggagcatcctcatggaggaggtaaccaccagcatattggtcatgcaagtactgtcaggcgtgatgcacctcctggccaaaaggttggtctcattgccgcaaggaggactggtcggctcagaggacaagctgctgctactgctgctaaagccgataagagtacttaaacagtattctattttagttaattgtgtttttgagatatctggtactcttttcccattatagattaatatctaaactacttggtgagttttgttgcagaaattttgtttggattgtggtaaacatctttcttaattatgacgtttggtttatgcattctttgaaatgagtccaaatacactatgcctatttttgttgagtggatgaagggaactcttattagaggttgtcgttgtggccatgatggaggtatggttatctccattctgtttcggatatgctgaaaattcaaatgttaagaggtggcttttgtaagtgttacattgttgaaaattcaaatgtcaagaggtg

SEQ ID NO: 3537 - DNA, 1000 bp, Cycas rumphii
  misc_feature (88)..(88): n is a, c, g, or t
  misc_feature (90)..(90): n is a, c, g, or t
  misc_feature (94)..(94): n is a, c, g, or t
  misc_feature (912)..(912): n is a, c, g, or t
gccatcctccacatatttccacgtagaaaaaaccctagaataaaagaggcgatattttaccttcctgtgtctcagagtaggtcatcgntngaancagggaaacgtcggttgaagtaaaactaaggtctcgcagagatgggtcgcgtaattcgagcacagaggaagggagcgggttcggtgttcagggcccatacccaccataggaaggggcctgcccgtttccggagtcttgactacggggaacgaaatgggtacataaagggcgttgtcacggatgtcatccatgatcctggtcgaggcgcccctctttgcagggtgacgttcagacatccattccgctacaggcaccagaaagagctatttgtagcggccgaggggatgtatactggtcagttcgtctactgcgggaagaaggccaacctcaccgttggtaatgttctacccttgaaatctgttccagaaggagccattgtgtgcaatgtcgaacatcatgttggtgatcgcggggccttcgccagggcttcgggtgactatgccattgttgtcagtcacaaccccgataacggcactaccagggtcaagcttccttctggggctaaaaagattgtgccaagtggttgcagagctatgattggccaggttgcagggggtggcaggacagagaagccaatgctgaaagctggtaatgcttaccacaaatacaaggctaagaggaactgctggccaaaggttcgtggtgtggctatgaaccctgttgaacatcctcacggtggtggtaaccatcaacatattggtcatgccagtactgtccgtcgtgatgccccccctggacagaaagttggtcttattgctgctagaagaactggacgtttacgtggacaagctgccacagcagctgcaaagacagacaanggtgcttaagtggtttcttcaatgttggttgtttgtttgtaagaagtttcttttatatttgttggacaactttgctattaccatctag

SEQ ID NO: 3538 - DNA, 802 bp, Flaveria ramosissima
accaccatcatcaacagcaaactcatctccaaaccctaaccctagccatgggtcgcgtcatcagagcccaacgtaagggagccggctccgtcttcaagtcccacacgcaccaccgcaagggtccggcgaggttccggagcctcgacttcggcgagcgcaacggctacctcaaaggcgtcatcaccgagatcatccacgaccccggccgcggggctccgcttgctcgcgtcactttccggcacccgttccgatacaagcaccagaaggagctcttcattgctgctgaggggatgtacactggtcagtttgtgttttgtgggaagaaggcgaatttgatggtgggggatgtgctgccgcttagatctattcctgaaggagctgttgtttgcaacgtggagcatcatgttggtgatcgtgggtcgtttgctagggcttctggtgattatgctattgttattagtcataatcctgataatggtaccactagagtgaagcttccatccggagccaagaaaattgtgccaagtggatgccgtgctatgattggtcaggttgctggtggaggacgtaccgagaagccaatgctgaaagctggtaatgcttatcacaagttccgcgtgaagagaaactgctggcctaaggttcgtggtgttgctatgaaccctgtggagcatccccacggtggtggtaaccatcaacacattggtcatgccagtactgttcgccgtgatgcaccacctggtcaaaaggttggtcttattgccgctaggaggactggtcgtctcaggggtcaagctgctgc

SEQ ID NO: 3539 - DNA, 1071 bp, Podocarpus macrophillus
aaaaccctcgtatagggttttgggtggacgaaaccctaatttttcgtttcttcagtagcagaggaggaagggaagaggagcggcagaaaaaagataggatggggagggttatcagagctcagaggaagggagcgggatccgttttcagatcccatacgcatcaccggaaaggtcctgcccagttccggagcctcgattactctgagcgcaatggctacattaagggaatcgtatccgaagtggtgcacgatccggggcgtggcgcgccgctctgccgggtgacatttaggcatccgtttcgttacaggcaccagaaagaactatttgtggctgcggaaggtatgtacacggggcaatttgtgtactgcggcaagaaggctaatcttaccgttgggaacgtgctgccgttgcgatcgattcctgaaggagccatagtctgcaatgttgagcagcacgtcggggatcgtggctcattcgctagagcctcaggggattatgctattgttgtcagtcataaccctgataacgggacttccagaataaaactcccttctggtgctaagaaaatagtgccaagcagttgccgagctatgattgggcaagttgctggtggtggtaggactgaaaaacccatgctcaaggctggcagagcgtatcataaatacagggtgaagaggaattgctggcctaaggttcgtggtgtggctatgaatcctgttgagcatcctcatggtggtggtaatcatcaacatattggtcatgccagtacagttcgtcgtgatgcaccaccaggccagaaagttggtcttatcgctgcaaggaggactggtcgtttgcggggacaagctgcaacagcagctgcaaagactgataagggatcttaggctatttcagttcgtttgtgttagaggattacaaataggttttggttggacaattttggtattacagacaatgactttgattgaagtgtttatgcatggttcttatagctcaattattttgacttatgttaatgtctccatttaatgcagatttgttgatgaactatatttacatgcttcaacttgg

SEQ ID NO: 3540 - DNA, 902 bp, Camellia sinensis
gatcactctaaaatattcactctcttcttttccctattctatcctcctgccggcccaaaccctagtccagacacagagagagagagagagagatgggtcgagtgatcagagctcagcgtaagggtgctgggtcggtattcaagtcccacacccaccaccgcaagggtccggctcggttccgcagcctggacttcggtgagcgcaacgggtacctgaagggcgtgatcaccgagatcatccacgatccaggtcgcggcgcccctcttgcacgcgtcactttccggcacccattccgtttcaagcaccagaaggagctattcatcgccgccgagggcatgtacaccggccagttcgtattttgcggcaagaaggccaatctcatggtcggcaatgtcctccccctcagatctatccccgaaggtgctgttgtctgtaacgttgaacaccatgtcggtgatcgtggtgttttggctagagcttctggtgattacgccatcgttatcagtcataaccctgataatggtacctctaggatcaaactcccatcaggggccaaaaagattgtgcctagtgggtgtcgtgccatgattggtcaggttgctggaggaggacgtacagagaagcccatgctcaaggctggtaatgcatatcacaagtaccgagtcaaaaggaattcatggcctaaggttcgtggtgtagctatgaaccccgtggagcatcctcatggtggtggtaaccatcaacatattggtcatgccagtacagttcggcgcgatgctccacctgggcaaaaggttggtcttattgctgccaggaggactggtcgtcttcgtggacagccgctgctactgctgcaaggctgatagagtgcttaaagaaatttagggatgctggctttatat

SEQ ID NO: 3541 - DNA, 770 bp, Juglans hindsii x Juglans regia
ggggggtgccggatcagtcttcaagtctcacacccaccaccggaagggtccggcccgcttccgcagcctcgacttcggcgagcgtaacggctacctcaagggcgtcgtcaccgagatcattcacgaccctggtagaggtgctccgctcgctcgtgtcaccttccgccaccctttccgctacaagaagcagaacgagcttttcgtagccgcagagggcatttacaccggccagttcatatactgcggcaagaaggccaatcttatggtaggtaatgtcttgcctctcagatctattcccgaaggagctgtggtctgcaacgttgagcaccacgtcggcgatcgtggtgtcttcgctagggcttctggggactacgctattgttatcagtcataacccagataatgacaccaccagggtcaaactcccatctggtgctaagaagattgtacccagtggttgccgagcaatggttggacaggttgcaggtggagggagaacagagaagccccttctcaaggctggtaatgcataccacaagttcagagtaaagagaaactgctggcccaaggttcgtggtgtggcaatgaacccagttgagcatcctcatggaggaggtaaccaccaacatattggacatgcaagtactgtcaggcgtgatgctccgccaggtcaaaaggttgggcttatcgctgcaaggaggaccggtcggctcagaggacaggctgctgccactgcatccaagtctgataaggcttaaaaaagtttgtctg

SEQ ID NO: 3542 - DNA, 986 bp, Primula obconica
tcagcggcgcacacacacacatttgggaagaatgggacgagtaatcagagcacagagaaagggagcaggatcggtgttcagatcccacacgcaccaccgcaaggggcagcgcgcttccgcagcctcgacttcgcggaacgcaacggatacaccaaaggagtcatcactgagatcattcatgaccccggccgcggcgctcccttggctcgcgtcaccttccgtcaccagtttaggttcaagcaccagaaagagctcatggttgcagctgaaggcatgtatactgggcagtttgtctattgcggaaagaaagcaaatctgatggttgggaatattttgccgctgcgatcggttcccgagggaggtgtcgtttgtaatgtcgagcaccatgtcggtgaccgtggcgtgtttgccagggcgtctggggattacgtgattgttattagtcacaaccctgataacgataccaccaggatcaagctcccatctgggtcgaagaagatagttccaagttcgtgcagggctatgattgggcaggtcgcaggcggtggaaggacagagaagccaatgctcaaggcaggtaacgcataccacaagtacagagtgaagaggaacagctggcccaaggttcgtggtgtggctatgaacccagttgagcatcctcacggtggtggtaaccaccagcatattggtcacgccagtactgtccgccgtgacgcgccccctggacaaaaggtcggtctcattgctgctagaaggactggtcgtctcaggggtcaagctgctgcttctgctgctaaagctgacaagtagagagaaagagaggggtttgacaaaaagtactctcgtagtatgtgtttttgttatttaattgtggttttgtttcttgctgcgtcgtattactgtttgctgctggtcttggatgtttttgaattgaggattttgttgcttagatggttgttttatggatatgactttttggagattcc

SEQ ID NO: 3543 - DNA, 850 bp, Brassica napus
cggaaaggtctttggatgatacgacagagaatgattcgttgctactgggtatgaatgaggttagacaagacaaggcaaagaagaaggaagatcatcatcatcaatgggtcgtgtcatcagagctcaacgtaagggagcaggctccgtcttcaagtcccacacccaccaccgcaagggccccgccaagttcaggagcctcgacttcggcgagagaaatggttacctcaagggtgtcgtcacggagatcatccacgacccgggacgtggtgctccgttagctcgcgtctccttccgtcatcctttccgttacaagaagcagaaggagctcttcgtcgccgccgagggtatgtacaccggacagttcttgtactgcggtaagaaggccactctcgttgtcggaaatgttctgcctctcagatctatccccgagggagctgttgtctgcaacgtcgagcaccatgttggtgatcgtggtgtgctcgctagggcttctggtgattacgctattgttatctctcacaaccctgacaacgacacgaccagggttaagttgccatctggttcgaagaagattgttccaagtggatgcagggccatgattggtcaagttgctggtggtgggagaactgagaagccgatgctcaaggcgggtaacgcgtaccacaagtaccgtgtgaagaggaactgctggcctaaggttcgtggtgtggctatgaaccctgttgagcatcctcacggaggaggtaaccatcaacatattggtcacgctagtaccgttcgtcgtgatgcaccacccggacaaaaggttggtcttattgctgcaaggagaactggtcgtctcagaggtcaa

SEQ ID NO: 3544 - DNA, 1181 bp, Marchantia polymorpha
ctcgagcggagctcgagagagaacccgagaaattgacgagaatttgccgctgcatccacgatgggtcgtgtgattcgagcacagaggaagggagcgggaagtattttccgatcccacactcaccgaaggaaagggcctgcccggttcaggtcgctcgattacgccgagagaaatggctacatcaagggtgtcgtttcggatgttatccacgattctggccgtggagctcctctggccaaggtgaccttcagacatgcgttcagattcaagcaccaaaaggagctctttgtcgccgctgagggtatgtacaccggtcagttcttgtactgtggaaagaaggctgccttgactgtcggcaatgttttgccccttcgatcggttcccgagggagctgtcgtctgcaatgttgagcaccgtatgggagacaggggtgcgtttgcccgcgcttctggtgattacgtcatcgttatcagtcacaaccctgataacggaacctctcgtattaaattgccatctggagccaagaagatcgttccaagtggatgtcgtgccatgattgggcaagttgccggagggggacgtaccgagaagcccatgttgaaggctggaaacgcttaccacaagtacaaggtgaagcgaaacagctggcctaaggttcgtggtgtggctatgaacccagttgagcatcctcacggaggaggtaaccatcaacatatcggtcatgccagtaccgtgcgtcgtgacgcaccgcccggtcaaaaggttggtcttattgctgcccgcagaaccggacgtctgcgaggacaagccgcaactgccgctgccaagaccgacaaaagttaagattaattgtcatcacactcctggcccagccacagcactagatttattccagttcttgcgattacttctcagttcacttgagctgatctgtacgaagggtatgattttccatctcttcacaagcaattttgctgaaagagtctactaccatcaaccgcgacttgctgtacgatatttgatttcggcttgtgtcggggaatgccatgcaaacttgccctcttccttagctcggcagtgttcggaacatgtggaatatgtcatggtggattgtgggactccgtgagctcgattcctactttgagcggtgtcttaaacacattttatgttcaaaaaaaaaa

SEQ ID NO: 3545 - DNA, 1366 bp, Pinus pinaster
cgtgtagatgtcgaattaaggtgggttatgttaattattgtaaattcacacaatacaaaattagggtttatggggtttgagtaaatgttccacccacattagggttagggtttatacccaactagggtttgtaggggattcgcatcttgacgaaaccccttagccatatctgttacttccattttcggaggcgcaacagatccaaactctgtgtagtgatctgctctggtctgcagacatgggtcgcgttattcgtgcacagagaaagggagcaggctccgtgttcaaatcccacacccatcacaggaagggacctgcacgtttcagaagcctcgactatggcgagcgcaatggctacattaggggaattatcacggacgtcatacacgatcctggccgcggcgctcccctctgcaaggtgaccttcaggcacccattccgttacaagcatcagaaggagctcttcgtagcggccgaaggtatgtactcgggacagttcgtttactgcggaaagaaggccaatttgactgtgggtaacgtgttgcccttgaggtctattccggagggagccattgtctgcaacgtggaacagaatgtcggcgatcggggttcgtttgctagggcttctggagactacgccatcgtcgtcagccacaatatcgataacggcactaccagggtgaagcttccctctggagctaagaagattgtgccaagtggttgtagagctatgattggtcaagttgctggaggtggaagaacagaaaaaccaatgctcaaggctggcaatgcataccacaaatacagggtcaaaagaaactcttggcccaaggttcgtggtgtggctatgaatccagttgagcatcctcatggtggtggtaaccatcaacatattggtcatgctagtactgtacgtcgtgatgcaccaccagggcaaaaagttgggcttattgctgccagaagaactggtcgtctgcgtggacaagctgcatcagcagctgcaaagatggacaactaatcttagttcatttctattttgcaaggatttcattgtcttattttggtgttttattttgtcgtaatgtgatttttcaagggttttgatccttttattcaggtagtagaagcaattgtttacagaggccaggaaacttataactgcatacccttattttcgttgtttatttaacttttatgttgcaacgatatatgtcaaccaagtaataatctcagctttcttttacatgattgtctataggtgagcagcttgctcacacaactgtatgattttttagacttgcaataattatacgatatatgatagtttaccacaaacttattaatatatttaccacagaacttgtta

SEQ ID NO: 3546 - DNA, 1390 bp, Pinus taeda
ttgacgaccatctcctctctcgacaatagttctcaccacctaaaccgtccgatctattcaaaggcagaatcccatccgttgagatgatatcaatcttgaccctctgaataaaccctagaaacgatctgagccgtctaaattcctagatggcgcagcatagcttctcgcctcgttaaaatgcaaactacctggcctgaagaaaattctcgcgttagggtttttctgtatcgggggagggagggttggagaggaaactctagtagtgtagtgtagcaatgggaagagtgatcagagcacagaggaagggagcgggttcggtgttcagatcccacacgcatcacaggaagggacctgcacgctttcgcagcctcgactatggggagcgcaatggctacatcaagggcattgtctccgatgttattcatgacccagggcggggtgccccgcttttgagggtgactttcaggcatcccttccgctataggcaccagaaggaactttacatcgcagccgagggtatgtatacgggccagttcatttattgcggtaagaaggccaatctcaccgtgggcaacgtgctgcctctcaaatctattcctgagggagctatcgtctgcaatgtggagcaacatgtcggagaccgtggttcgtttgcccgagcttcgggagactacgctatcgtcgtcagtcacaactttgataatgacactaccaggataaagctaccttctggagccaagaaaatagtgccaagcagttgcagagcaatgattggtcaagttgctggtggcggaaggactgaaaagcctatgctcaaggctgggaatgcataccataagtacagagtcaagagaaatagctggcccaaggttcgtggtgtggctatgaacccagttgaacatcctcatggtggtggtaaccatcagcatattggtcatgccagtactgtgcgccgtgatgcgccacctgggcagaaagtgggtcttattgctgcaagaagaactggtcgtttacgtggacaagctgcatcagctgctgcaaagaccgacaaaaccagttagtgtgttcctcgtcgttattaggtggaagaggtgttgtttatgccgtatgtgtatttggacattttggtatgttcacaaacaagagtaagatttattgccactcagatttggcctttgtgggactaaaattctgagtatttctttgtttactgaagttttgttcaagaattttgtttggtgaacatttttagatcactggtttaagcatcagcatttgtaggatgatagaacctaggccggcctttgctattacaatgaggaaagatacatttctttgtcgctcagtgtgttatattcagttgggtaattacatctatgtttccatttta

SEQ ID NO: 3547 - DNA, 915 bp, Brassica juncea
agcccaacgtaagggagcaggctccgtcttcaagtcccacactcaccaccgcaagggccccgccaagttcaggagcctcgatttcggcgagagaaacggttacctcaagggcgtcgtcacggagatcatccacgaccctggacgcggtgctccgttagctcgcgtctcgttccgtcaccctttccgttacaagaagcagaaggagctcttcgtcgccgccgaaggtatgtacaccggacagttcttgtactgcggtaagaaggccactctcgtcgtcggaaatgttctgccgctcagatctatccccgagggagctgttgtctgcaacgtcgagcaccatgtcggtgaccgtggggtgctcgctagagcctctggagattacgctatcgtgatttcacacaaccctgacaacgacacgacaagggtcaagttgccatctggttcgaagaagattgtcccaagtggatgcagggccatgattggtcaagttgctggaggtggaagaaccgagaagccgatgctcaaggcgggtaacgcgtaccacaagtaccgtgtgaagaggaactgctggcctaaggttcgtggtgtggctatgaaccctgttgagcatcctcacggaggaggtaaccatcaacatattggtcacgccagtaccgttcgtcgtgatgcaccacctgggcaaaaggttggtcttattgctgcaaggaggactggtcgtctcagaggtcaagctgctgctcttgcctccaagcaagaataaggagataaatcttcaagatgatgaagttgtttacttttgttggatttttgctgagaccttgtgttgaatcctttagtttttctataatctttcttgagacctttgtcctgagaattaaacctccatattatcagtttaaatttcgttattcagtc

SEQ ID NO: 3548 - DNA, 1008 bp, Allium cepa
cttcttcccatctctatacctttaaaaaacaaacccaatgggtcgtgtaattcgggcacagaggaagggagctggtgggatatttaaatcccacactcaccaccgcaaaggaccggctcgtttccgctcgatcgactacagcgaacgcaacggctacctgaagggcgtcatcactgacatcatccacgaccctggtagaggcgcaccactcgcacgcgtcaccttcagaaatccgctgagatacaagcaccagaaggagcttttcattgccgccgaaggaatgtatacaggccagttcgtgtactgtggacgcaaggcgaatctgatggtcggaaatgtgcttcccttgagtgcgattccggaaggagcggttatttgcaatgtagagcaccatgttggggataggggttctttggctagagccagtggtgattatgctattgttatcagtcataaccctgataataatactactagggtgaagctaccatccggagcaaagaagattctaccgagcggatgcagggccatgataggccaagtagcaggcggaggccgaacagagaaaccccttctgaaggcaggaaacgcataccacaagtacagagtgaagagaaactgctggcccaaggtacgtggtgtggccatgaacccggtcgagcatccacacggaggtggtaaccaccagcacatcggtcatgcctccactgtccggcgcgatgcaccaccgggacagaaggtcgggctcattgctgccaggaggaccggtcggctcaggggtcaagctgctgcttctgctgctaaggagaaggcttagtaggtttggaggttttgttcttggtattgaaagctcgttatgtttgagctttttgcattttaagaagtagggttgatttttggatgtttgaatttgatctttgtgatgttttgttttatagaccatatgttctgtttttgttttctgctggttttgggggtgatataccaattttatttgatgaatggtac

SEQ ID NO: 3549 - DNA, 1182 bp, Brassica rapa
gctttatgggcttttaaccaggcttaggcccatttagaacagatccacattaacctcactagggttttgagagactgtgatataaaacacctgtaacctcacttcatttcactcgccgtaaactcaagaagaaggaagatcatcatcatccatgggtcgtgtcatcagagctcaacgtaagggagcaggctccgtcttcaagtcccacactcaccaccgcaagggccccgccaagttcaggagcctcgacttcggcgagagaaatggttacctcaagggtgtcgtcacggagatcatccacgatccaggtcgcggtgctccgttagctcgcgtctccttccgtcatcctttccgttacaagaagcagaaggagctcttcgtcgccgccgagggtatgtacacgggacagttcttgtactgcggtaagaaggcgactctcgttgtcggaaatgttctgcctctcagatctatccccgagggagctgttgtctgcaacgtcgagcaccatgttggtgatcgtggtgtgctcgctagggcttctggtgattacgctattgttatctctcacaaccctgacaacgacacgaccagggttaagttgccatctggatcgaagaagattgtcccaagtggatgcagggccatgattggtcaagtcgctggtggtgggagaactgagaagccgatgctcaaggcgggtaacgcgtaccacaagcaccgtgtgaagaggaactgctggcctaatgttcgtggtgtggctatgaaccctgttgagcatccccacggagcaggtaaccatcaacatattggtcacgccagtaccgttcgtcgtgatgcacaacctgggcaaaaggctggtcttattgctgcaaggagtactggtcgtctcagaggtcaagctgctgctcttgcctccaagcaagaataaggagataaatcttcaagatgatgaagttgtttacttttgttggatttttgctgagaccttgtgttgaatcctttagtttttctataatctttcttgagacctttgtcctgagaattaaacctccatattatcagtttaaatttcgttattcagttttgatttctatctcgtttatagttctttaactgaaagttctgaataaacagtgcgaagcatctttatgtgatccctgagtcacgataggcggagttcgc

SEQ ID NO: 3550 - DNA, 745 bp, Brassica juncea
ccatgggtcgtgtcatcagagctcaacgtaagggagcaggctccgtcttcaagtcccacactcaccaccgcaagggccccgccaagttcaggagcctcgacttcggcgagaggaatggttacctcaagggtgtcgtcaccgagatcatccacgacccgggacgtggtgctccgttagctcgcgtctccttccgtcatcctttccgttacaagaagcagaaggagctcttcgttgccgccgaaggcatgtacaccggacagttcctgtactgcggtaagaaagcgacacttgttgtcggaaatgttctcccgctcagagcgatccctgaaggagctgtcgtctgtaacgtcgagcatcacgtcggtgatcgcggtgtgctcgctagagcttctggggattacgctatcgtgatttcgcacaaccctgacaacgatactaccaggatcaagttgccatctggttcgaagaagattgttccgagtggatgcagggccatgattggtcaagttgctggtggtggaagaacggagaaaccgatgctcaaggcaggaaacgcgtaccacaagtaccgtgtgaagagaaactcctggcctaaggttcgtggtgtggctatgaatccagttgagcatcctcacggaggaggtaaccatcagcacattggtcacgcgagtacggtcaggcgtgatgcaccaccgggacagaaggttggtcttatcgctgctaggaggactggtcgtctcagagg

SEQ ID NO: 3551 - DNA, 1055 bp, Marchantia polymorpha
  misc_feature (999)..(999): n is a, c, g, or t
agccgactggcagacctttcttcgtcgtaggagcagcaggatcgggaggtatgggtcgtgtaatcagagcccaaaggaagggagcgggaagtattttccgatcccacacccacaggaggaaaggacctgctcgatttagatctctcgactatgccgagagaaacggatacattaagggagtcgtttccgatgtcatccacgattcaggacgaggagcaccattgtgcagggtcacatttagacatgcgtttcgttacaagcaccagaaggagttgttcgtcgctgcagagggtatgtactctgggcaattcgtttactgtggaaagaaggctgctctcaccgtcggaaacgtcttgcctttgaggtctgtgcccgagggagctgttatctgcaatgtcgagcaccgtatgggagacaggggtgcctttgctcgcgcttctggtgactacgctatcgtcatcagccacaaccccgataacggaacatctcgcattaagttaccatctggtgcgaagaagatcgtccccagcggttgccgtgccatgattggtcaagttgccggtggaggaagaacagagaagcctatgttgaaggctggaaacgcctaccacaagtacaaggtgaagcgtaactcgtggcccaaggttagaggtgtggctatgaatcccgttgagcatccccacggaggaggtaaccaccagcatattggtcacgccagtactgtccgacgtgacgcaccacccggacaaaaggttggtctcattgctgctcgcagaaccggtcgtctgcgaggacaagcagctacagcagctgccaagacagacaagacataagtcgatttggtgtaggttagagatgcggatcacgcgatggagtaacggaatcgaattgagtctccaattgaaaactggtattacaattacattttgcccaatcatgtcagtacatatacaaattttgagcattccttgcctgtgatgtaactatggttcactgtgnatgtatgagtttcatggtactatgtctgggagaatttacactcctgaaaaaaaaaa

SEQ ID NO: 3552 - DNA, 813 bp, Platanus occidentalis
gggtccgtcttcaagtcccacacccaccaccgcaagggtccggctcgcttccgcagccttgacttcggggaacgaaatgggtatctcaagggcgtcgtcacggagatcgtccacgaccccggccgcggcgcccctctcgcccgagtcactttccgtcatcccttccggtacaagcaccagaaggagctcttcgtcgcggcggaaggcatgtacactggccagttcgtgtactgtggcaagaaagccaatctgatggtcggtaatgtgttgccgctccgatcgatccccgaaggtgctgtggtttgcaacgttgaacaccacgtcggtgatcgaggggtcttggcgagggcgtcgggtgattatgctatcgttatcagtcacaaccctgataatggtactacaagaatcaagcttccctctggtgccaagaagattgtgccaagtggatgtagggcgatgattgggcaagttgcaggtggggggaggactgagaagcccctgctcaaggctggtaatgcctaccacaaatacagggtcaagaggaactgctggccaaaggttcggggtgttgccatgaatcctgtggagcatcctcatggaggaggaaatcatcagcacattgggcatgccagcactgttcgacgcgatgcacctcctggccagaaggtgggtcttattgctgcaaggaggactggtcgtctccgtggacaagctgctgcaacggcttccaaggctgagaagagttcttagtgagttataattttcttgtaattgtttgcttgtcatccatcctagaagttccttagtcattgt

SEQ ID NO: 3553 - DNA, 793 bp, Cannabis sativa
ccctagtcggctttggaagcagcggcggcagcttgtcctcggagacgaccagtcctcctggcagcaatgagaccgaccttttgcccaggtgcagcgtctcttgcaattgtactggcatgaccaatgtgctggtggttaccaccaccatgaggatgctccacagggttcatagcaacaccacgaaccttaggccagctattcctcttcactctgaacttgtggtacgcatttccggccttcaacattggcttctcggtcctgcctccaccggcaacctgaccaatcatagctctgcatccacttggcaaaatcttcttagctccggatggaagcttaactctttccattatccgggttgtgactgataacaacggcgtaatcaccagatgccctagcgagaacaccacggtcaccaacgtggtgctcaacgttgcaaataacagtaccttcaggaagagatcgaagaggaaggacattaccaacgacgagattagccttcttcccacagtagatgaactgaccggaatacaagccctctgcggcgatgaaaagctccttctggtgcttgtacctgaatggatgacggaacgtgactcgggcaagtggggcacctcgccccgggtcgtggatgatatcggtgaccactcctttcaggtaaccattgcgctcgccgaagtccagagacctgaaccgggccggacccttacggtggtgggtgtgggacttgaacacagatccggcacccttacgctgtgccctaatgactcgtcccattgctacggttagggttagg

SEQ ID NO: 3554 - DNA, 931 bp, Selaginella moellendorffii
agggcaggagcgagcgagctaggagcaatggggcgcgccatccgggcacagcgtaagggtcgcggctccgtcttcaaatctcacacgcaccaccgcaagggtccggcgcggctccggaagctcgatttcgcggagcgcaatggctacatcaagggtgtggtgactgacgtgatccacgattctggccgtggggcgccgctgtgcaaggtgacattccgccatcccttccgcttcaagcaccagaaggagctcatgatcgctgccgaggggatctactctgggcagttcatgtactgcgggaagaaggctcagctcgccattgggaacattctgccgcttagatccgtgccagagggagctgtggtgtgcaatgtggagcaccgcgtcggggacaggggcgccttcgccagggcctctggagactacgctatcgtcgtcagccacaatccagacatgggaacctcccgtatcaagctcccatccggggccaagaaggtggttcccagtggctgccgggcgatgatcgggcaagttgcgggaggtggccggactgagaagcctctgctcaaggcgggcaacgcgtaccacaagttccgcgtgaagcgcaacagctggcccaaggttcgtggtgtggctatgaatcccgtggagcatccccacggaggaggtaaccaccagcacatcggtcacgccagcactgtccgccgcgacgctcctccggggcaaaaggtgggtctcattgcggcccggaggactgggcgtctccgtggacaagccgccagtgccgcggccaagaccgagaaggcatagagatgagcaaacaagaatcacaaaaagaaaaacgcaaaccacgttcgcgaaccaagtcttattttcctggttttgtagccttatcaactttttctaaattgagtttttgtactaagaagcc

SEQ ID NO: 3555 - DNA, 904 bp, Selaginella moellendorffii
agcgagcgagcgaggagcaatggggcgcgccatccgggcacagcgtaagggtcgcggctccgtcttcaaatctcacacgcaccaccgcaagggcccggcgcggctccggaagctcgatttcgcggagcgcaatggctacatcaagggtgtggtgactgacgtgatccacgattctggccgcggggcgccgctgtgcaaggtgacattccgccatcccttccgcttcaagcaccagaaggagctcatgatcgccgccgaggggatctactctgggcagttcatgtactgcgggaagaaggctcagctcgccattggaaacattctgccgcttagatccgtgccagagggcgctgtggtgtgcaatgtggagcaccgcgtcggggacaggggcgccttcgccagggcctctggagactacgctatcgtcgtcagccacaatccagacatgggaacctcccgtatcaagcttccatccggggccaagaaggtggttcccagtggctgccgagcgatgatcgggcaagttgcgggaggtggccggactgagaagcctctgctcaaggcgggcaacgcgtaccacaagttccgcgtgaagcgcaacagctggcccaaggttcgtggtgtggctatgaatcccgtggagcatccccacggaggaggtaaccaccagcacatcggtcacgccagcactgtccgccgcgacgctcctccggggcaaaaggtgggtctcattgcggcccggaggactgggcgtctccgtggacaagccgccagtgccgcggccaagaccgagaaggcatagagatgaggaaacaagaatcacaaagaaaaacgcaaaccacattcgcgaaccaagtcctattttcctggttttgtagccttatcaacttttctaaattgagtt

SEQ ID NO: 3556 - DNA, 986 bp, Papaver somniferum
cctatctcaaatcccacacccaccaccgcaaaggaccagcaaggttcagaagtttagatttcggtgaaagaaatggttacttgaaaggagtagttactgaaatcatccacgatccaggtcgtggtgctccattagcaagagttactttcagacatccattcaggtacaagcatcagaaagagctttttgttgctgctgagggtatgtatactggacagtttttgtattgtgggaagaaagctaatcttatggttggaaatgttcttccattgagatctatccctgaaggagctgttgtttgtaatgttgaacatcatgttggtgatagaggaacattagctagagcttctggtgattatgctattgttatcagtcataaccctgataatggtacttcaaggattaagcttccatctggagcaaaaaagattgtaccaagtggatgccgtgctatgattggccaagttgctggaggaggcaggactgagaagcccatgttgaaagcaggaaatgcttaccacaaatacagagtgaagagaaactcctggcccaaggttcgtggtgttgctatgaatccagttgagcatcctcacggaggaggtaaccaccaacatattggacatgccagtaccgttcgtcgtgatgcacctcctggacaaaaggttggtctcattgctgccaggagaactggacgtcttcgtggacaggctgcttcagctgctgccaagactgataaagcttaagttgttggctgttttactgttttagtttgttttgatatctcgaaacagtctttcctagtttgacacatgagaggtactgtgaggagaatacttttaatgtttattgtcttcagatattacttattagtgtgtagaatgatcagaattttatctctctgtgaactgcaagtttgttgcttgagcaatgtactgaatttaacaacacagtttgataatttcctctttgctaaagtcagtttttat

SEQ ID NO: 3557 - DNA, 986 bp, Zostera marina
ccgccgtcgtcgtcaccgtacgtcatagccagtaccatcgcagcaggatgggacgtgtcattcgtgcccagcgtaagggagcaggatcgatcttcagatctcacacgcatcaccgtaagggaccggcgaggttccgttccctcgatttcggtgagcgaaacggttacattaaaggtgtcatcaccgatgtgatccacgatccaggacgtggtactcctctagctcgcgtcacattcaggcatcctttcaggtacatgcattagaaggagctttttgttgcggcggagggaatgtataccggtcaatttgtgtactgtgggaagaaagccaatctaatggttggtaatgttcttcccattcgatctattcctgaaggaaccgttgtctgtaacgtcgagcatcatgttggtgatagaggtgcgtttgctagatgttctggggattacgcaattgttatcagccacaatcccgataatggaacttcaaggatcaagcttccatctggagtaaagaaaattatagctagtgggtgtcgtgccatggtaggacaagttgccggaggtggaaggaccgagaaacctatgcttaaggctggaaatgctttccacaaataccgtatgaagagaaactgctggcccaaggttcgtggtgttgccatgaatccaatggagcatccccatggaggtggtaaccatcagcatattggacatgccagtacagtccgcagagatgcacctcccggacagaaggttggtcttattgctgccaggagaactggtcggcttcgtggacaagctgctacaactgcatccaaggccgagtagaatttttcttcttctcatttcattcttatttcaatcttttgtctgtcatttttctttcttgtcaaactgtgaactttaactgtcttgttgcttcttgcttgttttaatttaagactccaattgtcggagtattgtcgtttgtccgtttattacatctccttg

SEQ ID NO: 3558 - DNA, 896 bp, Brassica juncea
ttgtaatctttcgccgtcgagcctccatccatcaatgggtcgtgtcataagagctcaacgaaagggagcaggttccgtcttcaagtcccacacccaccaccgcaagggtccagccaagttccgtagcctcgactacggcgagagaaatggatacctcaagggcgtcgtgaccgagatcatacacgatcccggccgtggttcgccgctagctcgcgtcgcgttccgtcatcctttccgttacaagaagcagaaggagctcttcgtcgccgccgaaggtatgtacacgggacagttcttgtactgcggtaagaaggccactctcgttgtcggaaatgttctgcctctcagatctatccccgagggagctgttgtctgcaacgtcgagcaccatgttggtgatcgtggtgtgctcgctagggcttctggtgattacgctatcgtcatctctcacaaccctgacaacgacacgaccagggttaagttgccatctggatcgaagaagattgtcccaagtggatgcagggctatgattggtcaagttgctggaggtggaaggagccaatgctcaaggctggtaacgcgtaccacgagtaccgtgtgaagagaaactgctggcctaaggtttgtggtgtggctatgaaccctgttgagcatcctcacggaggaggtaaccatcaacatatttgtcacgccagtactgttcgtcgtgatgcaccccctgggcaaaaggttggtcttattgctgcaaggagaactggtcgtctcagaggtcaagctgctgctcttgcttccaagcaagaataaggagagaaatcttcatgatgatgaagttgtttacttttgttggatttttgctgagaccttgtgttgaatcctttagtttttctataatcttt

SEQ ID NO: 3559 - DNA, 1011 bp, Brassica rapa
atagcttgcgcagagggcaacaacaagaagagaggcagcttcgtcgagatgggtcgtgttattagggctcaacgtaagggtgccgctggttccgtcttcaagtcccacacccaccaccgcaagggtccggctaagttccgtagcctcgactacggtgagagaaatgggtatctcaagggtgttgtgactgagatcatccacgacccaggacgtggtgctccgttagctcgcgtcgatttcagacatcctttccgttacaagaagcagaaggagctgttcgttgctgcggaaggtatgtacacgggacagttcctctactgtggtaagaaggcgactctcgttgtaggtaacgtgcttccccttagatcgattcccgagggagctgttgtctgcaacgttgagcttcatgttggtgaccgtggagcactcgctagagcttccggtgattatgccatcgtgatttctcacaatcctgacaacgacaccactaggattaaacttccttctggggcgaagaagattgtgcaaagtggatgcagagcgatgattgggcaagttgctggtggaggcagaacagagaagccacttctcaaggcaggtagggcataccacaagtaccgagtgaagagaaactgctggcctatagttcgtggtgtggctatgaacccagtggagcatcctcacggaggaggaaaccaccagcacattggtcatgctagtacggtcagacgtgatgcaccaccagggaagaaggttggtcaaattgctgcgagaagaacaggtcgtcgcagaggtgctgctgccgttgaatcagccaaggcagattagacttaattgtggcacaagcttctctgttttctttggattttttgctgattttattattaaactttaagagtttgccgtttttcgtttattttaatttttgttggtgtttaaaagcttatgctttttgtattggattaacccttaggggatacatttatgatttatatactattttattttggc

SEQ ID NO: 3560 - DNA, 727 bp, Platanus occidentalis
gtgttcaagtcccacacccaccatcgcaagggccctgccaggttcagaagtctcgacttcggcgaacgcaatggctatctcaagggggtcgtcaccgaaatcgttcacgaccctggtcgcggggcaccactcgccagagttaccttccgccaccccttccgctacaagcatcagaaggagctcttcgtcgccgccgagggtatgtacactggtcagttcgtctactgcggtaagaaggctaatctcatggtgggtaacgttctcccgctccgttcaatccctgaaggtgccgttgtttgcaacgttgaacaccatgttggtgatcgaggcgtccttgctagagcttctggggattacgccattgttatcagtcataatccagataatgggacttccaggatcaaacttccatctggagccaagaagattgtaccaagtgggtgccgtgccatgattggccaggttgctggtggaggcaggacggagaagccgcttctcaaagcaggcaatgcttatcacaagtacagggtcaagaggaactgctggcccaaggtacgtggtgttgctatgaaccctgtggagcatccccatggtggtggtaaccaccaacacattgggcatgccagtactgttagacgtgatgcccctccgggcagaaggttggtcttattgctgccaggaggactggtcgtcttcgagggcaagctgctgccacagcttcaaaagc

SEQ ID NO: 3561 - DNA, 776 bp, Cleome spinosa
gaactcgggggtagcagaaaaccggcgtcggcgatgggtcgtgtaatccgtgctcagcgtaagggtgctggttcggtcttcaagtcccacgcgcaccaccgcaaaggtcctgcgaagttccggagcctcgacttcggcgagcgcaatggttatctcaagggtgtcgtgacggagatcatccacgatccaggccgtggtgctccgctcgctcgggtcgttttccgacatcctttccggtacaagaagcagaaggaactcttcgtcgccgccgagggtatgtacaccggtcagttcgtgtactgtggtaagagggcctctctcgttgtcggcaatgttcttcctctcaggtccattcctgagggagctgtcgtttgcaacgtcgagcatcatgtcggcgatcgtggtgtgttcgctagggcttccggtgattacgctattgttatcgcccacaatcctgacaacgataccaccaggatcaagctcccatctgggtctaagaagattgtgccgagtggttgcagagccatggttggccaagttgccggtggaggaagaactgagaagcctctcctcaaggccggaaatgcctaccacaaattcagagtgaagagaaactgctggccgaaggtccgtggtgtggcgatgaacccagttgaacatccccacggaggaggtaaccaccagcacattggtcacgccagtacggtcagacgtgatgcccctcctggacaaaaggttggtctcattgctgcgaggagaactggtcgtctcagagg

SEQ ID NO: 3562 - DNA, 1285 bp, Fagopyrum esculentum
cggttgaagtatttcaattggtatatatttatcgggaagccgtcaactgtcgtctccgattcacgccgccgtaagccatgggaagggtcataagatctcaacgtaagggagcaggttccatcttcaagtcccacacacaccatcggaagggtgccgccaagctccgaactctcgacttcggcgaacgcaatggatacctcaagggagtcgtgactgacatcatccatgatccagggcgtggtgcgccgctcgcacgcgtcaccttccgtcacccctttcgcttcaagcaccagaaggagctgttcgttgctgctgaaggcatgtacaccggtcagttcatctactgtggtaagaaggcaaatctcgtggttggaaatgtcttgcctgtgagagcgatccctgaaggagccgtcgtttgcaatgttgagcaccatgttggagatcgtggtgtcttcgctagggcttctggagattacgccatcgttatcagccacaatcctgataatgataccactcgtgtgaagcttccttctggttccaagaaaaccatcccaagtagctgccgtgccatggttggtcaggttgctggtggtggacgtaccgagaagcctcttctcaaggccggaaacgcataccacaagttccgtgttaagaggaactgctggcctaaggttcgtggtgttgctatgaacccagtggagcatccccatggtggtggtaaccaccagcacattggtcatgccagtacggttagtcgttcttccgtacctggacagaaggtcggtctcattgctgccaggagaactggtcgtcttcgtggtcaagctgctactgctgctgccaagtcgaagtaaacatgagcattgagttttgctgtcatatttataatttccttgtcttctcattacaaacttatgacccaagaaagttcttatgttgtttttggttagttatgttttaaactcgtgtgttgcttgttctgagcctcgtgatatttgttaagtgaactctttcgagtcattttgggttgtgagccgtcaaaaaaaacgactaggtgaatggtgattttggcttcgtagggtgattgaatcgaatttggttatctgtacactgaattgttacggggccctcctctacacattcattttccttgtaaatacctagggttattagactctgacgagcagcttgaactaagtttgaaaaaagttgtatcaagtatgttcactctctatacaaattgaacttgtctgtacttaattaacaacgattgtttgatataact

SEQ ID NO: 3563 - DNA, 911 bp, Raphanus sativus
  misc_feature (228)..(228): n is a, c, g, or t
  misc_feature (258)..(258): n is a, c, g, or t
  misc_feature (264)..(264): n is a, c, g, or t
  misc_feature (294)..(294): n is a, c, g, or t
aatccatgggtcgtgtcatcagagctcaacgtaagggagcaggctccgtcttcaagtcccacactcaccaccgcaagggccccgccaagttcaggagcctcgacttcggcgagagaaatggttacctcaagggtgtcgtcacggagatcatccacgatccgggtcgcggtgctccgttacaagaagcagaaggagctcttcgtcgccgccgaaggtatgtacaccggncagttcttgtactgcggtaagaaggcgacnctcgtngtcggaaatgttctgcctctcagatctatncccgagggagctgttgtctgcaacgtcgagcaccatgtcggtgatcgtggtgtgctcgctagagcttctggagattacgctatcgttatttcacacaaccctgacaacgacacgacaagggttaagttgccatctggatcgaagaagattgtcccaagtggatgcagggccatgattggtcaagttgctggtggtggaagaactgagaagccgatgctcaaggccggtaacgcgtaccacaagtaccgtgtgaagaggaactgctggcctaaggttcgtggtgtggctatgaaccctgttgagcatcctcacggaggaggtaaccatcaacatatcggtcacgccagtactgttcgtcgtgatgcaccaccagggcaaaaggttggtcttattgctgcaaggagaactggtcgtctcagaggtcaagctgctgctcttgcctccaagcaagaataaggaggggaagcttcatgatgatgaaactgtttacttttgttggatttttgctgagaccttgttttgaatgctttagattttctataatcttctttgagacctttttcttcaggatcaaacctccacattatcattttaaatttcaggattcagttttgatt

SEQ ID NO: 3564 - DNA, 985 bp, Eutrema parvulum
ataacttgtgcagagggcaagaagaagaagaacttctgtgtggtcgtaatgggttgtgtgattagggctcaacgtaagggtgctgctggttccgtcttcaagtcccatactcaccaccgcaagggcccagctaagttccgtagccttgattacggcgagagaaatgggtatcttaagggtgttgtgacggagatcatccacgatccgggacgtggtgctccgttagctcgtgtcagtttccgccatcctttccgttacaagaagcagaaggagctgttcgtcgcggccgaaggtatgtacacgggacaatccctctactgtggtaagaaggcgaacctcgttgtagggaacgtacttccgcttagatcaattcccgagggagctgtcgtctgcaacgtcgaactccatgtcggtgatcgtggagccctcgctagggcttccggtgattacgccatcgttattgctcacaatcctgacaacgacaccactaggattaagcttccgtctgggtcgaagaagattgtgcaaagcggatgcagagccatgatagggcaagttgcaggtggaggaagaacagagaagccacttctcaaggcaggtaacgcgtaccacaagtatcgtgtgaagagaaactgctggcctaaggttcgtggtgtggctatgaacccagtcgagcatcctcatggaggaggaaaccaccagcacattggtcacgctagtacggtcagacgcgataaacctgctggtgcgaaggttggtctaattgctgcgagaagaacgggtcgtctcagaggtcaagctgccgcatcagcatccaaggcagattaaacttgactgtgacacacgttttttactgtagaattaaaagactcatcgttgcctctttacttgaatatacatatacttgctgttgaaagcttatgagctttgtactgaatctacccttaaagggtacagttttgagtgatatatttattaatatttt

SEQ ID NO: 3565 - DNA, 1162 bp, Sciadopitys verticillata
ggagcgggttctgtgttcaaatcccacacccaccacaggaagggacctgcgcgcttcagaagtttagattacggcgaaagaaatggatatctcaaaggtattgttaaggaagttattcatgaccctggacgcggcgctcctctctgcagggtagccttcaggcatcccttccgttacaggatacagaaggagctcttcattgctgccgagggtatgtatactggtcagtttgtttactgtggaaaaaaggctaatctgaccgtgggaaatgtcttgcctctgagatcgattccggagggagctgttgtctgcaacgtggagcagcacgtcggtgatcgtgggtctttcgctagggcttctggggattatgctattgttatcagtcacaatcctgataatgacactaccagggtaaagcttccatctggtgctaagaagatcgttccaagtagttgcagagctatgattggtcaggttgcaggtggtggaagaacagaaaagccaatgctcaaagctggcaatgcctatcacaaatatagggtgaaaagaaactgttggcccaaggttcgtggtgtggcaatgaacccagtggaacatcctcatggtggtggtaaccatcaacacattggacatgccagtactgttcgtcgtgatgcacctccagggcaaaaagttggtcttattgctgctagaagaactggtcgtttgcgtggacaggctgcaacggccgctgcaaagacagataaggcttagggtgtttggccacttaagcactacaggtagtttacacaaacaattacagagctctggaaatgcaaaagtgcggattgaaattttgtttttttctcttcaggttgctttgtggcaaaaatctatcaggaccaggttgtaatccaagtttgtttttattgtttttatcctttacccgtgactcagaattaaggtttaagataataccattttagaaaatcgttgcaagtttactactgtagccggaggcttatttctggctgttatatgaattggatttgttatttccagccttttttgttagtgttataattaataacctatttctgtcatccttattgtaagctgttacatcacttgaatttcttatcttcaagcttatagggaaaagtaattaggatgtgacttcaat

SEQ ID NO: 3566 - DNA, 833 bp, Phaseolus coccineus
aaacacaaaacggcgtcgcgtccgctatatattagcagcaaagccgaaaccctagcttccgatctatccttcttccatccacgcggcgcgcacaaacacacaggtatatccgaatgggaagggtaattcgcgcacagcgtaagggtggaggctccgttttcaagtcccacacccaccaccgcaagggaccggcgaggttccgcagcctcgatttcggcgaacgcaatggctacctgaagggagtggtcaccgacattatccacgaccccggtcgcggtgcccctctcgccaaggtcactttccgccatcccttccgctacaagaagcagacggaactcttcgtttctgccgaaggtctatatactgggcagttcctctactgcggcaagaaggccactctcgtggttggcaacgtcttgcccctccgatccatccccgagggtgctgtcatctgcaatgtcgaacaccacgttggtgatcgcggtgtcttcgccagagcatccggtgactacgccattgttatcagccacaaccccgataatgacacctctaggatcaagcttccttctggttcaaagaagattgtgccgagtgcatgtagggcaatgattgggcaagttgcaggtggagggagaactgagaagcctcttcttaaggctggtaatgcttaccacaagtttagagtgaagagaaactgctggcctaaggtgcgtggtgtggctatgaacccagttgagcatcctcatggaggaggtaaccaccagcacattgggcatgctagtactgtcaggcgtgatgctcctcctggccagaaggttggtctcattgctgcc

SEQ ID NO: 3567 - DNA, 731 bp, Euphorbia peplus
  misc_feature (706)..(708): n is a, c, g, or t
gccggctccgttttcagatcccacactcaccaccgcaaaggccccgcccaattccgttccctcgacttcggcgagcgtaatggatacctcaagggagtgattaccgagatcatccacgatccgggtcgtggagctccgttagcccgtgttaccttccgtcatccgttccgttacaagcaccagaaggagcttttcatcgcggctgaagggatgtatactggacagttcgtgtattgtggaaagaaggctaatttgatggttgggaatgttttgccattgagatctattcctgaaggagctgtggtttgtaatgttgaacatcatgttggtgatagaggctcttttgctagatgctctggtgattatgctatcgttgttagtcacaatcctgataatggaactagcagaatcaagcttccttctggagccaagaagattgttccaagtggatgcagagctatggttggacaagtagctggtggaggaagaaccgagaaacctatgttgaaggccggaaacgcgtatcacaaatacagagtaaagagaaactgctggcccaaggttagaggtgtggctatgaatccagtggagcatccccatggaggaggtaaccaccagcatattggtcatgccagtactgttcgtcgtgatgctcctcccggtcaaaaggttggtcttattgctgctaggaggactggtcgtcttnnnggacaagctgctgctactgctgc

SEQ ID NO: 3568 - DNA, 732 bp, Gerbera hybrid cultivar
aatgggtcgtgtcatcagagctcagcgtaagggagcaggctccgtcttcaagtcccacacgcaccaccgcaaaggtccggcgaggttccggagcctcgatttcggcgaacgcaatggttacctaaaaggtgttatcaccgaaatcattcacgatcccggacgtggtgcgcctcttgctcgcgtcactttccgtcatccgttccggtacaagcaccagaaggagcttttcgtcgccgccgaggggatgtacaccggtcagtttgtgttctgtggaaagaaggcgaatttgatggtcggaaacgtgcttcctctcagatctattccagaaggagctgttgtgtgcaacgtcgagcaccatgtcggtgatcgtggttcttttgctagggcttctggtgattatgctattgttatcagccacaatcccgataatggcaccactagagtcaagcttccatccggagccaagaaaatcgtgccaagcgggtgtcgtgccatgattggccaagttgcaggcggaggccgtactgaaaaaccgcttctaaaggccgggaacgcctactacaagttccgtgtgaagcgtaactgctggcccaaggttcgcggcgtggctatgaacccagcggagcatccccatggcggcggtaaccatcaacatatcggtcacgccagtacggttcgtcgtgatgcaccacctggtcaaaaggttgggctcattgccgctaggaggactgg

SEQ ID NO: 3569 - DNA, 1447 bp, Ceratodon purpureus
aaggtggagaaggagagcaggcgcacttctctttgatccctcgcagactgcagggacagcgtcggagtgccaacagcatcatcagctaacgtaggacacagcagccatgggtcgtgtgattcgcgcccagaggaagggagcgggctccatcttcaggagtcacactcaccgccgcaagggccccgcgcagttccgctcgctggactacgccgagcgcaatggctacatcaagggggtcgtgtccgaggtcgtgcacgactccgggcggggggcgccgctgtgcaaggtgacgttccggcacccgttccggttcaaacgccagaaggagaggttcatcgctgcggagggcatgtactcggggcaattcgtgtactgcgggaagaaggcgactctgtccatcgggaatgtgctgccgctgaggtcggtgcccgagggagccgtggtgtgcaacgtggagcaccgcatgggagatcggggcgcgttcgcgcgggcgtcgggcgactacgccatcgtggtgtcgcacaacgtggacagcgggacgacccgtatcaagttgccgtcgggggcgaagaaggtggtgccgagcgggtgcagggcgatggtggggcaggttgccggtggaggcaggaccgagaagccgatgctgaaggccggaaacgcgtaccacaagtacaaggtgaagaggaacagctggccgaaggtgagaggtgtggcgatgaaccccgtggagcatccccacggaggaggtaaccaccagcatatcggtcacgcgagtacagtgcgtcgggacgctcctcccgggcagaaggtgggtctcattgccgcccggcggacgggtcgtctgcgtggtcaagccgcgactgcagcgtcgaaggtggacaaggcttagggtcgtggcagtgatggttgtggcagttgagaaaatcagtgatggaattatcattgaggtttttcattgacgatgagaattttcgagaattaatgccaaagaagccgaattgggtcgactttcaattcctctggtttgtgatacttcgaggacgtcttttgtttctgcgtcttttacagagttcttttccttatgtattggagtagttttagctttttcataggagtggtcctgggggttctgattctgggttcttgttttgatctggtaacctttttttgggccttggttgtcgatgttgataatctggacaactaggtcatgctggacaattaggtctttctggctacattagtgagacctgagcttttagttgtgatactctgagaggtgtttgtgtggtgtcgactggttttcgaaatgttgtgtttccttttctactctttcttacttcatggtggattctggattttagggtttgaggatttgagtggacattattcacttagatcctattgtggcattgctttcgtcctgggaacgtttcagggatgtttt

SEQ ID NO: 3570 - DNA, 2139 bp, Ceratodon purpureus
ggaagcggggtttagggcaggggggcgccctcgctcatccttttcactctcgctgcctcgcaggtccagcgctcgggtcgggagggattccaccagcaagaaagcagcagcagcagcagcgatgggtcgtgtcatccgcgcccagcgtaagggagcgggctccatctttcggagccacacccaccgccgcaagggccccgcgcagttccgctcgctcgactacgccgagcgcaatggctacatcaagggcgtggtgtcggaggtggtgcacgactccggtcgtggtgcccccctctgcaaggtgacgttccgccaccccttccgattcaaacgccagaaggagcggttcatcgccgccgagggcatgtacagcgggcagttcgtgtactgcgggaagaaggcgacgctgtcgatcgggaacgtgctgccgctgaggtcagtgccggagggagccgtggtgtgcaacgtggagcaccgcatgggcgatcggggcgcgttcgcgagggcgtcgggcgactacgccatcgtggtgtcgcacaacgtggacagcgggacgacgcgtatcaagctgccgtcgggagcgaagaaggtggtgccgagcgggtgcagggcgatggtagggcaggttgcgggcggaggcaggacggagaagccgatgctgaaggccggaaacgcgtaccacaagtacaaggtgaagaggaacagctggccgaaggtgagaggtgtggcgatgaaccccgtggagcatccccacggaggaggtaaccaccagcatatcggtcacgcgagcacggtgcgtagggacgctcctcccgggcagaaggtgggtctcatcgccgccaggaggacgggtcgtctgcggggtcaagccgcgacggcagcgtcgaaggtggacaaggcgtagagaagtgggggttgggcctgtggcaccaaagcattttagcgatggtttttcatttacattttggttctatgatctcgtttgtgaagatcgtgggcaaccggaatacatggaatgcgtcattctactcactccactctactccatccgctgttgctccgcacactcagttgctttcacttaatcttgtcaatcagccatctgcttacgggtcactctggtttgtgagctttggtttgtgagctttgtgagctttgtttgtggggttgcttttgggtcgtcatggatttcgagagtgcgcgccactggctcgttgagcacaaattgcgtgccgttggttctatttgggcgacatcattgttaggctcgtttgcctataatttttcccaacctggcgtgaagacgagtgtaaagttgattcatgctaggctacatgcgcaagctttgacattagcagcactcgcagggagtgctgtggtggaatattacgatcaccaatcgggtgacaaagccaagcgttacgagaagcatatccagacttcacagaattcagacttgaaactctaagttgggagagggctctttgtgtcataaagtgactcgccagctccatgctttgggagccattccctttacttctgtatttcaacatgatctgttgcagggtactttttgtagctcgatcaaccagggagcatgtatcaacactgtagaatcatcggttacaaagtaaagttcacttagctagaatttaaggtcatctgaacttggagagtgtcttataagctcttcaaacggtgctagatgtagtctctttgcgttcgtaggattgagcattgaaacgtttgatcgctagccttctcgtgtcaggattggccgaggttttgttattctttcattcatgaacagtgctaagtacatacacgataaaagcagtgcacactcttcaggttaccatggttttgagatgggtaggctagacttgaaggaataaataccatggctatctgtctatgccttttctttgtgcgcttatctttggtcatgacaatctgttgctctttttcagagcatgttgtgcttcattcttgtgctgttactggctttaaccctctgtaacccactcgaccacaatctggtcgtaggggtgtctgtacagacttggattttgaaacttgaccttcagatgtgaagaatcacaacatacgttttctaaaaaaataaaatttcaattgtgc

SEQ ID NO: 3571 - DNA, 946 bp, Ceratodon purpureus
attagggcagggagggaagcgagcatcgatcttttccgattcctgcacaggctctgcaactcccagcgttgcatctgcagccatgggtcgtgtgattcgcgcccagaggaagggagcgggctccatcttcaggagtcacactcaccgccgcaagggccccgcgcagttccgctcgctggactacgccgagcgcaatggctacatcaagggggtcgtgtccgaggtcgtgcacgactccgggcggggggcgccgctgtgcaaggtgacgttccggcacccgttccggttcaaacgccagaaggagaggttcatcgctgcggagggcatgtactcggggcaattcgtgtactgcgggaagaaggcgactctgtccatcgggaatgtgctgccgctgaggtcggtgcccgagggagccgtggtgtgcaacgtggagcaccgcatgggagatcggggcgcgttcgcgcgggcgtcgggcgactacgccatcgtggtgtcgcacaacgtggacagcgggacgacccgtatcaagttgccgtcgggggcgaagaaggtggtgccgagcgggtgcagggcgatggtggggcaggttgccggtggaggcaggaccgagaagccgatgctgaaggccggaaacgcgtaccacaagtacaaggtgaagaggaacagctggccgaaggtgagaggtgtggcgatgaacccggtggagcatccccacggaggaggtaaccaccagcatatcggtcacgcgagtacagtgcgtcgggacgctcctcccgggcagaaggtgggtctcattgccgcccggcggacgggtcgtctgcgtggtcaagccgcgactgcagcgtcgaaggtggacaaggcttagggtcgtggcagtggtggttgtggcagctgagaaaattcgtgacggtcttctcattattgtttactttatgattaatacagg

SEQ ID NO: 3572 - DNA, 1207 bp, Ceratodon purpureus
gcggggtttagggcagggggggcgccctcgctcatccttttcactctcgctgcctcgcaggtccagcgctcgggtcgggagggattccaccagcaagaaagcagcagcagcagcagcgatgggtcgtgtcatccgcgcccagcgtaagggagcgggctccatctttcggagccacacccaccgccgcaagggccccgcgcagttccgctcgctcgactacgccgagcgcaatggctacatcaagggcgtggtgtcggaggtggtgcacgactccggtcgtggtgcccccctctgcaaggtgacgttccgccaccccttccgattcaaacgccagaaggagcggttcatcgccgccgagggcatgtacagcgggcagttcgtgtactgcgggaagaaggcgacgctgtcgatcgggaacgtgctgccgctgaggtcagtgccggagggagccgtggtgtgcaacgtggagcaccgcatgggcgatcggggcgcgttcgcgagggcgtcgggcgactacgccatcgtggtgtcgcacaacgtggacagcgggacgacgcgtatcaagctgccgtcgggagcgaagaaggtggtgccgagcgggtgcagggcgatggtagggcaggttgcgggcggaggcaggacggagaagccgatgctgaaggccggaaacgcgtaccacaagtacaaggtgaagaggaacagctggccgaaggtgagaggtgtggcgatgaaccccgtggagcatccccacggaggaggtaaccaccagcatatcggtcacgcgagcacggtgcgtagggacgctcctcccgggcagaaggtgggtctcatcgccgccaggaggacgggtcgtctgcggggtcaagccgcgacggcagcgtcgaaggtggacaaggcgtagagaggtggtggttgggactgtggcaccaaagcattttagagatggttttccattcatgtacgcttatcttttaacttatttagtgatgagttttttacgacaatttatgcaatcgcgtcgtgtattttctcaggtcgtttttctcttctattaattttaggtggttctcctttccggatatgtagccattttttctgtgttgttttgtgtgtttaacatttctggcttggaaattgttagcttctagtgaggttaggttgtactatgtctatttgtttatcaggtagttttttgattgggatgtga

SEQ ID NO: 3573 - DNA, 1206 bp, Adiantum capillus-veneris
aggagagggatcgagggcgggcttcggggttgctgcagaaaccctagtcgaaggtaagcttgagctttgggtctgttagcgatggggagggtcatcagaggccaaaggaagggagcaggctcgatctttagagcccacacacacaggcgcaagggccctgctcgttttagatctctagactactcagaaagtaatgggtacataaagggtgtcgtctccgacattgttcacgattctggcagaggagcacctctctgcaaggtgaccttccgccaccccttccgctttaaacaccagaatgagcgcttcattgctgcagagggtatgtactctggccagtttgtttactgtggaaagaaggcaaccctgtccattggcaatgttcttcctctcaagtcggtgccggagggcgctgtggtttgtaatgtcgaacagcgagtgggggatcgtggctcttttgctagagcttctggtgactatgtaatcgttgtcagccataatccggataacaacaccacacgtatcaagcttccctctggagccaagaagattgtgccaagtggttgccgtgcaatgattggccaagtcgcaggtggagggagaactgagaaacctatgctcaaggctggtaatgcgtatcataaatacaaggtgaaacgcaactgctggcctaaagtacgtggtgtggcaatgaaccctgttgagcatccccatggtggtggtaaccatcaacacattgggcatgccagtacggtcagacgtgatgctccacctgggcagaaggttggtcttattgctgctaggagaacgggtaggttgcgtggacaggctgctactgctgctgcaaagacagataagagtgcttgagggccattttgtaggctatttggcgtgagcagctgttttctggtggacatctgctgtctagcctgtagtcgtgaacattttagtttttggaagattaccacaagttttggacacacattttatgattgagaacgttaatttaaagctacgttatattgtctcgcctatctgaagaaaggccgaatacaaccctgacaagaattcctttcgtgcccttctctgggatttgaaggcgaacaacctccccccactttttcctgcaaaacctttgggttgttaaaaaaaaaaacctttcccttcttttttttttttgtagaaaaaaaaaagttcaaaaattcc

SEQ ID NO: 3574 - DNA, 1405 bp, Physcomitrella patens
gggtttagggcagcgagggcgcccgcgctctttccctttcgcagtcccagtgctgctgcgagtgtgcgtgctctcgctttgctgctccacaaccgagctagagttgcagcgaagaagggggcttcgccacagtagccatgggtcgtgtcattcgtgctcaacgtaagggagctggctctatcttccggagccacacccaccgtcgcaaaggccccgcccagttccgctccctcgactatgctgagcgcaatggttacatcaagggtgttgtatctgaggtcgttcacgactccggccgcggtgctccgttgtgcaaggtcaccttccgtcaccctttccgcttcaaaaggcagaaggagaggtttattgctgctgagggcatgtactctggtcaattcgtttactgtggcaagaaggcgaccttgtctattggaaatgtgctgcctctgaggtctgtgcccgagggagccgtggtgtgcaatgtggagcatcgtatgggtgatcggggcgcgttcgcgagagcgtctggtgactacgctattgtggtgtcgcacaacgtggacagcggaactactcgtatcaaattgccgtcaggggcgaagaaggttgtgcccagcggatgcagggccatggttggacaggttgccggaggaggcaggaccgagaagccaatgttgaaggctggcaatgcttaccacaagtacaaggtgaagagaaacagctggccgaaggtgagaggtgtggccatgaaccctgtggagcatccccacggaggaggtaaccaccaacatattggtcacgcgagtacagtgcgtcgggacgctcctcccgggcagaaggttggtcttattgctgccaggcgcacggggcgtctgcgtggtcaagctgccaccgccgcatcgaaggtcgacaaggcttaaaagcatatctcttacgtttctatcatttgaggaaatctgtaatggtgctctcactcccgtgtaccatcttttattaatttgttcacgaagatcatccttctttcagatcatcggatgctccgctctagttggttgaagtatctttcctcacttttctttgtacttgtgacgttcaagcatgctctccggaaggaagctgtgggctatttcgaatgtatgtagcaacgaatgttgtttcttcagtttggcttgttctgaagttgggtgataggcttatgaaagatgttattaacttcaggtttttattttgatcatttccgtaaaaaaattgtttgagtattttggtttactttgctgattcgatgcagagcttatttccaatagctgtagacgctcacgttgtcgtcctttgcaaatcttcaattatgctcttatttgtgactctcagggatttttaccctgagagaactgttacacttttcgtt

SEQ ID NO: 3575 - DNA, 1063 bp, Physcomitrella patens
aattagggtttggaggctgcgtcggggtagaagtcctggctctcgaatccgactctctctttctccctagcttctgctgcagggactgtgcgtctgcggacttgctgctgctatgggtcgcgttattagggcacagagaaagggagcggggtctatctttcggagtcacacccaccggcgcaagggccctgcccagttccgctcgctcgactacgccgagcgcaatggttacatcaagggtgtggtgtcggaggtggtgcacgactccggtcgcggcgctcccctgtgcaaggttaccttccgtcaccccttccgcttcaaaagacagaaggagaggtttattgccgcggagggcatgtactccggccaattcgtgtactgcgggaagaaggccactctctcaatcgggaacgtgttgcccctgaggtccgtgcccgagggagccgtggtgtgcaacgtggagcaccgcatgggggatcggggcgcgttcgccagggcgtccggggactacgccatcgtggtgtcgcacaacgtggacagcggaaccaccagaatcaagttgccatctggagccaagaaggtggtgccgagcggttgccgagccatggtagggcaagtggccggtggaggcaggaccgagaagccgatgctgaaggctggaaacgcataccacaagtacaaggtgaagaggaacagctggccgaaggtgagaggtgtggccatgaaccccgtggagcatccccacggaggaggtaatcaccagcacatcggtcacgcgagtacggtgcgtcgggacgctcctcccggacagaaggtgggtctcattgctgccaggcgtaccggacgtctgcgtgggcaagccgcgacggcggcatcgaaggtggacaaggcctagaggaatggcggtcggagacggcgattgcccggaggcagctaggtgtagtagagaaggagaggtggtggcactcgggcgagtggcatttgagcggactggggatggttattttgtcatgtatgttcacatttggattaatagagtgatggagaccattgttcgaacgta

SEQ ID NO: 3576 - DNA, 1526 bp, Physcomitrella patens
tcctctttttcccctttatcttctgctgcagggtttgtgtgggtttgtgcgaggagctcgctgctgtgctgggatgggtcgtgttattagggcgcagaggaagggagctggctccatattccggagccacacccaccgacgcaagggccctgcccagttccggtctctggactacgccgagcgcaatggctacatcaagggcgtcgtgtctgaggtggtgcacgactccgggcgcggggctccgctttgcaaggtgacgttccgccaccccttccgcttcaaacgtcagaaggagcggttcattgccgccgagggcatgtactccgggcaattcgtgtactgcggcaagaaggccactttgtcgatcgggaacgtgctgcctttgaggtctgtgcccgagggtgccgtggtgtgcaacgtggagcaccgcatgggagatcggggcgcgttcgcgagggcgtccggtgactacgccatcgtggtgtcgcacaatgtcgacagcggaaccacccgcatcaagttgccgtcgggagccaagaaggtggtgccgagcgggtgccgagccatggtcgggcaggtcgccggcggaggcagaaccgagaagccgatgctgaaggccggaaacgcgtaccacaagtacaaggtgaagaggaacagctggcctaaggtgagaggtgtggcgatgaaccccgtggagcatccccacggaggaggtaatcaccagcacattggtcacgcgagtacggttcggcgggacgctcctcccgggcagaaggtgggtctcattgctgccaggcggacgggacgtctgcgtggtcaagccgcgacggcggcgtcgaaggtggacaaggcgtagagggatggcggtggtagggggcgagcggttgggaagtcccagcggcgatagagagggcgtggtgcgggggagagacgcgaacgagagagacgatgctgcgtatgtgatgtgtgtggacttgtggatcaatggaatggcgaaggccgatattcgagtaaattggtggtggtggtggtggtggtggatggggtgtggacatttgtgtggcccggttgcgttgatgtggcaatttggaaccggtgcagacgggaggtgagagtggaatgtgtgacgtgggagggacacatatggggtggttgtgcgagtaatggcaacggttgtggtgtggcgatgttgatggtcggttgtgggaggatgttatgatgcgtgcggttgtggagtatgtgcacggtggttggtgtgcatgatgtatgtttgcgctcttgggtatatataggtgtctttcgcgacgaatatgtcgttaggattgtcagccttgtttgttggatgatttgatggaccctgcgttgggcattttgggattggctttgcttttgttgggatgggcacgttatcggtgggcttgactttgtcaggtgatggaattggttgtgcagtcaggagttggtgctaggtttgttttttgatagagcttatttatgtatcgatatggatagagtaaactgcagga

SEQ ID NO: 3577 - DNA, 986 bp, Physcomitrella patens
tgcagggtttgtgtgggtttgtgcgaggagctcgctgctgtgctgggatgggtcgtgttattagggcgcagaggaagggagctggctccatattccggagccacacccaccgacgcaagggccctgcccagttccggtctctggactacgccgagcgcaatggctacatcaagggcgtcgtgtctgaggtggtgcacgactccgggcgcggggctccgctttgcaaggtgacgttccgccaccccttccgcttcaaacgtcagaaggagcggttcattgccgccgagggcatgtactccgggcaattcgtgtactgcggcaagaaggccactttgtcgatcgggaacgtgctgcctttgaggtctgtgcccgagggtgccgtggtgtgcaacgtggagcaccgcatgggagatcggggcgcgttcgcgagggcgtccggtgactacgccatcgtggtgtcgcacaatgtcgacagcggaaccacccgcatcaagttgccgtcgggagccaagaaggtggtgccgagcgggtgccgagccatggtcgggcaggtcgccggcggaggcagaaccgagaagccgatgctgaaggccggaaacgcgtaccacaagtacaaggtgaagaggaacagctggcctaaggtgagaggtgtggcgatgaaccccgtggagcatccccacggaggaggtaatcaccagcacattggtcacgcgagtacggttcggcgggacgctcctcccgggcagaaggtgggtctcattgctgccaggcggacgggacgtctgcgtggtcaagccgcgacggcggcgtcgaaggtggacaaggcgtagagggatggcggtggtagggggcgagcggttgggaagtcccagcggcgatagagagggcgtggtgcgggggagagacgcgaacgagagagacgatgctgcgtatgtgatgtgtgtggacttgtggatcaatggaatggcgaaggccgatattcgagt

SEQ ID NO: 3578 - DNA, 1310 bp, Physcomitrella patens
ctccaacagtcccagtgcgtatgtgtgctctcgcccgttgccccgccaccgagctagagttgcagcgaagggggcttcgctacaatagccatgggtcgtgtcattcgtgctcaacgtaagggagctggctccatcttccggagccacacccaccgtcgcaaaggccccgctcagttccgctccctcgactacgctgagcgcaatggctacatcaagggtgttgtctccgaggtcgttcacgactccggccgcggtgctccgttgtgcaaggtcaccttccgtcaccctttccgcttcaaaaggcagaaggagaggtttattgctgctgagggcatgtactctggtcaattcgtttactgtggcaagaaggcgaccttgtctattggaaatgtgctgcccctgaggtctgtgcccgagggagccgtggtgtgcaatgtggagcatcgcatgggtgatcggggtgcgttcgcgagagcgtctggtgactacgccattgtggtgtcgcacaacgtggacagcggaactactcgtatcaaattgccgtcaggtgcgaagaaggttgtgcccagcggatgcagggccatggttggacaggttgccggaggaggcaggaccgagaaaccaatgttgaaggctggaaatgcctaccataagtataaggtgaagaggaacagctggccgaaggtgagaggtgtggccatgaaccctgtggagcatcctcacggaggaggtaatcaccaacatattggtcacgcgagtacagtgcgtcgggacgctcctcccgggcagaaggttggtcttattgcagccaggcgcacgggacgtctgcgtggtcaagctgccaccgccgcatcgaaggtcgacaaggcttagaagaatctcttacgcttttgtcattcgacagtttcgttgacactcgcttatcttttagttgcaattcctggccacaaagaaaaatcatgaatgccatgagactcggttttcgattaatgcgtttacctgaaaacggctcagtgtgctagctcagtggtatgttgttgacatcccccggattttctatgctgctgctagcgtgggcttagtttgcctgtgacttgtcgtgcctgttctgatcaggtctttccttatttgcgtgtacataattgggttagggtttgttactagagtgggtacaaaagtcacggtagtcatcgtctgcctgacttttatttgttcggtggtatgtatcatattttgaagtttcatctgaacagtgtcgcctgggcaataggatgtaaagtatgtttcctgtccctttttgaagcagacac

SEQ ID NO: 3579 - DNA, 1117 bp, Physcomitrella patens
ctttctccctagcttctgctgcagggactgtgcgtctgcggacttgctgctgctatgggtcgcgttattagggcacagagaaagggagcggggtctatctttcggagtcacacccaccggcgcaagggccctgcccagttccgctcgctcgactacgccgagcgcaatggttacatcaagggtgtggtgtcggaggtggtgcacgactccggtcgcggcgctcccctgtgcaaggttaccttccgtcaccccttccgcttcaaaagacagaaggagaggtttattgccgcggagggcatgtactccggccaattcgtgtactgcgggaagaaggccactctctcaatcgggaacgtgttgcccctgaggtccgtgcccgagggagccgtggtgtgcaacgtggagcaccgcatgggggatcggggcgcgttcgccagggcgtccggggactacgccatcgtggtgtcgcacaacgtggacagcggaaccaccagaatcaagttgccatctggagccaagaaggtggtgccgagcggttgccgagccatggtagggcaagtggccggtggaggcaggaccgagaagccgatgctgaaggctggaaacgcataccacaagtacaaggtgaagaggaacagctggccgaaggtgagaggtgtggccatgaaccccgtggagcatccccacggaggaggtaatcaccagcacatcggtcacgcgagtacggtgcgtcgggacgctcctcccggacagaaggtgggtctcattgctgccaggcgtaccggacgtctgcgtgggcaagccgcgacggcggcatcgaaggtggacaaggcctagaggaatggcggtcggagacggcgattgcccggaggcagctaggtgtagtagagaaggagaggtggtggcactcgggcgagtggcatttgagcggactggggatggttattttgtcatgtatgttcacatttggattaatagagtgatggagaccattgttcgaacgtagccgatactgtggcggtggtgtcgcgtttgagaaccagtttttggtacgggtgagtgtcgctgctgttgtgcgcagtttcgggcggatcgtccttctcggcaaggggtgctt

SEQ ID NO: 3580 - DNA, 970 bp, Eutrema halophilum
atagcttgcgcagagggcaagaagaagagcgtggtcgtaatgggtcgtgtgattagggcacagcgtaaaggagcggctggttcggtcttcaagtcgcacactcaccaccgaaaaggtccggctaagttccgaagcctcgattacggagagagaaatggatatctaaagggtgttgtgacggagatcgtccacgatccaggacgtggagctccgttagctcgcgtcgacttccgtcatcctttccgttacatgaagcagaaggaactcttcgtcgccgccgaaggtatgtacaccggacaattcctctactgtggtaagaaggcgaatctcgttgtcgggaacgttcttcctcttagatctgttcccgagggagctgttgtctgcaacgtcgagctcaaggtcggtgaccgtggagctctcgctagggcttccggtgattacgcaatcgtcgtttctcacaatcctgacaacgacaccactaggattaagctgccttctggatcgaagaagatagtgcagagtgggtgcagagccatgatagggcaagttgcaggtggaggaagaacagagaagccacttctcaaggcaggaaacgcataccacaagtaccgagtgaagagaaactgctggcctaaggttcgtggtgtggctatgaatccagttgagcatcctcacggaggaggaaaccaccagcacattggtcacgccagtacggtcaggcgagatagttctgctggtcaaaaagttggtcaaattgctgcaagaagaactggtcgtctccgaggtcaagctgccgcagcagcagccaaggcaggctagactttgacacactcttctctgctttctttggattttgttttgctggttttttttttttttcttaattacacccttgagatcagtttttgttttgttttgaaagcttatgagctttgtacccttagaagttagagttataatttatttatta

SEQ ID NO: 3581 - DNA, 730 bp, Brassica juncea
ttccaccatgggtcgtgtcatcagagctcaacgtaagggagctggttccgtcttcaagtcccacactcaccaccgcaagggtcccgccaagttcaggagcctcgacttcggcgagagaaacggttacctcaagggtgttgtcacggagatcatccacgatccaggtcgtggtgctccgttagctcgcgtcgccttccgtcatcctttccgttacaagaagcagaaggagctcttcgtcgccgccgagggtatgtacaccggacagttcttgtactgcggtaagaaagccactctcgttgtcggaaaatgttttgcctctcagatctatccctgaaggagctgttgtctgcaatgttgagcatcatgtcggtgatcgtggtgtcttcgctagagcttctggtgattacgctatcgttatcgctcacaatcccgacaacgacacaacaagggttaagttgccatctggttcgaagaagattgttccaagtggttgcagggctatgattggacaagttgctggtggtggaaggacagagaagccgatgctcaaggcgggtaacgcgtaccacaagtaccgtgtgaagagaaactgctggcctaaggttcgtggtgtggctatgaatccagttgagcatcctcacggaggaggtaaccatcagcatattggtcacgctagtactgttcgccgtgatgcaccccctgggcaaaaggttggtcttattgctgcaag

SEQ ID NO: 3582 - DNA, 1013 bp, Pteridium aquilinum
aggtggggtggagtggtcgtcgctgaaaccctaactctgtgtaagctcgggcttcgcttctaaccgcaatggggagggttatcagagggcaaaggaagggagcgggttccatctttacagcccacacacacaggcgcaaggggccagctcgctttagatccttggattactcggagaggaatggctacatcaagggtgtcgtctccgacattgtgcacgattccggcagaggagcccccctctgcaaggtgacattccgtcatcctttccgcttcaaacatcagaaggagaggttcatcgctgcagagggcatgtattccggccagtttgtgtactgtgggaagaaggcatccctctccattggtaatgttctgcctctcaaatctgttcctgaaggtgctgttgtgtgtaacgtcgagcagcgcatgggggaccgtggctcttttgcccgagcttctggcgactatgtcatcgttgtcagccacaacccggacaacaacaccacccgcatcaaattgccttctggtgcaaagaaagttgtccctagtggctgccgtgctatgattggtcaggttgctggtggaggcagaacagagaagccaatgctgaaggctggtaacgcatatcacaaatacaaggtgaaaagaaactgctggcctaaagtacgtggtgtggctatgaaccctgtggagcatccccatggtggtggtaatcatcaacacattgggcatgccagtactgtcaggcgtgatgctcctcctgggcaaaaggttggtctcattgctgctaggaggactggtagactgcgtggacaagctgcaactgctgctgccaagacagataaaagtgcttgaggggctgatctttaggctggatacttttagtggatggagctgcagtttctgggtggcagtttttcaattaactgcatatctagtcttgttctagttttggagtttttagtggctggaagtgtaccacaaattttggacatggatgtcaatttgagtact

SEQ ID NO: 3583 - DNA, 738 bp, Raphanus sativus
  misc_feature (339)..(339): n is a, c, g, or t
  misc_feature (375)..(375): n is a, c, g, or t
  misc_feature (429)..(429): n is a, c, g, or t
  misc_feature (519)..(519): n is a, c, g, or t
  misc_feature (522)..(522): n is a, c, g, or t
  misc_feature (549)..(549): n is a, c, g, or t
  misc_feature (587)..(587): n is a, c, g, or t
  misc_feature (643)..(643): n is a, c, g, or t
caacgtaagggagcaggctccgtcttcaaatcccacactcaccaccgcaaaggccccgccaagttcctcagcctcgactacggcgagagaaacggttacctcaagggcgtcgtgacggagatcattcacgatcccggccgtggcgcgccgcttgctcgcgtcgccttccgtcatcccttccgttacaagaagcagaaagagcttttcgtcgccgctgagggcatgtacaccggacagttcttgtactgcggcaagaaagccactctcgttgtcggaaatgttatcccgcttagggctatccccgaaggagctgtcgtctgtaacgtcgagcatcatgtnggtgatcgtggtgtgctcgctagagcttctggtgantacgctatcgtgattgcacacaaccctgacaacgatactactaggatcaagttnccgtctggttcgaagaagattgttccgagtggatgcagggccatgattggtcaagtagctggtggtggaagaacggagaagccgatgctnaangcgggaaacgcgtaccacaagtaccgngtgaagagaaactcgtggcctaagttcgtggtgtggcnatgaatccagtggagcatcctcatggaggagtaaccatcagcacattggtcacgcnagtacggttaggcgtgatgcaccaccagggcagaaggttggtcttattgctgctaggaggactggtcgtctcagaggtcaagctgctgcttctgc

SEQ ID NO: 3584 - DNA, 814 bp, Cannabis sativa
ctaaccctaatttttgagccaaaaaatgggacgagtgattagggcacaacgtaagggtgcggcgggctcggtgttcaagtcccacacgcaccaccgcaagggtccagctaaatttagatccctagactttggtgagcgcaacggttacctgaaaggggtggtgaatgacatcatccacgacccgggacgtggggccccgttggctcgtgtgacatttcgccacccctttcggtacaagcaccaaaaggagcttttcatagctgcagaagggttgtatagtggacaattcatctattgtggtaagaaagcaaatcttgtggttggtaatgtacttcctctaatgtctcttcctgaaggaactgtcgtttgtaatgtcgaacgacatgtcggtgatcgtggcgctcttgctagggcttctggtgattatgctgtcgttatttctcataaccctgataatggcactaccagagttaagcttccatctggtgccaagaaggttttgccaagtggatgccgggctatgatcggtcaagttgcgggtggaggaaggaccgagaagccgttgttaaaggcgggaaatgcataccacaagtacaaagccaagaggaattcttggccgattgttcggggtgttgctatgaatccagtagagcatcctcatggtggcggtaaccaccagcatattggtcatgctagtaccgtcgccagagatgctgtaccgggtcaaaaggttggtctaactgcggccagaaggactggccgccttagaggaacagatgcagcaacttccaaaggcgacaattaaatttgagaa

SEQ ID NO: 3585 - DNA, 1342 bp, Pinus taeda
atgtcaaattaaggtggggttatgttaattattgtaaattcacacaatacaaaattagggtttatggggtttgagtaaatgttccacccacattagggttagggtttatacccaactagggtttgtaggggattcgcaccttgacgaaaccccttagccatatctgttacttccattttcggaggcgcaacagatccaaactctttgtgtagtgatctgctctggtctgcagacatgggtcgcgttattcgtgcacagagaaagggagcaggctccgtgttcaaatcccacacccatcacaggaagggacctgcacgtttcagaagcctcgactatggcgagcgcaatggctacattaggggaattatcacggacgttatacacgaccctggccgcggcgctcccctctgcaaggtgaccttcaggcacccattccgttacaagcatcagaaggagctcttcgtagcggccgaaggtatgtactcgggacagttcgtttactgcggaaagaaggccaatttgactgtgggtaacgtgttgcggagggagccattgtctgcaacgtggaacagaatgtcggcgatcggggttcgtttgctagggcttctggagactacgccatcgtcgtcagccacaatatcgataacggcactaccagggtgaagcttccctctggagctaagaagattgtgccaagtggttgtagagctatgattggtcaagttgctggaggtggaagaacagaaaaaccaatgctcaaggctggcaatgcataccacaagtacagggtcaaaagaaactgttggcccaaggttcgtggtgtggctatgaatccagttgagcatcctcatggtggtggtaaccatcaacatgtacgtcgtgatgcaccaccagggcaaaaagttgggcttattgctgccagaagaactggtcgtctgcgtggacaagctgcatcagcagcttcaaagatggacaactaatcttagttcatttctatttgcaaggatttcattatcttattttggtgttttattttgaaggattttgatccttttttttattcaggtagtagaagcaaattgttacagaggccaggaaacctataactgcataccgacatttttgttgtttatttaactttttatgttgcaacgatatatgtcaaccaagtaataatctcagctttcttttacatgattgtttattggtgagcagcttgctcacacaactgtatgattttttagacttgcaataattatacgatatatgatagtttaccacaaaacttattaatatattttaccacaaaacttgttaatatatcagttgtaattgttattgt

SEQ ID NO: 3586 - DNA, 853 bp, Thalictrum flavum
catcgcaaaggccctgctcgatttcgcagtcttgatttcggtgaaagaaatggttatttgaaaggagtggtaactgacatcattcatgatccaggtcgtggtgcaccattagctaaagtaacatttcgacatccatttaggtataagcatcagaagaattgttgttgctgctgaagggatgtatactggtcagtttgtttattgtggaaagaaagctaatttaatggttgggaatgttttacctttgagatctattcctgaaggagctgttgtttgtaatgttgaacatcatgttggtgatcgtggtgttttggctagagcttctggtgattatgctattgttatcagtcataatcctgataatggaactagcaggattaagcttccatctggagcaaagaagattgtgcccagtggatgtcgtgccatgattggtcaggttgctggtggaggcaggactgagaagccgatgcttaaagctggaaatgcctatcacaaattcagagtcaagaggaactgctggcccaaggtacgtggtgtggctatgaatcctgtggagcatccccatggtggtggtaatcaccagcacattgggcatgcaagtactgttcgtcgtgatgcacctccaggacagaaagttggtctcattgctgctagaaggactggtaggctccgaggtcaagctgcagccaatcttgccaaggagaaggcatagacatttagtaactgatcttttctttatatttctatatgttctgtgtcagacagttgttattgacatttgttagtggcattagaagagtattttgcaaagttttgtttgaagaggatcataattttggtttgttggcta

SEQ ID NO: 3587 - DNA, 862 bp, Brassica juncea
caagtcccacactcaccaccgcaagggccccgccaagttcaggagcctcgacttcggcgagagaaatggttacctcaagggtgtcgtcaccgagatcatccacgacccgggacgtggtgctccgttagctcgcgtctccttccgtcatcctttccgttacaagaagcagaaggagctcttcgtcgccgccgagggtatgtacaccggacagttcttgtactgcggtaagaaggccactctcgttgtcggaaatgttctgcctctcagatctatccctgaaggagctgttgtctgcaatgttgagcaccatgtcggtgatcgtggtgtgctcgctagagcttctggggattatgctatcgtcatttctcacaaccctgacaacgacacgaccagggttaagttgccatctggatcgaagaagattgtcccaagtggatgcagggctatgattggtcaagttgctggaggtggaaggacagagaagccaatgctcaaggctggtaacgcgtaccacaagtaccgtgtgaagagaaactgctggcctaaggttcgtggtgtggctatgaatccagtggagcatcctcacggaggaggtaaccatcaacatattggtcacgccagtactgttcgtcgtgatgcaccccctgggcaaaaggttggtcttattgctgcaaggagaactggtcgtctcagaggtcaagctgctgctcttgcttccaagcaagaataaggagacgagtcttgaagatgaaattgttcacttttgttttttgttttttgctgagaccttgttttgaaaccttaagatctgctataatgttatttgagacctttctctatcaagtggaattcatgttttcca

SEQ ID NO: 3588 - DNA, 1166 bp, Gnetum gnemon
gttttgttacaagtgaccgactcgttagggtttaagtcgcatacaatagcccagggggttagggtttaagtcgcattcaacaacccagggtttgctctttacgggaggaggagtagttgcagaggcggaggaagaaggagaagcagaagcagaggaagcagtgatgggtcgtgtaatccgggcgcaaaggaagggagcaggctctgttttcaggtcgcacacgcatcatcgcaaaggtgcagctaagttcagggtactggactacagcgagcgtaatggctacatcaagggcgtcatcggcaaaatcatccacgatccagggcgaggtgcgccgctggcacaggtgacgttcaggcatcccttcaagtttcgtctgcagaaggagaatttcgtggccgccgaaggcatgtacacgggccagttcgtcttctgcggaaggaaggccactctcatggtcggaaacgtgctcccgctcagggaaatccccgagggtgctgtcatctgcaatgttgagcagaaccccggcgaccgcggctcctttgcccgcgcctccggtgactacgccatcgttgtctcccacaatcctgacaacaataccaccagaattaagttgccatcaggagcaaagaagcaagtatccagtgcttgcagggccatggtcgggcaagttgctgggggtggtagaactgaaaagccaatgctgaaggctggaaatgcataccacaagtacagagtgaagaggaactgctggcctaaggtacgtggtgtggcaatgaacccagttgagcatcctcacggaggaggtaaccaccagcacattggacatgcatccactgtacgcagggatgctccacccggccagaaagtcggtcttattgctgcaagaagaactggtcgtttgcgtggacaagctgcctcagctgctgcaaagacagagaaatctgcctaattgcatcggtgatttcagcagcattacaatttgttgttgttttgtttgttttccggaattttgaggttacattgcagaacagttttataatctttaggagtctttggttatgtctcttcagtcaattgggacgttttggtatgttatgtttaatgtgacggcaaaaggagattaatttaatattggagcgcattagacactttcagatttggatatt

SEQ ID NO: 3589 - DNA, 841 bp, Utricularia gibba
ggtcctgtccgccatgggtcgcgtcatccgagcacagcgaaagggagcgggctccatcttcgtgtcgcacacgcacaagaggaagggcgcggctcgtttccggtcgctggacttctcagagaggaatgggtacatcaagggcgttgtgacggagatcatccacgaccctggacgtggcgctcccctcgccaaggtcactttccgccatccgttccactacaagcaccagaatgagctcttcattgccgctgagggagtgtacaccggacagttcctctactgtggaaagaaggccaacctgaccatcgggaacgttctgcctctgcgatccatgcctgaaggaacagtcatctgcaacgtggagcagaaccttggggacaggggttcttttgcaagggcttctggagactacgccattattgttagtcataacttggacaatggtaccactcgcattaagcttccttccggttccaagaagattgttccaagtggctgccgtgccatggttggccaggttgccggcggtggtagaactgagaagcctatgttgaaggctggaaatgcttaccacaagtacagagtgaagaggaactcatggcccaaggtgagaggtgtggccatgaaccccgtggaacatcctcacggaggaggaaatcaccagcatattggacacgcatccactgtgcgcagagatgctccagctggacagaaggtgggtcttattgctgccagaagaacaggaaggctgcgtggacaagctgctggatccctaaagctagagaaaggagcttagatctgattctggtgtatgctttctgcttgttaccacaagagttcg

SEQ ID NO: 3590 - DNA, 912 bp, Helianthus annuus
aacaatcaacaatgggacgtgttatcagagcacaacgtaagggagcaggctccgtcttcaaatcccacacacaccaccgcaaaggcccagccagattccggagcctcgacttcggcgaacgcaacggttacctcaaaggagtcatcaccgagatcatccacgatccaggccgcggtgcgccgcttgctcgcgtcaccttccgtcatccgttccgttacaagcaccagaaggagctcttcgttgccgccgaggggatgtacaccggtcagtttgtgttttgtggtaaaaaagctaatctgatggtcggaaatgtcctgccgcttagatctattccggaaggagctgtggtttgtaatgtggaacatcatgttggggatagaggttcctttgctagggcttccggggattatgctattgttattagtcataatccggataacggtacaaccagggtcaagcttccatccggagccaagaaaattgtgccgagcggatgccgagccatgattggtcaggttgccggaggtggtagaaccgagaagccgatgcttaaagctggtaatgcttatcacaagttccgcgtgaagagaaactgctggcccaaggttcgtggtgttgctatgaatccagttgagcatccccatggtggtggtaaccatcaacatattggtcatgcaagtacagtccgtcgtgatgcaccacctggtcaaaaggtcggtcttattgccgctaggaggactggtcgtctcagagggcaagctgctgctactgccgccaggctgataagtagagcacttgaatggattttggtatcaggtttgaaatttttacttatctgtttgttttgtttgaatttggacttttgagggttaatctacaatacttgatacaatgttattgtcgttttgctta

SEQ ID NO: 3591 - DNA, 995 bp, Jatropha curcas
attccgcttccaaaccctaaaggccaagatgggacgtgtaatccgtgcacagcgtaagggagcaggctccgtcttcaagttcccacacccaccaccgtaaaggccctgctcgattccgctctctcgattttggagagcgaaatggttacctaaagggagtcattactgagattattcacgatcctggtcgcggcgcgccactagctagggtcacttttcgccatccatttcgctacaagcaccagaaggagctcttcgttgctgctgaagatgtatctgtcagtttgtactgtgaagaagctaattgatgtggaatgtttgccatgagatctattcagaagagctgttgtatgtctgtgagcatcatgtagtgataggggtgtgtttgctagatgttctggtgattatgctattgtgattagtcataaccctgataatgggactaccagaatcaagcttccttctggtgctaagaagattgtgcccagtggttgccgtgcaatggttggtcaagttgcaggcggtggaaggactgagaaacccatgttaaaggcaggaaatgcatatcacaaatacagagtcaagaggaactgctggcctaaggttcgtggtgttgctatgaatcctgtagagcatccccatggtggaggtaaccaccaacacattggacatgctagtactgttcgccgcgatgctcctcctggccaaaaggttggtctcattgctgcaaggaggactggtcgtctcagaggacaagctgcagcaacagctgccaaagcagacaagggtgcttaaggagccttgttttctagaactccatgtcttgtttttatcttcttctggacaaattgtctgttgtggtatcaatgagtttttgttttttatgtttaggatttgtgttcgtagttgggatatcgaatgccttatttttgatacgctatctttttgtattgcatgattttgttagaattctacttatattttgtttgcatttc

SEQ ID NO: 3592 - DNA, 952 bp, Secale cereale
gggccgcgtgatcagggcgcagcgcaagggcgcgggctcggtgttcaagtcgcacacgcaccaccgccagggcccggcgcggttccgggcgctggactacggcgagcggaacgggtacctcaagggcgtggtgacggacatcgtgcacgaccccggccgcggcgcgccgctggcccgcgtcgacttccgcgacccgtccgctacaagcaccgcaaggagctcttcgtcgccgccgagggcatgtacacgggccagcccgtctactgcggccgccgcgccgtcgtcgccatcggcaacgtgctcccgctcgcgtccctccccgagggcgccgtcgtctgcaacgtcgagcagcacgtcggcgaccgcggcgcgctcgcccgcgcctcgggcgactacgccatcgtcatcagccacaactccgacaacggcaccaccaggatcaagctgccgtcgggggcgaagaaggtggtgcagagcgggtgcagagcgatggtggggcaggtggccggcggcgggaggacggagaagccgctgctcaaggccggcagggcgtaccacaagttcagggtgaagaggaacagctggcccaaggtgcgcggcgtcgccatgaaccccgtcgaccacccgcacggaggaggcaaccaccagcacatcgggcacgcgtccacggtccgccgcgacgcgcctcccgggcagaaggttggacagatcggggcgcggaggaccggcaggctcaggggacaggccgccgtcaacgcatccaaggacagcagggcttagttcaattagagatcttcatacgtgtgtcatcatcgatcatattatgctaggttattacttagatttcgggactattatatatgtcatgctttccattgtggttgtggtactttttgtctttggttgaattgtgtatgggaagttctatatatatactcttaaattaggctga

SEQ ID NO: 3593 - DNA, 764 bp, Brassica juncea
caagtcccacactcaccaccgcaagggccccgccaagttcaggagcctcgacttcggcgagagaaatggttacctcaagggtgtcgtcaccgagatcatccacgacccgggacgtggtgctccgttagctcgcgtctccttccgtcatcctttccgttacaagaagcagaaggagctcttcgtcgccgccgagggtatgtacaccggacagttcttgtactgcggtaagaaggccactctcgttgtcggaaatgttctgcctctcagatctatccccgagggagctgttgtctgcaacgtcgagcaccatgttggtgatcgtggtgtgctcgctagggcttctggtgattacgctattgttatctctcacaaccctgacaacgacacgaccagggttaagttgccatctggttcgaagaagattgtcccaagtggttgcagggccatgattggtcaagttgctggtggtggaaggactgagaagccgatgctcaaggcgggtaacgcgtaccacaagtaccgtgtgaagaggaactgctggcctaaggttcgtggtgtggctatgaaccctgttgagcatcctcacggaggaggtaaccatcagcatattggtcgcgccagtactgttcgtcgtgatgcaccccctgggcagaaggttggtcttattgctgcaaggagaactggtcgtctcagaggtcaagctgctgctcttgcttccaagcaagaataaggagagaaagcgtcaagatgatgaaattgttcac

SEQ ID NO: 3594 - DNA, 710 bp, Cirsium arvense
aagtcccacactcaccaccgcaagggtccggcgaggttcagaagcctcgatttcggcgagcgcaatggatacctcaaaggagtcatcaccgagatcatccacgatcccggccgtggtgctcccctcgctcgcgtcactttccggcatccgttccggtacaagcaccagaaggagctcttcgtcgccgccgaaggcatgtacaccggccagtttgtgttttgcggtaagaaggctaacctcatggtcggaaacgtgcttcctctcagatctattcctgaaggagctgttgtttgcaacgtcgagcatcacgtcggtgatagaggctcgttcgctagggcttctggtgattacgccattgttatcagtcacaatcctgataacggaaccactagggtcaagctcccatccggtgccaagaaaatcgtgccaagtgggtgtagggccatgattgggcaggttgccggtggtggacgtaccgagaagccaatgctgaaggctggtaacgcgtatcacaagttccgtgtgaagaggaactgctggcctaaggttcgtggtgtggctatgaatcccgttgagcatccccatggtggtggtaaccatcaacatatcggtcacgcaagtaccgtccgtcgtgacgcaccacccggtcaaaaggttggtcttattgctgcaagaaggactggtcggctcagaggtcaagctgccgctac

SEQ ID NO: 3595 - DNA, 808 bp, Cannabis sativa
ctaaccctaatttttgagccaaaaaatgggacgagtgattagggcacaacgtaagggtgcggcgggctcggtgttcaagtcccacacgcaccaccgcaagggtccagctaaatttagatccctagactttggtgagcgcaacggttacctgaaaggggtggtgaatgacatcatccacgacccgggacgtggggccccgttggctcgtgtgacatttcgccacccctttcggtacaagcaccaaaaggagcttttcatagctgcagaagggttgtatagtggacaattcatctattgtggtaagaaagcaaatcttgtggttggtaatgtacttcctctgatgtctcttcctgaagggactgtcgtttgtaatgtcgaacgacatgtcggtgaccgtggcgctcttgctagggcttctggtgattatgctgtcgttatttctcataatcctgatatatatagagttaagcttccatctggtgccaagaaggttttgccaagtggatgccgggctatgatcggtcaagttgcgggtggaggaaggaccgagaagccgttgttgaaggcgggaaatgcataccacaagtacaaagccaagaggaattcttggccgattgttcggggtgttgctatgaatccagtagagcatcctcatggtggcggtaaccaccagcatattggtcatgctagtaccgtcgccagagatgctgtaccgggtcaaaaggttggtctaactgcggccagaaggactggccgccttagaggaacagatgcagcaacttccaaaggcgacaattaaataatttga

SEQ ID NO: 3596 - DNA, 896 bp, Elaeis guineensis
ctcccacacccgaccgaccggaagggccggcccgcttccggagcctcgactacggggagcgcaatggctatctcaagggcgtggtgaccgacatcatccacgaccccgggcgcggcgccccgctggcccgcgtcaccttccgccaccccttccgctacaagaagcagaaggagctcttcgtcgccgccgagggcatgtacacgggccagttcgtctactgcggccgcaaggcctccctcatggttggcaacgtcctgcccctccgctccatccctgagggtgccgtcgtctgcaacatcgagcaccacgttggtgaccgtggcgtcctcgcccgcgcctccggtgactacgccatcgtcatcagccacaaccccgacaacggcaccaccaggatcaagcttccctctggtgctaagaaggttgttcccagtggctgtcgagcaatgattgggcaggtagctggtggcggtagaaccgagaagcccttgctcaaggctggcaatgcctaccacaagttccgtgtgaagcgaaactgctggccaaaggttcgtggtgtggccatgaaccctgtggagcatccccatggaggaggaaaccaccagcatattggtcatgcatcaactgttcggcgcgatgcccctccaggacagaaggtgggtcttattgctgcaaggaggacaggtcggctcagggggcaggctgcagccacagcttccaaagcagataagagctcttaggttacaaacccactttcctattgcttgttatatgtttggtttcctcgggtctctagatacgctgaagacttcatctagcagttttctcatagtttattgagtcatgtgataaaattatgaagaccttgtttatgtaattacggacatatctgggtttgg

SEQ ID NO: 3597 - DNA, 810 bp, Setaria italica
tccgccgccgccgccatgggccgtgtcatccgcgcgcagcgcaagggcgcggcggggtcggtgttcaagtcgcacacccaccaccgcaagggccccgcccgcttccgctcgctcgacgtcggcgagcgccgcggctacctcaagggcctcgtcaccgacatcgtgcacgaccccggccgcggcgccccgctcgcccgcgtcaccttccgccaccccttccgctacgggcagcagaaggagctcttcctcgccgccgagggcatgtacaccggccagctcatttactgcggccgccgcgccagcctctccatcggcaacgtcctccccgtcggcacgctccccgaggggaccgtcacctgcaacgtcgagagccacgtcggcgaccgcggcgccctcgcgcgctgctccggcgactacgccatcgtcatcagccacaacacagacaacggcaccaccagggtgaagctcccgtctggcgccaagaagctggtgcagagcaactgccgcgcaatggtggggcaggtcgccggcggcggcaggaccgagaagccactgctcaaggccggcaacgcctaccacaagttccgcgtgaagaggaactgctggcccagggtgcgtggcgtggccatgaaccccgtggaccatccccacggaggaggcaaccaccagcacattggccacgcctccaccgtccgccgcgacgctccgcccggcgctaagaccggtcagatcggtgcgcggaggactggcaggcgcacgggccaagccgctgtcaccgccgggaaatctatgctatgagatggcagtaat

SEQ ID NO: 3598 - DNA, 1060 bp, Sorghum bicolor
acgccatccatccaccaacagaaggccgccgccaacaccgccatgggtcgtgttattcgagcgcagcgcaagggtgcggcggggtcggtgttcaagtcccacacccaccaccgcaagggccccgcccgcttccgcgcgctcgacgtcggcgagcgcagcgggtacctcaagggcgtggtcaccgacatcgtgcacgaccccgggcgcggcgccccgctcgcacgcgtcaccttccgccacccgttccgctacaggcagcagaaggagctgttcctcgccgccgagggcatgtacaccggccagctcatctactgcggccgccgcgccaacctctccatcggcaacgtcctccccgtcggcaccctgcccgagggaaccgtcatctgcaacgtcgagagccgcgtcggcgaccgcggcgccctcgcgcgttgctccggcgactacgccatcgtcatcagccacaacacggacaacgggacgaccagggtgaagctcccgtctggcgccaagaagttgctgcagagcaactgccgagcgatggtcgggcaggtcgccggcggcggcaggacggagaagccgttgctcaaggccggcaacgcctaccacaagttccgcgtgaagaggaactgctggcccagggtgcgcggcgtggccatgaaccccgtggaccatccgcacggaggaggcaaccaccagcacataggccacgcatccaccgtccgtcgggacgctcctcctggagcaaagtcgggccacatcgcggcacggaggactggaagacgcagagggcaagctgctgtggcagccggcaaatcaatgttatgagatctttaatctgtggcagtctgccagatatctatcagctatgttcgttagtcagttatttcgagatagagttacgtagggtaggctagggttttgttggatcgatcggattgtctgggtcccgttgtcgggtttgttgggtcagactcttcgagtgtaggtagacccatagtaaaagaaaattaagaagactcacgtttgagattatattcttatatagataataagttttgct

SEQ ID NO: 3599 - DNA, 798 bp, Hordeum vulgare
atgggccgcgtgatcagggcgcagcgcaagggcgcgggctcggtgttcaagtcgcacacgcaccaccgcaagggcccggcgcggttccgggcgctggactacggcgagcggaacgggtacctcaagggcgtggtgacggacatcgtgcacgaccccggccgcggcgcgccgctggcccgcgtcgacttccgcgaccccatccgctacaagcaccgcaaggagctcttcgtcgccgccgagggcatgtacacgggtcagtccgtctactgcggccgccgcgccgtcgtcgccatcggcaacgtgctcccgctcgcgtccctccccgagggcgccgtcgtctgcaacgtcgagcagcacgtcggcgaccgcggcgccctcgcccgcgcctcgggcgactacgccatcgtcatcagccacaacgccgacagcggcaccaccaggcaactgccatcgggggcgaagaaggtggtgcagagcgggtgcagggcgatggtggggcaggtggccggcggcgggaggacggagaagccgctgctcaaggcgggcagggccttccacaagttcagggtgaagaggaacagctggcccagggtgcgcggcgtcgccatgaaccccgtcgaccacccgcacggtggaggcaaccaccagcacatcggacacgcgtccacggtccgccgcgacgcgcctcccgggcagaaggttggacagatcggggctcggaggaccggcaggctcaggggacaggccgccgtcaacgcatccaaggacagcaggaccgcttagttcaattagagatct

SEQ ID NO: 3600 - DNA, 739 bp, Parthenium argentatum
gagaggttagagagagaaccaaccaaccaacaaacaacaatgggtcgtgtaatcagagcacaacgtaagggagcaggttccgtcttcaagtcccacacccaccaccgaaaaggtccagcacgtttccgcagcctggacttcggtgaacgcaacggttatcttaaaggggtcataacagagatcattcatgacccgggtcgtggagcaccgcttgctcgggtcacgttccgtcacccgtttaggtacaagcatcagaaggagctgtttgtggctgctgaagggatgtatactggacagtttgtgttttgtgggaagaaggctaatttaatggtggggaatgtgttgcctcttagatctattcctgaaggagctgttgtttgtaatgtggaacatcatgttggggatcgtggctcgtttgctagagcttctggtgattatgctattgttattagtcataatcctgataacggtaccactagggttaagcttccatctggagccaaaaaaattgttccgagcggatgcagagctatgattggtcaggttgcaggaggtggtagaaccgagaagccaatgctcaaagctggtaatgcttatcacaagttccgtgtgaagaggaactcctggcccaaggttcgtggtgttgctatgaatccagttgagcatccccatggtggtggtaaccatcaacatattggtcacgcaagtacggttcgtcgtgatgcaccaccgggtcaaa

SEQ ID NO: 3601 - DNA, 747 bp, Petunia hybrida
tcgaagcactgttggccagagagtaatcacaaaacaaacggcggcggagaaatgggtcgtgtaatcagagcacaacgtaagggagcagggtccgttttcaaatcccacacccatcaccgtaaaggtccagctaaattccgttcactggatttcggtgaacgtaacgggtacttaaaaggtgtgataacagaaatcatacatgacccaggtcgtggtgcaccattagcacgtgttacattccgtcacccattccgttacaagcatcagaaggagttgttcgttgctgcagaagggatgtacactggtcagtttatttactgtggtaaaaaagctaaccttatggtgggtaatgtgctggcacttagatctatcccagaaggagctgttgtttgtaacgtggaacataaagttggggaccgtggtgtttttgctaggtgttctggtgattatgctattgttatcagtcacaaccctgataatggcactactaggattaagcttccatctggagccaagaagattgttcctagtggttgtcgtgccatgattggccaagttgctggaggaggaagaactgagaagccaatgcttaaagctggtaatgcataccacaagtaccgtgttaagaggaactgctggcctaaggttcgtggtgttgctatgaatcctgtggagcatcctcatggtggtggtaaccatcacatattggtcatgccagtactgtccgtcgtgatgcaccacctgggc

SEQ ID NO: 3602 - DNA, 1039 bp, Sciadopitys verticillata
gcagtttggaaggatgggtagagtaatcagagcgcagaggaagggagctggatctgtattcagatctcacacgcaccacaggaagggacctgcgcgattcaggagcttagactattctgagcggaatggatacataaagggcatcgtctctgaggtggtgcacgaccctgggcgcggcgctcccctttgcagggtgactttcaggcatcccttccgctacaggcaccagaaagagctctttgtcgccgccgagggcatctacactggtcagttcatctactgcgggaagaaggccaacctcaccgtcgggaacgttttgcctctcagatctattcccgagggagccgttgtttgcaatgttgagcagcacgttggagatcgtggttcttttgccagggcttctggtgattacgctattgtcatcagtcacaacgttgataacgggacttccaggatcaaactaccttcgggggctaagaagatagtgccaagcagttgcagagctatgattggccaggttgctggtggtggtaggacagaaaagcccatgctcaaggcagggaacgcataccacaagtatagggtgaagagaaattgctggcctaaggttcgtggtgtggctatgaatccagttgaacatcctcatggtggtggtaaccatcaacatattggtcatgccagtactgtgcgtcgtgatgcccctccagggcagaaggttggtcttattgctgcaaggagaacaggtcgtttgcgtggacaagctgcaacagcagctgcaaagactgagaaggctcttaggcatttcactagatcattgcgagagaagagcttacatgtaggctcttttgttggacaattttggttttattgcagacaatgattttgttcatatgtagctaagattcgcggtatttataggcatacattatgaattctatgtttgttaaatgcagttttgttcaagagttataatcaatatgcttttattgtctaaaggaattgcaattagtagctaattattttgaaagaaaggtgatgt

SEQ ID NO: 3603 - DNA, 744 bp, Cajanus cajan
cccatccatctgagagagaggtaaggtaggttagcattctctgattccccagagccgcaatgggacgtgtgattcgtgcgcagcgtaagggtgcgggttccgtcttcaagtcccacacgcatcaccgcaagggcccggcgcgcttccgcagcctcgacttcggcgagcgcaacggctacctgaagggcgtggtcaccgacgtcatccacgaccctggccgcggcgcgccgctcgccaaggtcactttccgccaccctttccggtacaagaagcagaacgagcttttcgtggccgccgagggcttgtacactggtcagttcatctactgcggtaagaaggccacccttgttgttggcaacgtcttgcccctccgatccatccctgaaggtgctgtcatctgcaacgtcgagcaccatgttggtgaccgtggtgttttcgccagggcttctggtgactacgccattgttatcagccacaaccctgataatgacacctaggattaagcttccttccggggcgaagaagattgttccaagtgactgtagggctatgattgggcaagttgcaggtggtggaaggactgagaagcctcttcttaaggctggaaatgcttaccacaagtttagagtgaagaggaattgctggcccaaggtgcgtggtgttgctatgaaccctgttgagcatcctcacggaggtggtaaccaccagcatattggtcacgccagcactgtcaggcgttaggat

SEQ ID NO: 3604 - DNA, 940 bp, Picea glauca
tcacaggaagggaccctgcacggttcagaagcctcgactacggtgagcgcaatggctacatcaggggaatcgtaacggatgtcatacacgaccccggccgtcggcgctcccctctgcaaggtgaccttcaggcatgcatttcgttacaggcatcagaaggagctcttcgtagcggccgagggtatgtacacgggccagtttgtttactgcggaaagaaggccaatttgactgtgggtaacgtgttgcccttgaggtctattccggagggagccgttgtctgcaacgtggagcagcatgtcggcgtatcggggttcgtttgctagggcttctggggactacgccatcgtcgtcagccacaatcctgataacggcactaccagggtgaagcttccctctggagccaagaaaatagtgccaagcagttgcagagctatgattggtcaggttgctggtggtggaaggactgaaaagcccatgctcaaggctgggaatgcataccataaatacagagtcaagagaaattgctggcccaaggttcgtggtgttgctatgaacccagttgaacatcctcatggtggtggtaaccatcaacatattggtcatgctagtaccgtacgtcgtgatgcaccaccagggcaaaaagttgggcttattgctgccagaagaactggtcgtctgcgtggacaggcggcatcagcagctgcaaagacagacaactaatcttagttcgtttctatttgcaaggatttcatggttctattttagtgtttattttttgttaatgtgattgtacaagggtttttgaacctttttaattcaggtagtagaagtaattgtttacagaggtcatgaaacacaaactgcataccggtatttgtttgtttattttacctttctatgttgcaacgatctatgtcaaccaagtaataatctcaattt

SEQ ID NO: 3605 - DNA, 780 bp, Arabidopsis lyrata
gaaatgggtcgtgtgattagggcacagcgtaagggtgctggttccgttttcaagtcccacactcaccaccgcaagggtccagctaagttccggagcctcgattacggcgagcgaaatggttacctcaaaggattggtgaccgaaatcatccacgacccaggccgtggtgctcctctcgctcgcgtcgcgttccgtcatcctttccgctacatgaagcagaaggagctgttcgtagccgccgaaggtatgtacaccggacaatacctctactgtggtaagaaggctaatcttatggtcggtaacgttcttccccttggatcaatccctgagggagctgttgtctgcaatgttgagctccatgtcggtgaccgtggcgctctcgctagggcttctggtgattatgccatcgtaattgctcacaatcctgacagcaacaccactagggttaagcttccttctggatcgaagaagattttgccaagtgcttgcagagccatgattgggcaagttgcaggtggaggaagaacagagaagccacttctcaaggctggaaatgcataccacaagttcaaagtgaagaggaactgttggcctgttgtgcgtggtgttgcgatgaacccagtggaacatccccacggaggaggaaaccaccagcacattggtcacgccagtacggtcaggcgtgataaatctgctggggctaaggttggccaagttgctgcaaggagaactggtcgtcgtagaggtacagccgcattagcagccaaggcagactactag

SEQ ID NO: 3606 - DNA, 949 bp, Brassica juncea
gcaaaggccccgccaagttccgcagcctcgactacggcgagagaaacggatacctcaagggcgtcgtcacggagatcatccacgatcccggccgtggcgcgccgctcgctcgcgtcgctttccgtcatcctttccgttacaagaagcagaaggagcttttcgtcgccgccgaaggcatgtacaccggacagttcctgtactgcggtaagaaagcgacactcgttgtcggaaatgttctcccgctcagggcgatccctgaaggagctgtcgtctgtaacgtcgagcatcacgtcggtgatcgcggtgtgctcgctagagcttctggggattacgctatcgtgatttcgcacaaccctgacaacgatactaccaggatcaagttgccatctggttcgaagaagattgttccgagtggatgcagggccatgattggtcaagttgctggtggtggaagaacggagaagccgatgctcaaggcaggaaacgcgtaccacaagtaccgtgtgaagagaaactcgtggcctaaggttcgtggtgtggctatgaatccagttgagcatcctcacggaggaggtaaccatcagcacattggtcacgcgagtacggtcaggcgtgatgcaccaccgggacagaaggttggtcttatcgctgctaggaggactggtcgtctcagaggtcaagctgctgcttctgctgccaaggctgactaggtttaataagatatgtttgtttttgtttgagttttgctgcgtttccttttgaacctctccttgtgttctgaaatctacaattctcaagaatagcaaaccaaagttgctactgtttgcctatgtgaggttttgttttcgtgagtacaagtcagccggtttggcatgatgatcgatatgcaccagctttggagctttcatgctatagcttttgtgcagattgaaattgatactatggcgta

SEQ ID NO: 3607 - DNA, 850 bp, Ocimum basilicum
cgatcgctggacttcggagagcggaacggctacctgaagggcgtggtcaccgacgttatccacgaccccggccgcggcgcccccctcgcccgcgtcaccttccgccatcccttccgctaccagcaccagaaggagctcttcgtcgccgccgagggcatgtacaccggccaattcgtctactgcgggaagaaggccaatctcgtcgttggcaacgtcttgccgctccgatccgttcccgaaggtgccgtcgtctgtaacgtcgaacatcacgtcggagatcgcggcgttttcgctagggcttctggcgattatgccatcgttatctctcacaaccttgataatggcaccaccagaattaagctcccatcaggagcgaagaagatagtcccgagtggttgtcgtgcaatgattgggcaggttgcaggaggtgggagaactgaaaagccaatgttgaaggcgggaaatgcgtatcacaagtttagagtgaagaggaactcgtggcccaaggttcgtggtgttgctatgaaccctgtggagcatccccatggtggtggtaaccatcaacacattggccatgccagcactgtccgtcgtgatgctccgcccggccaaaaggttggtcttattgctgccagaagaaccggtcgtctacggggtcaagctgccgccactgccgctaaagctgataagtgatcaatcaatcatcttttttttctttaatttcaatgaatcagctcttgaatgttataatgctctgttttgtcgaggatatactagattttgttgggattctatgtattagatttattgcctcttatggattccatggataagactttatttaaatttt

SEQ ID NO: 3608 - DNA, 842 bp, Chelidonium majus
caggagtttagatttcggtgaacgaaatggttatctaaagggggttgtcaccgagatcattcatgatccaggtcgtggtgcgccgctcgccagagtcactttccgccaccctttcaggtacaagcatcagaaggagctcttcgttgcggcggaggggatgtacactggtatgtttgtctactgtgggaagaaggctaatctgatggtgggtaatgttcttccacttcgagcgatccctgaaggagctgttgtttgtaatgttgaacatcatgttggtgaccgtggagtcttggctagggcttctggagattacgccattgttatcagtcacaacccagataatggaacctccaggattaaacttccttctggagccaagaagattgtaccaagtgggtgccgtgccatgattgggcaggttgctggtggaggaagaactgagaagcccatgctgaaggcagggaatgcataccacaagttcagagtcaagaggaattcctggcccaaggttcgtggtgttgctatgaatcccgtggagcatccccatggtggtggtaaccatcaacacattgggcatgccagtaccgttcgtcgtgatgcacctcctggacaaaaggttggtcttattgctgctaggaggactggacgtctccgtggacaagctgctgctacagcttctaaggcagacaaggcttagtgagataaaatgatattttatggttcacctgacattcattcaaaattttggagacatttttagttgatattgagaggtaggtctcatataaggaatacattgaagtttttgtttttgaaactagttattaagtttttgattacct

SEQ ID NO: 3609 - DNA, 786 bp, Brachypodium distachyon
atggggcgcgtgatcagggcgcagcgcaagggcgcggcgggttccgtgttcaagtcccacacgcaccaccgcaagggtcccgcccggttccgggcgctggactacggcgagcggcacgggtacctcaagggcgtggtgacggagatcgtgcacgaccccggccgcggcgcgccgctggcccgcgtcgacttccgcgaaccggtgcgctacaagcaccgcaaggagctcttcgtggccgccgagggcatgtacacggggcagagcctctactgcggccgccgcgccgcgctctccgtcggcaacgtgctcccgctcgcggcgctccccgagggctccgtcgtctgcaacgtcgaggagcgcgtcggcgaccgcggcgccctcgcccgcgcctccggcgactacgccatcgtcgtcagccacaactccgacgccggcaccaccaggatcaagctgccgtcgggggcgaagaaggtggtgcagagcgggtgcagggcgatggtggggcaggtggcgggcggcgggaggacggagaagccgctgctgaaagccggcaacgcgtaccacaagtacagggtgaagaggaactgctggcccagggtgcgcggcgtcgccatgaaccccgtcgaccacccgcacggaggcggcaaccaccagcacattggccacgcctccaccgtccgccgcgacgcgcctccgggggccaagaccggccaggtcgccgcacggaggaccggcaggcgcagggggcaagacgccgtcaacgctgccaaggcgtcgctcaattag

SEQ ID NO: 3610 - DNA, 865 bp, Liriodendron tulipifera
  misc_feature (182)..(182): n is a, c, g, or t
  misc_feature (194)..(194): n is a, c, g, or t
  misc_feature (212)..(212): n is a, c, g, or t
  misc_feature (218)..(218): n is a, c, g, or t
  misc_feature (245)..(245): n is a, c, g, or t
  misc_feature (263)..(263): n is a, c, g, or t
  misc_feature (281)..(281): n is a, c, g, or t
  misc_feature (284)..(284): n is a, c, g, or t
  misc_feature (290)..(290): n is a, c, g, or t
  misc_feature (314)..(314): n is a, c, g, or t
  misc_feature (335)..(335): n is a, c, g, or t
  misc_feature (349)..(349): n is a, c, g, or t
  misc_feature (354)..(354): n is a, c, g, or t
  misc_feature (368)..(368): n is a, c, g, or t
  misc_feature (371)..(372): n is a, c, g, or t
  misc_feature (374)..(374): n is a, c, g, or t
  misc_feature (383)..(383): n is a, c, g, or t
  misc_feature (392)..(392): n is a, c, g, or t
ggtcgctggacttcggcgagcgcaacggctacctgaagggcgtcgtgacggaaatcatccacgacccgggccgaggcgccccactcgcccgagtcacgttccgccacccgttccgctacaagcatcagaaggaactcttcgtcgccgctgaagggatgtacaccggtcagttcgtgtactgnggcaagaaggcnaatctcattgtcggcaangtcctncccctgcgttcgatccccgagggtgcngtcgtctgcaacgtcgancaccatgttggcgatcgnggngtgttngctcgggcgtctggagattacgcnatcgtgattagtcataatccngataacggcaccancaggntcaagcttccttcnggnncnaagaagatngtgccaagnggatgccgtgccatgattggccaggttgcaggcgggggccggacagagaagcccctcctaaaggctggcaatgcataccacaagtttagggtcaagaggaactgctggcccaaggtccgtggtgtggccatgaacccagtggagcatcctcatggtggtggtaaccaccagcacattgggcatgccagcaccgtccgtcgtgatgccccacctgggcagaaggttggtctcatcgctgcaaggaggactggtcgtctccgtgggcaggccgccgccaccgctgcaaaatcagagaaggcttagtgagttcacctgctctcttacttttgttttagttaaaaaaaactactgtgggtttgaacaatttttgtttcccttttactctagcggtgagaattcatggcagttctgttttgaatttggattgtttatcagttacattagaattggatgcactcagttatataatatga

SEQ ID NO: 3611 - DNA, 783 bp, Arabidopsis thaliana
atgggtcgtgtgattagggcacagcgtaaaggtgcggctggttccgttttcaagtcccacacccaccaccgcaagggtccagctaagttccggagcctcgattacggagagcgaaacggttacctcaaaggattggtgaccgaaatcatccacgacccaggccgtggtgctcctctcgctcgtgtcgcgttccgtcatcctttccgctacatgaagcagaaggaactgttcgtagccgccgaaggtatgtacaccggacaatacctctactgtggtaagaaggctaatcttatggtcggtaacgttcttccccttggatcaatccctgagggagctgttatctgtaacgttgagctccatgtcggtgaccgtggtgctctcgctagggcttctggtgattacgccatcgtaattgctcacaatcctgaaagcaacaccactagggttaagcttccttctggatcgaagaagattttgccaagtgcgtgcagagccatgattgggcaagttgcaggtggaggaagaacagagaagccacttctcaaggctggaaatgcataccacaagtacaaagcgaagaggaactgttggcctgttgtacgtggtgttgcgatgaacccagtggaacatccccacggaggaggaaaccaccagcacattggtcacgccagtacggtcaggcgtgataaatctgctggtgctaaggttggtcaaattgctgcaaggagaactggtcgtcgtagaggtgcagctgccacattagcagccaaggcagactactag

SEQ ID NO: 3612 - DNA, 733 bp, Senecio madagascariensis
  misc_feature (74)..(75): n is a, c, g, or t
tggatcccccgggctgcaggcagaaacccacccaaaaatgggtcgcgtaatccgagcacaacgtaaggggagcnnaggttccgttttcaaatcccacacccaccaccgcaaaggtccggctcgtttccgcagtctcgacttcggagaacgtaacggttacctaaaaggcgtcatcaccgaaatcatccacgatccaggtcgcggtgcgccgttagctcgcgtcactttccgtcacccgttccgttacaagcaccagaaggagcttttcgtggcggctgaaggaatgtataccggacagtttgtgttttgtgggaagaaagcgaatctgatggtcggaaatgtgttgccgttgagatcgattcctgaaggagcggttgtttgtaatgtggaacatcatgttggcgatcgtggctcgtttgccagagcttccggggattatgcgattgttattagtcataatcttgataacgggacatcgagggtcaagcttccatctggagccaagaaaattgttccaagtggatgcagagctatgattggtcaagttgcaggaggaggccgtactgaaaaaccaatgctcaaagcaggaaacgcttaccacaagttccgtgtgaagagaaactgctggcctaaggttcgtggtgttgctatgaatccagttgaacatcctcatggtggtggtaaccatcaacatatcggtcatgcaagtactgttcgtcgtgatgcacctcct

SEQ ID NO: 3613 - DNA, 792 bp, Aquilegia formosa
atgggtagagttattagggcacaaagaaagggtcatggaggaattttcaaagcacatacacatcatcgtaaaggaccggcgaagtttcgcagtcttgattttggtgaaaaacatggttatttgaagggtgttgtgacagaaattgtgcatgatccaggaagaggtgcaccattagctcgagtgactttccgtcacccttttcgttacaaacatcagaaagaactatttgttgctgcagaaggaatgtatactggtcaatttatttattgtgggaagaaagcacaactgacagttggtaacgtcttgccgattggaactataccagaaggtgctgttgtttgtaacgttgaacgtaaagttggtgatcgtggggcgttagctagagcttctggagattatgctattgttattagtcataatcctgaaaatgggacttcaagggttaaattaccctctggaagcaaaaagattatatctagtggttgtcgtgctatggttggccaggttgcaggtggaggaaggactgaaaagcctatgctcaaggcaggcaatgcttatcacaagtatcgtgtcaaaaggaatagttggcctaaggtccgtggtgttgctatgaatcctgttgaacatcctcatggtggtggtaatcatcagcatattggacatggcagttgtgttggccgtgatgctgttcctggtcaaagggttggtcagctttatgcaagacaaactggtcgtggtcgtaagggtcaagctactggtactacatcaaagacaaaggcagacaaagcttag

SEQ ID NO: 3614 - DNA, 770 bp, Cleome spinosa
aacgccaacaaaaaaaaaaaccctagctttcatttcgcttcttctcctgccgcagtccccatcttcttccgccgtctccatgggtcgtgtcatcagagctcagcgtaagggtgctggctccgtcttcaaatctcacacgcaccaccgcaagggtccggctaagttccggagcctcgatttcggcgagcgcaatggctacctgaagggtgtcgtcaccgagatcatccacgacccaggccgtggcgcccctctcgctcgcgtcgttttccgacatccgttccgttacaagaagcagaaggagctcttcgtcgccgccgagggtatgtacaccggtcagttcgtgtactgtggtaagagagcctctctcgttgtcggtaacgtcctccctctcagatctatccctgagggagctgtcgtctgcaacgttgagcaccatgtcggtgatcgtggtgttttcgctagggcttccggtgattacgccatcgttattgctcacaaccccgataacgacaccactagaatcaagcttccatctggttcaaagaagattgtcccgagtgcctgcagggccatggtcggtcaagtggcaggcggtggaagaaccgagaagcctatgctcaaggcgggtaatgcttatcacaagttccgagtgaagaggaactgctggcctaaggttcgtggtgtggctatgaaccctgtcgagcatcctcacggaggaggtaaccatcaacacattggtcatgccagtacggtcagacgtgacgctcctc

SEQ ID NO: 3615 - DNA, 787 bp, Brachypodium distachyon
gcaatggggcgcgtgatcagggcgcagcgcaagggcgcggcgggttccgtgttcaagtcccacacgcaccaccgcaagggtcccgcccggttccgggcgctggactacggcgagcggcacgggtacctcaagggcgtggtgacggagatcgtgcacgaccccggccgcggcgcgccgctggcccgcgtcgacttccgcgaaccggtgcgctacaagcaccgcaaggagctcttcgtggccgccgagggcatgtacacggggcagagcctctactgcggccgccgcgccgcgctctccgtcggcaacgtgctcccgctcgcggcgctccccgagggctccgtcgtctgcaacgtcgaggagcgcgtcggcgaccgcggcgccctcgcccgcgcctccggcgactacgccatcgtcagagatatgatgattgatggatgtttgcaggatcaagctgccgtcgggggcgaagaaggtggtgcagagcgggtgcagggcgatggtggggcaggtggcgggcggcgggaggacggagaagccgctgctgaaagccggcaacgcgtaccacaagtacagggtgaagaggaactgctggcccagggtgcgcggcgtcgccatgaaccccgtcgaccacccgcacggaggcggcaaccaccagcacattggccacgcctccaccgtccgccgcgacgcgcctccgggggccaagaccggccaggtcgccgcacggaggaccggcaggcgcagggggcaagacgccgtcaacgctgccaaggcgtcgctcaattag

SEQ ID NO: 3616 - DNA, 725 bp, Brassica juncea
aaactcaaagaagacgaaacaacttcacacaatccacaatgggtcgtgtcatcagagcccaacgtaagggagcaggttccgtcttcaagtctcacactcaccaccgcaagggccccgccaagttcaggagcctcgacttcggcgagagaaatggttacctcaagggtgtcgtcacggagatcatccacgatccgggacgtggtgctccgttggcccgcgtcgccttccgtcatcctttccgttacaagaagcagaaggagctcttcgtcgccgccgaaggtatgtacaccggacagttcttgtactgcggtaagaaggccactctcgttgtcggaaatgttctcccgcttagagctatccccgaaggagctgttgtctgcaacgttgagcaccatgtcggtgatcgtggtgtgctcgctagagcttctggtgattacgctatcgttatttctcacaaccctgacaacgacacgaccagagttaagttgccgtctggatcgaagaagattgtcccaagtggttgcagggccatgattggtcaagttgctggaggtggaaggactgagaagccaatgctcaaggcgggtaacgcgtaccacaagtaccgtgtgaagagaaactgctggtctaaggttcgtggtgtggctatgaaccctgtggagcatcctcacggaggaggtaaccatcaacatattggtcacgccagtactgttcgtcgtgatgca

SEQ ID NO: 3617 - DNA, 967 bp, Cenchrus ciliaris
  misc_feature (111)..(111): n is a, c, g, or t
  misc_feature (417)..(417): n is a, c, g, or t
  misc_feature (444)..(444): n is a, c, g, or t
  misc_feature (570)..(570): n is a, c, g, or t
  misc_feature (582)..(582): n is a, c, g, or t
  misc_feature (756)..(756): n is a, c, g, or t
tgctcctcttcgcgttccgtgttccaactccggcgactccaccacccgacaccgagcagccagtccactccggccaccgcgatgtcgaggcgcggcgattgggtctacganaacaacggcgggacctgcgtggccatcgccggcgcggactactgtgtcgtcgcggccgacacccgcctctccgtcggatacagcatcctcacgcgagaccactccaagatctgcgacctagctgacaaatgtgtgctagcatcttctggctttcaaggtgatatcaaggctctgcacaagaacctagctgccagagaattgctataccaacaccagcacaataagaggatgagctgtcctgccatggcacagctgctctccaataccctgtactacaagcggttcttcccgtattatgccttcaangtgcttggtgggcttgacagtgagggnaaaggatgcgtgttcacctatgatgctgttggttcctatgagaggactggttacagtgctcagggaacaggatcttctttgatcatgccagtcttggacaatcaacttaaatcacctagccctctnttactccctgcnagagatgctgtcacacctttgtcggaatcagaggccatcgatctggtcaaggatgtgtttgcatctgcaactgagagagacatctacactggagacaagttggaaattgtagtcattaacaaagctgggaccaagcgtgagtacattgagctgaggaaggactaaagatgttanttgtgctgcagctgccatttgcttccaagttccaacgtgttgcctggagttgggatctatgcttaaagctgtcagcttcatagaaacacttgtgtttgcttgcatctgtgctgtaccaggattcagtgagctttttcttttgtttgttgaaacaaattgctttgatgctgaagtgatgtttattggaagaaggctgcgatgtttgggagca

SEQ ID NO: 3618 - DNA, 1114 bp, Pennisetum glaucum
cgttgttctcgtagacccaatcgccgcgcctcgacatcgcggtggccggaaaggactgccctccgcttcgccttccgtgttccaactccggcgactccccacccgacaccgagcaggcagtcctttccggccaccgcgatgtcgaggcgcggcgattgggtctacgagaacaacggcgggacgtgcgtggccatcgctggcgcggactactgcgtcgtcgcggccgacacccgcctctccgtcggatacagcatcctcacgcgcaaccactccaagatctgcgatctggctgacaaatgtgtgctagcatcttctggctttcaaggtgatattaaggctctgcacaagaacctagctgccagagaattgctataccaacaccagcacaataaaaggatgagctgtcctgccatggcacagctgctctccaataccctgtactacaagcggttcttcccgtattatgccttcaatgtgcttggtgggcttgacagtgaggggaaaggatgtgtgttcacctatgatgctgttggttcctatgagaggactggttacagtgctcagggaacaggatcttctttgatcatgccagtcttggacaatcaacttaaatcacctagccctctgttactccctgccagagatgctgtcacacctttgtcggaatcagaggccatcgatctagtcaaggatgtgtttgcatctgcaactgagagagacatctacactggagacaagttggaaattgtagtcattaacaaagctgggaccaagcgtgagtacattgagctgaggaaggactaaagatgttacttgtgctgctgctgccatttgcttccaagttccaacgtgttccctggagtttggatctatgcctaaagctgtccttcgtagaaacacccgtgtttgcttgcatctgtggattcagtgagcttttttttgtttgttcaaacaaattgctttgatgctgaagtgacattggcagaaggctacgatgtttgggagcaatagcatcacatgaatggcttattggcttgatctgaaatgtaaacgatttcttctcgatagagaaaaaggcagaaacgcctagaaaattcctgtggaccaaaaaaaa

SEQ ID NO: 3619 - DNA, 1260 bp, Saccharum officinarum
cccgaagtcggcaggcgagaagagcgccacccagtggccatcggacggcgtcggcgcggtgaagttgacgctcacccacgccgagtcctcttcctgtatcaccccaaaccacctcggcccacggaccacggcccagaaaggatcaaggtggaaagaaacaaaacgcaaggcggcgtccgctgctcctccacttcgcgttccgtgtttccaactccggtgactccaccaccagcaacccgcgcagcgaacccactccgaccaccgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactccaagatctgcgacctggctgacaaatgtgtactagcatcttctggctttcaaggtgatattaaggctctgcacaagaacctagctgccagagaattgctataccaacaccagcataataaaaggatgagctgccccgccatggcacagctcctctccaataccctgtactacaagcgcttcttcccatattacgccttcaatgtgctcggtgggcttgacagcgaggggaaaggatgcgttttcacctatgatgcagtaggttcctatgagagaaccggttacagtgctcagggaacggggtctactttgatcatgccagtcctggacaatcaactaaaatcaccaagtcctctattactccctgccagggatgctgtcacaccattgtcggagtcagaggccatcgatctagttaaggatgtgttcgcatctgcaactgagagagacatctacactggggacaagttagaaattgttgttattaacaaagccggtactaagcgtgagtacatcgaactgaggaaggactaagccaacgcttcagtaatgctgcagctgccatttgcttcgaacttgttcccttgtctggagatttatgtctaaagctgttgcttcatagaaacacttgtgtttacttgcgtatactgtaccaggattcagtcagcttgttttttttgttgaaacaaattgcatggatactgaagcggtacttattggcggaaaggctatatttggtttggaaacttgacattaggtggctttttcctgaattgtacatagcccccttttaatagataatcctcttatttatcatgtcttttctcgactgttcttttatctgttaatcttatctctcact

SEQ ID NO: 3620 - DNA, 1281 bp, Sorghum bicolor
ggcctctgtaccaccccaaacgacctcggcccacggaccacggaccacggcccagaaaggatcaaggtggaagaaaacaaaacgcaaggcggcgtgcgctgctcctccacttcgcgttccgtgtttccaactccggtgactccaccagcaacccagcaacccgcgcagcgatcccactccggccaccgccatgtcgaggcgcggcgactgggtctacgagaacaacggcgggacctgcgtggccatcgccggcgccgattactgtgtcgtcgccgcggacacccgcctctctgtaggatacagcatcctcacgcgcgaccactccaagatctgcgacctggctgacaaatgtgtactggcatcttctggctttcaaggtgacattaaggctctgcacaagaacctagctgccagagaattgctataccaacaccagcataataaaaggatgagctgccctgccatggcacagctcctctccaatacactgtactacaagcgcttcttcccatattacgccttcaatgtgctcggtgggcttgacagcgaggggaaaggatgcgttttcacctatgatgcagtaggttcctatgagagaaccggttacagcgctcagggaacaggatctactttgatgatgccagtcctggacaatcaactaaaatcaccaagtcctctattactccctgccagggatgctgtcacaccattgtcagagtcagaggccatcgatctagttaaggatgtgtttgcatctgcaactgagagagacatctacactggagacaagttggaaattgttgtcattaacaaagccgggactaagcgtgagtacatcgagctgaggaaggactaagccaacgcttcagtaatgctgcagctgccatttgcttcgaacttgttccctagcctggagatttatgtctaaagctgttgcttcatagaagcagttgtgtttacttgcatatgtactgtaccaggattcagtcagcttgtttttttgttgaaacaaattccttggatactgaagcggtacttattggcggaaaggctatttggttgggagcttgacatgattggcttgtgtcacaagcctctttagatgtcttatatactcactccgattcaaattgtcttttgtctttaaagtcaagccttttaacttctatatactcctactaccctttccatttcaaattatcagatgttcatagtatatttagatatattgctctcattatgcatctagacatgacaaaaggtagatcaagttatacttag

SEQ ID NO: 3621 - DNA, 1331 bp, Sorghum bicolor
ataaaactattttttttaactacacagggcctctgtaccaccccaaacgacctcggcccacggaccacggaccacggcccagaaaggatcaaggtggaagaaaacaaaacgcaaggcggcgtgcgctgctcctccacttcgcgttccgtgtttccaactccggtgactccaccagcaacccagcaacccgcgcagcgatcccactccggccaccgccatgtcgaggcgcggcgactgggtctacgagaacaacggcgggacctgcgtggccatcgccggcgccgattactgtgtcgtcgccgcggacacccgcctctctgtaggatacagcatcctcacgcgcgaccactccaagatctgcgacctggctgacaaatgtgtactggcatcttctggctttcaaggtgacattaaggctctgcacaagaacctagctgccagagaattgctataccaacaccagcataataaaaggatgagctgccctgccatggcacagctcctctccaatacactgtactacaagcgcttcttcccatattacgccttcaatgtgctcggtgggcttgacagcgaggggaaaggatgcgttttcacctatgatgcagtaggttcctatgagagaaccggttacagcgctcagggaacaggatctactttgatgatgccagtcctggacaatcaactaaaatcaccaagtcctctattactccctgccagggatgctgtcacaccattgtcagagtcagaggccatcgatctagttaaggatgtgtttgcatctgcaactgagagagacatctacactggagacaagttggaaattgttgtcattaacaaagccgggactaagcgtgagtacatcgagctgaggaaggactaagccaacgcttcagtaatgctgcagctgccatttgcttcgaacttgttccctagcctggagatttatgtctaaagctgttgcttcatagaagcagttgtgtttacttgcatatgtactgtaccaggattcagtcagcttgtttttttgttgaaacaaattccttggatactgaagcggtacttattggcggaaaggctatttggttgggagcttgacatgattggcttgtgtcacaagcctctttagatgtcttatatactcactccgattcaaattgtcttttgtctttaaagtcaagccttttaacttctatatactcctactaccctttccatttcaaattatcagatgttcatagtatatttagatatattgctctcattatgcatctagacatgacaaaaggtagatcaagttatacttaggccctgtttagttccccatccaa

SEQ ID NO: 3622 - DNA, 1033 bp, Triticum aestivum
ctccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgccgcggacacccgcctctctgtcggatacagcatcctcacgcgcgaccactccaagatctgcgacctggctgacaaatgtgtactggcatcttctggctttcaaggtgacattaaggctctgcacaagaacctagctgccagagaattgctataccaacaccagcataataaaaggatgagctgccctgccatggcacagctcctctccaatacactgtactacaagcgcttcttcccatattacgccttcaatgtgctcggtgggcttgacagcgaggggaaaggatgcgttttcacctatgatgcagtaggttcctatgagagaaccggttacagcgctcagggaacaggatctactttgatgatgccagtcctggacaatcaactaaaatcaccaagtcctctattactccctgccagggatgctgtcacaccattgtcagagtcagaggccatcgatctagttaaggatgtgtttgcatctgcaactgagagagacatctacactggagacaagttggaaattgttgtcattaacaaagccgggactaagcgtgagtacatcgagctgaggaaggactaagccaacgcttcagtaatgctgcagctgccatttgcttcgaacttgttccctagcctggagatttatgtctaaagctgttgcttcatagaagcagttgtgtttacttgcatatgtactgtaccaggattcagtcagcttgtttttttgttgaaacaaattccttggatactgaagcggtacttattggcggaaaggctatttggttgggagcttgacatgattggcttgtgtcacaagcctctttagatgtcttatatactcactccgattcaaatttcttttgtctttaaagtcaagccttttaacttcttt

SEQ ID NO: 3623 - DNA, 1109 bp, Zea mays
ggagctaaaattttgaaggagaaccccagaccacctcggcccacggacccacggaccatagcccagaaaggaccaaggtggaagaaacaaaacgaaaggcggtgtcagctgctcctccacttcccgtgtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatattacgccttcaatgtgctcggtgggcttgacagcgaggggaaagggtgtgttttcacctatgatgcagtaggttcctatgagagaactggttatagtgctcagggaacgggatctactttgattatgccagtcctggacaatcaactaaaatcaccaagtcctctattgctccctgccagggatgctgtcacaccattgtcggagtcagaggccatcgatctagttaaggatgtgtttgcatctgcaactgagagagacatctacactggagacaagttggaaattgtagtcatcaacaaagtcgggactaagcgcgagtacatcgacctgaggaaggactaagccaacgcttcagttgtgctgcagctgtcatttgcttcggacatgtttcctagtctggggatttatgtctaaagccgttgcttgcatagaaacatatgttattacttgcatatgtcctgtaccagggttcagtcagcttgttttttttttgttgaaacaaattgcttggatattgaagcggtacttactggcggaaagtctatatttggttgggagcttaacattaatggcctcatccgaaatgtcacaatca

SEQ ID NO: 3624 - DNA, 1697 bp, Panicum virgatum
cgtccacttctcttcgcgttccgtgttccaactccggcgactcgaccaccacccgagacccgagcagccagtctactccggccaccgcgatgtcgaggcgcggcgactgggtctacgagaacaacggcgggacgtgcgtggccatcgccggcgccgactactgcgtcgtcgcggccgacacccgtctctcggtcggatacagcatcctcacgcgcaaccactccaagatctgcgacttggctgacaaatgtgtactagcatcctctggctttcaaggtgatattaaggctctgcacaagaacctagctgccagagaattgctgtaccaacaccagcacaacaaaaggatgagctgtcctggtatggcacagctgctctccaataccctgtactacaagcggttcttcccgtattatgccttcaatgtgcttggtgggcttgacagtgagggtaaaggatgtgttttcacctatgacgctgttggttcctatgagaggaccggttacagtgctcaggggacaggatctagtttgatcatgccagtcttggataatcaacttaaatcaccaagccctctattactcccggccagagacgctgtcacacctttgtcggagtcagaagctgtcgatcttgttaaggatgtgtttgcatctgcaactgagagagacatctacactggagacaagctagagatcgtagtcattaacaaagccgggacaaagcgtgagtacatcgagctgaggaaggactaagctgacgcgtcggctgtgccggagctgccttatgcttccaacgtgttccctagtctggggattttatgtctaaagctgctgttgcttcatagaaagactcgtttgtttgcatctggctgtaccaggattcagtgagttttttctttgttgaaacaaattgcttggatactgaagaaatatttattggcaaggctacatggttggagagccctacaaacccacgccgccagcccgccgttaaccctcgctcctctcgcgcccccaactccccctctcccccttgcggcggcgcgtccagctccatctcccaaccatggcggactccaagaccagcacggcggtcaccctccgcacccgcaagttcatgaccaaccgcctcctctcccggaagcaattcgtgctcgaggtgatccaccccggccgggccaacgtctccaaggcggagctgaaggagaggctggccaaggtgtacgaggtgaaagaccccaacaccatcttcgtcttcaagttccgcacccacttcggaggaggcaagtccactggcttcggcctcatctacgacaacctcgaggccgccaagaagttcgagcccaagtaccgcctcatcaggaatggtcttgctactaaggttgagaagtcccgcaagcaaatgaaagagaggaagaacagggccaagaagattcgtggtgtcaagaagaccaaggctggtgatgcgaagaagaagtaaacacttatttacatttgtattactgttctggactctggggggtctagttgcactgtcataattatggttgttaggttttgttctaccctaagcactgaaatgaagttttgttattcctggatgtgaacttggccagattggctatagcatgttatgagaaggctattaacttgcaagccaacctattatctcatgcagttgtgtgatttgcccat

SEQ ID NO: 3625 - DNA, 987 bp, Panicum virgatum
gacagagcgcaaggcggcgtccacttctcttcgcgttccgtgttccaactccggcgactcacacctccacccgagacccgagcggccagtctactccggccaccgcgatgtcgaggcgcggcgactgggtctacgagaacaacggcgggacgtgcgtggccatcgccggcgccgactactgcgtcgtcgcggccgacacccgcctctcggtcggatacagcatcctcacgcgcgaccactccaagatctgcgacttggctgacaaatgtgtactagcatcctctggctttcaaggtgatattaaggctctgcacaagcacctagctgccagagaattgctgtaccaacaccagcacaacaaaaggatgagctgtcctgctatggcacagctgctatccaataccctgtactacaagcggttcttcccgtattatgccttcaatgtgcttggtgggcttgacaatgaggggaaaggatgtgttttcacctatgacgctgttggttcctatgagaggaccggttacggtgctcaggggacaggatctagtttgatcatgccagtcttggataatcaacttaaatcaccgagccctctattactcccggccagagatgctgtcacacctttgtcggagtcagaagccgtcgatcttgttaaggatgtgtttgcatctgcaactgagagagacatctacactggagacaagctggagatcgtagtcattaacaaagccgggacaaagcgtgagtacatcgagctgaggaaggactaagctgacgcttcggctgtgccggagctgctttatgcctccaacgtgttcccaagtctggggatttatgtctaaagctgctgtttcttaattgaaagactcgtttgtttgcaatctggctgtaccaggattcagtgagttttttctttgttgaaacaaattgcttggatactgaagagatattcattggcaaggctatatggttggagagccctac

SEQ ID NO: 3626 - DNA, 1042 bp, Zea mays
agaggaacccaaaccacctcggccggtcggcccacgggccacgacccaaaaaaggatcaaggtgggagaaacaaaacacaaggcggcgtccgcagcttccccactccacgttccgtgtttccgactccggtgactccaccaccagcaacccgtgcagcgagcgcactccgaccatcgccatgtcgaggcgcggcgactgggtctacgagaacaacggcgggacctgcgtggccatcgccggcgctgattactgtgtcgtcgctgcggacacccgcctctctgtaggatacagtatcctcacgcgtgatcactccaagatctgcgacctggctgacaaatgtgtactggcatcttctggctttcaaggtgatattaaggctctgcagaagaacctagctgccagagaattgctgtaccaacaccagcataataaaaggatgagctgccccgccatggcacagctcctctccaataccctgtactacaagcgattcttcccatattacgccttcaatgtgctcggtgggcttgacagcgaggggaaaggatgcgttttcacctatgatgcagtaggttcctatgagagaaccggttacagtgctcagggaacgggatctactttgatcatgccagtcctggacaatcaactaaaatcaccaagtcctctattactccctgtcagggatgctgtcacaccattgtcggagtcagaggccatcgatctagttaaggacgtgttcgcatctgcaactgagagagacatctacactggagacaagttggaaattgtagtcattaacaaggccggtactatgcgcgagtatatcgacctgagaaaggattaagccaacacttcagttgtgctgcagctgtcatttgctttgaactttttttcctagtctggtgatttatgtctaaagctgttgcttcataggaacacttgtgtttacttgcatatgtaatgtacggtatgtaccaggattcagtgagttttttttctgttgaaacaaattgcttggatactgaaacactgtatttattg

SEQ ID NO: 3627 - DNA, 894 bp, Cynodon dactylon
gcttcgcgtccccgttccaactccggcgactccaccaccacccgcacccgcgcacccagcccgctccgaccaccgcgatgtcgaggcgcggcgactgggtctacgagaacaacggcgggacctgtgtggccatcgccggcgccgactactgcgtcatcgccgccgacacccgcctctccgtcggatacagcatcctcacgcgcgaccactccaagatctgcgagctggctgacaaatgtgtactagcatcttctggctttcaaggtgacattaaggctctgcacaagaacctagctgccagggaactgctataccaacaccagcacaacaaaaggatgagctgcccagccatggcacagctcctctccaacaccctgtactacaagcgatttttcccatactacgccttcaatgtgcttggtgggcttgacagtgaagggaaaggttgtgttttcacctacgatgcagttggttcctacgagaggactggatacagtgctcagggaacaggatctactttgatcatgccagtcctggacaatcaactaaaatcacccagccctctgttgctccctgcaagagatgctgtcacacctttgtcggagactgaggccatagatcttgttaaggatgtgttcgcatcagcaactgagagagatatctacactggtgacaagttggagattgtagtcgttaacaaagatggtaccaagcgtgaatacatcgacctgaggaaggactaagttgacgcttcaattcgcccaaatgtgttcctgagaatgagcgtttatgtctaaagctgttaccaaatagagacgctcgtgtttgcttgcatctgtcatgtaccaggattcagtgatattgtttttgttaaaacgaattgctttgataccg

SEQ ID NO: 3628 - DNA, 1326 bp, Oryza sativa
aaaaagcccattaaaaaccacgggccggcccatgcccgatccatatccagacccaatacgaagttgggccaaggcccatggcctcgtgggagtcggatcaagggtggagaaaagcgcaacgcagcgaggcgtgtcctttccaatactctctctcctcctcctcctccactccggcgactcctccgccgcatcccgagcaagcaagccgccgccgccgacgacctagctccccgatcgcggccatgtcgaggcgcggcgactgggtctacgagaacaacggcgggacgtgcgtggccatcgccggcgcggactactgcgtggtggccgccgatacccgcctttccgtcggatacaacatcctcacgcgcgaccactccaagatctgcgagctagcggacaaatgcgcactagcatcttccggcttccaaggtgatatcaaagctctgcacaagaacttggctgccagagaattgctgtaccagcaccagcacaataaaaggatgagctgccctgccatggcacaactgctctccaacactctgtactacaagcgattcttcccatattatgctttcaatgtacttggtgggcttgatagtgaagggaaaggatgtgttttcacctatgatgcagttgggtcctatgagaggactggctacagtgcacagggaacaggatctgctttgatcatgccagtgctggacaaccaactaaaatcacctagtccactattactccctgcaagagatgccgtcacacctttgtcggagacagaggcggtcgatttagtgaaggatgtgtttgcatcggcaactgagagggacatctacactggtgataagctggagatagttgtcatcaacaaagctgggacgaagcgagagtacatcgacctgaggaaggactagatcgacgattatgttcttcagttaccgcaaatttgcatcaacaaatttgcttcgaacattctccctgatacgccagggaatcatgccctgaacttgatagaaacgcctgtgctttcttgcttctattctgtaccaggattctcccaacctgctttgttgaactaatcgctgccttgatgcaaatgagaccgaacatatttattgtcagaaatatcacaatggtcgatatgttgaactgtgcttgtgtttgctcgatattcgatatgtttattgactaggtttgtttatttattttagaatggtggttcgtttatttttggacggattgggaaggcatgtgtttcaggacggacaaaaataaatcgccgctctacttgctgatctacttttacgctggcaactagcgagtagcgaccag

SEQ ID NO: 3629 - DNA, 1132 bp, Brachypodium distachyon
cacggcccacaaagcctcgtaacgaaatctgatcaaaggcaacgaagcgaaacggagggcaccgcactgctccacttcgccttcccttccaagtcacgaactccggcgactccaccaccacctcccgggcaacctacccgctccgaccgccgccatgtctaggcgcggcgactgggtctacgagaataacggcgggacctgcgtggccatcgccggcgcagactactgcgtggtcgccgctgacacccgtctctccgtcggctacagcatcctcacgcgcgaccactccaagatctgcgagctggcagagaaatgtgtaatagcatcttcgggcttccaaggtgatatcaaagcgctgcagaagaacttagctgccagagaactgctttaccagcaccagcacaataaaaggatgagctgccctgcaatggcacaactgctctccaataccctctactacaagcgattcttcccatactatgctttcaatgtgcttggcgggcttgacagtgaagggaaaggatgtgtttactcttatgatgctgttgggtcctatgagaggactggttacagtgctcagggaacaggatctactttgatcatgccagtgctggacaaccagctgaaatcgcctagtccactattactccctgcaagagatgctgtcactcctttgtcagagtcagaggctgtcgacctagttaaggatgtctttgcatccgcaactgagagggacatctacactggcgacaaggtggagattgtagttatcaacaaagctgggacgcgtcgcgagtacatcgagctgaggaaggactaagttggggctttatgtttgtgctgccgctccgatttgctttggaacgttccctaggtattgggaattatgtagctgctgcttcgtagtaaacacttgtgcttgctttccttctgtgcttacccaaggattcacacagcttgctttgttaaactaagttgctgctaaatgcacatgagattgtggagttatttattggcatgaagcctacgagagttcatccccaaaacaggaagcctacgagagttgagatgctggtactcgatagtatgtaccgtagaagcccttgatatacgcctcgagctgatttcaatc

SEQ ID NO: 3630 - DNA, 994 bp, Brachypodium distachyon
ggagggcaccgcactgctccacttcgccttcccttccaagtcacgaactccggcgactccaccaccacctcccgggcaacctacccgctccgaccgccgccatgtctaggcgcggcgactgggtctacgagaataacggcgggacctgcgtggccatcgccggcgcagactactgcgtggtcgccgctgacacccgtctctccgtcggctacagcatcctcacgcgcgaccactccaagatctgcgagctggcagagaaaatgtgtaatagcatcttcgggcttccaaggtgatatcaaagcgctgcagaagaacttagctgccagagaactgctttaccagcaccagcacaataaaaggatgagctgccctgcaatggcacaactgctctccaataccctctactacaagcgattcttcccatactatgctttcaatgtgcttggcgggcttgacagtgaagggaaaggatgtgtttactcttatgatgctgttgggtcctatgagaggactggttacagtgctcagggaacaggatctactttgatcatgccagtgctggacaaccagctgaaatcgcctagtccactattactccctgcaagagatgctgtcactcctttgtcagagtcagaggctgtcgacctagttaaggatgtctttgcatccgcaactgagagggacatctacactggcgacaaggtggagattgtagttatcaacaaagctgggacgcgtcgcgagtacatcgagctgaggaaggactaagttggggctttatgtttgtgctgccgctccgatttgctttggaacgttccctaggtattgggaattatgtagctgctgcttcgtagtaaacacttgtgcttgctttccttctgtgcttacccaaggattcacacagcttgctttgttaaactaagttgctgctaaatgcacatgagattgtggagttatttattggcatgaagcctacgagagttcatccccaaaa

SEQ ID NO: 3631 - DNA, 970 bp, Secale cereale
gggaaggaagcgagacacagggcaccgcactgctccacttcgccttcttctcctccaagccacgaactccggcgactccaccccgagcagcccgccctctccgacgaccgccatgtcgaggcgcggcgactgggtctacgagaacaacggcgggacctgcgtggccatcgccggcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagctgccagagaactgctataccagcaccagcacaataaaaggatgagctgcccagcaatggcacaattgctctccaacaccctgtactacaagcgattcttcccatactatgctttcaacgtgcttggtgggcttgacagtgaagggaaaggatgtgtctactcctatgatgctgttgggtcctatgaaaggactggttacagtgctcagggatcagggtctaccttgatcatgccagtgctggacaaccagctgaaatcacctagtccactattagtccctgcaagagatgccgtcacccctttgtccgagtcagaggcggtcgacctagttaaggatgtctttgcatctgcaactgagagggacatctacaccggggacaaggtggagattgtagtcatcaacaaagctgggacgaggcgcgagtacatcgagttgaggaaggactaagtttgcgctgcggttgtcatttgtttccctagatatagggaattattatgcccagagctgctacttgatagaaaccccgtgcttgctttgcttccgtgatgatgtaccaggatcgacccagcttgctttgttaaactactttgttgtttcatgcatatgagatgctgagctatttgttggaaacgctaaaaa

SEQ ID NO: 3632 - DNA, 994 bp, Secale cereale
gaagcgagacacagggcaccgcactgctccacttcgccttcttctcctccaagccacgaactccggcgactccaccccgagcagcccgccctctccgacgaccgccatgtcgaggcgcggcgactgggtctacgagaacaacggcgggacctgcgtggccatcgccggcgcggactactgcgttgtcgccgccgacacccgcctctccgtcggatacaacatcctcacgcgcgagcactccaagatctgcgagctggccgataaatgtgtaatagcatcttctggcttccaaggtgacatcaaagctctacagaagaacttagctgccagagaactgctataccagcaccagcacaataaaaggatgagctgcccagcaatggcacaattgctctccaataccctgtactacaagcgattcttcccatactatgcgttcaacgtgcttggtgggcttgacagtgaagggaaaggatgtgtctactcctatgatgctgttgggtcctatgagaggactggttacagtgctcagggatcaggttctaccttgatcatgccagtgctggataaccagctaaaatcacctagtccactactagtccctgcaagagatgctgtcacccctttgtccgagtcagaggcggtcgacctagttaaggatgtctttgcatctgcaactgagagggacatctacaccggggacaaggtggagattgtagtcatcaacaaagctgggacgaggcgcgagtacatcgagttgaggaaggactaagtttgcgccgcggttgccatttgcttccctagatatagggaattattatgcccagagctgctacttgatagaaacacccgtgcttgctttgcttccgtgatgatgtaccaggatcgatccagcttgctttgttaaactactttgttgtttcatgcatatgagatgctgagttatttattggaaaaatgctagaagtacgttcatagaccaaaaaaaaaaaaa

SEQ ID NO: 3633 - DNA, 1023 bp, Secale cereale
tcaaaggggaaggaagcgagacacagggcaccgcactgctccacttcgccttcttctcctccaagccacgaactccggcgactccaccccgagcagcccgccctctccgaccaccgccatgtcgaggcgcggcgactgggtctacgagaacaacggcgggacctgcgtggccatcgccggcgcggactactgcgtggtcgccgccgacacccgcctctccgtcggatacaacatcctcacgcgcgagcactctaagatctgcgagctggccgataaatgtgtaatagcatcttctggcttccaaggtgacatcaaagctctacagaagaacttagctgccagagaactgctataccagcaccagcacaacaaaaggatgagctgcccagcaatggcacaattgctctccaataccctgtactacaagcgattcttcccatactatgctttcaacgtgcttggtgggcttgacagtgaagggaaaggatgtgtctactcctatgatgctgttgggtcctatgaaaggactggttacagtgctcagggatcagggtctaccttgatcatgccagtgctggacaaccagctgaaatcacctagtccactattagtccctgcaagagatgccgtcacccctttgtccgagtcagaggcggtcgacctagttaaggatgtctttgcatctgcaactgagagggacatctacaccggggacaaggtggagattgtagtcatcaacaaagctgggacgaggcgcgagtacatcgagttgaggaaggactgagtttgcgccgtggttgccatttgcttccctagatatagggaattattatgcccagagctgctacttgatagaaacacccgtgcttgctttgcttccgtgatgatgtaccaggatcgacccagctcgctttgttaaactactttgttgtttcatgcatatgatatgctgagttatttattggaaaaatgctaaacgtacgttcatagaccaaaaaaaaaaaaaaaaaaaaaaaaaaaaaa

SEQ ID NO: 3634 - DNA, 955 bp, Secale cereale
actgctccacttcgccttcttctcctccaagccacgaactccggcgactccaccccgagcagcccgccctctccgacgaccgccatgtcgaggcgcggcgactgggtctacgagaacaacggcgggacctgcgtggccatcgccggcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagctgccagagaactgctataccagcaccagcacaataaaaggatgagctgcccagcaatggcacaattgctctccaacaccctgtactacaagcgattcttcccatactatgctttcaacgtgcttggtgggcttgacagtgaagggaaaggatgtgtctactcctatgatgctgttgggtcctatgaaaggactggttacagtgctcagggatcagggtctaccttgatcatgccagtgctggacaaccagctgaaatcacctagtccactattagtccctgcaagagatgccgtcacccctttgtccgagtcagaggcggtcgacctagttaaggatgtctttgcatctgcaactgagagggacatctacaccggggacaaggtggagattgtagtcatcaacaaagctgggacgaggcgcgagtacatcgagttgaggaaggactaagttgtgctgcggttgtcatttgcttccctagatatagggaattattatgcccagagctgctacttgatagaaacaccgtgcttgcttgcttccgtgatgatgtaccaggatcgatccagcttgctttgttaaacttactttgttgtttcatgcatatgagatgctgagttatttattggaaaaaatgctagaagtacgttcataa

SEQ ID NO: 3635 - DNA, 986 bp, Hordeum vulgare
cctccaagccacgaactccggcgactccccaccaccagccccccgagcagcccgcccactccgaccaccgccatgtcgaggcgcggcgactgggtctacgagaacaacggcgggacctgcgtggccatcgccggcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagcagccagagaactgctataccagcaccagcacaataaaaggatgagctgcccagcaatggcacaattgctctccaacaccctgtactacaagcgattcttcccatactatgctttcaatgtgcttggtgggctcgacagtgaagggaaaggatgtgtctactcatatgacgctgttgggtcctatgagaggactggttacagtgcacagggatcaggatctaccttgatcatgccagtgttggacaaccagctgaaatcacctagtccactattagtccctgcaagagatgccgtcacccctttgtccgaatcagaggcggtcgacctagttaaggatgtctttgcatccgcaactgagagggacatctacactggggacaaagtggagattgtagtcatcaacaaagctgggacgaggcgtgagtacattgagttgaggaaggactaagcttgcgctgctgcagttgccatttgcttccctagatatagggaattattatgcccagagctgctactttgatagaaacacccgtgcttgctttgcttccgtgctgtaccaggatcgacccagcttgctttgttgaactaatttgttgtttcatgcatatgagatgctgagttatttgttggaaatgctaaaagtacgttcatgataacccacaataaatactctcatcagggcatcttgaacagcag

SEQ ID NO: 3636 - DNA, 1052 bp, Hordeum vulgare
gatcaaaggggaaagaagcgagacacagggcacagcactgctccacttcgccttctcctccaagccacgaactccggcgactccccaccaccagccccccgagcagcccgcccactccgaccaccgccatgtcgaggcgcggcgactgggtctacgagaacaacggcgggacctgcgtggccatcgccggcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagcagccagagaactgctataccagcaccagcacaataaaaggatgagctgcccagcaatggcacaattgctctccaacaccctgtactacaagcgattcttcccatactatgctttcaatgtgcttggtgggctcgacagtgaagggaaaggatgtgtctactcatatgacgctgttgggtcctatgagaggactggttacagtgcacagggatcaggatctaccttgatcatgccagtgttggacaaccagctgaaatcacctagtccactattagtccctgcaagagatgccgtcacccctttgtccgaatcagaggcggtcgacctagttaaggatgtctttgcatccgcaactgagagggacatctacactggggacaaagtggagattgtagtcatcaacaaagctgggacgaggcgtgagtacattgagttgaggaaggactaagcttgcgctgctgcagttgccatttgcttccctagatatagggaattattatgcccagagctgctactttgatagaaacacccgtgcttgctttgcttccgtgctgtaccaggatcgacccagcttgctttgttgaactaatttgttgtttcatgcatatgagatgctgagttatttgttggaaatgctaaaagtacgttcatgataacccacaataaatactctcatcagggcatcttgaacagcaggcctaaaaaa

SEQ ID NO: 3637 - DNA, 883 bp, Leymus cinereus x Leymus triticoides
  misc_feature (13)..(13): n is a, c, g, or t
  misc_feature (79)..(79): n is a, c, g, or t
gcacgaggccgcnatgtcgaggcgcggcgactgggtctacgagaacaacggcgggacctgcgtggccatcgccggcgcngactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagctgccagagaactgctataccagcaccagcacaataaaaggatgagctgcccagcaatggcacaattgctctccaataccctgtactacaagcgattcttcccatactatgcgttcaacgtgcttggtgggcttgacagtgaagggaaaggatgtgtctactcatatgatgctgttgggtcctatgagaggactggttacagtgctcagggatcaggatctactttgatcatgccagtgttggacaaccagctgaaatcacctagtccactattagtccctgcaagagatgccgtcacccctttgtccgagtcagaggccgtcgacctagttaaggatgtctttgcatctgcaactgagagggacatctacactggggacaaggtggagattgtagtcatcaacaaagctgggacgaggcgcgagtacatcgagttgaggaaggactaagtttgcgctgcagttgccatttgcttccctggatacagggaattattatgcccagagctgctacttgatagaaacactcgtgcttgctttgcttccgtgatgtaccaggatcgacccagcttgctttgttaaactaatttgttgtttcatgcatatgagatgccgagttatttattggaaatgctaaacttacgttcatagcca

SEQ ID NO: 3638 - DNA, 987 bp, Pseudoroegneria spicata
  misc_feature (5)..(6): n is a, c, g, or t
ccgtnnctttcgccgttgctgtcgccgcactgctccacttcgccttctcctccaagccagaactccggcgactccaccaccagccccccgagcagcccaccctctccgaccaccgccatgtcgaggcgcggcgactgggtctacgagaacaacggcgggacctgcgtggccatcgccggcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctgcagaagaacttagccgccagagaactgctataccagcaccagcacaataaaaggatgagctgcccagcaatggcacaattgctctccaacaccctgtactacaagcgattcttcccatactatgctttcaacgtgcttggtgggcttgacagtgaagggaaaggatgtgtctactcctatgatgctgttgggtcctatgagaggactggttacagtgctcagggatcaggttctaccttgatcatgccagtgctggacaaccagctaaaatcacctagtccactattagtccctgcaagggatgccgtcacccctttgtccgagtcagaggccgtcgacctagttaaggatgtctttgcatctgcaactgagagggacatctacaccggggacaaggtggagattgtagtcatcaacaaagctgggacgaggcgcgagtacatcgagttgaggaaggactaagtttgcgctgcagttgccatttgcttccctggatatagggaattattatgcccagagctgctacttgatagaaacactcgtgcttgctttgcttccgtgatgtaccaggatcgacccagcttgctttgttaaactaatttgttgtttcatgcatatgagatgttgagttatttattggaaatgctaaacgtacgtacatagcca

SEQ ID NO: 3639 - DNA, 991 bp, Triticum aestivum
ctgctccacttcgccttctcctccaagccacgaactccggcgactccaccaccagcccccgagcagcccgccctctccgaccaccgccatgtcgaggcgcggcgactgggtctacgagaacaacggcgggacctgcgtggccatcgccggcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagctgccagagaactgctataccagcaccagcacaataaaaggatgagctgcccagcaatggcacaattgctctccaacaccctgtactacaagcgattcttcccatactatgctttcaacgtgcttggtgggcttgacagtgaagggaaaggatgtgtctactcatatgatgctgttgggtcctatgagaggactggttacagtgctcagggatcaggatctaccttgatcatgccagtgctggacaaccagctgaaatcacctagtccactattagtccctgcaagagatgccgtcacccctttgtccgagtcagaggcggtcgacctagttaaggatgtctttgcatctgcaactgagagggacatctacaccggggacaaggtggagattgtagtcatcaacaaagctgggacgaggcgcgagtacatcgagttgaggaaggactaagtttgcgccgcggttgccatttgcttccctagatatagggaattattatgcccagagctgctacttgatagaaacacccgtgcttgctttgcttccgtgatgatgtaccaggatcgacccagcttgctttgttaaactactttgttgtttcatgcatatgagatgctgagctatttgttggaaatgctaaaagtacgttcatagccattctatgattacccggaataaatactctca

SEQ ID NO: 3640 - DNA, 1033 bp, Triticum aestivum
agcgaggcacagggcaccgcactgctccacttcgccttctcctccaagccacgaactccggcgactccaccaccaccccccgagcagcccgccctctccgaccaccgccatgtcgaggcgcggcgactgggtctacgagaacaacggcgggacctgcgtggccatcgccggcgcggactactgcgtggtcgccgccgacacccgcctctccgtcggatacaacatcctcacgcgcgagcactccaagatctgcgagctggccgataaatgtgtaatagcatcttctggcttccaaggtgacatcaaagctctacagaagaacttagctgccagagaactgctataccagcaccagcacaataaaaggatgagctgcccagcaatggcacaattgctctccaacaccctgtactacaagcgattcttcccatactatgctttcaacgtgcttggtgggcttgacagtgaagggaaaggatgtgtctactcgtatgatgctgttgggtcctatgagaggactggttacagtgctcagggatcaggatctaccttgatcatgccagtgctggacaaccagctgaaatcacctagtccactattagtccctgcaagagatgccgtcacccctttgtccgagtcagaggcggtcgacctagttaaggatgtctttgcatctgcaactgagagggacatctacaccggggacaaggtggagattgtagtcatcaacaaagctgggacaaggcgcgagtacatcgagttgaggaaggactaagtttgcgccgcggttgccatttgcttccctagatatagggaattattatgcccagagctgctacttgatagaaacacccgtgcttgctttgcttccgtgatgatgtaccaggatcgacccagcttgctttgttaaactactttgttgtttcatgcatatgagatgctgagctatttgttggaaatgctaaaagtacgttcatagccattctatgattacccggaataaatactctcatcggggcatcttcaactgcca

SEQ ID NO: 3641 - DNA, 1055 bp, Avena sativa
acaaagaaatctagaagcggcggaacacaggactgctccacttcgccttccccacgaactccggcgagtcggtcccccagcccccgagcacccacccgccccgaccaccgccatgtcgagacgcggcgactgggtctacgagaacaacggcgggacctgcgtggccatcgccggcgcggactactgcgtggtggccgccgacacccgcctctccgtcggatacaacatcctcacccgtgaccactccaagatctgcgagctggcagagaaatgtgtaatagcatcttccggcttccaaggtgatatcaaagctctgcagaagaacttatctgccaaagagctgctatatcagcatcagcacaacaaaagaatgagctgccctgcaatggcacaattgctctcgaataccctgtactacaagcgattcttcccatactatgctttcaacgtgcttggtggtcttgacagtgaagggaaaggatgtgtttactcctatgatgctgttggttcctatgagaggactggttacagtgctcagggaacaggatctactctgatcatgccagtgctggacaaccagctgaaatcacccagtccgctattagtccctgcaagagatgctgtcacccctttgtctgagtcagaggctgttgacctagttaaggatgtgtttgcatctgcaactgagagggacatctacactggtgacaaggtggagattgtagtcatcaacaaagctggcacgaggcgcgagtacattgagttgaggaaggactaagtaggggcttgaagtttgtgatgcagttccatttgcctgggaatgttccctagatatatagggaattattatgcccacagctgttacttcatagaaacccttgtctcgtgcttgcttgcttctgtgctgtaccaggattcacacatcttgctttgttgaattaatttgctgcttcatgaacatgtgactgagctatttattggcaggaatcctacgagatactgaacgtatgttctagacatcagatgatctttcgatagtaactcactttgataat

SEQ ID NO: 3642 - DNA, 778 bp, Festuca arundinacea
  misc_feature (338)..(338): n is a, c, g, or t
  misc_feature (395)..(395): n is a, c, g, or t
  misc_feature (434)..(434): n is a, c, g, or t
  misc_feature (578)..(578): n is a, c, g, or t
ggcacgagggctccacttcgtcttcccccccaagacacgaactccggcgacccagccccccacccacgagcaccccactcgctccgaccaccgccatggcgaggcgcggcggcgactgggtctacgagaataacggcgggacctgcgtggccatcgccggcgcggactactgcgtggtcgccgccgacacccgcctctccgtcggatacaacatcctcacccgcgaccactccaagatctgcgagctggcagagaaatgtgtaatagcatcttccggcttccaaggtgatatcaaagctctgcagaagaacttatctgccaaagaactgctataccancaccagcacaacaaaagaatgagctgccctgcaatggcacaattgctctccaatacnctgtactacaagcggttcttcccatactatgctttcaangtgcttggtgggcttgacagtgaagggaaaggatgtgtttactcctatgatgctgttggttcctacgagaggactggttacagtgctcagggaacaggatctactctgatcatgccagtgttggacaaccagctgaaatcaccnagtccactattagtccctgcaagagatgccgtcactcctttgtctgagtcagaggccgtcgacctagttaaggatgtttttgcatccgcgactgagagggacatctacactggcgataaggtggagattgtagtcatcaacaaagctgggacaaggcgcgagtacattgagttgaggaaggactaggtcagggctttaag

SEQ ID NO: 3643 - DNA, 906 bp, Ananas comosus
aaaccctcctcggcaatggctctgcggcgcgattgggtatacgagaacaatggcgggacgtgcgtggcgatcgcgggcgccgactactgcgtggtggcggcggacatgaggctctcggttggatacagcatcctcacccgcgaccactccaagatctgcgaacttgcggataaatgtgtattggcttcctctggctttcaaggtgatataaaagctttacacaagaacttggcagctagacatctgatctatcagcatcagcacaacaagcaaatgagctgccctgcaatggctcaactgctctccaatactctttattacaagcgattctttccctattatgctttcaacgtacttggtggactcgacaatgaaggaaaaggctgtgtgttcacatatgatgctgtgggatcctatgaaagggtgggatatagtgctcaaggaacaggagctacattaattatgcctgttttggacaatcagctcaaatcccctagtcctctcttacttcctgccagggatgctgtgacaccactttcagagtctgaagccgtcgatctggttaaggacgtttttgcatctgctactgaaagggatatttacacgggcgataagctagagatagttgtcatcaacgctgctgctacacggcgtgaatacatagagcttaggaaagattaacttggtatattaatggagttcggaattggtttgggattaatggtgcatccttgattccttcatgattttcccagcagctttagtaacattatccgttcagaaacaagattgttgtgcttgaaatgctgatggttttcttcaaaccaacaccttcagattatcaattacattatgtcgaacaaaggctttttgaagttacgaatttgcccatgattctatgtttct

SEQ ID NO: 3644 - DNA, 931 bp, Triticum aestivum
gcacgaggggacctgcttggccatcgccggcgccgattactgtgtcgtcgccgcggacacccgcctctctgtcggatacagcatcctcacgcgcgaccactccaagatctgcgacctggctgacaaatgtgtactggcatcttctggctttcaaggtgacattaaggctctgcacaagaacctagctgccagagaattgctataccaacaccagcataataaaaggatgagctgccctgccatggcacagctcctctccaatacactgtactacaagcgcttcttcccatattacgccttcaatgtgctcggtgggcttgacagcgaggggaaaggatgcgttttcacctatgatgcagtaggttcctatgagagaaccggttacagcgctcagggaacaggatctactttgatgatgccagtcctggacaatcaactaaaatcaccaagtcctctattactccctgccagggatgctgtcacaccattgtcagagtcagaggccatcgatctagttaaggatgtgtttgcatctgcaactgagagagacatctacactggagacaagttggaaattgttgtcattaacaaagccgggactaagcgtgagtacatcgagctgaggaaggactaagccaacgcttcagtaatgctgcagctgccatttgcttcgaacttgttccctagcctggagatttatgtctaaagctgttgcttcatagaagcagttgtgtttacttgcatatgtactgtaccaggattcagtcagcttgtttttttgttgaaacaaattccttggatactgaagcggtacttattggcggaaaggctatttggttgggagcttgacatgattggcttgtgtcacaagcctctttagatgtcttatatactcactccgattcaaatttcttttgtctttaaagtcaag

SEQ ID NO: 3645 - DNA, 1151 bp, Setaria italica
agagcgcgaccgagccggattctcttcttgcagcacaagaagaagatacggagaagaactcgactcccgcggcgtgccggagctcccctgcctttaagcaaagccagcctcccccttccacccccaaccgccctcggcaaatcggcatcagaactcagagaccagaccccgagtgaatctcggagcggaggcagatggccaggttcgacccgtacgagaacaacggcggcacgtgcgtggccgtcgccggcgccgactactgcgtggtcgccgccgacacccgcctctccgtcggatacagcatcctgtcccgcgaccactccaagatcgcccaactagcagacaaatgtgttttggcctcatctgggttccaaggtgatatcaaagctttgcaaaagaatctggctgccaaggaattggtttatgaacacaatcataacaagaagatgagctgccctgcaatggcgcagctgttgtcgaacacactctactacaagagattcttcccatactacgcgttcaatgtgttgggtggactggatagccaaggtaaaggatgtgtcttcacatacgatgctgttgggtcttacgaaaggacaggctatagtgctcagggaacaggcgcagcgttgatgatgcctgttcttgacaaccagttgaaatctcctagtcctctgctactgccagctcgggatgcagtgacaccattgtctgaatccgatgcggttgatctggtgaaggatgttttcgcatcagccacagaacgagacatatacactggagataagttggaaattgtggtcatcaacagctccggcacacacagagagtgcattgaactgaggaaggattagtgcagtgttcctataaaatggcactaccatggttcttacataaggatatttgttttcactgtctgatgtgtttgaatttcctctaaaaatatatgtatttgaatttccattctgttgattctaggaggaagttatgacaattcatcattttatattatatacttagaagacaacttttcaagtctattggattgcttactgaagcactcatattgcctgagcatggggatagcagaaatgaacttcctctgttaaaaaaaatggagaaagcctggctgggcatgatgttcttgaccc

SEQ ID NO: 3646 - DNA, 1104 bp, Elaeis guineensis
cgtgaccctagcgaagcagaaacaaaagcaagcaagacccagcggttccaggcctcccggtttcatcccctcctcctcccacctcagtgaccatggctttgagtcgtaactggatgtacgagaacaacggaggcacatgcgtggcgatcgcgggagcggactactgcgtggtggccgccgacacgaggctgtccatcggatacagcatctacacccgcgactactccaagatctgcaagctggcagacaaatgtgtgttggcatcttctggatttcaaggtgatataaaagctttgcaaaaaaacttggctgctaggcacttgatctatcagcatcaacacaacaaacaaatgagctgccctgcgatggctcaactcctctcaaataccctttattacaaacgcttctttccatattatgctttcaatgttctaggtggacttgacaatgaagggaagggctgtgtgttcacgtacgatgctgttgggtcctatgaaagggttgggtacagcacccaaggctcagggtcaacactcatcatgcctgttttggacaaccaacttaaatcccctagtcctctcttattgcctgctagggatgctgtgacaccactctcggaatcagatgcagttgatttggtaaaagatgtttttgcatctgcaactgaaagagatatatacactggagataaactagaaatagtcgtcatcaatgcatcaggtatacggcgtgaatttatagaactcaggaaagactaatttcacataattgtggtctctgcagctgtgacccagttttcggatctgggaggtcttccaatatcattgtcatggtggagctgtgctccttggtgattgccccgatttagcttttacatccctcaaacatattcttgtactttgagatatggattctttcagaccaactgaagtaatgcatgttttatatgaacgaggccagaatttgtcatttatattggcattttatcaagttttactcctttttcctgcatggcttgccttcaggagttcatatttagagtttgaactgtactgactttatatttagaatttgaacttcatatttagagtgaaaaaaaaaaaa

SEQ ID NO: 3647 - DNA, 1064 bp, Pennisetum glaucum
gcggcgtgccggagctcccctgtttgcctataagcaaagccaagccttacctccccttcctccccacaaccgccctcggcaaatccgcatcagaattcagagtcggaccccgagagcgaagcgaacaaaccgcgcccgcgagcagcgaggaggcgagtgaatctcggagcggaggcgcgcgcgcgatggccaggttcaacccgtacgagaacaacggcggcacgtgcgtggccgtcgctggcgccgactactgcgtggtcgccgccgacacccgcctctccgtcggatacagcatcctgtcccgcgaccactccaagatcgcccagctagcagacaaatgtgttttggcttcatctgggttccaaggtgatatcaaagctttgcagaagaatctggctgccaaggaattggtttacgaacacaatcataacaagaagatgagctgccctgcaatggcacaactattgtcgaacacactctactacaagagattcttcccatactacacgttcaatgtattgggtggcctggacagccaaggtaaaggatgtgtcttcacctacgatgctgttgggtcttacgaaaggacaggttatagtgctcagggaacaggtgcagcgttgatgatgcctgttcttgacaaccagttgaaatctcctagtcctctgctactgccagctcgggatgccgtgacacccttgtctgaatccgatgcggttgatctggtgaaggatgtttttgcatcagccacagaacgagacatatacactggagataagttggaaattgtggtcatcaacagctctggcacacaccgagagtgcattgaactgaggaaggattagtgcagtgttcctataaaatggcactatcatggttcttacagaaggatatttgttttcactgtctgatgtgtttgaatttcctctaaaaatatatgtatttcgaatttccattctgctgattttagaaggaagttattacaattcatcatattatctgatacttagaggacaacttttcaagcatttcgaattgcttaatgaaacattgcctgagcatgg

SEQ ID NO: 3648 - DNA, 1549 bp, Brachypodium distachyon
ccggggcgagccggggctcctcctcttcttccttcttgcagcacacgaagagctcggctccctcggtccctccccgcggcgcattctcccgtacaaagccttctctctctccacgccgctcgccgcgttgtaccgacagagcccgagagagagacagagcagcagcagcgcggagaggacccgaagatctcttcctccagccagcgcgccatggcgaggttcgacccgtacgagaacaacggcggcacgtgcgtggccgtcgcgggggccgactactgcgtcgtcgccgccgacacccgcctctccgtcggatacagcatcctctcccgcgcccactccaagatcgcccacctggcggacaaatgtgttttggcctcatctgggtttcagggtgatatcaaagctttgcagaagaacctgactgcgaaggaattggtatatgaacacaaccataacaagaagatgagctgccctgccatggcacaattactgtcaaacacgctctactataagagattcttcccatactatgctttcaatgtgttgggtggactggatagcgaaggtaaaggctgtgtcttcacatatgatgctgttggttcatatgagcggaccggttatagtgctcagggaacaggcgcaacattgatgatgcctgttctagacaaccagttgaaatctcctagtcctcttctactgccagctagggatgcagtgacgcccctgtctgaatcggaggctgttgatctggtgaaggacgtttttgcatcagccacagaaagagatatatacactggagatagtgtggaaattgtagtcatcaacagctccggcacccatagggagtgcattgagctgaggaaggattagtttgggatacctgtgaaacattaccgtggaacatcacttgttacaacaggtccctaccacaagcaaaatgattttacattttctgttgtgtcaggtgtatttttcttcctgtttgtttgttcactattgcaagattggctatacacacattgtatttatcatagtctgctatacccagtacttatttggattacttactgaatcactcacatagcctagattcagctaagttatggaacttatgtcagcagaaacaaccatgggacagcagaatcaagctcactgttgaacattgagaaagaacagactacgtataaaaacattgaaacagttaacaaattgctaacatactatttctaaaccctagtacattagtgacccaatcaggagtcgggcttgcagccaatagctttgctgcaaccttgtaccacttcttctcccttctcagtctaaatacgaatcgatcaagaaaacagtgcatccaaaacaccatccaactaccaaaattttgctaggcgccgaaatggatctgcatgcagccgatcaagccggaggaacaacactgctggtgactgcattgaagatctccatgtacccaaccatgccaaccaagacggcttcctctttgtcgttgctttcggtgacccaaaggtgtgttgccctgtgcgccagcatctgc

SEQ ID NO: 3649 - DNA, 1072 bp, Brachypodium distachyon
ggaccgagccggggctcctcctcttcttccttcttgcagcacacgaagagctcggctccctcggtccctccccgcggcgcattctcccgtacaaagccttctctctctccacgccgctcgccgcgttgtaccgacagagcccgagagagagacagagcagcagcagcgcggagaggacccgaagatctcttcctccagccagcgcgccatggcgaggttcgacccgtacgagaacaacggcggcacgtgcgtggccgtcgcgggggccgactactgcgtcgtcgccgccgacacccgcctctccgtcggatacagcatcctctcccgcgcccactccaagatcgcccacctggcggacaaatgtgttttggcctcatctgggtttcagggtgatatcaaagctttgcagaagaacctgactgcgaaggaattggtatatgaacacaaccataacaagaagatgagctgccctgccatggcacaattactgtcaaacacgctctactataagagattcttcccatactatgctttcaatgtgttgggtggactggatagcgaaggtaaaggctgtgtcttcacatatgatgctgttggttcatatgagcggaccggttatagtgctcagggaacaggcgcaacattgatgatgcctgttctagacaaccagttgaaatctcctagtcctcttctactgccagctagggatgcagtgacgcccctgtctgaatcggaggctgttgatctggtgaaggacgtttttgcatcagccacagaaagagatatatacactggagatagtgtggaaattgtagtcatcaacagctccggcacccatagggagtgcattgagctgaggaaggattagtttgggatacctgtgaaacattaccgtggaacatcacttgttacaacaggtccctaccacaagcaaaatgattttacattttctgttgtgtcaggtgtatttttcttcctgtttgtttgttcactattgcaagattggctatacacacattgtatttatcatagtctgctatacccagtacttatttggattacttactgaatc

SEQ ID NO: 3650 - DNA, 1077 bp, Oryza sativa
ctagcctccccgcgacgccgcgccgccccgccccgcccgatcgccgccgcactcgccgcccgtccgcctcgccgcaacgcaccgcgccaccgcgccgcgccagcctgagggagagagagagacgccgaggtttgaggttggtgagggagctgaggcggcgggagaaggaggaggagcgagagcgagggagagagatcgatggcgaggttcgaggtgtacgagaacaacggcggcacgtgcgtggccgtcgccggcgccgactactgcgtggtcgccgccgacacgcgcctctccgtcggatacagcatcctcagccgcgacagctccaagatcgcccacctagcggataaatgtgttttggcctcatctggatttcaaggtgatgttaaagctttgcagaggaaccttactgccaaggaattgctttatgaacacaaccataacaagaaaatgagctgccctgcgatggcgcaattactgtccaacacgctctactacaaaaggttcttcccatactatgccttcaatgtgttgggtggacttgacagcgaaggtaaaggatgtgtcttcacatatgatgctgttgggtcttatgaaaggacaggttatagtgctcaggggacaggtgcagctttgatgatgcctgttctggacaatcagctaaaatctcctagcccattactacttccagctcgggatgcagtgacaccattatctcaatcagatgctgtcgatctggttaaggacgtttttgcatcagccacagaacgagacatatacactggagataaactggagattgttgtcatcaacagcgccggctctcaccgtgagttcattgagctaaggaaggattagcgtgggatactatcaaaccacctcgtacctgtgcaacaacaataccattcagttactagcagaatgtgccttttccttgccagatgtatttaaattaccgttgtattattcagtgttcaccattattacggaagtggttacgtaagacattttgtagtctttctatctgaactatgcgtatctgaattgctcactgaatttttcttgcattgcctgaac

SEQ ID NO: 3651 - DNA, 1042 bp, Panicum virgatum
aagatacggagaagaactccgactccggcggcgtgccggccggagctgcctttaagcaaagcgagccctctccccttccccaaccgcgcttcgcaaattcgcatcagttcctgctcaaaaaaaaaattcgcatcagttcatctgggatcagacccgagagcgaagcaagagacgagtgaatctcgtagcggaggcgatggccaggttcgacccgtacgagaacaacggcggcacctgcgtggccgtcgccggcgccgactactgcgtggttgccgccgacacccgcctctccgtcggatacagcatcttgtcccgcgaccactccaaggtcgcccaactggcagaaaaatgtgttttggcctcatctggcttccaaggtgatatcaaagctttgcagaagaatctggcagccaaggaattggtttatgagcacaatcataacaagaagatgagctgccctgcaatggcgcaactgctgtcgaacacgctctactacaagagattcttcccatactacgcattcaatgtattgggtggactggacagccaaggtaaaggatgtgtctttacatacgatgctgttgggtcttatgagaggacaggttatagtgctcagggaacgggtgcagcattgatgatgcctgttcttgacaatcagttgaaatcccctagtcctctactactgccagctagggatgcagtgacgcccttatctcaatctgaggcagttgatctggtgaaggacgttttcgcatcagctacagaacgagacatatacactggagatagattggaaattgtggtcatcaacagctccggcacataccgagagtacattgaacttaggaaggactagtgcattgttcctgtgaaatggcactaccattattaagcataaggatatttgtttctgttgtcagatgtgtttgaatttcctctaaaaagaaagatgtatttgaatttccaatttgttgattctagcacgaagtgataattcatcattttatctgttatacttagactgcaccatttcaagcctttt

SEQ ID NO: 3652 - DNA, 932 bp, Eragrostis curvula
cgggggctgggttcgcgttccactccggcgacgccccaccacccgcacccaagtagccagcccactccgaccaccgcgctgtcgaggcgcggcgactgggtctacgagaacaacggcgggacctgcgtggccatcgccggggccgactactgcgtcatcgccgccgacacccgcctctccgtcggatacagcatcctcacgcgcgatcactccaagatctgcgagctggctgacaaatgtgtgctagcatcttctggctttcaaggtgatattaaagctctgcacaagaacctagctgccagagaactgctataccaacaccagcacaacaaaaggatgagctgccccgccatggcacagctcctctccaacaccctgtactacaagcggttcttcccatactacgccttcaatgtgctcggtgggcttgacagtgaagggaaaggatgtgttttcacctatgacgcagttggttcctatgagaggaccggttacagcgctcagggaacaggatctactttgatcatgccagtcttggacaaccaactaaaatcacccagtcctctattactccctgcaagagatgctgtcacacctttgtctgagtccgaggctgtcgatctagttaaggatgtgtttgcatctgcaacggagagagacatctacactggcgataagttggagatcgtagtcattaacaaagctggtaccaagcgcgagtacatcgacctgaggaaggactaagtttgacgcttcagttgctgccatttgcttcaaacgtgttccttagactgggagcttatgtctaaagctgttcttcatagaaacactcgtgtttgcctgcatctgtggtgtaccaggattatgtgagcttgtttttgttaagacaaattgctttgatactgaagaatgtttattgacagaaaggctgg

SEQ ID NO: 3653 - DNA, 966 bp, Zea mays
aagaattcgactccctgcttcccattccgtgaccgcgcctcagaattttcagaagagagcagaccgccaccgaagcacacaagcagcgtcgtcagggcgtgaaggcaccaccgaatctcgggagcagcagctatggcgaggttcaacccatacgagaacaacggcggcacgtgcttggccgtcgccggcgccgactactgcgtcgtcgccgccgacacccgcctctccatcggttacagcatcctgtcccgtgaccactctaaaatctctcagctgtcagacaaatgtgttttggcttcatctgggtttcaaggtgatatcaaagctttgcagaaggctctggctgctaaggaattaatctatgaacacaataataacaagaagatgagctgcccagcaatggctcaacttctgtcaaacacactctactacaagagatttttcccatactacgctttcaatgtgttggccggactggacacccaaggtaaaggatgtgtctttacatacgatgctgttggatcttatgagaggacaggctatagtgctcagggaacaggttcagcgttgatgatgcctgttcttgacaaccagttgaaatcccctagtcctctcctactgccagctcgggatgcagtgacacccttgtctgaatctgatgcggttgatctggtgaaggacgttttcgcatcagccactgaacgagacatatacactggagatagattggaaattgtggtcatcaacaaatctggcacacaccgagagtacattgaactgagaaaggattagtgcaatattcctgtataatggcacattagcactatcgttgttatgcataaggatatttgttctcactgtcaggtttctgtatttgaatttcgtctaaacagaaaggtgcatttgaatttccattctgttgattctagcaggaaatgattataaagaggtcgtaattcatcattt

SEQ ID NO: 3654 - DNA, 1140 bp, Sorghum bicolor
gaccccgagaagaactcgactcccgcggcggtgccggtgccggagccgcctataagcaaagcgagcgagccccagcctccccttccctgaccgcgcctcagaaatttcagaagagatccgaccgccaccgaagcacacaagcagcgtcgccagggcgtgagagggagcaccagtgaatctcgggagcagaggcgatggcgaggttcgacccgtacgagaacaacggcggcacgtgcgtggccgtcgccggcgccgactactgcgtcgtcgccgccgacacccgcctctccgtcggttacagcatcctgtcccgcgaccactccaagatcgcccagctggcagacaaatgtgttttggcctcgtctgggttccaaggtgatatcaaagctttgcagaaggctctgactgccaaggaactaatctatgaacacaacaataacaagaagatgagctgcccagcaatggctcaacttctgtcaaacacactctactacaagagattcttcccatactacgctttcaatgtgttggccggactggacacccaaggtaaaggatgtgtctttacatacgatgctgttgggtcttatgagaggacaggttatagtgctcagggaacaggttcagcgttgatgatgcctgttcttgacaaccagttgaaatcccctagtcctctcctactgccagctcgggatgcagtgacacctttgtctgaatctgatgcggttgatctggtgaaagacgttttcgcatcagccactgaacgagacatatacactggagatagattggaaattgtggtcatcaacagctctggcacacaccgagagtgcattgaactgaggaaggattagtgtaatgttcctgtgtaatcacactaccgttgttatgcatgaggatatttgttttttattgtcagatatctgtatttgaatttcctctaaacagaaagttgtattttgaatttccattctgttgattccagcaggagatggttataaagatattgtaattcattattttatacttatgatgagacaccttcttgaaatactcatattgcctgggggaataaactctctgttcaaaaaatggagacaagttttcatttgggcgtcatgtttttgatccaaagtagta

SEQ ID NO: 3655 - DNA, 1091 bp, Sorghum bicolor
agcgaccgagccggattctcttcttgcagcacaagaagaaaagaccccgagaagaactcgactcccgcggcggtgccggtgccggagccgcctataagcaaagcgagcgagccccagcctccccttccctgaccgcgcctcagaaatttcagaagagatccgaccgccaccgaagcacacaagcagcgtcgccagggcgtgagagggagcaccagtgaatctcgggagcagaggcgatggcgaggttcgacccgtacgagaacaacggcggcacgtgcgtggccgtcgccggcgccgactactgcgtcgtcgccgccgacacccgcctctccgtcggttacagcatcctgtcccgcgaccactccaagatcgcccagctggcagacaaatgtgttttggcctcgtctgggttccaaggtgatatcaaagctttgcagaaggctctgactgccaaggaactaatctatgaacacaacaataacaagaagatgagctgcccagcaatggctcaacttctgtcaaacacactctactacaagagattcttcccatactacgctttcaatgtgttggccggactggacacccaaggtaaaggatgtgtctttacatacgatgctgttgggtcttatgagaggacaggttatagtgctcagggaacaggttcagcgttgatgatgcctgttcttgacaaccagttgaaatcccctagtcctctcctactgccagctcgggatgcagtgacacctttgtctgaatctgatgcggttgatctggtgaaagacgttttcgcatcagccactgaacgagacatatacactggagatagattggaaattgtggtcatcaacagctctggcacacaccgagagtgcattgaactgaggaaggattagtgtaatgttcctgtgtaatcacactaccgttgttatgcatgaggatatttgttttttattgtcagatatctgtatttgaatttcctctaaacagaaagttgtattttgaatttccattctgttgattccagcaggagatggttataaagatattgtaattcattattttatacttatgatgagacaccttcttga

SEQ ID NO: 3656 - DNA, 1056 bp, Saccharum officinarum
tcccgagaagaactcgactcccgcggcggtgccggtgccggagccgcctataagcaaagctagagagcccccggttccccttccctgaccgcgcctcagaattttcagaagagatccgaccgccaccgaagcacacaagcagcgtcgccagggcgtgagggggggcaccagtaaatctcgggagcagaggcgatggcgaggttcgacccatacgagaacaacggcggcacgtgcgtggccgtcgccggcgccgactactgcgtcgtcgccgccgacacccgcctctccgtcggttacagcatcctgtcccgcgaccactccaagatcgcccagctggcagacaaatgtgttttggcctcgtctgggttccaaggtgatatcaaagctttgcagaaggctctgactgccaaggaattaatctatgaacacaacaataacaagaagatgagctgcccagcaatggctcaacttctgtcaaacacgctctactacaagagattcttcccatactatgctttcaatgtgttggccggactggacacccaaggtaaaggatgtgtctttacatacgatgctgttgggtcttatgagaggacaggttatagtgctcagggaacaggttcagcgttgatgatgcctgttcttgacaaccagttgaaatcccctagtcctctcctactgccagctcgggatgcagtgacacccttgtctgaatctgatgcagttgatctggtgaaggacgtttttgcatcagccactgaacgagacatctacactggagacagattggaaatcgttgtcatcaacagctctggcacacaccgagagtgcattgaattgaggaaggattagtgacttagtgtaatgttcctgtgtaatggcactaccgttgttatgcatgaggatatttattttcactatctgtatttgaatttgctctaaacagaaaggtgtatttgaatttccattctgttgattctagcaagagattattataaagatattgtaattcatcattttatctgatgtacttatgataagacaccttcttgagcc

SEQ ID NO: 3657 - DNA, 1007 bp, Musa acuminata
ctgcaatctcctgtcttgaggagaaagaaaccgagaccaaaaggcttcccctctctctctctctctctctctctctcatcaacggcgacatggctctccgccgcgattgggtatacgagaacaacggagggacgtgcgtcgcgatcgcgggatcggactactgcgtcatcgccgccgacaccaggctctccgtcggctacagcatctacacccgcgactactccaagatctgcaagctagcggacaagtgcgtgatggcgtcgtcgggcttccagggtgatctgaaggctttgcagaagaacttggcggcgaggcacttgatctatcaacatcagcacaacaaacagatgagctgccctgccatggctcagctcctgtccaatacactttactacaagcgattcttcccgtactacactttcaacatcctaggtggactcgacagtgatggaaagggttgtgttttcacatatgatgctgttggatcatatgagagagttgggtacagtgcccaaggcaccggtgcaggactcatcatacctgttttagacaaccagctcaaatctcccagtcctctattattgcctgccaaggatgcagtcacacctttgttggaatcagaggcagttgatttggtgaaggatgtgttcgcatcagcaactgaaagggatatatatactggagataaagtagaaattgttgttataaatgcttcgggcatccgacaagagttaatggagctgaggaaggactgaccaccggattgggaaaggggagctcgaacattttgtgcactgtgggatttatagctaatcttcgcttagctttcgactctacttggaaaccagtgtgttgtgtttttttgcttccagaactggaaacttggatgtctttgtggattcaaagattattggttattttcattagaatttttttttcttctgattttgcctgggcatgacttttaacttgatgatcaaagaaaagttgttttatgatcgaagaaa

SEQ ID NO: 3658 - DNA, 968 bp, Musa acuminata
ggagaccaaaaggcttcccctctctctgtctctctctctcatcaacggcgacatggctctccgccgcgattgggtatacgagaacaacggagggacgtgcgtcgcgatcgcgggatcggactactgcgtcatcgccgccgacaccaggctctccgtcggctacagcatctacacccgcgactactccaagatctgcaagctagcggacaagtgcgtgatggcatcgtcgggcttccagggtgatctgaaggctttgcagaagaacttggcggcgaggcacttgatctatcaacatcagcacaacaaacagatgagctgccctgccatggctcagctcctgtccaatacactttactacaagagattcttcccgtactacactttcaacatcctaggtggactcgacagtgatggaaagggttgtgttttcacatatgatgctgttggatcatatgagagagttgggtacagtgcccaaggcaccggtgcaggactcatcatacctgttttagacaaccagctgaaatctcccagtcctctattattgcctgccaaggatgcagtcacacctttgttggaatcagaggcagttgatttggtgaaggatgtgttcgcatcagcaactgaaagggatatatatactggagataaagtagaaattgttgttataaatgcttcgggcatccgacaagagttaatggagctgaggaaggactgaccaccggattgggaaaggggagctcgaacattttgtgcactgtgggatttatagctaatcttcgcttagctttcgactctacttggaaaccagtgtgttgtcttttgtttgcttccagaactggaaacttggatgtctttgtggattcaaagattattggttattttccttagaatttttttttcttctgattttgcctgggcatgacttttaacttgatgatcaaagaaaagttgttttatgatcgaag

SEQ ID NO: 3659 - DNA, 1060 bp, Phalaenopsis aphrodite
ggttccgtcctccttgcctctctctcgacttgcaggagaagaaaaaccatacgaacgagcaaatctgttcttagtgaaatccagaaatcatcagcccgcttctcccattccagctttaacgatggctctgagaggtgactgggtttacgagaacaacggaggtacatgcgtggcgatcgccggaaccgattactgtgtggtggccgcagacacccgtctttccgtcggatacagtatatacacacgcgactactctaagatctgcaagctagccgacaaatgtgtattggcatcttctggattccagggagatatgaaagccctgcagaagaatttggctgcaaagcaccttatatatcagcatcaacacaataaacaaatgagctgtcctgcaatggctcggcttctttcaaatactctttactataaaaggttcttcccttactatacattcaatattctaggtgggctggacaatgaagggaaaggttgtgtttattcatatgatgctgttggatcctatgagagggtggggtacagttgccaaggaacaggtggaacccttataatgccagttttagacaaccagctgaagtcccctagtcctttgttattacctgctagggatgctgtgacgccactctctgaatctgaggcagttgatctaatcaaagatgtttttgcatcagctacagaaagagatatatacactggagataagctagaaattatcattgttaatgcaacgggtatccgacaggagtttattgaactgaggaaggattagaaaaccagaggtgcagatctgctggaaatttggaagataaacatcctccaaccaaacttgaattaatcttccctttctattttgcctaaatatttaaatctcagcttatttccttagattcttactgcatcaagttgaggattttattggtgttttttctggttttgaaacatcactactgcagtgaaattttttttttccttttggctgtgagaattgtgttgcctcagatatttatttgtgatgaatgctattcaattttagcgctataaa

SEQ ID NO: 3660 - DNA, 1056 bp, Allium cepa
ggggatcagctcctggccgaagcgaccaccttccctcaacatcataaacgatcccagatactccaacaaactttcgcaaaccatttctttctacttcatttcatctacttcagttttcgagtatgggcgattgggtttatgaaaacaatggaggtacttgtgtcgcaattgctggattggattactgcgtggttgcagctgatactagattatcggttggatacagcatctatactcgtgattactcaaaaatctgccagctagccgagaaaagtgtcttggcgtcgtctggatgtcaatgtgatattaaagctttgcaaaagcacttgggttcaaagcacttgttatatcaacatcaacacaataaacagatgagctgccctgctatggctcaactattgtctaacacactttactataagcgcttctttccttactatgctttcaatgtacttggtggccttgacaatgaaggcaaaggttgtgtgtacacatatgatgctgttggctcttatgaaagagttggttatagtgctcaaggttctggttcaacactaatcatgcctgtcttggacaaccaactaaaatcccctagccctcttctgcttcctgctaaagacgccgtaacacctctatctgaaacagaagcagttgacatggtgaaagatgtatttgcttctgcaactgaaagagatatatacacgggagacaaggtagagattgtcatcattaatgcagcaggaatccgtcgcgaatatattgaattaaggaaagattagttttctttaattttgcttatgaccatgggtgtccattctgaacatttataaaacatttgaatcaatatggctctgttctgtttttaagtttatcggtaattttatggctgttgaattatgtttacattcagaatgtggtttgtactcatatattattatgcatcagttatcaacctcccgtttctgtgatacgtgtatttgtacaacctcccgtatctgtctggtagattgtttatttgtacttgcatttctagttgaagaatatgcttatgcaact

SEQ ID NO: 3661 - DNA, 955 bp, Secale cereale
gcgactccaccccgagcagcccgccctctccgaccaccgccatgtcgaggcgcggcgactgggtcgtacgagaacaacggcgggacctgcgtggccatcgccggcgcggactactgcgtggtcgccgccgacacccgcctctccgtcggatacaacatcctcacgcgcgagcactctaagatctgcgagctggccgataaatgtgtaatagcatcttctggcttccaaggtgacatcaaagctctacagaagaacttagctgccagagaactgctataccagcaccagcacaacaaaaggatgagctgcccagcaatggcacaattgctctccaataccctgtactacaagcgattcttcccatactatgctttcaacgtgcttggtgggcttgacagtgaagggaaaggatgtgtctactcctatgatgctgttgggtcctatgaaaggactggttacagtgctcagggatcagggtctaccttgatcatgccagtgctggacaaccagctgaaatcacctagtccactattagtccctgcaagagatgccgtcacccctttgtccgagtcagaggcggtcgacctagttaaggatgtctttgcatctgcaactgagagggacatctacaccggggacaaggtggagattgtagtcatcaacaaagctgggacgaggcgtgagtacatcgagttgaggaaggactaagtttgcgctgcggttgtcatttgtttccctagatatagggaattattatgcccagagctgctacttgatagaaaccccgtgcttgctttgcttccgtgatgatgtaccaggatcgacccagcttgctttgttaaactactttgttgtttcatgcatatgagatgctgagctatttgttggaaacgctaaaagtacgcccatagccattctatgataaccccagaataaatactctgaaaaaaaaaaa

SEQ ID NO: 3662 - DNA, 2307 bp, Amorphophallus konjac
cctgaagccgaactctccccgctcgacacggcacgccttcaccggtccccagctgagtcgcggcgccccaaattcgcgagcttgctgtcgtcggagtcgaaggcgcgcccccgttcgcggatatgggggctggtcgccgcagcctcgccttccgcagtggcggagctcgggggtgaagaaggtgggagtggggacgaggagtccatgagcatcgacttgctgcaccgcttcgtcgacctcaacattggcaagtggagcggatccttctatcaattcgatgcttacgggaatttacttcaaaaggtggtgacgagggtcgcagcgagctcatacggggaggacgagctgatcagtcttatccaaacgttatacataaaacagccaccttctagaacatttatttctgctcatgacgatgaatctgagtgggtggagtacaaaatcaaggagactaatatgtttactgcggacaaatatcagcagattacctttttcccaaatgagaaggcattttctttaaggtatcaaactgctggaatgctggaaactgtactgagagctggggtccttggtgaggatgacacgggggaagaatgtccaaggaatttgaagcttccttctctccgaccttccattgtatgtgagaattgcctttattcactggaaaaggatatccgagcaagggcctttcatatcatggacccaaagggtttccttgagatgtttcttattttccttgaagaaagaggagatgatacttcacttatctctttggatgactatctgaaggatgacacaaatacattgacatcacttcttggacgatgggagggccgctctgtaacgaaacgtagtggtgtttatggatctactattacagaagctgatataactgctttgctggaaatggatggcaagggccagcttgttcaggacataacatcaacaaccagaggaagcaacactgccaccaatgtcaactggactggcacgatatcaaacaacttgattacctttgatgggggttaccagatgacattactgcccggtggaatgtatatgggatgcccgtgtgatattgcaaatagtgtggcccatttacagtccttccatctcgagttctgctggatggaatctccgaaccgaaggcagagactggtgcgaacctacgatgctgaggggttggctgtctcatccacatatagtttggagaccaaagtataaagaatgtaatagaaaaagaaattttcacaattgagactgtttcaccctgcttaaagaatatttttttggaccaccaagaaaaacttctgaccattagcaaattctactgcttgtcgataaatggcaagcccaaaacattgtctactttaaattcatggtattcaaggatttaacagttcacatgcgaagcaaaccagttttcagaaatgacaaggaaaatcctcgaccaatagataaagtcatgagactactgtcaatctattggtcgagaaggcaggatgtagccaccagtatgatcctcacatgtagtacaacatcagcgggaggggaacaaaaatttaatctttcctgagctcaatgtactccctcctgatgcctgatgcatttatgatgactatttcaactttatctcccgtgtatatgtccctttcagtggcagatgcaaaaacatcttttaccaagtcgacagcttcggcttcagataatggtgtcacagcatccttggcgggcaacaggagtgggctaggagatttcagttggttatccaaaacgggtataactagagttgaaccagtgccttgggcactgtatccaaccctctcatatgatccaacagcatcatacgtgaagacacagccctttccttcactatcgaggcctcctagaatgttgaaggcatagtaaggaaagaatcgcttgtagtaaagtgtattggacaggagttgacccatcgcaggacagctcatttgtttgttgtgttggtgctggtagatcaaatgcctcgcagccaaattcttttgcagcgcttttatgtcagcttgaaatccagaggatgctaagacgcacttgtctgcaagctggcagatcttggagtagtcgcgggagaggatgctgtagcccgtggacatcctcgtgtcggcagccaccacgcagtaatccgcgcccgcgatcgcgacgcaggtccctccattgttgtcgtaggggttgaaccgcgagcccatcgccgatcgacgagagagagtattgagacgaagccgagacccaaacactgcaggttcgtatgattcgatgcttcggtgtttt

SEQ ID NO: 3663 - DNA, 1089 bp, Elaeis guineensis
ttcatctccttctccccaaaccaaccatggctttgagtcgcgactggatgtacgagaacaacggaggcacttgcgtggcgatcgcgggagcggactactgtgtggtggccgccgacacgaggctgtccattggatacagcatctacaccagggactattccaagatctgcaagctgacggagaaatgtgtgttggcatcttctggattccagggtgatataaaagctttgcaaaaaaatttggctgctaagcatttgatctatcagcatcaacacaacaaacaaatgagttgccccgcaatggctcaactcctctcaaataccctttatttcaaacgtttctttccatattatgctttcaatgttctagggggacttgacaatgaagggaagggctgtgtgttcacatatgatgctgttgggtcctatgagagggttgggtacagcgcccaaggctctgggtcaacactcgtcatgcctattttggacaaccaacttaaatcccctagtcctctcttattgcctgccagggatgctgtgacaccactatcggaagctgatgctgttgatatggtaaaagatgtttttgcatctgcaactgaaagagatatatacactggagacaaactagaaatagtcattctcaatgcatcaggcgtacggcgtgaatttatggatctcaggaaagactaatttcccataattgcgggctgctgttgtgacctagctggcggagctgggggtggtccttcccaggtcatcatcatggtggagccatgctccttccatggtgatcgcccatatttagcctttgttatccctcaaaaatctttcagaccaactaatgttatgcatgtttatatgaacaaggcctgattttagtctttggtattggcattttatcaacttttaatccttccctttacccttctgcatggcctgccttcgggattttgtatttaaaggttgaactatattatcacaggcttccaattcattctcaaagagatcacagatggttatgctctgccacaactgtgagaagttggcgtgcgtaaggtttgatattagtatctggaggttgcccaaa

SEQ ID NO: 3664 - DNA, 1035 bp, Zostera marina
accctaacacttcccattccggcgatctgaaaccaccatcgtcgctacgtctctatcttttgcctgtttctgctagcatctttctcatataaatgggttcccgatggtctccgtatgacaacaacggcggtacctgtgtggcgatcgccggtgcaaactattgtgttgtggcagcagacactcggatgtcaactggttacagtattctcactcgcgaatactccaagacctgcaaattagctgataagtgtgtattggcttcttcgggattccaggctgatgtgagagctctgcagaagaatctttctgccaaacacttgttctatcagcatcagcataacaagcaaatgagttgccctgcaatgggtcagcttctgtccaataccctgtattacaaacgtttcttcccttactatgcattcaatgtattaggtggtctcgataatgaaggaaagggttgtgttttcacatatgatgctgttggatcgtatgaaagggttggatacagtacccaaggtagcggttcaagtcttatcatgccagttttagacaaccaactaaaatcacctagtccacttttactgccggctaaggatgccataacccctttatctgaatcagaagctgttgatttggtcaaagacgtgtttgcatcagcaaccgaaagagatatctacactggagacaaagttgagatagtcatcattaatgacgtaggcatccgcagggagtatattgatctgagaaaagactaatgctgtgtcccctccctctttgagctcgatatattttgggaattctgaattttagcatgtttccatatttaattgggaatggtgttctttcttttattccttgcatgaacttaaattgtggaattttagctatttttagttgaataaaaacttagaatgtgactcgataattctgcgtttctactttctgtttcgaaagcaatttcaatattttatattgaattcattttgcaatattataatttataaatcaaggttatctattaagtttaacaatacc

SEQ ID NO: 3665 - DNA, 1043 bp, Aquilegia formosa
gcttcacagtcttcttttcttcttctaaatcttccttcaacactcaatttctcgttcgatctaatcaatcatggctcgcttttctccttacgataacaatggcggaacatgtgtggccatcgctggagcagattactgtgttatcgcagcagatactcgaatgtcaactggttacagtattctaactcgagattactctaagatttgcaaattggcagataaatgtcttttggcttcctctggatttcaagctgatgtcagagctctgcagaaagtgttgtcctccaggcacttggtctatcagcatcaacacaacaagcagatgagctgccctgcaatgggccaacttctgtccaatactctctactataaacgttttttcccttactatgctttcaatgtcctaggtggtcttgatagtgaaggtaagggttgtgtttttacatatgatgctgttggatcctatgaaagggtcggatacagcgcacagggatctggttctacgctcatcatgcctgtgttggacaatcaattgaaatctcctagtcctctcctattacctgccaaggatgctgtcactccattgtcggagaacgaagcagtagatttggtaaaagatgttttcgcatctgcaactgaaagagatatatacactggcgacagggtcgaaattgtcattgtaaacgcagaaggaatccgtcgtgagtatatcgaacttagaaaggactgatatctgttccaatggtaactcatgataagaagtgtattaaaaagactgatgcagtgttttgacattcccgtgatcccatcagttgctactgtctagattcgaaagagagcaagatctcagagaatttgtctatcttttcagttgaatgttgtttcaatatttggttattaacatctgcacttgcaatgactgccttgaacatgaaactacagaaattttaaattgtcaatgtgtaattttttttgtattcttagatatgtttgtggacacaaatcatatttaatcaggcagtgaggcagatagttgaagtttt

SEQ ID NO: 3666 - DNA, 1002 bp, Aquilegia formosa
gcttcacagtcttcttttcttcttctaaatcttccttcaacactcaatttctcgttcgatctaatcaatcatggctcgcttttctccttacgataacaatggcggaacatgtgtggccatcgctggagcagattactgtgttatcgcagcagatactcgaatgtcaactggttacagtattctaactcgagattactctaagatttgcaaattggcagataaatgtcttttggcttcctctggatttcaagctgatgtcagagctctgcagaaagtgttgtcctccaggcacttggtctatcagcatcaacacaacaagcagatgagctgccctgcaatgggccaacttctgtccaatactctctactataaacgttttttcccttactatgctttcaatgtcctaggtggtcttgatagtgaaggtaagggttgtgtttttacatatgatgctgttggatcctatgaaagggtcggatacagcgcacagggatctggttctgcgctcatcatgcctgttttggacaatcaattgaaatctcctagtcctctcctattacctgccaaggatgctgtcactccattgtcggagaacgaagcagtagatttggtaaaagatgttttcgcatctgcaactgaaagagatatatacactggcgacagggtcgaaattgtcattgtaaacgcagaaggaattcgtcgtgagtatatcgaacttagaaaggactgatatctgttccaatggtaactcatgataagaagtgtattaaaaagactgatgcagtgttttgacattcctgtgatcccatcagttgctactgtctagatttgaaagagagcaagatctcagagaatttgtctatcttttcagttgaatgttgtttcaatatttggttattaacatctgcacttgcaatgactgccttgaacatgaaactacagaaattttaaattgtcaatgtgtaattttttttgtattcttagatatgtttgtggacacaa

SEQ ID NO: 3667 - DNA, 1308 bp, Cephalotaxus harringtonia
gttttgtttcagaggaagagtgcgtgaaagcaggttcctcgatatcgcggatcgatccgttagcgtgaattagccactgttcggaagcaagccggtcgagccacacctttcctctgctattacccggctgtcgccgcagatcactatactcttacagccacttacacttgtcggcagaagctgctattccaaacacgaaatgggtgccacagaagggatgagccagcatcagtctacatggagcccttatgacaataatggaggaacttgtgtcgcaatagcaggggccaattactgtgtagttgccgcagacacaagaatgtcgactggctatagcattctcacaagggattactctaagatttgcgaactagcagataaatgtgtacttgcatcttcaggatttcaagctgatgtaaaggcattgcagaaaaatttatctgctagacatctgatttatcagcatcagcataacaagcaaatgagctgtcctgccatggcacaacttctttcaaatactctttactacaagcgatttttcccatattatgctttcaacgttttaggtggcctagacagtgaaggaaaaggctgtgtttttacatacgatgcagttggctcatatgaaagagtaggctatggatcacaggggactggatcaacacttatgatgcctgttcttgacaatcagcttaaatcccccagtcctctgctcttgccggttaaagatgctacaactcccctatctgaatctgaagcagtcgatttggtgaaggatatatttgcttcagctacagaaagagacatatacactggtgatggactagaaatagtagttgtcaatgcaggaggcatcagacgggaagagattatgaagttgcgatatgattaatttaatctcactgctgaattagttgcacaactagttatatgttttcactatttgtgcatatctattgaagtcaacttgaaatcccgtaaagtgatagcctatattaaagaaatactgttattactctgaaaactggtgtttcaattcattcaacttggtctgggactgttattttgagtttttgtattccttatttccgcaacttattgaagaaagatacaatttttggtgttagtatatgccttaaaagaaactaagtgattcatctagggataccatcttggctgtttcctcagggcactgggctgaacattgtagttgtctatgcagaaggcatcaaatgtgtttgtgggttagtttcaagtgattgatctaatttctattaataatttttattgatctaatttctattaaaa

SEQ ID NO: 3668 - DNA, 1151 bp, Cryptomeria japonica
  misc_feature (612)..(612): n is a, c, g, or t
ggtgatcggtattttttttgggaaagggaaattttggatttagattgccaggggaagattggagataggagaattgcagaggagttttttttggctggcgagaggattggaggatttgttttcagtttcctgggaagtgtgtttggagaaatgggtgctacagaagtgatcacgcaacgacagtctacatggagtccttacgacaacaacggaggaacttgtgttgcaatagcgggggccaattactgcgtaattgcggcagatagaagaatgtcaactggctatagcattctcacaagggattactctaagatttgcaaacttgcagataaatgtgtacttgcatcttcaggattccaagctgatataaaggcattgcaaaaaaacttatctgctagacatctgatttatcagcatcagcataacaagcaaatgagttgccctgccatggcacagctgctctcgaacactctttactacaaacgatttttcccatactattctttcaatgttttaggtggtctagacagtgaaggaaaaggctgtgtttacacatatgatgcagttggctcatatgaacgagtaggctatggatctcaggggactggctcnacacttatgatgcctgttcttgacaatcagcttaaatccccaagtcctcttctcttgccagctaaggatgctacaacacccctgtcagaatctgaagcagtcgatttggtgaaggatatttttgcttcagctaccgaaagagacatatacactggtgatggactagaaatagtagttgtgaatgcggaaggcatcagacgagaagagattatggagttgcgaaaagattaatttcaccgccaaatttggtgcattattagttatattttaaactaattgtgaatttctgttgaatatttgaatctgcattaactgatattcatttgagagatacaaatatcatattatttgttgcaaaattgcgtgtttcagtacactcgatctgagatatctattgaagttttgtactcctgcaacttattgaacaaaatgacatataattttggcgattagtacagtgtgttaaaagaaacaaagtaattatctatggatactatattgggtgttttctcagggcactctgcctgaaactttttaag

SEQ ID NO: 3669 - DNA, 1105 bp, Manihot esculenta
atggttttcttgatgctaaagacagatagatccgtgaaataaaagaaccagcaaggcaagccttgaaagcttgaagcttttttctgcaatttcgttgccctgtctttcatcttatatttgaatccccgtttttgctctgtacttgatgactaagcaacaagctaactggtctccatacgataacaatggaggatcttgtgttgcgattgctggcgccgattactgtgttatcgccgccgacactcgaatgtccactggctacagtattctcacccgggagtactccaaaatctgtaaactagctgacaaaagtgtaatggcatcttctggctttcaagctgatgtgaaagccctacaaaagcatttggcagctaggcacttgatctatcaacatcaacacaacaagcaaatgagctgtcctgccatggctcaactactctccaatactctctactataagcgcttctttccctactatgcttttaatgttctaggtggccttgatagtgaaggaaagggctgtgtctacacttatgatgctgttggttcctatgagagggttggatatagtgctcagggttctggttccactcttatcatgccatttctggataaccaactgaagtctcccagccccctcttattgcctgcccaggatgctgtaactccactttcagaactggaagctgttgacttggtgaaaactgtttttgcatctgcaactgagagggatatatacactggggataagcttgaaattgtcgtcctaaatgctgatggtattcgtcgggaatatatggaactcagaaaagattgagctggccaaaaatcttgtttgtcttgtcataagttgcttgaggaaatgcctggatcaccctttggtacacttgtcatgtttgatgtttcagctgtttaagcattttcatcctgttgatcggtaacttttaaattagcataacttgaacaaatatattttctagtgtagattttcaccaatgacgcaattcatgtcttggaacatatgtggttgcattttgatcggctagtttgaaaattttatggcctgtaagtaagaatttaatgaatgaagtccttattgcaccac

SEQ ID NO: 3670 - DNA, 1373 bp, Citrus sinensis
aaaactacgttagtttatagctctcgtttcttgttctcaaagccactcttagatctaaaacactgaaaacgaacccaaattcatattatccaaatttcaaaccctaattgatcacaattcatcatgacgaagcagcatcctgcatggtctccatacgacaacaatggaggaacttgtgttgcgattgctggtgctgattactgtgtaatcgctgccgacactcgaatgtcaaccggttacagtatcctcactcgcgattactccaaaatctgtaaactggcagacaaatgtgttatggcctcttctggttttcaagctgatgtgaaagccttacaaaaactcttggcagcaaggcacttgatctatcagcatcagcacaacaagcaaatgagctgccctggaatggctcaactactctccaacaccctgtactacaagcgtttctttccttactattcatttaatgtcttgggtgggcttgacaatgaagggaagggttgtgtctacacatatgatgctgttggttcctatgagagggttggatatagctcccaaggttctgggtccacgctcatcatgccattcctggataaccaactaaagtctcccagtcctctcctactgcctgcccaggatgctgttactcctctttcagaggctgaagcagttgatttggtcaaaacttgttttgcatcagcaactgagagagacatatacacgggagacaaacttgaaattgttgtcctaaacaaaggtggtattcatcgtgaatacatggaactgaggaaggattaatctctttggcatcatgccacgctcgtcaagctgaagtgggtggagctgccacgagcaaaatttcagtgttcttatgttgtcatggtttcacattttgatatgaatccagtttgatatgtctttccttgctagtggatatgttgcggtgatgatgccaataggagacattagtttcttctactctaacattagatctggtgttattgtcgttgaggataaattgtatatttggtattcaaattacatctggtgtgcatctatattttgatgttatatttgctctgtatttcaacaaatgatagcagcgctccagtttcagttaaggattgcaagtttcaggcaagtgatatggccttaattttatgagttttatagttgatgaaacttgatggctctttcctggtaacaggaggctatttgagaataacatctttcataaatgttgaacaatgaggtaaatcgttcatttcatatttccctgttctgaatacgtatgtcaaattgcaaaacaataatggcacttcctattctattgtgcacattttcttgtgaataaacattttgattttagcagagta

SEQ ID NO: 3671 - DNA, 1399 bp, Citrus clementina
aacagagcctcaaatagaaacttactatcatactctcacccaaaaactacgttagtttacagctctcgtttcttgttctcaaagccactcttagatctaaaacactgaaaacgaacccaaattcatattatccaaatttcaaaccctaattgatcacaattcatcatgacgaagcagcatcctgcatggtctccatacgacaacaatggaggaacttgtgttgcgattgctggtgctgattactgtgtaatcgctgccgacactcgaatgtcaaccggttacagtatcctcactcgcgattactccaaaatctgtaaactggcagacaaatgtgttatggcctcttctggttttcaagctgatgtgaaagccttacaaaaactcttggcagcaaggcacttgatctatcagcatcagcacaacaagcaaatgagctgccctggaatggctcaactactctccaacaccctgtactacaagcgtttctttccttactattcatttaatgtcttgggtgggcttgacaatgaagggaagggttgtgtctacacatatgatgctgttggttcctatgagagggttggatatagctcccaaggttctgggtccacgctcatcatgccattcctggataaccaactaaagtctcccagtcctctcctactgcctgcccaggatgctgttactcctctttcagaggctgaagcagttgatttggtcaaaacttgttttgcatcagcaactgagagagacatatacacgggagacaaacttgaaattgttgtcctaaacaaaggtggtattcatcgtgaatacatggaactgaggaaggattaatctctttggcatcatgccacgctcgtcaagctgaagtgggtggagctgccacgagcaaaatttcagtgttcttatgttgtcatggtttcacattttgatatgaatccagtttgatatgtctttccttgctagtggatatgttgcggtgatgatgccaataggagacattagtttcttctactctaacattagatctggtgttattgtcgttgaggataaattgtatatttggtattcaaattacatctggtgtgcatctatattttgatgttatatttgctctgtatttcaacaaatgatagcagcgctccagtttcagttaaggattgcaagtttcaggcaagtgatatggccataattttatgagttttatagttgatgaaacttgatggctctttcctggtaacaggatgctatttgagaataacatctttcataaatgttgaacaatgaggtaaatcgtccatttcatatctccctgatctgaatacgtatgtcaaattgtacttcctattctattgtgcacattttcttgtgaataaacattttgattttagcagag

SEQ ID NO: 3672 - DNA, 1399 bp, Citrus sinensis
aacagagcctcaaatagaaacttactatcatactctcacccaaaaactacgttagtttacagctctcgtttcttgttctcaaagccactcttagatctaaaacactgaaaacgaacccaaattcatattatccaaatttcaaaccctaattgatcacaattcatcatgacgaagcagcatcctgcatggtctccatacgacaacaatggaggaacttgtgttgcgattgctggtgctgattactgtgtaatcgctgccgacactcgaatgtcaaccggttacagtatcctcactcgcgattactccaaaatctgtaaactggcagacaaatgtgttatggcctcttctggttttcaagctgatgtgaaagccttacaaaaactcttggcagcaaggcacttgatctatcagcatcagcacaacaagcaaatgagctgccctggaatggctcaactactctccaacaccctgtactacaagcgtttctttccttactattcatttaatgtcttgggtgggcttgacaatgaagggaagggttgtgtctacacatatgatgctgttggttcctatgagagggttggatatagctcccaaggttctgggtccacgctcatcatgccattcctggataaccaactaaagtctcccagtcctctcctactgcctgcccaggatgctgttactcctctttcagaggctgaagcagttgatttggtcaaaacttgttttgcatcagcaactgagagagacatatacacgggagacaaacttgaaattgttgtcctaaacaaaggtggtattcatcgtgaatacatggaactgaggaaggattaatctctttggcatcatgccacgctcgtcaagctgaagtgggtggagctgccatgagcaaaatttcagtgttcttatgttgtcatggtttcacattttgatatgaatccagtttgatatgtctttccttgctagtggatatgttgcggtgatgatgccaataggagagattagtttcttctactctaacattagatctggtgttattgtcgttgaggataaattgtatatttggtattcaaattacatctggtgtgcatctatattttgatgttatatttgctctgtatttcaacaaatgatagcagcgctccagtttcagttaaggattgcaagtttcaggcaagtgatatggccataattttatgagttttatagttgatgaaacttgatggctctttcctggtaacaggatgctatttgagaataacatctttcataaatgttgaacaatgaggtaaatcgtccatttcatatctccctgatctgaatacgtatgtcaaattgtacttcctattctattgtgcacattttcttgtgaataaacattttgattttagcagag

SEQ ID NO: 3673 - DNA, 992 bp, Prunus persica
ctccacgccctaaatttgctcctctctctctctctctctctctctctctctctctctctctcactgacccagacggattcaccatgaccaagcagcatgctaactggtccccctacgacaacaatggcggatcctgtgtcgctattgcgggagccaattactgtgtgattgcggccgatactcggatgtcgactggttacagtattctcacccgcgactattctaagatctgcaaattagcagacaaagctgtattagcctcgtctggttttcaagctgatgtgaaagcgttgcaaaagcatttggctgctaagcacttgatctatcagcatcaacataacaaacaaatgagctgccctgcaatggctcaactactttccaacaccctttactacaaacgcttctttccctactatgctttcaatgttttgggtggtttagatagtgaaggtaagggctgtgtcttcacatatgatgctgttggttcctacgagagggttggatatagctcccaaggttccgggtctacactcatcataccctttttagataatcagttgaagtcacctagccctctcttattgcctgccgtggatgccgttacaccactttctgaagcagaggcaatagatttggttaaaactgtttttgcatcagcaacagagagagatatatacactggtgacaggcttgaaattgtcgttctaaatgctgatggcactcggtatgagtacatggaactgaggaaagattgatgcctaccccggaccatgctgccggttttgaccagagctgaaaatgttatctattccaggtctctgtgtaggtcatatctcgaaatggcttgtttattacgttgcaaagtttcagtttgtactcaacttcccctattacggtgaaacatttaaagcagtaaacagtcgagaaccatttctgtactgatattttctttgtgaacaaagtaagttatccacccctgcaccatttctttt

SEQ ID NO: 3674 - DNA, 850 bp, Nuphar advena
  misc_feature (90)..(90): n is a, c, g, or t
  misc_feature (402)..(402): n is a, c, g, or t
  misc_feature (408)..(408): n is a, c, g, or t
  misc_feature (501)..(501): n is a, c, g, or t
  misc_feature (507)..(507): n is a, c, g, or t
  misc_feature (648)..(648): n is a, c, g, or t
  misc_feature (651)..(651): n is a, c, g, or t
cacaaaagcgaagcagagcacctctctctctcaaaaatggcgccggtcgaagtcgcgaagcagcaagcgaactggagcccttacgataanaatggagggacgtgcgtcgcgatcgcggggttggattactgcgtcgtcgccgcggacacgaggatgtcgacgggctacagcatcctcacccgcgactactccaagatctcccaattagctgaaaaatctgtgatggcctcttctggattccaggcagatgttaaagctcttcagaaaaacctggctgctagacactctatatatcaacatcaacataacaaacaaatgagctgccctgcaatggctcagcttttgtctaatacactctactacaaacgtttcttcccctactatgcttttaatgtcttgggnggcctngatactgaaggaaaaggctgtgttttcacatatgatgctgttggctcctatgaacgagttgggtacagtgcccagggttctggctcgacgctngtaatncctgttttggataaccagttgaagtctcctagtcctttgctgttgcctccgagggatgctgtaactcctctgtcggaatctgaagcagttgatttggtgaaggatgtttttgcttctgctgctgaaagagacatttacacnggngaccgggtagagattgccgtcataaatgcatcgggcattcgccgtgaatacattgagcttaggaaagattaattgttgtggattgttatcttaactgacatacccatgtattctcttgctctcttgttaaacttttgtagacaaatgagagcactattaaaccctttttttttttgaaaaatacttatagttttagaat

SEQ ID NO: 3675 - DNA, 654 bp, Musa acuminata
gaacgacaagaagaagaacatcaagatggctctgcgccgcgactgggtgtacgagaacaacggaggaacgtgcgtcgcgatcgcgggaacggactactgcgtgatcgccgccgacacgaggctttccgtcggctacagcatctacacccgcgattactccaagatctgcaaactagcggacaagtgcgtgatggcatcttcgggcttccagggtgatctaaaggctctgcagaagaacttggcggcgaggcacctgatctatcagcatcagcacaacaaacaaatgagctgtcctgccatggctcagcttctgtcaaataccctttactacaagcggtttttcccctactatactttcaacatcctaggtggacttgacagtgatggaaagggctgtgtctacacatatgatgcagttggatcttacgagagagtcggatacagtgcccaaggcacgggtgcaggactcatcattcctgttctggacaaccagcttaagtctccaagtcctctactattacctgccaaggatgccgtcacacctttgtcggaaacagaggcagtcgatttggtgaaagatgtttttgcatcagcgactgagagagacatatatactggagataaagtggaaatcatggttataaatgcatcagt

SEQ ID NO: 3676 - DNA, 801 bp, Allium cepa
  misc_feature (679)..(679): n is a, c, g, or t
  misc_feature (681)..(681): n is a, c, g, or t
  misc_feature (685)..(685): n is a, c, g, or t
  misc_feature (766)..(766): n is a, c, g, or t
ctttctacttcatttcatctacttcagttttcgagtatgggcgattgggtttatgaaaacaatggaggtacttgtgtcgcaattgctggattggattactgcgtggttgcagctgatactagattatcggttggatacagcatctatactcgtgattactcaaaaatctgccagctagccgagaaaagtgtcttggcgtcgtctggatgtcaatgtgatattaaagctttgcaaaagcacttgggttcaaagcacttgttatatcaacatcaacacaataaacagatgagctgccctgctatggctcaactattgtctaacacactttactataagcgcttctttccttactatgctttcaatgtacttggtggccttgacaatgaaggcaaaggttgtgtgtacacatatgatgctgttggctcttatgaaagagttggttatagtgctcaaggttctggttcaacactaatcatgcctgtcttggacaaccaactaaaatcccctagccctcttctgcttcctgctaaagacgccgtaacacctctatctgaaacagaagcagttgacatggtgaaagatgtatttgcttctgcaactgaaagagatatatacacgggagacaaggtagagattgtcatcattaatgcagcaggaatccgtcgcgaatatattgaantnaggnaagattagttttctttaattttgctatgaccatgggtgtccattctgacatttataaacatttgaatcatatggctctgtnctgtttttagttatcggtaatttatggctgtgaat

SEQ ID NO: 3677 - DNA, 1744 bp, Aristolochia fimbriata
tggaaattaaaaacttttagcgagcgaccctggcactccaagttgcaggaactctttaagggcattaagattggattcattcgaagaggccagaagactgagaagggtgacacttaatcaaattgaacgaccttttgtttccttgcaaaccctagatcctttctacttcttctttgatcgatggctcacaaggaacacgcgaaatggtctccttacgataacaatggagggacgtgtgtggcggttgcaggcgccgattactgtgttatcgccgcagacacgcgaatgtcgacaggttacaacatcctcacacgtgattactccaaaatatgcaagctagcggataagtgtttgttggcttcctcaggatttcaggctgatattagagctttacaaaagaatttagctgccaaacacttgatctatcagcatcaacataacaagcagatgagctgccctgctatggctcagctgctgtccaatactctgtattacaaaagatttttcccttattatgctttcaatgtgctgggaggcctggataatgaaggaaagggctgtgtttttacatatgatgctgtgggatcatatgagagagttggatatagctcccaaggttctggttctaccctcatgatgcctgtcttagacaaccaactgaaatcaccaagtcccctcttgctacctgcaaaggatgctgttactcctctttcagaatctgaggcagttgatcttgtaaaagatgtttttgcatctgcggctgaaagggatatttatactggtgatggactagaaatagttgttgtaaatgctgggggcattcgccgtgagtacgttgagctaagaaaagattagtttagtctctatgcttgatggctacttgtgctcaaacattgcttcatttgtcacaactactgtattatcaagttttaatactcatactccaagaaactggcaccagaaatgtataaacgtttacatattctgctgtcaaagaagaacaaaatctcagaaatgccatgacagaatcaattattatgcactctcgtgaaattcagtatattttacggaagcaagccgtcacactgcaaaattcaactgttgctgtgtgaaacatgaaatgtttttgagtactcgtgcggaatttattctcatcatgtgtgtctacaaattgtgggaatgaataagggtaatgcaggactgaatagttatgaatggaaattctaaataaatactaaataagacaatgaaaaatgaagtttatcataatggatgagtatttatatgagctgcatacatgtaggtgacaccttagtatttatttcatttagaacagattatgacagttatgcccttgcataacgattttaaatatgcatgaagaaagcttatgatgcagtcattcttctagcaacttgttcctttgtcattggacttggtaggatgatgggatattagggatggtggcagggtttggaacctgccctggatggttttcagggtgggacatgggtgggttctgattttccaaaatgagaccgtgatccgacccaaccagattcattgtcattaccattgccttctccactacgggtaaaattattagtgaagttaggcgctgagattatttgattaatgctgcatcccactgtcttcttgcttgcttattgttgtataatcttaaaatgagttatttcttgttacaagtgatactttcagtggtaaaagctgtgttttctttcag

SEQ ID NO: 3678 - DNA, 1322 bp, Cephalotaxus harringtonia
ggcgtttctatgggaggaagcccttcctgttttcgttagcaccacatatgtgtaatgatccgtggatttagtattggttttgtttcagaggaagagtgggtgaaaagaggttcctcgatatcgcggatcgatccgttagggtgaattagccagccactgttcggaagcaggccggtcgagtcacacctattccctgctattacccggctgccgccgcagatcaatatactcttaccgccacttccacttgtcggcagaagcagctattccaaacacgaaatgggtgccacagaagggatgaggcagcatcagtctacatggagcccttatgacaataatggaggaacttgtgtcgcaatagcaggggccaattactgtgtagttgctgcagacacaagaatgtcgactggctatagcattctcacaagggattactctaagatttgcgaactagcagataaatgtgtacttgcatcttcaggatttcaagctgatgtaaaggcattgcagaaaaatttatctgctagacatctgatttatcagcatcagcataacaagcaaatgagctgtcctgccatggcacaacttctttcaaatactctttactacaaacgatttttcccatactatgctttcaatgttttaggtggcctagacagtgaaggaaaaggctgtgtttttacatacgatgcagttggctcatatgaaagagtaggctatggatcacaggggactggatcaacacttatgatgcctgttcttgacaatcagcttaaatcccccagtcctctgctcttgccagttaaagatgctacaactcccctatcagaatctgaagcagttgatttggtgaaggatatttttgcttcagctacagaaagagacatatacactggtgatggactagaaatagtagttgtcaatgcaggaggcatcagacgggaagagattatgaagttgcgatatgattaatttgatcgcactgctgaattagttgcacaactagttatatgttttactttcactatttgtgcatttctattgaagtcaacttgaaaccacatgaagtgatagcctttatcaaagaaatactgttattactctgaaaattggtgtttcaattcattcaacttggtctgggactgttattctgagtttctgtattccttatttctgcaacttattgaagaaagatacaaatttttggtgttagtatatgccttaaaagaaactaagtgattcatctagggataccatcttgggtgtttcctcagggcactgggctgaacattgtagttgtctatgcagaaggcatcaagtgt

SEQ ID NO: 3679 - DNA, 1033 bp, Momordica charantia
aagaaaagaagaagcgaggaagctaaaaccagagctaagtttttaagccttcgctttgccaagttcctcttccctcacacgccttcgctttcatctgccctattcgccatgacgaagcagcacgccaactggtccccttacgacaacaatggcggatcgtgtgttgcgattgccggtgccgattattgcgtaatcgccgccgatactcggatgtctacgggttacaatatccttactcgcgattactccaaaatttgcaagctggctgataaagctgtgatggcctcttctggttttcaagctgatgtgaaagctctacaaaaggttttggcggctaggcatttgacctaccaacatcagcacaacaagcaaatgagctgccctgccatggctcaactactctcaaacacattgtactacaagcgattctttccgtattatgcttttaacgttttgggcggacttgataatgaaggaaagggctgtgtgttcacctatgatgctgttggttcttatgagagagtcggatacagcgcccagggttctggttccaccctcattactccctttttggataaccagcttaagtctcccagccctctattattgcctgcacaggatgctgcaacgccactttcagaagccgaagcaattgacctggtgaaaaccgtttttgcatctgcaactgagagggatatctacactggcgacaaactcgaaatcgttgttcttaatgctgatggtcttcgtcgtgaatacatggatctccgaaaagattagtttgatgctggcttgatagatccgatgttgcttcaaccgtatgaactgcgccacgggcggtacttgtcccagagactattgcattgtgatatttacggatggttaagttttagttttctctgtaatatgaactccatttccaaattaaaatctctgttgtgaacatgggattgtactgaaatctacatggctgatgttgatcgatctcccttttaggctaagaaaaaaaaagaaaaaacaaacatgtcggccg

SEQ ID NO: 3680 - DNA, 2286 bp, Quercus alba
aaaaaagctcgattcgagcaattagcctttagttcctcctcgccctaagttgagttcttcatctctctcactcttctctgcttcttcaaattaccaatcaaccatgaccaagcaacaagctaactggtctccatacgacaacaatggcggatcctgcgttgcgatcgccggagccgattactgtgtaatcgccgccgatactcgcatgtcctccggttacaatattctcacccgcgagtactccaaaatctgcaaattagcagacaaagctgtaatggcctcttctggttttcaagctgatgtgaatgctttacagaagcacttggcagccaggcacttgacctatcagcaccaacacaacaagcagatgagctgccctgcaatggctcagctgctctccaacaccctctactataaacgtttctttccttattatgccttcaatgttttaggtggtcttgacagtgaaggcaagggttgtgtcttcacctatgatgctgttggttcctatgagagagttggatattcttcccaaggttctggttccacgctcatcatgccctttctggataaccagctgaagtctcccagccctctgttattgccagctcaggatgctgttactccactttctgaatcagaagcagttgatttggttaaaactgtttttgcatctgcaactgagagggatatatacactggagacaagcttgaaattgttgttctaaatgctggaggtattcatcgtgaatacatggaactcaggaaagactgatttctgtactgaactgtcctgctggtctttccaaagaagaatgctgaaactgtatgaactggcctttgagtagagagttctcatgactcatcaattaagctttagcttttcaacgacaatttgattaattgcatttcctagcggaattgttgcagctgtgatgcctcttttggacacaagtctcctgtactagactatgttaatatttatattcagtttactttatcccaagttagacgtttaagtctgacaccatgggaaaaaggatgtggtaatgatttatgaatgatgaatctctttagttttctgtttgaggaaatattaatttcatttatctgcttacatgatgtgtcgaagagaacctgattggcattcagacgcccatcacccctgttatcattgcacaaaagcatctgttactgacattcattcttcaagtgttaggtgcctgttgttatagttgtatatcatgcacatggtctttatgataacaaacttatctgtcttggaacttcataaaatttaatttcttctattctttatttcaggagagatcaaatctctgttacttttgaagctctgcagccttggctgaaagagttttgctggttgtacaattacaataaagaatgataaaaattcttctgatctagtctattaaagatcatcaccacatgattataggctgtttttttagaagtgaaggtacaatgttgttatgattaattcttctggtatgagaaaaaatccctcaaaagctgtcttcagaagcccatcctttcttctctaactctagtcgcaatgccttgattctctttttattgtaatcaaaatcatagtttcctagccgtgatgcagatcgatactccactattgagttcttgcccggtggaaaccagaattcaacatcatccaccaaccccagtatggggctctcatattcgactcgcacataatcatctttcttctccgctatccgcggtgtaaacttgtcgggttttgttgattctatcacttggataagctcctccattgcctcttctctgctcacagccttttttctttccgcggttgtagttccagggtggggcataatgggtgagatcaccgacactctcggacgttgatatacagtttttggtagccggacatagtgctagtgcaggtgggtttttctgaactcccaagtactcaggctttttcccaccgaagttgaagatggctccaacaactgctaattcgctgctccttagtacgatttcccttcggccaacttggtcagtactgggtttgtgaggctgttcttcttgagattgagaaacaatgatagtacgtgaagggatagaaaccttgcaagatttcttgtgattcttaaagaaataatgggtgcttggtgttgttgatgccattgaagccatttgttaaaacctcaaaaactctagaacttttctctctttcgctctcgctctctccttttttggaagtgcgtctctctttctctccgatcccat

SEQ ID NO: 3681 - DNA, 932 bp, Tripterygium wilfordii
cgcttccgttcgattcgccatgacaaagcagcaagctaattggtctccctacgacaacaatggaggatctgttgttgcgattgctggggctgattattgtgtagtcgcagcggatacaagaatgtcaaccggttacagtattctgactcgcgaatactcaaaaatctgtcaattagcggataagtcttttttggcttcttcaggatttcaagctgatgtgagagccctacagaaacagttagctgccaggcacttgatatatcaacatcaacacaacaagcaaatgagctgccctgcaatggcgcaactactctctaacaccttatactacaaacgtttcttcccgtactatgcttttaacgtattaggtggtcttgataatgaaggtaagggttgtgtcttcacttatgatgctgttggttcctatgagagggttggatatagctcgcaaggttctggttccacactcattatcccctttttggacaatcaattgaagtctcccagtccactcctcttgcctgcacaggatgctgtaactccactctcagaagctgaagcaattgatttggtcaaaactgtttttgcctctgcaactgagagagatatatacacaggagacaagctggaaattgttatcctaaatgctgctggtactcgtcgtgagtatatggaactccgtaaagattgatctattcgaggaaacctgctgcagatgttgtgtggcagaatacgtagaattgcatgaagtcatttggtagggaattctatggatggttattcgtgtttttatgtcttatggattgcaatgtagcttttaaaggaatgcttttgagctgctgcttttcctgctgtatggaaaatgtagtatatgctgcttgtaatttagaccttgcagttaactttgttggtactattaaacatttaacgat

SEQ ID NO: 3682 - DNA, 1176 bp, Taxus baccata
tataagattgtttccattttcgtagggtctctaataggattttcgtagtatattttgttcatcacagccgcgagaggcttttcagtttcacacgtacattgaaatttttggttaaattatttgcagaaatgggtgccacagaagggatcagccagcatcagtctacatggagcccttatgacaacaatggaggaacttgcgttgcaatagcgggggccaattactgtgtaatagcagcagatacaagaatgtcaaccggctatagcattctcacaagggattactctaagatttgccaactagcagacaaatgtgtacttgcatcttcaggatttcaagctgatgtaaaggcattgcagaaaaatttatctgctaggcatcttatttatcagcatcaacataacaagcaaatgagctgtcctgccatggcgcaactcctctcaaatactctttactacaaacggtttttcccatactatgctttcaatgtcttgggtggcctagacagtgaaggaaaaggctgtgttttcacatacgatgcagttggctcgtatgaacgtgtaggctatggatcacaggggactggatcaacacttatgatgcctgttctcgacaatcagcttaaatctcccagtcctctgctcttgccagctaaagatgctgcaactctcctgtcagaatctgaagcggttgatctggtgaaggatatttttgcttcagctactgaaagagacatatacactggcgatggattagaaatagtcgttgttaatgcggaaggtatcagacgagaagagattatgaagctacgatatgattaatttgatgtcactcctgaattaggtgcatgacttgttacatgtttttaccacctttacatttctattgaaggtgatttgaaagcacataaactgatatccttcatcaaagaaatactgctatcattgtgttatttattctgcagattagtgtttaaatatattcaacttgagctgggattgttattttgagttttgaactcctaatttgtgcaacttatttaagaacgatacaaattctggcatttagtataatgtcttaaaagaaacgtgcttcatctagggatactatcttgagtgtttcctcatggaactgagctgaagattgaaagttagtttatgctgagagccatgtagt

SEQ ID NO: 3683 - DNA, 1135 bp, Epimedium sagittatum
aagagaaaataaaaggaaggaagaacgaaaatagactcacttcgtcttcttcagaactaaaatcttgttccactttctcatcgtctacttgattcgatcgtccaatcatggctcacaaacagcaagccaactggtctccctatgacaacaatggaggaacatgtgttgcgattgctggagcagattactgcgttatcgcagcagacacccgtatgtcgaccggttacagtattctcactcgtgattattccaagatctgcaaattagcagataaatgtgtgttggcctcttccggattccaggcagacgttaaagctctgcagaaggttttgtcagcaaggcacttggtctatcagcatcaacataacaagcagatgagctgtcctgcaatgggtcaacttctatcgaatacactgtactacaaacgtttcttcccttactatgcattcaacgtcttaggtggcctcgacaatgaaggaaagggttgtgtttttacttacgatgctgttggatcgtatgagagggttggatacagttcccaaggatctggttctacactcatcatgcctgtcttggacaaccaattgaaatctcctagccctctcttgttgcctgccaaggatgctgtaactccattgctggaatcagaagcggttgaccttgtgaaagatgtttttgcatctgccgctgaaagagacatatacactggcgacagtgtcgaaattgtggttgtaaatgcatcaggaatccgaaaagagtatattgaactacgggaggactgattttgcgatccgctgagctggaatttagaatgaaaaaaatgcacgagaagatcagtaatgggttattgctttccattgtttagttttaagataactgaaaatcaaatgtgcgtcaatcttacgaattgttacagatatctgtcatggcaagggaattgtgtaggttaatctttaagcaaggtactgtgtcagaatagcgttcagtattggccggttattgccgttttctgcaagtttttcctctgcaggaaaggtgtagattctggattctatcctgtgttgagttggatcctaaaagcttttaaaattgaaaaccttattagtgctaccttgtaggttcatcatatgcaaag

SEQ ID NO: 3684 - DNA, 989 bp, Manihot esculenta
aaaagtaagaaaggcagaccttgaaggcttgaagctttgttctgcaatttatttcgtaatcaattttaatctccattttgctgcttaccaccatgactaagcaactagctaactggtctccatacgataacaatggaggatcttgtgttgcgattgctggcgccgattactgcgtcatcgccgccgacactcgaatgtccactggctacagtattctcacccgggagtactccaaaatctgtaaattagctgaaaaaagtgtaatggcatcttctggctttcaagctgatgtgaaagccctacaaaaacatttggcagctaggcacttgatctatcaacatcaacacaacaagcaaatgagctgtcctgccatggctcaactactctccaacactctctactacaagcgcttctttccctattatgcttttaatgttctaggtggccttgatagtgaaggaaagggctgtgtgtacacttatgatgctgttggctcctatgagagggttggatatagtgctcagggttctggttccactctgatcatgcctttcctggataaccaactgaagtctcccagccctctcttattgcctgcccaggatgctgtaactccactttcagaagtggaagctgttgacctggtaaaaactgtttttgcatctgcaactgagagagatatttacactggagacaaacttgaaattgttatcctaaatgctgacggtattcggcgcgagcatatggaactcagaaaagattaatttaaccaaaattcttgttggtcttgtcataattggaggaggaattgcatggattactcctgggttggcacttgtcaaggctgatgcttcagcattgtcattctattgatcagttaactttaaatttgcccaactggaacgatctattttctagtatagatgttcagtgaggatgtaatccatgaattggaacgtgttcagttggcgtttaaatttgttggtccg

SEQ ID NO: 3685 - DNA, 1061 bp, Castanea mollissima
ctcgattcgagcaattagcctttagttcttcgccctaagttgagttcctcatctctctcactcttctctgcttcttcaaatcagcaatcaaccatgaccaaacaacaagctaactggtctccatacgacaacaatggcggatcctgcgttgcgatcgccggagccgattactgtgttatcgccgccgatactcgcatgtcctccggctacaatattctcacccgcgagtactccaaaatctgcaaattagcagacaaagctgtaatggcctcttctggttttcaagctgatgtgaatgctttacagaagcagttggcagccaagcacttgacctatcagcaccaacacaacaagcagatgagctgccctgcaatggctcagctactctccaacaccctctactataaacgtttttttccttattatgccttcaatgttttaggtggccttgacagtgaaggcaagggttgtgtcttcacctatgatgctgttggttcctatgagagagttggatattcttcccagggttctggttccacgctcatcatgccctttctggataaccagctgaagtctcccagccctctgttattgccagctcaggatgctgttactccactttctgaatcagaagcagttgatttggttaaaactgtttttgcatctgcaactgagagggatatatacactggagacaagcttgaaattgttgttctaaatgctggaggtattcatcgtgaatacatggaactcaggaaagactgatttctgtactgaactgtcctgctggtctttccaaagaagaatgctgaaactgtatgaactggcctttgagtagagagttctcatgactgatcaattaagttttagcttttcaatgattacaatttgattaattgcacttcctagcggaatggttgcagctgtgatgcctcttttggacacaagtctcctgtactagactatgttaatatttatattcaggttactttatcccaagtttacacatgggaaaaaggatgtggtaatgatttatgaatgatgaatctcctttacttttc

SEQ ID NO: 3686 - DNA, 1254 bp, Citrus sinensis
ttaaaccctcacttgaaaacgacgtcggttttaagctcccatttcttgttctcaaagccactccacatctgaaacactggaaacgaaccaaattcatattgtccaaatttcaaaccctaattactgacaattcatcatgacgaagcagcatcccgcatggtctccatacgacaataatggaggaacttgtgttgcgattgccggagctgattactgtgtaaccgctgccgacactcgaatgtcaaccggttacagtatcctctcccgcgattactccaaaatcattaaactggcagacaaatgtgttatggcctcttctggttttcaagctgatgtcaaagccttacaaaaactcttggcagcaaggcatttgatctatcagcatcagcacaacaagcaaatgagctgccctgcaatgggccaactactctccaacaccctgtactacaaacgtttctttccttactattcatttaatgtcttgggtgggcttgacaatgaagggaagggttgtgtctacacatatgatgctgttggttcctatgagagggttggatatagctcccagggttctggttccacgctcatcatgccattcctcgataaccaactaaagtctcccagtcctctcctattgcctgcccaggatgctgttactcctctttcagaggctgaagcagttgatttggtcaaaacttgttttgcatcagcaactgagagggacatatacacgggagacaaacttgaaattgttgtcctaaacaaagatggtattcatcgtgaatacatggaactgaggaaggattaatctctttggaatcatgccacactggtcaagctgaagtaggtggagctgccatcagcaagttctcagtgttcttgtgttgtcgtggtttcacattttcttatgaatccagtttgatataactttccttactagtgcatatgttgcagtgatgatgccttagaagacgttagtttcttgtactagtagcctataatgtttggaagaatggatccggtgttattttcgttaaggataaattatatattcggttttcaaatgacatctggtgtgcgtctatatttcagtattatatttgctctgtacttcgacaaatgataccagggctccagtttcagttaaggcttgcacgtttcaggcaagtgatgtggccttaatttaatgacttttatagttgatgaaacttgatgggtctttcctggtaacaggaggccatttgagaataacat

SEQ ID NO: 3687 - DNA, 1277 bp, Citrus clementina
cttaaagccattctccaacggcttaaaccctcacttgaaaacgacgtcggttttaagctcccatttcttgttctcaaagccactctcatatctgaaacactggaaacgaaccaaattcatattgtccaaatttcaaaccctaattactgacaattcatcatgacgaagcagcatcccgcatggtctccatacgacaataatggaggaacttgtgttgcgattgccggagctgattactgtgtaaccgctgccgacactcgaatgtcaaccggttacagtatcctctcccgcgattactccaaaatcattaaactggcagacaaatgtgttatggcctcttctggttttcaagctgatgtcaaagccttacaaaaactcttggcagcaaggcatttgatctatcagcatcagcacaacaagcaaatgagctgccctgcaatgggccaactactctccaacaccctgtactacaaacgtttctttccttactattcatttaatgtcttgggtgggcttgacaatgaagggaagggttgtgtctacacatatgatgctgttggttcctatgagagggttggatatagctcccagggttctggttccacgctcatcatgccattcctcgataaccaactaaagtctcccagtcctctcctattgcctgcccaggatgctgttactcctctttcagaggctgaagcagttgatttggtcaaaacttgttttgcatcagcaactgagagggacatatacacgggagacaaacttgaaattgttgtcctaaacaaagatggtattcatcgtgaatacatggaactgaggaaggattaatctctttggaatcatgccacactggtcaagctgaagtaggtggagctgccatcagcaagttctcagtgttcttgtgttgtcgtggtttaacattttcttatgaatccagtttgatataactttccttactagtgcatatgttgcagtgatgatgttattttcttgtactcgtagcctataaagtttggaagaatggatccggtgttattttcgttaaggataaattatatattccgttttgaaatgacatctggtgtgcgtctatatttcagtattatatttgctctgtacttcgacaaatgatagcagggctccagtttcagttaaggcttgcacgtttcaggcaagtgacatggccttaatttaatgacttttatagttgatgaaacttgatgggtctttcttggtaacaggaggccatttgagaataacatatttaataattg

SEQ ID NO: 3688 - DNA, 1003 bp, Cucumis sativus
agagaccaagttttgtgtctttgctttgttaagttcctcttccctcaagaacgctttcgctttttcatctgccctattcgacatgacgaagcagcaagctaactggtctccttacgacaacaatggcggatcctgtgttgcgattgccggtgccgattactgtgtaatcgccgctgatacacggttgtctacgggttacaacattctcactcgcgattactccaaaatttgtaagctggctgacaaagctgtgctggcctcttctggttttcaagctgatgtgaaagccttacaaaaggctttgtcagctaggcatttgatctaccaacatcagcacaacaagcaaatgagctgtcctgcgatggctcaactgctctcaaatacattgtactacaaacggttctttccttattatgcttttaatgttttgggtgggcttgatagcgaaggaaagggttgtgtcttcacctatgatgctgttggttcatatgaaagagttggatacagtgcccagggctcgggctccaccctaattaccccctttttagataaccaactgaagtctccaagccctctattattgcctgcacaggattcttcaacgcctctttcagaagctgaagcaattgacctggtgaaaaccgtttttgcatctgctaccgagagggatatctacaccggtgacaaactcgaaatcgttgttcttaatgctgatggtcttcgacgtgaatacatgaatctccgagaagattagtttagtggtttctcgattgattgaatgattcagcaaccttttgaactccccatccgcgtacccctcccggagattattgcattgtgatgttatatttacggatggttaagttgaagattttctctgtaatatgacctctgtttccagattaaaatttctgttgtgaacattggattgtattaaaatctgcagggccgttggccaatgttgatcgatcctcccttttcttctaaaaagtagcttatttca

SEQ ID NO: 3689 - DNA, 1219 bp, Eucalyptus grandis
atgcgtaagaaacggagtcaagggaggggcaaattggtcactcggaccgcagctcactggcctctcgcccaagaaaaagggttctcattcattacgtcgccgggggtcgcgcgatcggattccattcgagccctgagaaaccagacgaccgacgacgacgaaatcgagcgcgaactctcctccgtccggcagattccggtctcctctccacctccgacgatgacgaagcagcaggcgaactggtccccgtacgacaacaatggaggatcttgcgtggcgattgccggcagggactactgcgtgatcgcggcggacacccggatgtcgaccggctacagcatcctcacccgcgattactccaaaatctccaaactggctgacaaagctgtattggcctcttctggatttcaagctgatatcaaagccttacaaaagcacttagctgctaggcatttgatctatcagcatcagcacaacaagcaaatgagctgtcctgctatggctcaactgctttctaataccctctactacaagcgcttcttcccctattatgcttttaatgttctaggtggccttgatagtgaaggaaagggttgcgtctttacatatgatgccgtgggttcctatgagagggttggctacagtgcacagggatctggttcaactctaataatgccttttctagataaccaactgaagtctcctagcccgctcttattgcctgcacaggatgccgttactccactttcagaattagaagctattgatttggtcaagactgtttttgtatctgcaactgaaagggatatatatactggagacaaggtggaaattgtcatcttgaatgccgagggtctccgtcgggaatttatggatctgaggaaggattgaaactttggtccttgtaagtgttttgctgaagaaagaaggcttccaatgcaaacgttgatcaattactgtccttggtggttgtcctagacttcttttagcacactccggagtaaatccggccttccggttgctgtaattgatgttttagccctgtttatggaaattattgcgatcatgatgcctgtgcgagagatgaatattagacggtgctttatttgcattaaaccaacttcatggtagttctatggaaaggatacgagtttcattctgtgttcgaacatcctatggtggttttctttcctttggcaacgaggcctgtcgatttctc

SEQ ID NO: 3690 - DNA, 994 bp, Euonymus alatus
attacggccggggactcccttctctgtctaacacttctatcttcgcttccgttcgattcgccatgacaaagcagcaagctaattggtctccctacgacaataatggaggatctgttgttgcgattgctggggctgattattgtgtggttgctgccgatacaagaatgtcgaccggttacagtattctgactcgcgaatattcaaaaatctgtcaattagcggaaaagtcttttttggcttcttcaggatttcaagctgatgtgggagccctacagaaacagttagctgccaggcacttgatatatcaacatcaacacaacaagcaaatgagctgccctgcaatggctcaactgctctctaacaccctctactacaaacgtttcttcccctactatgcttttaacgtgttaggtggtcttgataataaaggtaagggttgtgtcttcacttatgatgctgttggttcatatgagagggttggatatagcgcgcaaggttctggttccacactcatcatgccctttttggacaatcagttgaagtctcccagcccactcctgttgcctgcgcaggatgctgtaactccactttcagaagctgaagcagttgatttggtcaaaactgtttttgcttctgcaactgagagagatatatacacaggagacaagctggaaattgttatcctcaattctgctggtactcatcgcgagtatatggaactccggaaagattgatctattcgaggaaatgtgctgcagatgttgtgtgggcactgggcagtgtggcagaatatgcagaattgcatgaagtcatttgttggggaattctacggatgttattcatatttttatggcttatggattgcagtgtagcttttaaatgaatacttttgggctgctgccttttctaatggacggaaaatgtagtacctcctcattgatggatatatctgtacttctgttcttgcacttggctggcgaaaattgattgcaaa

SEQ ID NO: 3691 - DNA, 1279 bp, Citrus sinensis
cttaaagccattctccaacggcttaaaccctcacttgaaaacgacgtcggttttaagctcccatttcttgttctcaaagccactctcatatctgaaacactggaaacgaaccaaattcatattgtccaaatttcaaaccctaattactgacaattcatcatgacgaagcagcatcccgcatggtctccatacgacaataatggaggaacttgtgttgcgattgccggagctgattactgtgtaaccgctgccgacactcgaatgtcaaccggttacagtatcctctcccgcgattactccaaaatcattaaactggcagacaaatgtgttatggcctcttctggttttcaagctgatgtcaaagccttacaaaaactcttggcagcaaggcatttgatctatcagcatcagcacaacaagcaaatgagctgccctgcaatgggccaactactctccaacaccctgtactacaaacgtttctttccttactattcatttaatgtcttgggtgggcttgacaatgaagggaagggttgtgtctacacatatgatgctgttggttcctatgagagggttggatatagctcccagggttctggttccacgctcatcatgccattcctcgataaccaactaaagtctcccagtcctctcctattgcctgcccaggatgctgttactcctctttcagaggctgaagcagttgatttggtcaaaacttgttttgcatcagcaactgagagggacatatacacgggagacaaacttgaaattgttgtcctaaacaaagatggtattcatcgtgaatacatggaactgaggaaggattaatctctttggaatcatgccacactggtcaagctgaagtaggtggagctgccatcagcaagttctcagtgttcttgtgttgtcgtggtttaacattttcttatgaatccagtttgatataactttccttactagtgcatatgttgcagtgatgatgccttattttcttgtactcgtagcctataaagtttggaagaatggatccggtgttattttcgttaaggataaattatatatttggttttcaaatgacatctggtgtgcgtctatatttcagtattatatttgctctgtacttcgacaaatgatagcagggctccagtttcagttaaggcttgcacgtttcaggcaagtgatgtggccttaatttaatgacttttatagttgatgaaacttgatgggtctttcctggtaacaggaggccatttgagaataacatatttaataattg

SEQ ID NO: 3692 - DNA, 1133 bp, Aristolochia fimbriata
gagttggaaaaggcccagcacagggtgagctgcttccatctgctattcgatttcccccccttgtcagccttcttcttcgttcgatcgatggctccgaaggaacacgcgaactggtcaccttacgataacaatggcggaacgtgcgtggctattgcaggcgccgattactgtgttatagcggccgacactcggatgtccactggttacagcatccttacgcgtgactattccaagatcatcaagctagcagataaatgtgtgatggcttcatcaggatttcaggccgatgtcaacactttacagagaaacctggcagcaaagcacttggtctatcagcaccaacacaacaagcaaatgagctgtcctgctatggctcagcacctctctaatactctctactacaaacgattcttcccatactatgccttcaatgttttggggggtcttgataatgatggaaagggttgtgtattcacctatgatgcagtggggtcatatgagagagtcggatatagctcgcaaggctctggttcgactctcatcatgcctgtcttggacaaccaactgaaatctccaagtcctctcttactacctgcaaaggacgctgtaacgcccctgtcagagtccgaggctgttgacttaataaaagatgtttttgcctctgcagcagaaagagatatttacacaggagataaggtagaaatcgtggttataactgctgcagggatcaaacgcgagtacaaagatctcaggaaagattagtttcgcctcagctgctgcagggatcaaacgcgagtacaaagatctcaggaaagattagtttcgcctcagctgctgcatgatggcaacattcaagaaactccaaggaacgtgctaaaatggaagcagtggtggttcagtctcactggtacttgtttcgttcccaaggatgaaattgcagttcattatctttcgagcatcgttgtatcgttaactctcacgtatgttctctctttctcacacctgttaatgcatattcgactttttctgtgcgacttcgtcatggattttgtttatcataaattagggacgatgaactattaccaaaaactttttttagttattgaagttgaaaaatatctgtttttacgtta

SEQ ID NO: 3693 - DNA, 909 bp, Eschscholzia californica
caccaaaatttccattcctctggttctcgccctagtacttccccactttctctctcttctctctaacattcgatctaatcatggctcacaaacagcaagctagctttaatccttacgataacaatggaggaacttgtgtagcgatcgcagggtccgattactgtgtcattgcagccgatactcggatgtcaactggttacaacatccttactcgtgattactccaaaatttgccaattggcagataaatgtgtactgtcttcctctggtttccaggctgatgtcaaagctctacagaaagccctttcagcaagacatttgatctatcaacaccaacacggcaagcagatgagctgccctgctatgggtcaactcctctcgaataccctatactacaaacgtttctttccctactatgctttcaatgtcttgggtggccttgacaacgaaggaaagggttgtgtttatacatatgatgctgtgggatcgtatgagagggttgggtatagctcccagggatcaggttctagtctgatcatgccggttttggataaccaactgaaatctcctagccctctcttgttacctgccaaggatgctgttactccgttatcagaatcagaagctgttgatctagtaaaagatgtgtttgcctctgcagctgaaagagatatatacactggtgacagggtggaaatagtaattgtaaatgctgctggtattcgacgtgagtatgtcgagcttaggaaagattaatctatctgatggccctgaagtgaaatcaagatcacaagaaactgctgcatagtcagtcacctggttaccatcaactgttatcatttatcattttatcttttaaggattgaaactttggacccaactccgaacttttgcttgaaatgtttatgtg

SEQ ID NO: 3694 - DNA, 941 bp, Euphorbia peplus
aatccctaatttccgtcgctaattaaaatccctgaatccgtcgctaatagaatgacgaagcaacatgctaactggtctccatacgacaacaatggaggatcttgtgtcgcgattgctggcgcgaactactgcgtgatcgccgcggatactcggatgtctaccggatacagtattctcacccgtgaatactccaagatcagtaaactagctgataaatctgtgatggcatcatctggatttcaagctgatgtgaaagccctgcaaaagcatttgacagctaggcacttgatctatcaacatcagcacaacaagcaaatgagctgtcctgccatggctcaattgctctccaacactctttactacaaacgtttcttcccttattatgcttttaacgtgctaggtggacttgatagtgaaggaatgggctgtgtttacacctacgacgctgttggttcctatgaaagggttggatatagtgctcagggttccggttctactcttatcatgccttttcttgataaccagctgaaatctcccagccctctcttattaccggcagtggatgctgttactccactttctgaatctgaagccattgatttggtgaaaactgtctttgcatctgcaaccgagagagatatatacactggagacaagcttgaaatagttgtcctaaatgctgatggtatccgtcctgagtttatggaactcaggaaagattgatttgttcgaaaatcctgctcttaacaagaattgcacgaattgtttaggcagatgtcagagcacatttatgcattttcatcctgttgtttggtgcctagcttctatatcgaaaccatcttcaagaagtgcatttccttgttatggatgttcgatgacaatgcgctttgtgttttatgatatatgcagtttatatttaaattagagatattgtggataag

SEQ ID NO: 3695 - DNA, 1170 bp, Cucumis melo
agagaccaagttttgtgcctttgctttgtgaagttcctcttctctcaagaacgccttctctttttcatctgccctattcgacatgacgaagcagcaagctaactggtctccttacgacaacaatggcggatcctgtgttgcgattgccggtgccgattactgtgtaatcgccgctgatactcggttgtctacgggttacaacattctcactcgcgattactccaaaatttgtaagctggctgacaaagctgtgatggcctcttctggttttcaagctgatgtgaaagccttacaaaaggttttgtcagctaggcatttgacctaccaacatcagcacaacaagcaaatgagctgccctgcgatggctcaactgctctcaaatacattgtacttcaaacggttctttccttattatgcttttaatgttttgggcgggctcgatagcgaaggaaagggttgtgtcttcacctacgatgctgttggttcatatgagagagttgggtacagtgcccagggttcgggttccaccctaattaccccctttttagataaccaactgaagtctccaagccctctattattgcctgcacaggattcttcaacgcctctttcagaagctgaagcaattgacttggtgaaaaccgtttttgcatctgctaccgagagggatatctacaccggtgacaaactcgaaatcgttgttcttaatgccgatggtcttcgtcgtgaatacatggatctccgaaaagattagtttggtgattgctcaattgattgaatgttgcagcatccttttgaactccccatccgcatacccctcccggagattattgcaccgtgatcgttatatttacggatggttaagttgaagtttctctctgtaatatgacctccgtttccagattaaaatttctgttgtgaacatgggattgtattaaaatctgcacggccgttggccaatgttgatcgaccgatctcccttttcttctaaatcgtagcatttttcatgagaaaatggatttgaaccttaactgcaaggtaatagaagctggctgggtagtacatgatatttaaaatcttattaacatgttgtgttgatttatgatgtctatgaaatgctaggcttggaagcactaaacaaatatgaaatagacaaatgttggaaccaaa

SEQ ID NO: 3696 - DNA, 847 bp, Vinca minor
ccatgaccatcgaccacgcaaactggtctccttatgacaacaatggagggacttgtgttgccatcgccggagcagattactgtgtagttgccgccgatactcgaatgtctagtggatataatattctcactcgcgattactccaaaatcgtacaattagcggaaaagtctgtgatggcttcctcaggttttcaagctgatgtgagagctttgcagaaggtcctatctgctaggcacttgttctaccagcatcaactcaacaagcagatgagctgccctgccatggcccagttgctctcgaacacgctgtattacaagcgtttcttcccttattatgctttcaatgttcttgctggtcttgatagtgaaggcaagggctgtgtctttacatacgatgctgttggctcctatgaaagggttggatacagttcccaaggttctggctctacgcttatcatgccctttttggacaaccaactgaaatcaccaagtcctctactattacctgccaaggatgctgttacaccactttcggaatcagaagctattgacttggtaaaaacatgttttgcttctgcaacagaaagagacatctacactggagacaagctggaaattgtcatcttaaatgcaagtgggatcagtcgtgaatacatggagctaaggaaagattaacccttcctcaccttgtcatgaacgtctttgctactctgggatatttcagtgctgttgattcatgttactggtaattgagttggaaaagtcattggaatcttggtctgtactgtactctttgagatatttattcataccatgaatctgtttttatgtttaaattattactactc

SEQ ID NO: 3697 - DNA, 1152 bp, Gossypium raimondii
gggcctgtatgggcctaaacccgaacccataatactgataatataaagtgcctccatttcttgttggcaaagctagagtcgttttaaatctgtgagtaaaggaaattaaatttctttaattttttctctttgtcgacctaaatctcttttatttgcttctttcaccatgaccaagcagcaggctaactggtctccttacgacaacaatggaggatcttgcgttgcgatcgctggagctgattactgtgttatcgccgccgatactcgaatgtcaaccggttacaatatactgacccgagattactccaaaatctgtaaacttgcagataaatgtgtcatggcatcctcaggatttcaagctgacgtgagggctttacaaaagcaactggcagctaggcacttgatttatcagcatcagcacaacaagcaaatgagctgccctgcaatggctcaattgctttccaacacactttattacaagcgtttctttccttattattcttttaatgttttgggtggccttgataacgaaggaaagggttgtgtcttcacatatgatgctgttggttcctatgagaaggttggatacagttctcaaggttctggttcaacgctcatcatgcctttcttggataaccaactgaaatctcccagtcctcttctattgcctgcccaggatgctgttactccgcttgtggaagctgaagctattgatttggtaaaaactgtttttgcatctgcatccgagagagatatatacactggagacaaactcgaacttgttatcataaatgcagctggtatccgccgggaatacatggaacttaggaaagattgattaatctccattctccaaactgggttaccacctcttatagatgtgtgagttcttgaaattgatggaatgactcttacaatgtgtctgatgcttgtactgcaactatttccttgcatttggatactttaaaatatggattgcagttgaattttatcttccgtctgttagacgaaaatagtctttcatggatggtatgttgcatgactagtctttggtgttctaatttaactccaaaattatttccacttttgattcatccatcctatcagtcttttttgacatataaaaaagatgaattaaccctttattaatta

SEQ ID NO: 3698 - DNA, 1341 bp, Gossypium raimondii
gtttaggctctatgggcctaaaacccgatccaaacccctaaaagctcttttttgaaaaaaaaaaatttcttgttcgcgaagccaaaaatatatctgcggaataaaagttctctcaaattgtgcagtctttattttctcttcggtcgacctttactctttcaccatgcctaaggagcaagctaactggtcaccttacgacaacaatggaggatcttgcgttgcagttgccggcgccgattactgtgtaatcgctgctgatactcggatgtcgacgggttacaatattctcacccgtgactactcaaaaatctgtaaattagcagataaatgtgttatggcatcctcaggatttcaagctgacgtgaaggctttacaaaagcatctggcagctaggcacttgatttatcagcatcagcacaacaagcaaatgagctgcccggcaatggcccaactgctgtccaacaccctttattacaagcgcttctttccttattattcttttaatgttttgggtggtctcgataatgaaggaaagggttgtgtcttcacatatgatgctgttggttcctatgagaaagttggatacagctctcaaggatctggttcaacacttatcatgcctttcttggataaccaactgaaatctccaagcccgcttctgttgcctgcccaggatgctgttactccacttgcagaagctgaagctattgatttagtaaaaactgtttttgcttcggcatccgaaagagatatatacaccggagacaaacttgaaatcgttgtcataaatgctgatgggatccgccgggaatacatggatcttcgcaaagattgattgattttctactctgtgcctgttgtctgaattgaaactattttcttgatttcagattgcgcttaaccttatctggatttatctgatgttagggaataatatagacttgatgtttttttttttttttttaatgtggaagaggaaccttgggatgctgcttggtctcattagtagttttgttggtttttcttatccccacatatatagaataaactaggagcagagcaccacaagtacataagattaagaatgaacatatccatcttttgttcaatcccctttcaattagatagaccacaatccaccaagatgtgttcgattatgatttatgacaatgacctaagttcagatatgttagaaaggtgtctatcgaaaaagaagagagaatgatctcagtttaacaaccgggacagtggatatgtagacagtgtaagtgtcgagtgcaatgataagatgtattatacctatactcagttgaaaattaaaattatatattaaaatgaaaa

SEQ ID NO: 3699 - DNA, 1118 bp, Fagus grandifolia
caatatgttttcttgaaggcaaagacacctgaggctgagatctaaatttacatttgttcctcgctctatttctcttacattttttgctgaaatcgttctcatcctgctcacagtctcactcttctctgctccgttgaactacaatttaaccatgactaccaagcagcacgccaactggtctccctacgacaataatggaggatcctgtgttgcgatcgccgggaccgattactgcgtaatcgcagctgatactcgcatgtcctccggttacaacattctaacccgcgagtattcgaaaatctgcaaattagcggacaaatctgtaatggcttcttctggttttcaagctgatgtgaaggctttacagaagcacttggcagccaggcacttgatctatcagcaccaacacaacaagcagatgagttgccctgctatgggtcaactgctctccaacaccctctactataaacgtttctttccttattattccttcaatgttttaggtggccttgacaatgaaggaaagggttgtgtcttcacctatgatgctgttggttcttacgagagagttggatatagtgcccaaggttctggttccacgctcatcatgccctttctggataaccagctgaagtctcccagccctctcttattgcctgcccaggatgcggttactccgctgtctgaagcagaagcagttgatttggtgaaaaccgtttttgcatctgcaactgagagggatatatacactggagacaagttggaaattgttgtcctaaatgcggatggcattcaccgtgaatacatggaactccggaaagactgagttctttactgaactgtcccgctggaagttttagcatttcaatgagaacaatttgatcaattgcaattcttagtggaatagttgcacaagtttcctgtactagactatgttaatatttatattcagtttactttatccgaagtttacatttaagtctgacaccatggaaaaaggatgaggtaatggtttatgaatgatgaatcttttggtgtttgagtgacagattttatttatctgctttattatatgatgtttggaggagaccctgaacagcactcagaccctcacccct

SEQ ID NO: 3700 - DNA, 883 bp, Cirsium arvense
cccatcatcatgcccaaggaacaagcgaattggtctccatacgacaacaatggaggaacttgcgtggcgatcgccggtgcggattattgtgtaattgcagccgatactcggatgtccaccggttacagtattctcacccgagattactccaaaatctgtaaattagcagacaaaagcgtcttggcttcttccggatttcaggcagatgtcaaagcattgcagaaggtcctggcctctagacacttgatctatcaacatcaacataacaagcagatgagttgccctgctatggctcagcttctctcaaataccctttactacaagcgtttcttcccatattacgccttcaatgttttaggcggcctcgacagtgaaggaaagggctgtgtattcacatatgatgctgttggatcatatgagagagtcggatacagtgctcaaggttccggtgccacacttatcactcctttcctggataaccagctcaaatctcccagccctcttctcttaccagctaaggatgctgttacaccactttctgaaactgaagctattgatttggtgaagacttgtttttcatcggctacagaaagagatatatacacaggagacaaggttgaaattctagtcttaaatgctgacggcattcattgtgaatacgaggaactccgcagagattaaactcgtcataaccgaaccatttttcttcttggggttgtcggttataattttaattttatcagatggggttcatttagttaggtttggtttggttaacccgaattcttgtgaattacttgaatgttggatctttataagttcacaatcacataaagattttgttggccttttgttgcattcaaaaaagaaaaagtaccgacta

SEQ ID NO: 3701 - DNA, 1057 bp, Coffea canephora
ggggggaggaacaacttggattaagcgattcaatcgttcatagatttctctgaaaatcccagcttttttcttttcatatcttggattcgacgatgccgattcagcaagcaaactggtctccgtatgacaacaatggagggacttgtgtggcgattgcaggtgcagattactgtgtgattgcggccgatactcgaatgtctactggctacaatattcttactcgcgattattccaaaatcattcagctagcggacaaatctgtgatggcttcctcaggttttcaggctgatgtgagggctttacaaaaggttctggaagctaggcacttggtatatcaacatcagcataacaaacagatgagctgccctgctatggcccagctgctctcaaataccctctattacaagcgtttcttcccttattattctttcaacgttctaggtggtcttgacagtgaaggtaagggttgcgtctttacatatgatgctgttggatcttatgaaagggttggatatagttcccaaggttccggttccacactcattatgccctttttggacaatcaactgaaatctccaagtccactgctattacctgctaaggatgctgttacaccactttcagaatcagaagctgcagacttggtgaaaacatgttttgcttcagcaacagaaagggatatctacactggcgacaagctggaaatccttgtgttgaatgctgaaggcattcgtcgtgaatacatggagctgagaaaagattgactttctacaccatgttgcagtttctgttttcaatatcctccaattcgggtgctcagggtatattaagctggtaattgattggacagaatctggtttttgcatggattgtaatcgcatatgggctttctgaccatacaatttgaatattttctttatgagggaatgctgcgatcatgacttccaacaccttctcataaccattctgttgaaatggtcccctgttttccttttaatcttcttttgttgtacttgaaattatttactgcaaagctactgcatttgggtgctaatga

SEQ ID NO: 3702 - DNA, 1054 bp, Gossypium hirsutum
ttaaattttctttaatttttttctctttgttgacctaaatctcttttatttgcttctttcaccatgaccaagcagcaggctaactggtctccttacgacaacaatggaggatcttgcgttgcgatcgctggagctgattactgtgttatcgccgccgatactcgaatgtcaaccggttacaatatactgacccgagattactccaaaatatgtaaacttgcagataaatgtgtcatggcatcctcaggatttcaagctgacgtgagggctttacaaaagcaactggcagctaggcacttgatttatcagcatcagcacaacaagcaaatgagctgccctgcaatggctcaattgctttccaacacactttattacaagcgtttctttccttactattcttttaatgttttgggtggccttgataacgaaggaaagggttgtgtcttcacatatgatgctgttggttcctatgagaaggttggatacagttctcaaggttctggttcaacgctcatcatgccgttcttggataaccaactgaagtctcccagtcctcttctattgcctgcccaggatgctgttactccacttgtggaagctgaagctattgatttggtaaaaactgtttttgcatctgcatccgagagagatatatacactggagacaaactcgaacttgttatcataaatgcagctggtatccgccgggaatacatggaacttaggaaagattgattaatctccattctccaaaatgggttaccacctcttatagctgtgtgagtacttgaaattgatggaatgactcttacaatgtgtctgatgcttttactgcaactatttccttgcatttggatactttaaaatatgcattgcagttgaattttatcttccgtctgttagacgaaaatagtctttcatggatggtatgttgcatgactagtctttggtgttctaatttaactccaaaattatttccacttttgattcatccatcctatcagtcttttttgacataataaaaaagatgaattaatcctttaattaaaaaaaa

SEQ ID NO: 3703 - DNA, 848 bp, Gossypium hirsutum
tctcaaattgtgcagtctttattttctcttcggtcgacctttactctttcaccatgcctaaggagcaagctaactggtcaccttacgacaacaatggaggatcttgcgttgcagttgccggcgccgattactgtgtaatcgctgctgatactcggatgtcgacgggttacaatattctcacccgtgactactcaaaaatctgtaaattagcagataaatgtgttatggcatcctcaggatttcaagctgacgtgaaggctttacaaaagcatctggcagctaggcacttgatttatcagcatcagcacaacaagcaaatgagctgcccggcaatggcccaactgctgtccaacaccctttattacaagcgcttctttccttattattcttttaatgttttgggtggtctcgataatgaaggaaagggttgtgtcttcacatatgatgctgttggttcctatgagaaagttggatacagctctcaaggatctggttcaacacttatcatgcctttcttggataaccaactgaaatctccaagcccgcttctgttgcctgcccaggatgctgttactccacttgcagaagctgaagctattgatttagtaaaaactgtttttgcttcggcatccgaaagagatatatacaccggagacaaacttgaaatcgttgtcataaatgctgatgggatccgccgggaatacatggatcttcgcaaagattgattgattttctactctgtgcctgttgtctgaattgaaactattttcttgatttcagattgcgcttaaccttatctggatttatctgatgttagggaataatatagacttgatgtgttttttttt

SEQ ID NO: 3704 - DNA, 1081 bp, Cucurbita pepo
aaagaagcgagcaagtttttgctttggctttgttgagttcctcttctctcagacgccttcgcttttctctgacctcttcgccatgacgaagcagcaagccaactggtctccctacgacaacaatggcggatcgtgtgttgcgattgccggcgccgattactgtgtaatcgccgctgatactcggttgtctacgggttacaatatcctcactcgtgattactccaaaatttgtaagctggccgacaaagctgtgatggcctcctctggttttcaagctgatgtgaaagccttacaaaaggttttggctgctaggcatttgacctaccaacatcagcacaacaagcaaatgagctgcccggcaatggctcaactgctctcaaatacattgtacttcaaacgtttctttccttattatgcttttaatgtcttgggcggacttgataatgaaggaaagggttgtgtgttcacctatgatgctgttggttcttatgagagagttggatacagcgctcagggttcgggttccaccctcattacaccctttttagataaccaacttaagtctcccagccctctattattgcctgcgcaggattctgcaacgcctctttcagaagccgaagctattgacctggtgaaaactgtttttgcatctgctactgagagagatatctacactggtgacaaactcgaaatcgtcattcttaatgccgacggtattcgacgtgaatacttggacctccgaaaagattagcggcacggtgctcggcttgatagattgaatgttgctgcaaccgtatgaaccgcccatcagcacccgtccctgagattactgcattgtgatatttacggatggttaagttttagttttctctctgtaatgtgacctcgtttccaaattaaagtccctgttgtgaaacgtgggattgtactgaaatctggagggctgctggctgatattgatcgatctccctttttttcttttgctaccgttgaccttaaggaattgttttttagcggtaagctcacgagaagctggatttgaatctttggttaatatgagaagctaggtggcatatgt

SEQ ID NO: 3705 - DNA, 1028 bp, Fraxinus spp
gagaaaaaagataccgagagctcaaaaggtgaagtggaaattctttcacatccaagactctacgaacttcaatcgcccccctccttctctaattctctcagatcagatatcacaatgactaaacagaaagcaaattggtctccttacgacaataatggagggacatgtgttgcgattgcgggaactgattactgcgtgattgcggccgacactcgaatgtcatctggctacagcattctcactcgcgattactccaaaattattcaactagcggacaaatccgtgctggcctcttcaggttttcaggctgatgtgagagctctgcaaaaagttttggctgctaagcacttgcaatatcagcatcagcataacaagcaaatgagctgtcctgcaatggctcagctgctctctaataccctgtactacaaacgtttctttccatactatgcattcaatgtcttgggtggtcttgaccatgaaggaaagggctgtgtcttcacatatgatgctgttggatcttatgagagggttggttacagttcccagggctccggttctacacttatcacgccctttttggacaaccaactgaagtctccaagccccctcttattacctgccagggatgcagttacaccactttctgagtcagaagccattgacttggtcaaaacctgttttgcatctgcaacagaaagggatatatataccggagacaaactggagattctcattttgaatgctagtggtatacgcgtggagtacatggagctcaggaaagattgaatcctctcccctgttatttgttgctgttcttgctgaaatgggaggcttgatgctcggtatggctgttgagggtaattgccagataattcttatgttctcgtggcacattacttatttaactcctgaagtcgcattctgctatcttttaagtggtaaattttgagattcatgacttctactgaaacttcattttcttaatgtagaacctgtgtcctagctttagttcacgtatctttagattc

SEQ ID NO: 3706 - DNA, 933 bp, Heritiera littoralis
gaaagtgaaatctgaggaaataagaaaacacttctcgaaaatcaaatttgcactattctttatttttctcttttgtcgacccaagtctgtctctgctcctttcaaccatgaccaagcagcaagctaactggtctccttacgataacaatggaggatcttgcgttgcgatcgctggagctgattactgtgttatcgcagctgatactagaatgtctaccggttacaatatcctcactcgcgattactccaaaatctgtaaactagcggataaatgtgttatggcatcctcaggatttcaagctgatgtgaaggctttacaaaagcaactggcagctaggcacttgatttatcagcatcagcacaacaagcaaatgagttgccctgcaatggctcaactgctgtccaataccctttattacaaacgtttctttccttattattcttttaatgttttgggtggccttgataatgaaggaaagggttgtgtcttcacatatgatgctgttggttcctatgagaaggtcggatacagctctcagggttctggttcaacactaatcatgcctttcttggataaccaactgaaatcccctagccctctcctattgcctgcccaggatgctgttactccacttatggaagcagaagctgttgacttggtaaaaactgttttcgcatcagcttctgagagagatatatacaccggagacaaacttgaaatcgttatcataaatgccgctggtatctgccgagagtacatggatctgaggaaagattgattcatttctactctgaactgggtttgagctcttgcagaagtggaatacttgaattgatggaatggtgggttatgtttctaccatggttctcacataatgtgcctagtattgaactattttcacgtattctgaccatattgatacttgaatcatg

SEQ ID NO: 3707 - DNA, 1046 bp, Lippia dulcis
gaggaaagacaacacaaaaagctccgcagataaaagctgaagtgaaattcataaatcccaatttcttcaatcttgttgcatttctgtccttgatttttcgtcactccgctcaagatcgccatgacgaagcaacaagcgaattggtctccttatgacaacaatggagggacttgtgttgcgatcgccggagctgattactgcgtgattgcggccgacactcgaatgtccactggctataacatccttactcgcgattactccaaaattattcagctagcggacaaatcggtgatggcctcctcaggttttcaggctgatgtgagagctctgcaaaaggttttgtccgcgaggcacttgatctatcagcaccagcataacaagcaaatgagctgccctgcaatggcacagcttctctctaatacgctgtattacaagcgtttcttcccttattactctttcaatgtcttgggtggccttgacaatgaaggaaagggctgtgtcttcacatacgacgctgttggatcttatgaaagggtgggatacagctctcagggttctggttctactcttatcacaccattcttggacaaccaactgaaatctcctagtcctcttttgttaccagcggtggatgctgttactcctctttcagagtcagaagccattgacttggtaaaaacatgttttgcatcagcaacagaaagagacatatacacaggagacaagctggagatagtcgttctgaatgctagtggattgcgccgtgaatacatggaacttaggaaagattaaatccagttctccttcttctgcttgaattgggagatgaaaatgctcagatgccttttgaaggatgatttctggataaatttatcttcttggattagttatctgtcactcttgctttaatagaaccgttgtgttgagatgatttctttctggaaaagtaaaatttaacattcccatgaagtatttgttttaagccttaatctgggacgcctgtattgactgctgattaccaatcagatttcctcaaagaattactg

SEQ ID NO: 3708 - DNA, 935 bp, Podocarpus macrophillus
ggtgtctggaaatccaagaaaacacagttgcagcaatggatgcttcgaaagggatgaggcagcatcagtctacatggagtccttacgacaacaatggaggaacatgcgttgcaatagcgggttccaattactgtgtgattgcggcagatacgagaatgtcaactggctatagtattctcaccagagagtactccaaaatatgcaaactagcagataagtgcgtgcttgcatcatcaggatttcaggctgatgtaaaggcattacagaaaaatttatctgcgacacatttgatttatcagcatcagcataacaagcaaatgagctgtcctgccatggcacaacttctatcaaatactctttactacaaacgctttttcccatactatgctttcaatgttttgggtggtctagacagtgaaggaaaaggctgtgttttcacatatgatgcagttggctcatatgaaagagtaggttatggagcacagggaactggtgccactcttatgatgcctgttcttgacaatcagctcaagtcccccagtcctttgcttctgccagccatggattctgcgactcctctctcagagtctgaagcagttgatttggtaaaagacatatttgcatcagctgctgagcgagatatatacactggtgatggactagaaatagtggttgtcaatgcggaaggcatcaggcgggagtctattgagttacggcttgactaacacttcaagacaatttactagagcagagcttagtattgagtattgtactcatttctgcaactcgttgaaggaatgattatataacaagattttggcgatttttaatgccttaaaaacatgtttgattttcgttaaagagtttttcttttgtgaaatgaaacatggtagttgtcaatgcagaagaatcaagtgaattcatggacttggtca

SEQ ID NO: 3709 - DNA, 1266 bp, Picea glauca
ttcggttcggtccgttcggactgtactcgagaagacgtaggtaggttacgtacaacgacgagtaggtacggcgggtatcttactaaacttacttttagtttttaaaaccttttcattctcagggcgaaggacatagttttctcatcggatttttagctacatcagctcgattcttccatttcctcatttgagtttttgcatatttccgtccatctgttctccattctctccatactccaagttctgctctgcatcagtaatggctgctacagaaggcatcaaacagcaccactcgacatggagtccttatgacaacaacggaggaacatgtattgcaatagctggttccaattactgcgtgattgcagcagatacgaggatgtccactggctacagcattctcactcgtgattactccaaaatttgcaatctagcagataagtgtgtgatggcctcgtcaggatttcaggctgatgtaaaggcactacagaaaaatttgtctgccagacatctgatttatcaacaccagcataacaagcaaatgagctgtccggccatggcgcaactactctcaaacactctttattacaaacgattttttccatactattctttcaatgttttaggtggcctagacaatgaaggaaaaggatgtgtctttacatatgatgcagttggctcatatgaacgagtaggctatggtgcacaggggacgggtgggacgcttatgatgcctgttcttgacaatcagcttaaatctcctagtcctctgctcttaccagctcaggatgctacaactccactatcggaatcagaagcggttgacttggtgaaggatgtatttgcttcagctgctgaaagagacatatacactggtgatgggctggaaatagtagttgtcaatgcagaaggtgtcaagcgagagttcttggagttgcgtcgtgattgatccattgaaattcaatgaaatttttaagtcaggtgtcatgcttatatgaattcacatcatgctttatctgaaaaacatctcaaagataaattttcgatattgtgattactttgaccttttaaattcattaccagcttgtagttctgatatagtgggattgttcttgtggcaaaatgccactaactggatattgcatccctactgtcattgctatgggtggatgttggcatgtgtgagtatacaagtgccatatgttttatgtttaattttgcttttgaacattgctgatggtttcttagtagtaaaatttctttggt

SEQ ID NO: 3710 - DNA, 1049 bp, Triphysaria pusilla
gagaaaaaaggtagcggcatagctgatacaaaagaatactgaacttgcttccaatccattgttctgaatccccatcaaaatctcccctttcaaattatttctctcgctttctccgatccgaaatcacgatgaccaaacagcaagcgaattggtctccatacgacaacaatggagggacgtgtgttgcgattgccggagctgattactgtgtggttgccgccgacactcgaatgtccactggatatagtattctcactcgcgattactccaagattatccagctagcggacaagtctgtgatggcttcttcaggttttcaggctgatgttagagctctgcaaaaggtcttgtctgctagacacttgctttaccagcaccaacacaacaagcaaatgagctgtcctgcaatggctcaattgctctctaacaccctgtactacaaacgtttcttcccatactattcattcaatgtcttgggtggcctcgacagtgagggaaagggctgtgtcttcacgtatgacgctgttggttcttatgaaagggtgggatatagtgcccagggctccggtgctactcttatcacaccgttcttggacaaccaactgaaatctccaagtcctctcttactgcctgcaaaggatgcggtgactccacttaatgagacagaagccattgacttggtgaaaacttgttttgcatcagcaactgaaagagatatatacacgggagacaagctggaggtgctcgtattgaacgctagtggtatacgccgtgagtacatggagcttaggaaagattaaaatccaacttctggtttcttttgccccgcggttttataatgaaacagaagaagacaatgtgttttttgttccctcaggacacttcacaactctgcatttgttatgttaccttcaatttgcatcaagttactgcttatgttattgaatcgtaatgtgttgttaccttccttctgagaacatcatatcgaaacgcttatttgttggctttcggatctttaattagacctttttaaattgttaccagtgttt

SEQ ID NO: 3711 - DNA, 937 bp, Tripterygium wilfordii
accagtcttcctttagcacttccttctccgtcaattacttgttcattcctcgctcttgttcgattcgccatgacgaagcagcaagctaattggtctccatacgataacaatggaggatctgttgttgcaattgctggggctgattactgtgtaatcgctgccgacacacgaatgtcaaccggttatagtattcttactcgcgaatactctaaaatctgtcaactagcggacaagtcctttttggcttcttcaggatttcaagctgatgtgagagccctacaaaaacagctagctgccaggcacttgatatatcaacatcaacacaacaagcaaatgagctgccccgcaatgggtcaactgctctcgaataccctctactacaaacgtttcttcccatactatgcctttaatgtgttaggtggtcttgataatgaaggaaagggttgtgtcttcacttatgacgctgttggttcctatgagagagttggatatagctctcaaggttctggttccacactcatcatgccctttttggacaatcaattgaagtctcctagcccactcctgttgcctgcacaggatgctgtaactccactttcagaagctgaagcagtagatttagtcaaaactgtttttgcatctgcaactgagagggatatatacacgggagacaagctggaaattgttatcctcaatgcttctggtactcgtcgtgagtatatggagctccggaaggattgatctaaacgaggaaatgtgctgtgggtcgtgatgcagaatacattgaattgcagtaattctatgactggttattctgcttttcccattgaaaggaaaatgtagtagcaatatacgcttttcgtatttagggcatgaagttaactttaatggttcttttaaacatttaaagaagagtttgcctctttggcataagaat

SEQ ID NO: 3712 - DNA, 1253 bp, Papaver somniferum
aaaacccaagtcctaccctagttcttcttcaccttcttctctctctgtaatctcgatctaaccatggctcacaaacaacagcgatttgatccttatgacatgaatggaggaacttgtgttgcgatcgcaggagcagattactgtgtcattgcagcagatactaggatgtctactggttacagtattcttacacgagattactccaaactttgcaaattggcggataaatgtataatggcatcagggggatttcaggcagatgtgaaagctctgcagaaagccttgtctgcaaagcacttgatctatcagcaccaacatgggaagcaggtgagctgccctgccatggggcagctgctctccaataccctctactacaaacgtttctttccttactatgctttcaacgtcttaggtggccttgataatgaaggaaagggttgtgtttacacttatgatgccgtgggatcctatgagagggttggatacagtgctcaaggttccggttctactcttatcatgcctgttttggataatcaactgaagtctcccagccctctcttgttacctgccgtggatgctgtgactccattatcagaagcagaagcaattgatttggttaaagatgtttttgcatctgcaactgaaagagatatctacactggagacaggcttgaaataatgatcgtaaacgcagcaggtaccagaaccgagtacgttgagctcaggaaagattagtatgtgtgccctgatgctgttccttctggtgtggaatctggagcacaagaaactgcagttttgacagtttctctaactgctaccatcaactaccatagatcatcttttcaaaataacaaatttctgctgaatttccagctcttttattagtgttgtgggaaaggctgtccgagactgtacgtcttccctgaaacagagtttaagagttgcatatgtattggattttgttgcttgcatatttatttctaaggaattccttttgtttctaaggaattccttttgaggttgtcttatgaattgtccatgtctcattatttcttgctcagacccataagccaacggcatgggttatatatttagtcattaaacaaaacagtgctatatccatatattatgtatgcgcacaacaggtcagcaacaggtatgcaaggcagtattagtcttttaatacctgatggcttttgtaaaagttagtattattattagtattttgttaagtccctaaaaaaaaaaaaaaa

SEQ ID NO: 3713 - DNA, 1078 bp, Primula obconica
gtagcaactctaagcaaacccactcgcttaatcctgttcttatctattctggcaaaagatagctcatcccattacggccgaaaaaagtttaagcattttgagctctcgtcgctagccctaaactactctctctctctctctctccgattgaatcacgatgacgaagcagcaagcaaacttttctccttacgacaacaatggcgggacgtgtgtagctattgcaggatcggattactgtgtgattgctgctgatacgaggatgtccactggctacagcatccttactcgcgattactccaaaatccgcaagctagcggacaagtcggtgatggcctcttcaggatttcaggctgatgttagagctttgcaaaaggttttggaagctaggcacttgagctaccagcatcagcacaacaagcaaatgagctgtcctgcaatggcccaactgctttccaacactctctactacaaacgtttctttccttattatgctttcaatgttctcggtggccttgataaagaaggaaagggttgcgtgtatacctatgatgctgtcggttcctatgagagggttggattcagcgcccaaggttctggttccacacttatcatgccttttctggacaaccaactgaaatcaccaagccctttgttattacctgctaaggatgctgttaccccactctctgaatctgaagccatcgatttggtgaagacttgttttgcctctgcaacagagagggatatatacaccggggacaaacttgaattagtcgtcttaaatgcaaatggtcttcgccgtgagtacatggaactcaggaaagattgatctgcctaaactgtctttgttcctagcatcgatgctctgtgttttgattgctgtcgactgtctgttttctgtagtttctatttatgcagatttcgtataagctttattgtacttcggatatatgaatttacttttgatgcaagtatgcttttatgaacaatttgtctaattctgctcctggtgtggtaatgagggaaatgacaatggagatgttgaaagaaagtatttttattaacaagtgcttatcgt

SEQ ID NO: 3714 - DNA, 1154 bp, Sequoia sempervirens
gcgaacagtgaaaggagctcgtgataaatttgttcattttctggattctctcggttccaacgtaagttcgtaaggaatacgactgcagttcgcgctaattcctcgtattactgaccgtagaagaaatgggtgctatagaagtgatcacgcagcgacagtctacatggagtccttacgacaacaacggaggaacttgtgttgcaatagcgggggccaactattgcgtaattgcagcagatagaagaatgtcgactggctatagcattctcacaagggattactctaagatttgcaaacttgcagataaatgtgtacttgcatcttcaggatttcaagctgatgtaaaggcattgcaaaaaaacttatctgctagacatctgatttatcagcatcagcataacaagcaaatgagttgccctgccatggcacagcttctctcaaatactctttactacaaacgatttttcccatattatgctttcaatgttttaggtggcctagacagtgaaggaaaaggctgtgttttcacatatgatgcagttggctcatatgaacgagtaggctatggatctcaggggactggctcgacacttatgatgcctgttcttgacaatcagcttaaatcccccagtcctctgctcctgccagctaaggatgcgactacccccctgtcagaatctgaagcagttgatttggtgaaggatatttttgcttcagctaccgaaagagacatatacactggtgatggactagaaatagtagttgtgaatgcagaaggcatcagacgagaagagattatggagttgcgaaaagattaatttcactgctaaatttggtgcactattagttatattttaaattaattgtgcatttctgttgaaggtttgaatctgcattaactgatattcatttgagaaatacaaatatcatgttatttattgtgaaattgagtgttcattacattcaattgatctgagatatctattgagttttgtactcattgctgcaacttactgaacaatgatacaaaattttggtgtttagtacaatgccttacaagaaacaaagtaattatctatggatactatgttgtgtgtttcctctagggcattcgtaggcgaacaagaaacaaagtaattatctatggatactat

SEQ ID NO: 3715 - DNA, 1122 bp, Panicum virgatum
agggtggggagggggaacgactgaacgagcaagccccacgcccacggcgcggcgaggcgcaggctagctatcatctcggcctccgccacccacggccggccggccggccccgcctccgccgcattgccgcgcgccgccgggccggcactcgccgtcctgacgcgagaggaaagaggtccctgagccgcgggggccctggctcggggcagcctgagccccgccgcgggatcggaggaggagcaaggaagcggtggaggcgggcgggcatgtgcgatctggtggcccgcacgggccggcacctgcagcgctacgaggacggccgtcgccttgtggccgggtgcataccattcagatatagacacattaaagatgaacaaaagaaacttgttgaagttctcatgatcaactcccaaagtggaccgggtcttctgtttccaaagggaggatgggagaatgatgaaaccgttgaagaggcagctgcacgagaagctatcgaagaagctggagttcgaggagatttagtgaaactgttgggcttctatgatttcaagacgaagcaacccgaaggtatgtgcagagctgctgtctttgcgctgcatgtgaaggaagagctggcctcctggcctgaacagagcacccggcagaggagttggctcacagttcctgaggcagcagagcggagtcgtcatccgtggatgcaagaagcccttgttacaggcttctctgcctggcttgagaactggatcaatggtggtggctgtgtggacggaagcgaaagatgacgacacctaaagcatcagggggcatctgctttttctctctcccctttttaccttgcttggacagctggactaaacttcaaaacctgacatacctgagggctctctgatgctcagtagtttgttcgttcacccatcatttcaggacacaattctgtgtcgtcaaccgacctgagaattgtcggaattgtaagttgcagattctcgcggtcaccagctattttactcctgactcaacattttaacaacaaatactgtgttgcaccttgttatggaagtgcatttgtaatgacaatactgaaagttatggattgtcttgttggtgaattggctctttctctcc

SEQ ID NO: 3716 - DNA, 1197 bp, Sorghum bicolor
gagcggccgagcgccccaagccccacggcgcagcgagccccacgataacacaacttccccacctccgccaccgccacccacggcccggccccgcctccgccgcattgccgcgcgccgccggccggcactcgccgtccggacgcgagagggaagaggctctaggaagcttgggggggacgggctaagggcagcctgtatcccgccgtgggatcggagggagaggccgggaggcgggcatgtgcgatctggtggcccgcacgggccggcacctgcagcgctacgagaacggccgtcgccttgtggccgggtgcataccattcagatatagagatattaatgatgaagcttctgatgatgaacaaaagaaacttgttgaagttctcatgatcagctcccaaagtggaccaggtcttctatttccaaagggaggctgggagaatgatgaaactgttgaagaggcagctgcaagggaagctatcgaagaagctggagttcgaggagatttagtgcaactgttgggcttctatgatttcaagagcaagcaacccgaagctatgtgcagagctgcaatctttgccctgcacgtgaaggaagagctagcctcctggccagaacagaacacccggcagaggagctggctcactgttcctgaggcggcagagcagagtcgttacccatggatgcaggaagcccttgtgacaggcttctctgcctggcttgagaactggagaaatggtggtggccgtgtggatcgaagtgaaagatgacacctaccttaagcatcaggggggcagcatctgctatttcttggtgttccctttgtatcttgcttggactaaatttccagaacctgacaatacatgagggctctctgatgctctgtagtttgttgacttttgttccttcacccatcctcaggataacaacaatctagcctgtgtcttcaactgacccgaggattgttggaattgtaagttgctgattctcgtggtcgccagctattttacccttgtgttgagtcttgacacaccaagcattgtccatcatatgtgtcgtgttgccttactatgggagtgtgtttgtaatgacaatatcgggagtcctcttgttgatcattgcaactctgcttaccctcggaaatatcttcttgggaatgttaagatttcaaatttgagaatttctacgttgaaaggtcta

SEQ ID NO: 3717 - DNA, 1533 bp, Sorghum bicolor
aaactatataataaagataataaaaagaaccaccacaaaaaaaaggaaaaaacaacggacaaagcaaaaggaacacaaaagaaaaggaaaaggaaaagagagggagagcgagaggaagcgagcggccgagcgccccaagccccacggcgcagcgagccccacgataacacaacttccccacctccgccaccgccacccacggcccggccccgcctccgccgcattgccgcgcgccgccggccggcactcgccgtccggacgcgagagggaagaggctctaggaagcttgggggggacgggctaagggcagcctgtatcccgccgtgggatcggagggagaggccgggaggcgggcatgtgcgatctggtggcccgcacgggccggcacctgcagcgctacgagaacggccgtcgccttgtggccgggtgcataccattcagatatagagatattaatgatgaagcttctgatgatgaacaaaagaaacttgttgaagttctcatgatcagctcccaaagtggaccaggtcttctatttccaaagggaggctgggagaatgatgaaactgttgaagaggcagctgcaagggaagctatcgaagaagctggagttcgaggagatttagtgcaactgttgggcttctatgatttcaagagcaagcaacccgaagctatgtgcagagctgcaatctttgccctgcacgtgaaggaagagctagcctcctggccagaacagaacacccggcagaggagctggctcactgttcctgaggcggcagagcagagtcgttacccatggatgcaggaagcccttgtgacaggcttctctgcctggcttgagaactggagaaatggtggtggccgtgtggatcgaagtgaaagatgacacctaccttaagcatcaggggggcagcatctgctatttcttggtgttccctttgtatcttgcttggactaaatttccagaacctgacaatacatgagggctctctgatgctctgtagtttgttgacttttgttccttcacccatcctcaggataacaacaatctagcctgtgtcttcaactgacccgaggattgttggaattgtaagttgctgattctcgtggtcgccagctattttacccttgtgttgagtcttgacacaccaagcattgtccatcatatgtgtcgtgttgccttactatgggagtgtgtttgtaatgacaatatcgggagtcctcttgttgatcattgcaactctgcttaccctcggaaatatcttcttgggaatgttaagatttcaaatttgagaatttctacgttgaaaggtctatttggggattttattttccgtgcccttcggatgtaggcatttttgtgcccttccagagttagtatgtattccgctaggcattttgtgtctaatggattgagctgtaaaactgaaccaaaatagagaacgtttgatttttttttttggagctactgtttagatttttattttaaaagtgatacttgtgagtattgcttaatgagccggtgaatttgat

SEQ ID NO: 3718 - DNA, 1250 bp, Zea mays
aaaaagaaaagagagggagaggaagcgagcggctgggcgccccaagccccacatggtgcagcgaggtccacgctaacaacttctcgaccttggcctcccacggctctgccgcattgccgcgcgccgccggccggcactcgccgtcctgacgcgagaaggaagatgctctaggaagttgggggcctggctagggacagcctgtgtcccgccgtgggatcggtgggagagggggaggcaggcatgtgtgatctggtggcccgcacgggccggcacctgcagcgctacgagaacggccgtcgccttgtggccgggtgcataccattcagatatagggatattaatgatggagcttctgatgatgaacaaaagaaacttgttgaagttctcatgatcagctcccaaagtggaccgggtcttctatttccaaagggaggctgggagaatgatgaaactgttgaagaggcagctgcaagggaagctatcgaagaagctggagtgcgaggagatttagtgcaactgctggggttctacgatttcaagagcaagcagcccgaagcaacgtgcagagccgcaatcttcgccctgcacgtgaaggaagagctagcctcctggccagaacagagcacccggcagaggagctggctcaccgttcccgaggcggcggagcggagccgctacccgtggatgcaggaggccctcgtgacaggcttctccgcctggctcgagaactggagaaacggtggtggcggcggcggcggctgcgtggaccgaactgagagatgacaccaccttaaagcatcaggggggcccccggcggagaagccatctgctagctatttcttggcgttgtatcttgcttggactagaattttcttccagaggctgactgcctggcatacatgcatgagggctctctgatgctcggtagcttttgtttactttgtcgctttattacaccgtcgtcttcaggatgacagtctcctcagctgatgatggcccgaggtttgttaaattgtaagcttgctgattctcgcggtcgccagctatatttaactgtcttgtattgagccttgagacaaagcaagctttgtgtatatcatgtgtcgtcgtcgtcgtggtgtactggtgtttgcctttttttgaagagttactggtgtttgccttgctatggaagtgcaacgggagtcctcttgttgtcacagtcgcaacttctctgcctttttaccctcggaaagatgctcttgcgacca

SEQ ID NO: 3719 - DNA, 803 bp, Pennisetum glaucum
ccttgtggccgggtgcataccatttagatatagagacattaaagatgaacaaaagaaacttgttgaagttctcatgatcaactcccagagtggaccaggtcttctatttccaaagggaggatgggagaatgatgaaactgtggaagaggcagctgcacgagaagctattgaagaagctggagttcgaggagatttagtgaaactgttgggcttctatgatttcaagagcaagcaacctgaaggtatgtgcagagctgctgtctttgcactgcacgtaacggaagagctggcctcctggcccgaacagagtacccgggagaggagctggctcaccgttcctgaggcagccgagcgaagtcgtcacccatggatgcaggaagcccttgtgacaggcttctctgcctggcttgagaacgcaagcaacggtggtggctgtgtggaccgaagtgaaagatgacgacacctgaagcatcaggggggggggggcatctgctatttccttttccctttttgaccttgcctggactataactcccagaaaacctgacataactgagggctccctgatgctcagtagcttgttggttcacccatcatttcaggacaggacacattatagtgtgtgtggtcgaccgacccgaggattgttggaattgtaagttactgattctcgtggtcaccagctatttaacttgtcttacaccaaatgtctgtgctgcaccttatatggaagcgtgtttgtaatggcaacattgaaagtcaggagttgtcttgttgatcaattgctgtttcttggatttggg

SEQ ID NO: 3720 - DNA, 1046 bp, Zea mays
aagcggctgggcgccccaagccccacatggtgcagcgaggtccacgctaacaacttctcgaccttggcctcccacggctctgcagcattgccgcgcgccgccggccgccactcgtcgtactgacgcgagaaggaagatgctctaggaagttgggggcctggctagggacagcctgtgtcccgccgtgggatcggtgggagagggggaggcagccatgtgtgatctggtggcccgcacgggccggcacctgcagcgctacgagaacggccgtcgccttgtggccgggtgcataccattcagatacatggatattgatgatggagcttctgatgatgaacaaaagaaacttgttgaagttctcatgatcagctcacaaagtggaccgggtcttctatttccaaagggaggctgggagaatgatgaagctgttgaagagacagctgcaagggaagctatcgaagaagctagagtgcgaggagatttagtgcaactgctggggttctacgatttcaagagcaagcagcccgaagcaacgtgtagagccgcaatctttgctctgcacgtgaaggaagagcgagcatcctggccagaacagagcacccgacagaggagctggctcacagttcccgaggcggcggagcggagctgctacctgtggatgcaggaggccctcgtgacaggcttctcctcctggctcgagaactggagaaacggtggtggcggcggctgcgtggaccgaactgagagatgacaccaccttaaatcatcagggggccccggcggagaagccatgtgctatttggcgttgtatctttgcttggactaaaattttcttccagaggctgactggcgtacatgcatgagggatctctgatgcttggtagcttttgtttactttgtcgctttattacaccgtcttcaggatgacagtctcctcagctgatgatgacccgagggatgttggagttgtaagctgctgattcttgcggtcgccagctatatttaactgtcttgtattgagccttgagacaaagcaagctttgtgt

SEQ ID NO: 3721 - DNA, 2661 bp, Brachypodium distachyon
caaaatttatacgccttgtatatttggacggtggagtaatcaagaaatgcaagcacgcaagaggaaaataactacaggagtccaacggaatggacgaattctctggccagacgacaatccaaacaaaggaaaagtgtgagaaatccaacgtgttaaagacgagaaggaggaagaaattctgaaactcttaaaaaaggcaaaaatttagcgaggaaggaagggaggaagccccaccccacggcacacctctcgagcccctcgacctcctccacccgcaccaccaccccgttcgcgtcccgcccttccaccgccgcattgctctcgccgccgcccaacccctccgcgagaggcaaggtcgacggccggacagaggtcgttggcgttcgcggacccggacccggatcggattaggaggaagagaaggcgggggcaggtgcggcgcggcggcatgtgcgatctggtggctcgcacgggccgtcttcagcagcggtacgaggacggccgtcgccttgtcgccgggtgcataccattcagatatagagataataatgacgaaacttctggcggcgagcagaagaggcttgttgaagttctcatgatcaactcccagagtggaccaggtctcctgtttccaaagggaggatgggagaatgatgaaaccgttgaagaagcagctgctcgggaagctattgaagaagctggagttcgaggcgatttagtgcaattcttgggcttctacaatttcaagagcaagtcacatcaagacgagttctgccctgaaggcatgtgcagagctgcgatttttgcactgcatgtgaaggaagagcttgcctcttggcccgaacagagtatccgccagaggagctggctcactgttcctgaggcggcggagcggagccggtacccatgggtgcaagaagcccttgtcacggggttctctgcttggcatgacaagtggagcgaagctggctccgctccggatccaagttcaagatgaccgcagtcccaagcagcagtggccagggccaaattccaaacatgccatatatgtgctcgctggtgctcagtgtttcgactacctctcctttctggatgtacaatcttagccttattagtgctgtcgattgctcaatccgagaattgttggaattgtaagtgttgattctcgtggttgctgtctggacttcactatttatgcgtcggaagtataattttaccggtcgatgtggaggcgcacgtgtacacaacagatgctttgtgtgttgcctgaaatcaaagaaagtttttctggctaatcacattgtgccgctcattgcaacagatgctttgtgtgtttccaatgaattgttgcctgcaatccaggttatgataatctttgatgttcataaacgtgggcaagtaaaaatgacaatgttgttacagtttagcctatcactgctaccttggtatctcataatcaacatgtttttgctggcttgattggtattactagattagaaccgaaagagtaataagaccaaaaaaaaggtttcaaaccccaagtacgactcgtcagaacgttcagagaacgatcaaaataaggatagcagagttgcgatggacaaaaacgatttggggtgagagaggctcgaactctcgacctcaggatcactcgcaattagctatgagacctacgcgctagccaactgcgccaccacccctttgttgtgagaattgttgtttcacatctcatactctctattcaggctgcacgccgaagagcagaggtcctgcctaggcggcgacgctgaccggcgcggccccgacggcgctgaggatcttgtcgtcgaggtcgaagctcatggccttctctccgtccactgctggcgtactcggcgaacctctccttgaggtcctccggcaggttggtggtgctcgtccaccccagcacctccttcgccgcccgaggctccgcgtagaaatgctgcaagccaattcaacaatcacatgacacgcaacgcaaaagcgccattaacgagcttgctcgcttagcttaccatgttgcggaaggggaaggccttcttggcgtcgacgccggcggcggccgggtcgtagtggacgatctcgacggcggcgccggctgccgccgcgcacatcttggccagcccgtccagcgtcactgcgcggtcgctcacgcagttgaagatcttcccggccgccgcgtcggggctctccacggccatcgtcagcatgctgcccaggtcccgcgcgtgggagatgttggtcagctgcatcccggaccccgggatcggcaccggccgcttccgcacgattcctgtcagattctttcttccgttaaaccactcctcgcagtccttgttgttgccggagccgatcatgtactgcggccggaacgaggcccagctgccgaactccgccgcgatgtacttctccacgcccacgtgccccgcgctccctttcacggcgtcctgcaaccatcggcattagtacttaagacgccgctcagtgctcagcttctagcttgcaggggcgatggatttgtgttatgttaccccctcgacgtgcggcggctcgtcggtcggagtgtagatcccggcgctgctgatgaagaggaactggcccacgccggccgactttgcccagtccgccaccggcctgcag

SEQ ID NO: 3722 - DNA, 585 bp, Panicum virgatum
tgcataccatttagatatagagacattaaagatgaacaaaagaaacttgttgaagttctcatgatcaactcccaaagtggaccaggtcttctatttccaaagggaggatgggagaatgatgaaactgttgaagaggcagctgcacgagaagctatcgaagaagctggagttcgaggagatttagtgaaactgttgggcttctatgatttcaagaccaagcaacctgaaggtatgtgcagagctgctgtctttgcgctgcatgtgaaggaagagctggcctcctggcctgaacagagcacccggcagaggagttggctcacagttcctgaggcagcagagcggagtcgtcatccgtggatgcaagaagcccttgttacaggcttctctgcctggcttgagaactggagcgatggtggttgttgtgtgaatctatgatacgcggatatttcgcaaaactcacgtaccggtatcggataccatatcggatacccgtactccacggatactcccggatacgtatcccgtaagtatcggactatttaggtattttcaaataataaaaataaatcggatactcatgggaaa

SEQ ID NO: 3723 - DNA, 884 bp, Brachypodium distachyon
gtgcggcgcggcggcatgtgcgatctggtggctcgcacgggccgtcttcagcagcggtacgaggacggccgtcgccttgtcgccgggtgcataccattcagatatagagataataatgacgaaacttctggcggcgagcagaagaggcttgttgaagttctcatgatcaactcccagagtggaccaggtctcctgtttccaaagggaggatgggagaatgatgaaaccgttgaagaagcagctgctcgggaagctattgaagaagctggagttcgaggcgatttagtgcaattcttgggcttctacaatttcaagagcaagtcacatcaagacgagttctgccctgaaggcatgtgcagagctgcgatttttgcactgcatgtgaaggaagagcttgcctcttggcccgaacagagtatccgccagaggagctggctcactgttcctgaggcggcggagcggagccggtacccatgggtgcaagaagcccttgtcacggggttctctgcttggcatgacaagtggagcgaagctggctccgctccggatccaagttcaagatgaccgcagtcccaagcagcagtggccagggccaaattccaaacatgccatatatgtgctcgctggtgctcagtgtttcgactacctctcctttctggatgtacaatcttagccttattagtgctgtcgattgctcaatccgagaattgttggaattgtaagtgttgattctcgtggttgctgtctggacttcactatttatgcgtcggaagtataattttaccggtcgatgtggaggcgcacgtgtacacaacagatgctttgtgtgttgcctgaaatcaaagaaagtttttctggctaatcacattgtgccgctcattgca

SEQ ID NO: 3724 - DNA, 1033 bp, Panicum virgatum
caaatctctcctccccctttctcgccctcgccgcattgcccgccgacgacccaccgccggatagagaggaggaggagcggcgcggctgcgggagaagcgggtggcggcggagcgggcggcatgtgcgacctggtggcccgcacgggccggcatcagcagcggtacgaggatggccgtcggctagtggccgggtgcataccatttaggtatagagttaataatgatgaacataagaaacttgtggaagttctcatgataaattcccaaagtggacctggtcttttgtttccaaagggaggatgggagaacgatgaaactgttgaagaggcagcagctcgagaagctatagaagaggctggagttcgaggtgatatagtgcatcttctggggttttatgactttaaaagcaagacacatcaagatgcgtgctgtcctgagggtatgtgcagagctgccgtgtttgcactgcatgtaaaggaagagctgacctcatggcctgagcagagcacccggcagagaacctggctcaccgttcctgaagctgcatcacagtgccggtaccagtggatgcaagaggccctgctcacaggcttctctgactggcacgacaagtggagcagaggtggcggtggtactaactgtgacccggcctaaccgccgaatccatcaggggtcctccaatttgttcatgttctctctgtccctaggcgccaaccttgcagaatgcaataatacagtgtacttctcttgtgtctggttaggccattgacccttgatgtctcatgtcaggatggttatctagtttagtgggatgtggtatatctcatcaagacgagaattctcacaacttttaagtgtcgattctcgtgcttattatttctcggtttcagctgctgctgtcgcggtgctgcaaggacgcactgtgcacattttgtaactcgctcctgattctggagatgcgtatgctatgtattcctaactgctatataagcctataataactgaaatcaaaaggtcaccattgactggagtc

SEQ ID NO: 3725 - DNA, 938 bp, Brachypodium distachyon
cgacacggcgcgcaggaagagcgggcgggcggcggctgcggcggcggcgggcagggtagcatcatgtgcgacctggtggcccgcacgggccggcaccagcagcggtacgaggacggccgtcgcctcgtggcagggtgcataccattcaggtacagagctaatagcgacgaaacttctggtgatgaacagaagaaacttgttgaagttctcatgataaactcccaaagtggaccaggtttattattcccaaagggaggatgggagaacgatgaaactgttgaacaggcagctgctcgggaagctatagaagaagctggagttcgaggagacatagtgcaatttctaggtttttatgacttcaagagcaagacacatcaggatgcatgctgccctgagggtatgtgcagagcggcagtgtttgcgcttcatgtgaaggaagagctggcctcgtggcctgagcagagcacccgccgaaggacctggttgacagttcctgaagctgtgtcgcagtgtcggtaccagtggatgcaagaggccctagtcacgggcttctccaactggcatgacaactggagcaaaggtggtggtggtaaagactgcgactcggtctaaatgcagaaacatgtcgctgtccttcgtttttgttcgcctcctcctctcctgcccctaggctccaaccttgcagattttgcaataatacagtgtggtgcttgatggatgatgcctagtaggttattgacccttcgtctctgggattgatatctagcttagtatatctcatcgaagacgagaattatcacaaattttaagtgtcagattctcgcgcctattattttgacaacttcagcttgatttctggctcctgattttggagatgcagacgctatgtattatttaaccacacctgaaatcaaaagtgtacttgttcagtcgactca

SEQ ID NO: 3726 - DNA, 953 bp, Brachypodium distachyon
cacagcccccccagccggcgacacggcgcgcaggaagagcgggcgggcggcggctgcggcggcggcgggcagggtagcatcatgtgcgacctggtggcccgcacgggccggcaccagcagcggtacgaggacggccgtcgcctcgtggcagggtgcataccattcaggtacagagctaatagcgacgaaacttctggtgatgaacagaagaaacttgttgaagttctcatgataaactcccaaagtggaccaggtttattattcccaaagggaggatgggagaacgatgaaactgttgaacaggcagctgctcgggaagctatagaagaagctggagttcgaggagacatagtgcaatttctaggtttttatgacttcaagagcaagacacatcaggatgcatgctgccctgagggtatgtgcagagcggcagtgtttgcgcttcatgtgaaggaagagctggcctcgtggcctgagcagagcacccgccgaaggacctggttgacagttcctgaagctgtgtcgcagtgtcggtaccagtggatgcaagaggccctagtcacgggcttctccaactggcatgacaactggagcaaaggtggtggtggtaaagactgcgactcggtctaaatgcagaaacatgtcgctgtccttcgtttttgttcgcctcctcctctcctgcccctaggctccaaccttgcagattttgcaataatacagtgtggtgcttgatggatgatgcctagtaggttattgacccttcgtctctgggattgatatctagcttagtatatctcatcgaagacgagaattatcacaaattttaagtgtcagattctcgcgcctattattttgacaacttcagcttgatttctggctcctgattttggagatgcagacgctatgtattatttaaccacacctgaaatcaaaagtgtacttgttcagtcgac

SEQ ID NO: 3727 - DNA, 1014 bp, Secale cereale
taagtttaaaccgtttaaactttaaattttaagttaacttaccccgttagtacaaccgaccggaccccaactcgccccacaggccggcgagacggcgcgcaggaagagcgggcgggcggcggcgggcagggtagcatgtgcgacctcgtggcccgcacgggtcgccaccagcagcggtatgaggacggccgacgcctcgtcgccgggtgcataccattcaggtatagagctgatgaaacttctggtgatgaacagaaaaaagttgttgaagttctcatgataaattcccaaagcggaccaggtttattattccccaagggaggatgggagaacgatgaaacagttgaacaagcagctgctcgagaagctatagaagaagctggagttcgaggagatatagtgcaatttctaggtttctatgatttcaagagcaagacgcatcaggacgcatgctgccccgagggcatgtgcagagcggcagtgtttgcactgcatgtgaaggaggagctggcctcatggcccgagcagagcacccgccggaggacctggctgacggtccccgaagccacgacacaatgtcggtaccagtggatgcaagaggccttgctgacgggcttctccgagtggcatgacaactggagcaaaggcggcggtgcaggcgacacaatctaaacgcaagaaggtgtcgtcgtttgtctgtcgtctctcgctttcctttgccttctcctctgttctcctcctccctaggccccaaccttgcacgcaaattgcaataatacagtgtggtgcttttacttgatgatgcctagtaggtcattgatccttggttcctgggattgaagtcttagtgtagtcgtatatctcatcgaagacgagaattatcacaaattttaagtgtctgattctcgcggcgtcaaattatttctcaaatttcagcttgattttgatttcttgctcctgattctgggggatgcatgccgcattgtatttaccagacctgaaatcgaaagtgta

SEQ ID NO: 3728 - DNA, 830 bp, Zea mays
gacgtatatcggatggctgacttcgcggacacgggcacacggcaacagaaggtcttcgccggactctacgcccactgaacacgcccttgagggctgaggccttgacccactgaacacgcccttggcgaccgccgccgctctactcccagttgccctgttcttcgccggacccttcgccggcgacaagcactaaccaacgaccaacacgttttgttgcgatggggttattcaggggcagcttcactctcttggtgggaatgggatgtggtgtctatatagctcagaactacaatgtgccgaacgtcaagaagctattcaacacatatgtttttctggcaaagcacattgaggaaacctaccgtaagccgaagaaagacgatgattgatccttttacatttgttttccatgttatgccctgggaaagcaagtacagctgacgtaatacagaaaggtgcttttttgaaatggtgaaggcatttttgtttatggtctagtttgaactccagtggtaaatgttagttgtggaattcagttgctgtgatagtttttggtcgcatgggcttctagatcatccccttttggcctttgctcgtgttcctgtgcctgagaaatgcactgaactttgtagttgaactgttgaagtgcggccatggataatctagcacatattagtgtgtttgtcaagttaacttaggatgggatgatgtgtttagttgaatctagatttatctttgtttctttaaattgtttgttcttcgatttaccacgatggatgatgacatttgtatttgcaaccagatagtggggatgtgcctttcaccacccataa

SEQ ID NO: 3729 - DNA, 636 bp, Triticum aestivum
  misc_feature (474)..(474): n is a, c, g, or t
  misc_feature (546)..(546): n is a, c, g, or t
  misc_feature (549)..(549): n is a, c, g, or t
  misc_feature (555)..(555): n is a, c, g, or t
  misc_feature (592)..(592): n is a, c, g, or t
  misc_feature (595)..(595): n is a, c, g, or t
  misc_feature (601)..(601): n is a, c, g, or t
ttctcccccaagttcatcttgtgcagttgtgctaacacgcggcgccccaggccctccggcgccgcccacctccaccgcctggaatccaggacatccggcgccgcccacctccgtcccctgtctgctgcctcgactcaactgttttgctgcgatggggttattcaggggcagcttcactctcttggtgggaatgggatgtggtgtctatatagctcagaactacaacgttccgaacgtcaagaagctattcaacacatatgtttttctggcaaagcacatcgaggaaacctaccgtaagccgaagaagaaagacgatgattgatcctttcacatttggtatctctgttatgccctgggagcatgtggaaatgtgcatttttgaaattgtgaaggcaattttggttatggacaaattttttaactccagtggaaaatgttagctgtgaaattcaattgctgtaatagttttggtcntaatggacatgggcttcaaaacctcccttttgctcgggtcctgtgcctggaaatcacggacttgtgttgaangcnggatgntaaccaacacacatggttttcagttacaaaggtgggnganagttantgaccaaattccaataaaatgcaagtctcgaaaaa

SEQ ID NO: 3730 - DNA, 763 bp, Zea mays
atattagaatatttcgagtacgcaaccagactccattctctcccccatcttctcccccaagttcatcctctgtgcagttgtgctaacacgcggcgccccaggccctccggcgccgcccacctccaccgcctggaatccaggacatccggcgccgcccacctccgtcccctgtctgctgcctcgactcaactgttttgctgcgatggggttattcaggggcagcttcactctcttggtgggaatgggatgtggtgtctatatagctcagaactacaacgttccgaacgtcaagaagctattcaacacatatgtttttctggcaaagcacatcgaggaaacctaccgtaagccgaagaagaaagacgatgattgatcctttcacatttggtatctctgttatgccctggagcatgtggaaatgtgcatttttgaaattgtgaaggcaattttggttatggacaagttttttaactccagtggaaaatgttagctgtgaaatttccagttgctgtaatagtttttggtcgtattggaccatgggcttctagagcctcccctttttgctcgtgttcctgtgcctgggaaatgcactggactttgttgttgaagtgcggcgatggataatctagcatcatcagtgtgtttttcatgttaacataaggatggggtgatatgtttatttgaacctagatttgccgaaatatatatattgacacaggttcttctgaacgcatgccatttcatgtgctcgtttgtgctattc

SEQ ID NO: 3731 - DNA, 884 bp, Pennisetum glaucum
tcgcccccaacatccagttgcgccgccgcgtcaccgtcgcctcgccgctcgccggcgactcgagacggcggagccgcccacaccgaagcctctgccccgggcgacaggcgtcgccctcatcgtcttccccgccctctgctggtgcctgggctttcgcgacgcggggatccgtcctcgctgacctagatcggcactccgcctctgccggtttcgtctcaatggggttattcaggggcggcttcactctcttggtgggaatggggtgcggcgtctatatagctcaaaactacaacgttccgaacgtcaagaagctattcaacacctacgtgtttctggcaaagcacattgaggaaacctaccggaagccgaagaaagatgaggattgatccttttacattggttttccctgctatgccctgggaaagcgaaagtacagctgacatgatacgggaacttgcttttctggaatggtgaaggcaatcttggtgattggcgagttttgagctatgttggataatattggttagttgtggaactgagttactgtaaaacttttccctcagtttagaccatgcatatctagactcccttttggtcatgttcctgtgccttggaaatgcactgaactttgtagctgaggtgtggcgatggataaactcagctatcacatcagtgtgtgtcaagttaacatgggatgggatgatatgcttagttcaatttagatttgctcttttttcttaaattgcctccctctttttatcactagattaacaaatatggattgtggaatttatatctgctactgaaatggggtgggggaatgttcctttgcggctttgctcctaaaatgactcttgcaacctggcactttggttttagtggcg

SEQ ID NO: 3732 - DNA, 555 bp, Panicum virgatum
  misc_feature (334)..(334): n is a, c, g, or t
  misc_feature (342)..(342): n is a, c, g, or t
  misc_feature (354)..(354): n is a, c, g, or t
  misc_feature (403)..(403): n is a, c, g, or t
  misc_feature (405)..(405): n is a, c, g, or t
  misc_feature (407)..(407): n is a, c, g, or t
  misc_feature (432)..(432): n is a, c, g, or t
  misc_feature (510)..(510): n is a, c, g, or t
ctgggcgagcggcggcgccgtttgtaacgtcttcgcccagctcttcgccggcgacgagcacccacaaggtttcgtctctatggggttattcaggggcagctttactctcttggtgggaatgggatgcggtatctatatagctcagaattacaacgttccaaatgtcaagaagctgttcaacacctacgttttcatggcaaagcacatcgaggaaacctaccggaagccaaagaaagacgatgattgatccttttatattggtcttccctgctatgctcggggaaagtggagtacagctaacgtgataggaaacatttttgaattggcaagggcnattttggngatcgacaggtnatgaactatggtggattatcttggttagttgtggaattcagttcctgtnananaatgttggtctgctttgaccatgantatgtagacgagcattccctttggtcgtgttcctgtgcctggaaatgcgcagaactttgcagctgagtgtggcggtgnataatctcgcatcatatatgaatgcactgaaacattttggcatgt

SEQ ID NO: 3733 - DNA, 834 bp, Sorghum bicolor
ggtaagagaggggggcgggcatacacctcttcgctgttcttctcccgtttcaccaggagtcttgcgctggattcggccgactgagcacggccttgccgccgccgccgccctactccaagctgcgcaggtcttcgtcggaccctttgccggcaacgagcatccaccagtcacacaccaggttttgttgcaatggggttattcaagggcagcttcacacttttggtgggaatgggatgtggtatctatgtagctcagaactacaacgttccgaacgtcaagaagttattcaacacatatgtttttctggctaagcacattgaggaaacctaccgaaagccgaagaaagacgatgattgattctttgggaaagcaagtacagctaacattatacggaaaggtgcttttttgaaatggtgaaggcaattttggttatgaacaagtattgaactctggtgggtaatgttggttagttgtggaattcagttgctgtaatagtttttggtcgtgttagaccatgagcttctatagcatcccttctgctcgtgttcctctgcctgggaaatgcactgaactttgtaattgaagtgcggtgatggataatgtagcatcatatcagtgtgtttgtcaacataggatgggatgatatgtttagttgactctagatttgtcttggtttgtttacattgtggtgttcctggatttaccacgatcgatgatgacaatttatattttcaaccggggtagggatgtgccttttcccacccatcatctagggttgacaaaccatgccgaaatacagtcgagttggcacgcatccttctgaacgcatgcttc

SEQ ID NO: 3734 - DNA, 1007 bp, Sorghum bicolor
agagagatacggaccaacaataaaaagggtaagagaggggggcgggcatacacctcttcgctgttcttctcccgtttcaccaggagtcttgcgctggattcggccgactgagcacggccttgccgccgccgccgccctactccaagctgcgcaggtcttcgtcggaccctttgccggcaacgagcatccaccagtcacacaccaggttttgttgcaatggggttattcaagggcagcttcacacttttggtgggaatgggatgtggtatctatgtagctcagaactacaacgttccgaacgtcaagaagttattcaacacatatgtttttctggctaagcacattgaggaaacctaccgaaagccgaagaaagacgatgattgattctttgggaaagcaagtacagctaacattatacggaaaggtgcttttttgaaatggtgaaggcaattttggttatgaacaagtattgaactctggtgggtaatgttggttagttgtggaattcagttgctgtaatagtttttggtcgtgttagaccatgagcttctatagcatcccttctgctcgtgttcctctgcctgggaaatgcactgaactttgtaattgaagtgcggtgatggataatgtagcatcatatcagtgtgtttgtcaacataggatgggatgatatgtttagttgactctagatttgtcttggtttgtttacattgtggtgttcctggatttaccacgatcgatgatgacaatttatattttcaaccggggtagggatgtgccttttcccacccatcatctagggttgacaaaccatgccgaaatacagtcgagttggcacgcatccttctgaacgcatgcttcatgtgctcgtttgtgctattcaccttgttgcttatctgttgtgaccaaacttttagaatatgtattaccatctacgaggtcaaatagctgcactatcaagatatatttcgtggagaatttaataaaactatttgtatgtgttggtg

SEQ ID NO: 3735 - DNA, 617 bp, Panicum virgatum
  misc_feature (21)..(21): n is a, c, g, or t
  misc_feature (172)..(172): n is a, c, g, or t
  misc_feature (288)..(288): n is a, c, g, or t
  misc_feature (351)..(351): n is a, c, g, or t
ggacgcagtccgctctgcccncgacggtgtggcggcgctggatcgactgcagcggcggcggcactccgactcgagggggccacggatctctcccctccgccatccatcctccccgcccgctttctcgccggttttgttcaatggggttattcaggggcagctttactctctnggtgggaatgggatgcggtatctatatagcgcagaactacaacgttccaaacgtcaagaagctgttcaacacctatgttttcctggcaaagcacatcgaggaaacctaccggaagncaaagaaagacgatgattgatccttttatattggtcttccctgctatgcctggggaaagtgangtacagctaacgtgatagggaacatttttgaactggcgagggcaattttggtgatcgacaggttatgaactatggtggattatcttggttagttgggaattcagttcctgtaaaaaattttggtctgtttagaccatgatgaatatgtagacgagcactcccctttgggcatgttcctgtgcctgggaaatggcactgaactttgcagttgaagtgtggcggtggataatctcgcgtcataacatggaatacactgttatgtttgg

SEQ ID NO: 3736 - DNA, 1425 bp, Oryza sativa
gtaaccgagctcgtattcgcgtcgtcgccctttctcctctcttctcctctcctcccccgtctccgccgctcgcgatccccaccgccgccggcgacgcgcgcgcggcggtcgccgggcgttgtgtccgcgccgccccgacgagccggctcgtcgacggagacggtgcggctgttcctccgtactcgtcgcccgccacctcatcccgcggcgccgtctccctcgatcccctcgccaaagcgcgcaaggaaggaaggctctcccccgccaccgacgccgtccgtccagatctaaggttttgacacaatggggttattcaagggcagcttcacattcatggtgggaatgggatgtggtgtctatgtagctcagaactacaatgttccaaacatcaagaagcttttcaacacatatgttttcatggcaaagcacatcgaggaaacgtatcggaagccaaagaaagatgatgactgatgatttccacagattttcattttggtgcccctggaaatcaacgtgtaactaacatgatacagaaatatgatgttcatgaatggggaagtcggtaaagtcggttctgatcgtcggcaattgaactatggtggcttaaatgctttaccggtgaaccactgtttactactttactatactgcttttaggggggttgttagagagacagaagttgctgtccagatgacaatgactcccttttatcttttgtcggtgctacgaaaatgcacttgacctttttttggctgttgaaatgtgtaggactggaaatccaccactattatcatgtccatctgtatatgtcatgcttagattttcaagaggccactgtttactatactgtttttagggggttgtcagagaagcagaagttactgtctactcgatgacaatgacttccttttgtggtttgtcggtgctaggaaaatttactagaccttttttttggctgttgagatgtgtaggcctggaaaatttactactgttatcatgtccatgtgtatatgtcatgctgagactaacttttcaagaggtcactgttgtttgtgcatgcaattatgggggtgattaatcggaatgacatgctgaaactgtttttcgtgtgattgtcaagcttaggtggatatgcgtgatcaacgttgcctaactagtgatttcagtatttcacatgtgcctaatgatattaacaccttgtaagcatatttaactgaaaatagacctttatcatcatagtgccacgcccaaaaaccatcaagatcatctcgcagtggtatggctagtatgattgatgcatcatcttgattaaaaagtttgctagaccagctgtgagtcccattgcaaagttatacgatcaatcaactcattaacagtattcaacagaatactgacttaccgagagctaactctccttcttgtgcc

SEQ ID NO: 3737 - DNA, 692 bp, Secale cereale
cgccatcccccgccagcaaccaccctcgacgccgccgttcccctccgcctcgccaatcccctccgcctcgccaatccccgaccccgtgccgacccgtgcccgctccccggccctccgctgccgccgcccacctcgtcgcacttccgccgccgtcacccctcggctgcctccggacccccgttgcgcctggccgtcgtgctgacctgtcgctgctgactccggcaccggcggctgactgcccgatctcctcaacccgcagctgctaatagacaccgatctgtgctcctccatctgcaacccggttttctcgcaatggggtttttcggtggtggcttcaagtttttagtgggaatgggatgtggtgtctatgtagctcagaactacaatgttccaaatgtcaagaagctgttcaacacgtatgttttcctggcaaagcacattgaggaaacataccgtaagccgaagaaagacgacaaagacgagtgattacacccctggcgaaaagaagtatactctgacatgacataaatgtaatcttcaagagcttagagctgtgaaattcatcacggcaaggtttgtggatctttatgataaagccttagaagtttttttaagtatgagagagggtatgcaagcgtccgatccaaatattatggccctagtataaatttcataatgagtgccccaatttg

SEQ ID NO: 3738 - DNA, 526 bp, Secale cereale
cctccggacccccgttgcgcctggccgtcgtgctgacctgccgctgctgactccggcaccggctgctgactgaccgatctcctcaacctgcagctgctaatcgacaccgatccgtgctcctccatcagcaaccggttttctcgcaatggggtttttcggtggtggcttcaagtttttagtgggaatgggatgtggtgtctatgtagctcagaactacaacgttccaaatgtcaagaagctgttcaacacgtatgttttcctggcaaagcacattgaggaaacataccgtaagccgaagaaagacgacaaagacgactgattacacccttggcgaaaagaattttactctgacacatgacataaatgtaatcttcaggagcttagagctgtgaaattcatcatggcaaggtttgtggatctttatgataaagccttagtagttttttaagtaggagagagggtatgcaagcgtccgatccaaatattatggccctagtataaatttcataatgagtgccccaatttg

SEQ ID NO: 3739 - DNA, 484 bp, Triticum aestivum
ggttttctcgcaatggggctttttggtggtggcctcaagtttttggtgggagtgggatgtggtgtctatgtagctcagaactacaacgttccaaatgtcaagaagctgttcaacacgtatgttttcctggcaaagcacattgaggaaacataccgtaagccgaagaaagacgacaaggacgagtgattatcgcgcccctgggccaaaagaagtttgttctgacatgacagcaatgtgatcttcaagtgcttagaagtacgacggtgcatagtgggtactactagctgtgaaatttaccatggcaaggtttgtggatctttatgatgaaaccttagtacgtattttttaagtaggagagagggtatgcaaacatccgatcgatatatcatggcaccagtacaagtttcataataaatggaacctcttgtcgtaatcttcccgtgagtgcccgatttgctatctcttccttactggttaggttttc

SEQ ID NO: 3740 - DNA, 570 bp, Secale cereale
cgccatcccccgccagcaaccaccctcgacgccgccgttcccctccgcctcgccaatcccctccgcctcgccaatccccgaccccgtgccgacccgtgcccgctccccggccctccgctgccgccgcccacctcgtcgcacttccgccgccgtcacccctcggctgcctccggacccccgttgcgcctggccgtcgtgctgacctgtcgctgctgactccggcaccggcggctgactgcccgatctcctcaacccgcagctgctaatagacaccgatctgtgctcctccatctgcaacccggttttctcgcaatggggtttttcggtggtggcttcaagtttttagtgggaatgggatgtggtgtctatgtagctcagaactacaatgttccaaatgtcaagaagctgttcaacacgtatgttttcctggcaaagcacattgaggaaacataccgtaagccgaagaaagacgacaaagacgagtgattacacccctggcgaaaagaagtatactctgacatgacataaatgtaatcttcaagagcttagagctgtgaaattcatcacggc

SEQ ID NO: 3741 - DNA, 507 bp, Hordeum vulgare
tcatcggtatccaggttttctcgcaatggggctcttcggtagcggcttcaaatttctggcgggagtgggatgtggtgtctatgtggctcagaactacaacgttccaaatgtcaagaagctgttcaacacgtatgttttcctggccaagcacattgaggaaacataccgcaagccaaagaaagacgacaaagacgactgattatcgcgcccctggcgaaaagaagtatactctgacatgacagaagcgtgatcttcaagagcttaaaactacgacggatcatagtgggtagctgtgaaatttgtcatggcaatgtttgtggatatttatgatgaaaccttagtattttgattgaagtaggagacaaaggtatgccaacatccgatccatatattatggcactagtacaaaattcatatcgtaataaatggcacattttgtgtcgttatcttcccgtgagtgcccgatttgctctcccttcctggttactagtccagatttctatgaag

SEQ ID NO: 3742 - DNA, 1344 bp, Brachypodium distachyon
attggatcggtttggtctaggtgagtatgcggtttggattggtctggtctctcctcgtccaccctgtctgcttgactcctgattcctctcctccccgattccctcttctctcccgattcgcgccgccacccttcagatccaccgccggcaactcgccccctccaccctccggctatcgcggcaccgcgcccaccaccctcctccacactcaggccgaagcccatctcgccgcctctcccacgaagatccggcagcttggcgctcatctcggagttcatcttgtcccggtccaagaccctccaccgagctgctcatccacgcccgccgcctgctcgccctccctgcctcccttccatgtagatccatctcggtgtgcggagctcctccccctacgtaccaagccgccgtagtacactgcgtcaccggctgccccacgcccgccgacgtcctctgcctcctcttcgtctgtggaggattttgacgcctggctcgccaataagcttctgcagatcctacgagacggagtacagaactcggggtcacaattcataagggaaggagaaggacttgtgattatctacgcagaaggaggagacgtagtacaggttttctcacaatgggattattcagtggaagcttcaaatttttaatgggaatgggatgtggtatctatgtagcccagaactacaacgttccaaatgtcaagaagctgtttaacacatatgttttcctagcaaagcacctcgaggaaacataccgcaagccgaagaaagaagattgatcgtcacgccccccagcgaagtgacagaaacatgatctttataaatggtgaagcagttttgatcgtaaacggaactgtgatggcttatactcctattagttagctgtgatgttggtggcacgtttttgtggattattaggacaaacacaattctctgggtgttgcctaggtgacccaattcgtcatttccagtgctggatttcaaatgcagagcttggtgatttctgttacctcggcttattgccaagtaccttagctctaactgctgtcatggattgatgaattacctacttttcaacaggccatgatttgagaaaaaaaaatcacttaggtatcgtactatttactataaattctcctgagtgactcaaccatactttgaacatggaaaatttctactccgtgattttttttttggagagaattagacagtttttaggactgcaccagtaggaggctccttttgagaaaagagagcaaaaacaacaattgtaaaagagtaatgtcatccattgtcaagcgatttgttagaaagctgttgctccgcggacaaataagctgta

SEQ ID NO: 3743 - DNA, 1498 bp, Hordeum vulgare
cggtaaccctcgccggccagtcgccgccgccatcccccaccaggcggcactcctcgacgcaggcgctccacgccgagccaatccccgactccctgccgacccgcgcgcgctccccggccatccgctgcgccgcccgcatcgtcgcactcccgccgtcacccctcggctacctccggacccccgttgcgcctggtcgttgtgccgacctgccgctgctgactcccgcgcccgcggccgactgctcgatctcctcgacccgcatctgctaatcgacaccgatccgtgctcctccatccgtaacccggttttctcgcaatggggctcttcggtagcggcttcaaatttctggcgggagtgggatgtggtgtctatgtggctcagaactacaacgttccaaatgtcaagaagctgttcaacacgtatgttttcctggccaagcacattgaggaaacataccgcaagccaaagaaagacgacaaagacgactgattatcgcgcccctggcgaaaagaagtatactctgacatgacagaagcgtgatcttcaagagcttaaaactacgacggatcatagtgggtagctgtgaaatttgtcatggcaatgtttgtggatatttatgatgaaaccttagtattttgattgaagtaggagacaaagaacggaagaagatcgggaggcttgagggccaaggcagtgggcccacagggagccacaagccctgttgccgcggccagggggccgcggaaaccaagcttgtgccccctggcgctcccctgccctagctctttggcctataaattccctaaaaatccagaaaaaatcagggcatccacgaaaacacttttccgccgccgcaagcttccgtttccgcgagatctcatctggagacccttcccggtgccctgccggaggggactttggagttggagggcttctacatcaacatcatcgcctctccaatgactcgtgagtagtccacttcagacctacgggtccgtagttagtagctagatggcttcttctctctcttggatcttcaatacaaagttctccatgatcttcatggagatctatccgatgtaatcctctttggcggtgtgtttgtcgagatccgatgaattgtggatttgtgatcagattatctatgaattatatttgagtctttgctgatttcttatatgcatgatttgatatccttgtaagtctctccgagtcttgggctttgtttggccaactagatctatgattcttgcaatgggagaagtgcttggttttgggttcataccgtgcggtgacctttcccagtgacagaaggggcagcaaggcacacatcatgttgttgccatcagggtaacaagatgggctttcatcatagatttcagattgtccatctacatcatgtcatcttgcttaaggcgtcactctgttcttatgaactcaatacactagacgcatgctggaaagcggtcgtaatagtagtagatacacaaagtatcac

SEQ ID NO: 3744 - DNA, 730 bp, Oryza sativa
cttctcacccgatccctctgacctccgttttacgagttcggttcgaacggaacggatcggggcgaaggcgaggcgagtgtgtgcgagacccgaaataaaaataaattaaaaaaaaatctgcttcaacgagagaacccagaaaaaaaccagcagagagaagtctccagattctagggttggggaatcgcggcgagaggaagtagcagcggcggcggcggagggaggggaggtgaaccagcagcctgagcaggagcggcggcgtcggcggcggcggattccaagttttgttgcaatgggtttcttcaggaccagcttcacattaatgtttggaatgggatgtggtgtctatgtagctcagaattatgacgtcccaaatgtcaagaagctattcaacacgtacatgttcctagccaagcatattgaggaaacatatcgtaagccaaagagagacgactgatagattgcaaagttttttcttgcatcacccttggattgtgaagtatatctctgacatgatacagaaaatgtaatctcttcagaagtttcataggaagtttctatttctcgacaactgttgaactatgatcttggttagctgtgagattctaccgatgtaacagttttgcggataatttaccggatgtctagttgagcacttcttttttgtttgattgccaattgtaggcaaatggaaagtttatgctaatttttttcaaatttttgtggcctg

SEQ ID NO: 3745 - DNA, 1218 bp, Brachypodium distachyon
attggatcggtttggtctaggtgagtatgcggtttggattggtctggtctctcctcgtccaccctgtctgcttgactcctgattcctctcctccccgattccctcttctctcccgattcgcgccgccacccttcagatccaccgccggcaactcgccccctccaccctccggctatcgcggcaccgcgcccaccaccctcctccacactcaggccgaagcccatctcgccgcctctcccacgaagatccggcagcttggcgctcatctcggagttcatcttgtcccggtccaagaccctccaccgagctgctcatccacgcccgccgcctgctcgccctccctgcctcccttccatgtagatccatctcggtgtgcggagctcctccccctacgtaccaagccgccgtagtacactgcgtcaccggctgccccacgcccgccgacgtcctctgcctcctcttcgtctgtggaggattttgacgcctggctcgccaataagcttctgcagatcctacgagacggagtacagaactcggggtcacaattcataagggaaggagaaggacttgtgattatctacgcagaaggaggagacgtagtacagatttgggcacaggcaggaagaggcgtgatgcagggaagaatgtttctggttgatttctacgaaaacagagggcacaggctcggtatcatgggcggggacacacaagtgaaaagcaataccacaaggttttctcacaatgggattattcagtggaagcttcaaatttttaatgggaatgggatgtggtatctatgtagcccagaactacaacgttccaaatgtcaagaagctgtttaacacatatgttttcctagcaaagcacctcgaggaaacataccgcaagccgaagaaagaagattgatcgtcacgccccccagcgaagtgacagaaacatgatctttataaatggtgaagcagttttgatcgtaaacggaactgtgatggcttatactcctattagttagctgtgatgttggtggcacgtttttgtggattattaggacaaacacaattctctgggtgttgcctaggtgacccaattcgtcatttccagtgctggatttcaaatgcagagcttggtgatttctgttacctcggcttattgccaagtaccttagctctaactgctgtcatggattgatgaattacctacttttcaacaggccatgatttg

SEQ ID NO: 3746 - DNA, 550 bp, Secale cereale
acctcgtcgcactcccgccgccgtcacccctcgccctcggccccccgttgcgccgctgctgactccgacgccggcggccgactgcccgatctcctccacctgcggctgctaatcgacatcggtccgtgctccttcatctgcaacccggttttcttgcaatggttttcggtggcggcttcaaatttttagtgggaatgggatgtggtgtctatgtagctcagaactacaatgttccaaatgtcaagaagctgttcaacacgtatgttttcctggcaaagcacgttgaggaaacttaccgtaagccgccgaagaaagacgacgactgattatcacgcccatggcgaaaagtatactctgacttgacagaaatatcatcttcgtgaatattaaagtagttatgatcttttcaagagctgagaacacaagctgtgaagtttgtcatggcaaggtttgttgatctttatgataaaaccctggtgttttttaacgtccgatccaaatattatggcactagtagaaatttcataataaatgggtgcctgacatctta

SEQ ID NO: 3747 - DNA, 551 bp, Secale cereale
ccgacccgtgcgcgctcctgggccctccgcggcgccgcccacctcgtcgcactcccgccgccgtcacccctcgccctcggctccccgttgcgccgctgctgactccgacgccggtctcctccacctgcagctgctaatcgacatcgatccgtgctccttcatctgcaacccggttttcttgcaatggttttcggtggcggcttcaaatttttagtgggaatgggatgtggtgtctatgtagctcagaactacaatgttccaaatgtcaagaagctgttcaacacgtatgttttcctggcaaagcacgttgaggaaacttaccgtaagccgcctaagaaagacgacgactgattatcacgcccatggcgaaaagtatactctgacttgacagaaacatcatcttcgtgaatattaaagtagttatgatcttttcaagagctgagaacacaagctgtgaagtttgtcatggcaaggtttgttgatctttatgataaaaccctggtgttttttaacgtccgatccaaatattatggcactagtagaaatttcat

SEQ ID NO: 3748 - DNA, 615 bp, Triticum aestivum
tgggccctccgcggcgccgcccacctcgtcgcactcccgccgccgtcacccctcgccctcggctccctcggacccccgttgcgcctggccgtcgtgctgacctgccgctgctgactccgacgccggcggccgactgcccgatctcctccacctgcagctgctaatcgacatcgatccgtgctccttcatctgcgacccggttttcttgcaatggttttcggtggcggcttcaaatttttagtgggagtgggatgtggtgtctatgtagctcagaactacaacgttccaaatgtcaagaagctgttcaacacgtatgttttcctggcaaagcacattgaggaaacataccgtaagccgaagaaagacgacaaggacgagtgattatcgcgcccctgggccaaaagaagtttgttctgacatgacagcaatgtgatcttcaagtgcttagaagtacgacggtgcatagtgggtactactagctgtgaaatttaccatggcaaggtttgtggatctttatgatgaaaccttagtacgtattttttaagtaggagagagggtatgcaaacatccgatcgatatatcatggcaccagtacaagtttcataataaatggaa

SEQ ID NO: 3749 - DNA, 715 bp, Triticum aestivum
gccgggcagtcctcccctctgtcctcggccgagcgcgctagggttcctcatcccgccgcccgctcctctcctcctccctccgacgagcgagggcctcctccgacccccgcagcagccgacgagcgcggccccgacgcgcccaccccgcctgcccctgccgtcctctgcccccggtcacctccgcagcagccggcgagccaaggacggtgccgtgaccctcgccgccacctcccgccgtctcttcctgcgcgtggccgaccgctgctctccttcgaccgcggcctggggttttcttgcaatggttttcggtggcggcttcaaatttttagtgggagtgggatgtggtgtctatgtagctcagaactacaacgttccaaatgtcaagaagctgttcaacacgtatgttttcctggcaaagcacgttgaggaaacttaccgtaagccgccgaagaaagacgacgactgattatcatacccatggcgaaaagaagtatatactctgacattacagaaacatgatctgcgtgaatattaaagttgttatgatcttttcaagagctgagaacaccagctgtgaagtttgtcatggcaaggtttgtggatctttatgataaaaccttagtgttttttaacgtccgattcaaatattatggcactggtagaaatttcataataagtgggtgtctggcaacttaccaaaagtgccccgatttgc

SEQ ID NO: 3750 - DNA, 856 bp, Zea mays
atctcatctctctccccgacctcccagctctagagtctagacagccacaggcaggagctccacgagtccacgtgacctcagacctcacacattcacagtgtcacgctgcctcaacgtcatgtctctcctcgcctcccccacgccgttcggcgtgaccgccatccgccgccgcgtcgccccgcttcctctcctccctgctggcggtcgcgccgccctgcacgtggccctcgcgcgccgcggcggggtctcgtcccggacgcagcggcgcctcgaggaacgaggaggcaagaagcgccgcggtggggtcgtggcgcccgacgtggacgaggacgcggcggaggcgggggtggctgagtgggaaggggagccgctggggttcgaggtgtcgacggagcccatgccgcggctgccagacccggagacgcccgacttctgggagggacctcagtgggaggccctcggcttcttcgtgcagtacatgtgggcgttcggcgtcgtcttcggcctcattgcttgcggtgtcgctgtggccacttacaacgatggtgcaacagatttcaaagacacgcctgcttacaaggagtcccaatcacaggagttccctgaggagtcagaatcatcaagcgctgatgtgtttgaaggcaatccgactgaggtagcaccagctctcgagtaggactatcaaggaggcacgggagaaaagttgtctctcgattcaagctatagcctatagggcttcgccttcgcaatatagatgcaaaggtttggttgatgatgctaagaaaattggctggtaattattttgtactgaattttcccttagaattaaatatagatggctagtgtctagtggtga

SEQ ID NO: 3751 - DNA, 1091 bp, Sorghum bicolor
aaaatatcttatctcatctctctccccgccctcccagctcgagacagccacagccaggagctctccccgcctccacgctgcagcttctccacgtgacctcacacattcacagtgcctcgctgccccgaagcctcagcctcccatgtctctcctcgcctcccccacgccgttcggcgcggccgccgtccgccgccgcgtcgcgccgcttcctctcctccctgcaggcggtcgcgccgcgctgcacgtggccctcgcgcgccgcggcggggtctcgtcccgcacgcagcggcgcctcgaggaacgcggaggcaagaagcgccgcggcggggtcgcggcgcccgacgtggacgaggacgcggcggaggcgggggcggcggcttgggaaggggagccgctggggttcgaggtgtcgacggagcccatgccacagctgccggacccggagacgcccgacttctgggagggacctcagtgggaggccctcggcttcttcgtgcagtacatgtgggcgttcggcgtcgtcttcggcctcattgcttgtggtgtcgctgtggctacctacaacgatggagcaacagatttcagagacacgcctgcttacaaggaatcccaatcacaggagttccctgaggaggcagaatcatcaagcgccgatgtgtttgaaggcaatccaactgaggtagcaccagctcttgagtaggaggcacgggggagaaaacttgtgtctctattcaagctatagcctatagggctttgcgtttgcaataggcaataagacatgtaaaagccttggttgaaatcttgatgccaagaaaattggctggttaatattgtgtactgaattttcccttagaatcgaatatagatggctagtggtgataggattcaactgtactttattaccaaaagttgggggaaacgaaagagagcaagcattgctgtcttccctgtattttgattcatcctgcctctacaatggcttttctggcacatataagtccaagggaaatgtataatttcaaataagtttcacaaattacattctgtaccggcacaatccataattcaaaggaacatgtggcattatcaga

SEQ ID NO: 3752 - DNA, 1391 bp, Sorghum bicolor
tgatagtgtcctaaaggtaaacaaacaaatatgccttttatacctccacacgtagttcataggaggaagaagatatttatttctatttctttcatagggcgattcgcatgactcaaagttcttgacaagaaagagatgagatccccttttacctgaaaaaaatgaaatatacatggaaatgaaaaaccccaaattatatataccaagaacaaaaaaggagaaaatatcttatctcatctctctccccgccctcccagctcgagacagccacagccaggagctctccccgcctccacgctgcagcttctccacgtgacctcacacattcacagtgcctcgctgccccgaagcctcagcctcccatgtctctcctcgcctcccccacgccgttcggcgcggccgccgtccgccgccgcgtcgcgccgcttcctctcctccctgcaggcggtcgcgccgcgctgcacgtggccctcgcgcgccgcggcggggtctcgtcccgcacgcagcggcgcctcgaggaacgcggaggcaagaagcgccgcggcggggtcgcggcgcccgacgtggacgaggacgcggcggaggcgggggcggcggcttgggaaggggagccgctggggttcgaggtgtcgacggagcccatgccacagctgccggacccggagacgcccgacttctgggagggacctcagtgggaggccctcggcttcttcgtgcagtacatgtgggcgttcggcgtcgtcttcggcctcattgcttgtggtgtcgctgtggctacctacaacgatggagcaacagatttcagagacacgcctgcttacaaggaatcccaatcacaggagttccctgaggaggcagaatcatcaagcgccgatgtgtttgaaggcaatccaactgaggtagcaccagctcttgagtaggaggcacgggggagaaaacttgtgtctctattcaagctatagcctatagggctttgcgtttgcaataggcaataagacatgtaaaagccttggttgaaatcttgatgccaagaaaattggctggttaatattgtgtactgaattttcccttagaatcgaatatagatggctagtggtgataggattcaactgtactttattaccaaaagttgggggaaacgaaagagagcaagcattgctgtcttccctgtattttgattcatcctgcctctacaatggcttttctggcacatataagtccaagggaaatgtataatttcaaataagtttcacaaattacattctgtaccggcacaatccataattcaaaggaacatgtggcattatcagattcagtttttttttagagttctagggggatggctggagctcagttcagtttcaaactctcagaatgcattatcagattca

SEQ ID NO: 3753 - DNA, 915 bp, Zea mays
aaaaaaatcttatctcatctctccccgtcctcccgtcctccatgtcgacttgtcgagacaccacaggctccaactccccggcccgctgcatcttctccacgtgaccgcccatcccacaatcacagtgccgcgctgccccgcagcctcagccgcatggctctcctcgcctcccccacgccgttcggcgctgcagccatccgccgccgcgtcgccccgcttcctctcatccctgcaggcggtcgcgccgccctgcacgtggccctcgcgcgccgcggcggggtctcgtcccgcacgcagcggcgcctcgaggagcgcggaggcaagaagcgccgcggcggggtcgcggcgcccgacgtggacgaggacgcggcggaggcggggacggcggcggagtgggaaggggagccgctggggttcgaggtgtcgacggagcccatgccggagctgccgaacccggagaagcccgacttctgggaggggcctcagtgggaggccctcggcttcttcgtgcagtacatgtgggcgttcggcgtcgtcttcggcctcattgcttgtggcgtcgctgtggccacctacaacgacggggcaacggatttcagagacacgcctgcttacaaggaatcccaatcacaggagttccctgaggagtcggaatcatcgagcgctgatgtgttcgaaggcaacccgactgaggtagcaccagctcttgagtaggactagcaaggaggcacgggggagaaaactcgtctctctattcaagctttagcctatagggagggcttcgcgtttgctgtatagatataaaaggtttggttaaaatctgatgctacgaaaattggctggtataattattttgtactggattttcccttagaatcaaatatagatggatggctagtgcctggtggtgatggg

SEQ ID NO: 3754 - DNA, 699 bp, Panicum virgatum
tccgccgtcgcgccgcaccgcttccccttctccccgcgagcggtcgcgctgccctgcacgtggccctcgctcgccgcggcggggtctcgtcccgcacgcagcggcgcctcgaggagcgcggcggcaagaagcgccgcggcggggtcgcggcgcccgacgtggacgaggaggcggcggaggcgggggccgcggagtgggaaggggagccgctggggttcgaggtgtcgacggagcccatgccggagctaccggacccggagacgccggacttctgggaggggccccagtgggaggcccttggcttcttcgtccagtatatgtgggcgttcggcgtcgtgttcggcctcattgcttgtggtgttgcggtggctacctacaacgatggggcaacagatttcagagacactcctgcttacaaggaatcgcaaacacaggagttccctgaggagtccgaatcatcaagcgctgatgtgtttgaaggcaatccgactgaagtagcaccagctcttgagtagggctggcaaggagacacgagggagagaagaagatgaccctctgtctgcggtatagcctataggacttttccttgaaagtagctggtgagcatgtacgttttggttgaaatcatgatgctatgaaatttggctcgtaattattgtgtactgaattttcccctggaagaaattatagatggctagt

SEQ ID NO: 3755 - DNA, 970 bp, Saccharum officinarum
cgctgcagcttctccacgtgacctcacacattcacagtgcctcgctgccccgcagcctgagcctctaatgtctctcctcgcctcccccacgccgcgctgcacgtggccctcgcgcgccgcggcggggtctcgtcccgcacgcagcggcgcctcgaggaacgcggaggcaagaagcgccgcggcggggtcgcggcgcccgacgtggacgaggacgcgacggaggcgggggcggcggagtgggaaggggagccgctggggttcgaggtgtcgacggagcccatgccgcagctgccggacccggagacgcccgacttctgggagggacctcagtgggaggccctcggcttcttcgtgcagtacatgtgggcgttcggcgtcgtcttcggcctcattgcttgtggtgtcgctgtggctacctacaacgatggggcaacagatttcagagacacgcctgcttataaggaatcccaatcacaggagttcccggaggagtcagaatcatcaagcgctgatgtgtttcaaggcaatccaactgaggtagcaccagctcttgagtaggaggcacggggagaagacttgtctctctattcaagctatagcctgtagggctttgcgtatgcaataggcaataagacatgtaaaaggcttggttgaaatcttgatgctaagaaaattggctggttaatgttgtgtactgaattttcccttagaatcaaatatagatggctagtggtgataggattcaactgtactttatacccaaaagtagggggaaacgaaagagagcaagcattgctgtcttccctgtattttgcattcatcttcatcctgcctccacgatggcttttctggcacatagtccaagggaaatgtataattcaaataaatttcacaaattacattctgtaccggcacaatccatcggacgtgcgagggtttccgaattcggtccggtacgtcagtcgaacgg

SEQ ID NO: 3756 - DNA, 821 bp, Pennisetum glaucum
ctgccgtacacgtggccctcgcgcgccgcggcggggtctcgtcccgcacgcagcggcgcctcgaggagcgcggcggaaagaagcgccgcggtggggtcgcagcgcccgacgtggacgaggacgcagcggaggcgggggcggcggagtgggaaggggagccgctggggttcgaggtgtcgacagagcccatgccggtgctgccggacccggagacgcccgacttctgggagggaccccagtgggaggccctcggcttcttcgtccagtacatgtgggcgtttggcgtcgtcttcggcctcattgcttgtggtgttgccgtggctacctacaatgatggcgcaacagatttcaaggacactcctgcctacaaggaatcactaacacaggagttccctgaggagtctgaatcatcaggtgctgatgtgtttgaaggcaatccgactgaggtagcgccagctcttgagtaggaccgtcgaggaaatacgggggagacaagaagatgactctctactatttgaggtatagcctatagggctttacctatgaagtagcgggtaagacatgtaaggtttggttgaaatcataatgctaaaaaaatggctggtaactattgagcactgaattttcccttggatgaaaatatagatggctagtggtgatagaatttaagtattcaactgtcacttgcacccagaagtagggaaaaggaagagagcaaggattgccaaatttcctgtattttgctttcatcttaccctgtaccatcataggatgcttttcatgcatatagtctgaggaaaatgtataattcaatgaatttc

SEQ ID NO: 3757 - DNA, 891 bp, Pseudoroegneria spicata
  misc_feature (369)..(369): n is a, c, g, or t
gccgctctcgcgcacactcgcgcagagccactgccgcgtccagctccaggccgcatgtctctcctcagttcccccacgccgttcggcgcggccaccgccgcccgccgtcgcctcccgctcgccgccccactcctgggccgccgcgccgcgctgcacgtggcgctcgcgcgccggaccggcgtctcgtcccgcacgcagcggcgcctcgaggagcgcggcggcaagaagcgccgcggcggcgtcgagacccccgacgcggacgaggactccggcccggcgtgggagggcgtggagtgggaaggggagccgctggggttcgaggtgtcgacggagccgatgccgtacctgccggacccggagaagcccganttctgggaggggcccaactgggaagccctcggcttcttcgtgcagtacatgtgggccttcggcgtcttcttctctttggttgcttgtggcgttgccgtggctacatataacgatggggcatcagacttcagagacactcctgctttcaaggaatcaacccaggcccaggagttccccgaagagtcagaatcatcgggcgccgatgtgtttgaaggtaatccaactgaggtagcaccagctcttgagtaggacttgtcaaggagacatcagggaaaagaaatgaaggctctctctttgagctatagggctctgcagtagccagtaaacttgtacaacattcagtggaaatttgaaaccatagtgttaaggaaattggctgccatggtttggaaaagaaaattagctggcgatcactatgtactgaattatctcttgaacaatcctacgtcgaggtcagaatatgtaaatggttaattagtggtgatgaaattcagctatgcttctatctttattgttatttta

SEQ ID NO: 3758 - DNA, 1154 bp, Brachypodium distachyon
ccccaggattagaatagatgcaccgcgaaaatttaaaccggaaaacaaatgaaaagaaagattatctcatcttcctcccggctctcacacagcttcccccgctccacgctctccacgtgaccacacctccggtcctccacacgccctgcgcgcacacacagtcacacagagcccctgccgcgtcatgtctctcctggcttccccgacgccgttcggcacggcctccgccgccgcccgccgtcgcctccctcccgccaccaccccgctcctgggccgccgcgccgcgctgcacgtggcgctcgcgcgccggggcggcgtctcgtcccgcacgcagcggaggctcgaggagcgcggcgggaagaagcgccgcggcggggtcgacgcccccgcaccgcccgacgcggacgaggactacgccgaggcgtgggagggggtggagtgggagggggagccgctggggttcgaggtgtcgacgacgccgatgccgtacctgccggacccggagcagcaagacttctgggaggggccccagtgggacgggcttggcttcttcgtgcagtacatgtgggccttcggcgtcttcttctctttgattgcttgtggtgttgccgtggctacatataacgatggggcaacagacttcagagacactccagctttcaaggaatcccaaacacaggagttcccagaagagtcagaatcatcaggctctgatgtgtttgaaggtaatccaactgaggtagcaccagctcttgagtaggactgtcaaggaggcattatgagaagaaaaaggatgaaggctctctctttgagctatagggctatgcggtagccattaaaatttgtgcaagattcagctgaaactcgaaaccatagtggtaaggaaattagctggtgatcaccatgtactgaattctcccctgataatcctacgttgaaatcagaatatgtagatggttagtggtgatgaaattcagttgtgtttttatgccttcttttatttttatttaatttcctgggtactcaaatggtttgtctacatgtcgagtgacaagaagcacattcatgtcttttctgtcatctacctagtacaaaatgtacattcctgatcatctaacaaaaatattccaaagaccaaacttatttcaaaaaac

SEQ ID NO: 3759 - DNA, 947 bp, Brachypodium distachyon
gtcatgtctctcctggcttccccgacgccgttcggcacggcctccgccgccgcccgccgtcgcctccctcccgccaccaccccgctcctgggccgccgcgccgcgctgcacgtggcgctcgcgcgccggggcggcgtctcgtcccgcacgcagcggaggctcgaggagcgcggcgggaagaagcgccgcggcggggtcgacgcccccgcaccgcccgacgcggacgaggactacgccgaggcgtgggagggggtggagtgggagggggagccgctggggttcgaggtgtcgacgacgccgatgccgtacctgccggacccggagcagcaagacttctgggaggggccccagtgggacgggcttggcttcttcgtgcagtacatgtgggccttcggcgtcttcttctctttgattgcttgtggtgttgccgtggctacatataacgatggggcaacagacttcagagacactccagctttcaaggaatcccaaacacaggagttcccagaagagtcagaatcatcaggctctgatgtgtttgaaggtaatccaactgaggtagcaccagctcttgagtaggactgtcaaggaggcattatgagaagaaaaaggatgaaggctctctctttgagctatagggctatgcggtagccattaaaatttgtgcaagattcagctgaaactcgaaaccatagtggtaaggaaattagctggtgatcaccatgtactgaattctcccctgataatcctacgttgaaatcagaatatgtagatggttagtggtgatgaaattcagttgtgtttttatgccttcttttatttttatttaatttcctgggtactcaaatggtttgtctacatgtcgagtgacaagaagcacattcatgtcttttctgtcatctacctagtacaaaatgtacattcctgatcatctaacaaaaatattc

SEQ ID NO: 3760 - DNA, 692 bp, Sorghum bicolor
atcgcaacaaagttacaaacttacaatacaccagcaattagcagagcaaagtgcaggagaaaatggcctccatgaagccgctgctcacgctcacctgcatcttcctcctctccgggctcgtcgtgttgggtgagatcggcgggacgacgctggcggcgccggagccgtgcccggtggtgtgcatccagggcgggtacatcacctgcgacaactacccgtaccaggagctggacggctgcgactgcgagtgcgcgcccaaggacggcatcaactgcgtgctccaccaccttgccaccggcgataccttcaactgcccaccgcaggcataggctttgcacttcagctggagcggcgcatgcagggatgatacgagggctcgctgttgctgctcttgattagtctataccaagctgatgcactgtgatcatcgtctgaatagtatcgttgctgaatatcagtgaagtcctagtatatatgtttatagtacaataatgaaagcatgtgtcttagcactatagcgtctgtatgatgatgtgaaacgaacgatgacagggcaagcccagtctgcactgcagtcaactgaacaagcgtttcaaggtcatgaaaaatattcaaaatgcaaaaggccaccgttattttttcaatttgcttaacagtacttttcagtcaacgcgttgaagtttgaactccct

SEQ ID NO: 3761 - DNA, 751 bp, Sorghum bicolor
cacatcttcgtattgccatcgttctctatataaacacatcgatatgcacttctgcagccatcgcaacaaagttacaaacttacaatacaccagcaattagcagagcaaagtgcaggagaaaatggcctccatgaagccgctgctcacgctcacctgcatcttcctcctctccgggctcgtcgtgttgggtgagatcggcgggacgacgctggcggcgccggagccgtgcccggtggtgtgcatccagggcgggtacatcacctgcgacaactacccgtaccaggagctggacggctgcgactgcgagtgcgcgcccaaggacggcatcaactgcgtgctccaccaccttgccaccggcgataccttcaactgcccaccgcaggcataggctttgcacttcagctggagcggcgcatgcagggatgatacgagggctcgctgttgctgctcttgattagtctataccaagctgatgcactgtgatcatcgtctgaatagtatcgttgctgaatatcagtgaagtcctagtatatatgtttatagtacaataatgaaagcatgtgtcttagcactatagcgtctgtatgatgatgtgaaacgaacgatgacagggcaagcccagtctgcactgcagtcaactgaacaagcgtttcaaggtcatgaaaaatattcaaaatgcaaaaggccaccgttattttttcaatttgcttaacagtacttttcagtcaacgcgttgaagtttgaactccct

SEQ ID NO: 3762 - DNA, 1699 bp, Panicum virgatum
gttgtcttgcccttatccatccaaatcgcgagaaattccccgtcaccatgaagctccggttgcgatcgatggaggcgcgcggcggcggtcgcgccgccgtcgagacccaccgcgtggatctgccgcccacggccacgctgccctacgtgaaggccctcctcgccgccaagctctccgcggcgcagcccgtccccgccgagtccgtccgcctctccctcaaccgcaccgaggagctcgtctcgcccgaccccgccgccacgctccccgccctcggcctcgcgtccggcgacctcgtctacttcgccctgtctcctctcacagccctcgcgccgccggcgcaggcgctgccccggaaccctagcccggggtccgcctctgttccgaccgcgatggccgtcgacggcggtaaagggtcggaacagcctggcaccggaggttcctcgctgcaggtgcgaacggtggccgtggaccctatcgttccagccgcacccggtccggcggatgtggtgatggaggaggtcgtcgatgccacaaagggctggtcgagttttgtgcttagggatctcaagagggagatggggaacgtcgctggcgcagaggaaaccgccgccggtcgcctggtttcggccctgcatgcagctctgcttgaggttggcttcctcaccactgatccgatggggtcatacctctcgctgcaacaggactggccgtcggttgcttcaaagccactggccatcaagtataccataccagagctttcaccaatgtcgcctgcggccgaggagggtaaagtggcagtgctgaacttctccttgatgggtaatttcgtgattgtatacgggtatgtgcctggggcgcagtcggaggtgtgccgattgtgcttggagttgccaaggcttgagcctttgctgtatctggatagcgatcagctgagcggagtgcaggagagggcgattcttgatatgtggaaagtgctgaaggatgatatgtgcttgccactgatgatatccttatgccagctgaatggtttgcgcttgcccccatgcttgatggctctgcctgctgagctgaagactaaggtcttggatcttttacctggggatgatcttgcaagggttgagtgcacttgcaaggaaatgaggaatcttgcagcagatgatagtctttgggagaagtttatagcgaagtacaaaaattatggtgagggttctagaggggccatgagcgcgaaggccatgtttggagaagcttggctggccaataagaggcggcagaagaggccccatccaaccttttggaactatggctggggaaacaatccttatagccgtccacttaggcagccgttgattggtggggactcagacagactgccttttattggtaatcacggttctgttgggcgtaactttggaaatcaacgaaggaacatcgtgccgaactgcattcttgatggtcaccgccataacttcctttgaagtttctttgggttttcttgtatgccaagagtattttgtaagaaggggtgcatagacggatagaccgtcttgttaatatcttcaagttgcacacttatgcatgcgcagagcacccttatccttatatatccttttagtatcttagatcctgtcttttctgtttttgtttttatgataccgatgtaacccatgctctagtaataaagtacccttgttctatt

SEQ ID NO: 3763 - DNA, 2507 bp, Sorghum bicolor
atgcactcactttcttcctcctctcttccgctcccaggctcccaatttgttatcgtcgcgcgccaacgacgacagtcattccttggcctcgtccgtttctcctcgggtaaccaacctccttcctactcctccagaccacacatccaccccactggtttgcctgagagcatcacaacaagagggagagacagagacaagcaggcggcgggccggagaagcaaggaggcatggggatgggcagcgacgctgccgccgtgttgttccccttctctaccaccaccaccaccacgtcgccgcggctctgcggcaccgccgtcagtagtcacaggaggatattttcagatgtcgctgaggatgtgaccgtatcggtggatggacagtcgtttctcctgcacaagttccctttagtatctcggtgtggacgagtacggaaaatggtagtggactccaaggacccagatctcctaaagctggagcttgtaaatgtaccagggggagcttttgcattcgaacttgctgccaagttctgttacggtagcaatttcgaaataaccacgggaaatgtggcccatctgcgatgcgttgcagagtacttggaaatgacggaggactatcaagaggagaacctcattttcaggacagagacgtacttgaacgagatcgtgctcaagaacctcgataaatccctggaagtcctttgtaaatgtgatggattggacccagtagtggaggaagtcgggcttgttgataggtgtgtcgatgcaatcgcggtgaatgcaagtaaggagcagctggtttcaggtttggctcacttggaatgtgatgtgggatctgcaaagctgcgtatgcactgccaggattggtgggttgaagacctttctgcattgagaattgaccactatcggcgtgtgattgctgcaatgagaagaaatggggtcaggcctgagagtattggcacctctattactcactatgcccaaacatcactcaagggtgtcgaaagacgacatgtatgggactcaggtccctttgtcggagacagtcaaagaatgattgttgagacactcatcgatctgttagcgactgaaaatattacaacggttactttatccttcctgtttggcatgctgagaatggcaattgaagttgatgcaagcctagactgcagaatcgaagtcgagaaaaggattggccttcagctggagatggcatcactagatgatctgctgatcccctccacgcaaacaagtgactcgatgtttgacgttgacactgtccaccgtatattggtgaacttcttgcagaggatagacgaagatagttcaggagagttgtcaccttgtggatatgactctgacggactcaagtctccaagccacagttcagtcctgaaggttggaagactaatggatggttatcttgcagaggtagcaccagatccctatctgaaactgcagaagttcatggctctgattgaactgttgccagattatgcacgcattgttgatgatggactctatcgtgccatcgacatatacctgaaggcgcatccatctctgacggagtcggagtgcaagaagctgtgcaagctgatcgactgccagaagctgtcgcaggacgcgtcgagccacgcggcgcagaacgaccggctgccgatccagatggtggtgcgcgtgctctacttcgagcagctccgcctcaagtcgtccttctcaggcggcgggtccgggtgcgtgagcggcctcgggctgggcgccgacgggtccctgtcgcagcggttcgtgtgcagcagcagcggcgtgccgagctcgtgcgtgtcgccgcagcgggacaactacgcgtcgctgcggcgggagaaccgggagctgaagctggagatctcgcggatgcgggtgcggctgacggagctggagcgggagcaggggctgatgaagcagcaagggaggatgcgcggcggggacggcggcgggcggcacggcggggagcagggccgcgcgttcctcgcgtcgctgtcgaggggcttcggccgcatcaccatgttcggcgtcggcggcgggcccgcggcggcggacaggagaaggaagaagagcggcggcaggagctcccagtgctccgacggcaaggctcgcaggcggcacaaggcgtccttcgcctacgactgatgcagtgaagctttggcatcgtcgacaatggaggcaggcggcgatcgtggatggatgccgtctctagcagccggaggatcggagatagcaggccagtgggctgaggatgatcaagactgcgtttttagatgttggtgaaggcagttcgtcactcagacgaacaaatggaatggatcaagcggaggtttatagcaggaattgcttgtgcttgcgacagattttagcaggaacaacgcagggtaacgaaattagcaccaggaactgctagtgtcaaaaacttgatgactgtaatatatacactagtctagtatactactttttagcctgaaatttgaatgcttgcct

SEQ ID NO: 3764 - DNA, 2789 bp, Sorghum bicolor
cagaatactgacagtggagcaggggttgtcccctagtcacccaactattcctccccgagtcgcttttttcagtcatcagtctgatgaatgatgatggggggttcctttttctctctcaggctcagacgctgagctaatcataatctttgttcctcctaatccctcctccgctctgcctcccacgtcaagatcaagacacaacaaaacaaacgatgctctgtcgctgtctgcatgcactcactttcttcctcctctcttccgctcccaggctcccaatttgttatcgtcgcgcgccaacgacgacagtcattccttggcctcgtccgtttctcctcgggtaaccaacctccttcctactcctccagaccacacatccaccccactggtttgcctgagagcatcacaacaagagggagagacagagacaagcaggcggcgggccggagaagcaaggaggcatggggatgggcagcgacgctgccgccgtgttgttccccttctctaccaccaccaccaccacgtcgccgcggctctgcggcaccgccgtcagtagtcacaggaggatattttcagatgtcgctgaggatgtgaccgtatcggtggatggacagtcgtttctcctgcacaagttccctttagtatctcggtgtggacgagtacggaaaatggtagtggactccaaggacccagatctcctaaagctggagcttgtaaatgtaccagggggagcttttgcattcgaacttgctgccaagttctgttacggtagcaatttcgaaataaccacgggaaatgtggcccatctgcgatgcgttgcagagtacttggaaatgacggaggactatcaagaggagaacctcattttcaggacagagacgtacttgaacgagatcgtgctcaagaacctcgataaatccctggaagtcctttgtaaatgtgatggattggacccagtagtggaggaagtcgggcttgttgataggtgtgtcgatgcaatcgcggtgaatgcaagtaaggagcagctggtttcaggtttggctcacttggaatgtgatgtgggatctgcaaagctgcgtatgcactgccaggattggtgggttgaagacctttctgcattgagaattgaccactatcggcgtgtgattgctgcaatgagaagaaatggggtcaggcctgagagtattggcacctctattactcactatgcccaaacatcactcaagggtgtcgaaagacgacatgtatgggactcaggtccctttgtcggagacagtcaaagaatgattgttgagacactcatcgatctgttagcgactgaaaatattacaacggttactttatccttcctgtttggcatgctgagaatggcaattgaagttgatgcaagcctagactgcagaatcgaagtcgagaaaaggattggccttcagctggagatggcatcactagatgatctgctgatcccctccacgcaaacaagtgactcgatgtttgacgttgacactgtccaccgtatattggtgaacttcttgcagaggatagacgaagatagttcaggagagttgtcaccttgtggatatgactctgacggactcaagtctccaagccacagttcagtcctgaaggttggaagactaatggatggttatcttgcagaggtagcaccagatccctatctgaaactgcagaagttcatggctctgattgaactgttgccagattatgcacgcattgttgatgatggactctatcgtgccatcgacatatacctgaaggcgcatccatctctgacggagtcggagtgcaagaagctgtgcaagctgatcgactgccagaagctgtcgcaggacgcgtcgagccacgcggcgcagaacgaccggctgccgatccagatggtggtgcgcgtgctctacttcgagcagctccgcctcaagtcgtccttctcaggcggcgggtccgggtgcgtgagcggcctcgggctgggcgccgacgggtccctgtcgcagcggttcgtgtgcagcagcagcggcgtgccgagctcgtgcgtgtcgccgcagcgggacaactacgcgtcgctgcggcgggagaaccgggagctgaagctggagatctcgcggatgcgggtgcggctgacggagctggagcgggagcaggggctgatgaagcagcaagggaggatgcgcggcggggacggcggcgggcggcacggcggggagcagggccgcgcgttcctcgcgtcgctgtcgaggggcttcggccgcatcaccatgttcggcgtcggcggcgggcccgcggcggcggacaggagaaggaagaagagcggcggcaggagctcccagtgctccgacggcaaggctcgcaggcggcacaaggcgtccttcgcctacgactgatgcagtgaagctttggcatcgtcgacaatggaggcaggcggcgatcgtggatggatgccgtctctagcagccggaggatcggagatagcaggccagtgggctgaggatgatcaagactgcgtttttagatgttggtgaaggcagttcgtcactcagacgaacaaatggaatggatcaagcggaggtttatagcaggaattgcttgtgcttgcgacagattttagcaggaacaacgcagggtaacgaaattagcaccaggaactgctagtgtcaaaaacttgatgactgtaatatatacactagtctagtatactactttttagcctgaaatttgaatgcttgccttcactggattgcattgcatcatgcatccatccatcctacagctttaaagcg

SEQ ID NO: 3765 - DNA, 844 bp, Panicum virgatum
gattgctgctcgtcgggtgattccttggtcgcttctggtggcggtggcctcgtttgatccgtttctttgggagattttggttgatgtgttgggtttcctcggagctcagttccccaattcgccattttgatgaggagttcttcctactgtgagagcaactgcgctcctcctctgtgctacctgccctgcctcctcaaatccaaagacgatgcagggggtgatctggaatccgagtctccgagcccggcagctgtcgctgaggacaagccgcccgtggtccagaagattgaggaagccgcggcggcgaccggcggcggcgatgacgacgacgatgatgagaagggctgtaaggaggtggcggtggcttccaagagctgcttgaagagggctgattgtgtggacagcagtaaaaatgtggtaaaaggcaatgtgaagtggaaggatttgttggggaaagatctcacacaagtcaaggaattcgagccaagcgaatccggagactcggacgacgacgaagacgccggcgcctgcacctgtgtcatccaatgagcccggggggtctccactgtaaattctgtgaagaaaaagaaaaacaaaaacagaagagaattgcctgagtcagccattagtcattgtgagtagagggtagagagcagcaggtccattgttgtgtgtgggtatgtggatggcaacggcgccatggcttgtgttgtctttcgtcagcagcttcaacagtaaaatgttgttacaaatgcatagctttagaaggtttctgccaaaggtgtcattctcctgtctgaactttgtcatgcttgctgtggctgagacattctcgttttctttg

SEQ ID NO: 3766 - DNA, 1377 bp, Setaria italica
ctccattcccctccatcaaaagaatttccatttcttccgtgggatttctgcgatttttttttctcactcggtttcttgtggggctggccgcgaggttgcgaggccaagcagcgcagcaaaagttgcgatctttatcggctggattcctctcctccctttctctctcatcctccgcttcctttgtgcttcgttgttgagagttgagacccacttgcctttcttctctctctcatcccccttccaactcctcctggtccctggaaaaaaggagatcttttggtgcaagattcgatctgctgttgccgccttgctgcacagagatttgctcctttcttggccggtttcgctcggtggtttcttggagtggcagggctttctggtgtgggcagttgcagttcttgatccaggctcagattgcaggcggtggatgattgctctgagggcgaggttgctgcggtcaggtgattccttggtcgcttgtggtggcggtggcctcgtttgatccgtttcttcgggagattttggttgatgtgttgggtttcctgggagctcagttccccaattcgccattttgatgaggagttcttcctactgtgagagcaactgcgctcctcccctgtgctacctgccctgcctccccaaatccaaagacgatgcagggggtgatctggcatccgggtctccaagcccggccgctgtcaccgaggacaagccgcccgtggtccagaagattgaggaagccgcggcggcgcccggcggcgatgatgatgatgagaaaggctgtaaggaggtggcggtggcttccaagagctgcttgaagagagctgattgtgcggacagcagtaagaatgtggtgaaaggcaatgtgaagtggaaggatttgttggggaaggatctcacacaagtcaaagaattcgagccaagcgaatccggagactcggacgatgatgaagacaccggcgcctgcacctgtgtcatccaatgaggccaggggtctccactgtaaattctgtgaagaaaaaacaaaaagcaaaaacagaagaggattgtctgagtcagccattagtcattgtctgtagaggctagaccgctagagagcagcaggtccatccattgttgtgcgtgtggatatttggatgccatggcttgtgttgtgtttcatcagcagcttcaactgtaaaatgttgttacagatgcatagctttagaagatttctgccaaatgtgccatattctcctgcctgaattttgctctgcttgctgtggctgagacattctgattggctggtacatctgtctgtcaatgggcctggctggacttgacctgatccaatctgatgattctaaccgggctggactgggctgtccatttggggac

SEQ ID NO: 3767 - DNA, 850 bp, Sorghum bicolor
cgcagctcaattagccatggaaataacaaaaagtttagtaaagggaacgagctttctagaatgaaaatctgccgtggctgatctgtcaccacacgattggcaggaaaaggataagaggggaaacctcataaaacggatcaccagcccaacgcaaccaaaacatttttctcttctctccatcgcttctcccactcgtcaagccatggccacctcggtctccgccgtggccgccctagccgttttctcggctccaagaagcctccttcagcgcccggcccagctgccgtcccgccagaacgtcgtgtcgttcttcgtcgggccggcgcgggcgcaccgccggttggtggccgtggcggccagctcgccggccacgccgccggatcttgccaacaaggtgtccgagagcatcaagcaggccaaggagacgtgcgcggatgacccggtgagcgccgagtgcgtggcggcgtgggacgaggtggaggagctcagcgcggccgccagccacgcgcgcgaccggcagaagggcgtcgacccgctcgaggagtactgcaaggacaaccccgagaccgacgagtgccgcacgtacgaggactgaaacgcgcgaggctggcctccggcttccgccatcgctgtcgcttgatctagctagcttggcatgatggcaatttgcaggcatgcaatggatgatggttctgccccttcgtcacctttggtgcttgagtttggtttcttcgtttttttagtctttggcttggtgtggaataaagcgaggtttgttatttataagaaacatttaggaactcctaatgtaattccaagtaggatgtaatccttagaaatatatttgctg

SEQ ID NO: 3768 - DNA, 876 bp, Sorghum bicolor
aaacggatcaccagcccaacgcaaccaaaacatttttctcttctctccatcgcttctcccactcgtcaagccatggccacctcggtctccgccgtggccgccctagccgttttctcggctccaagaagcctccttcagcgcccggcccagctgccgtcccgccagaacgtcgtgtcgttcttcgtcgggccggcgcgggcgcaccgccggttggtggccgtggcggccagctcgccggccacgccgccggatcttgccaacaaggtgtccgagagcatcaagcaggccaaggagacgtgcgcggatgacccggtgagcgccgagtgcgtggcggcgtgggacgaggtggaggagctcagcgcggccgccagccacgcgcgcgaccggcagaagggcgtcgacccgctcgaggagtactgcaaggacaaccccgagaccgacgagtgccgcacgtacgaggactgaaacgcgcgaggctggcctccggcttccgccatcgctgtcgcttgatctagctagcttggcatgatggcaatttgcaggcatgcaatggatgatggttctgccccttcgtcacctttggtgcttgagtttggtttcttcgtttttttagtctttggcttggtgtggaataaagcgaggtttgttatttataagaaacatttaggaactcctaatgtaattccaagtaggatgtaatccttagaaatatatttgctggtgtgcttctggtacttgattacactatgtgctagtccaatacatgtctcaatgatactgcatgtcagaagtagcactaagaaatttgagaccgagacaaagtatttgggacgggattgtttacttatatcccgcccaattgacactccaattcac

SEQ ID NO: 3769 - DNA, 2037 bp, Saccharum officinarum
cccaccgcctccttcgactcttcttcaccctcccctcctctccctcgcgaactcacgagattaccaagtagacgagcgagaaggagatggcgaagaagaaggagaaggcggtgaacgtgtcgggcaagccacggcactcgaacgacgtcaaccgccccaatgacaagaagggcgcgggcggcggcgccggcggcgggagccggtccgcggccaccgtgcggcggctcaagatgtacaagacgcggcccaagagggaccgctccgggaaggtgctcaggaacgacttccagtctaaagagctccccaacacccgcatcgagcccgaccgccggtggtttggcaatactcgcgttgtgggccagccacagcttgaaatgtttcgggaggaactccagagtcggctttccgacaacttcagtgtcatcctgaaagaacggaagctgccattatcgctcctgcaagatcatcaaaagcaagcaagggcacatcttcttgatgttgaaccttttgagcatgcttttgggccaaagggcaagaggaaacgcccgaaactcactgctcttgactatgaatctttgctgaagagagctgatgattcccaagatgcatttgagcaaaagtatgcttcatcaaagttgccaagggaggaagaagaagacggcttacgggatctagtgaggcatacaatgtttgagaagggacagagcaaaagaatctggggtgaactatacaaagttattgactcttcagacgttgttgtgcaggtgttggatgctagggatccaatgggcactcgatgctaccatctagagaaacatctaaaagagaattgcaaacacaaacacttggttttcttactaaataagtgtgatctaattcctgcttgggctacaaaaggatggttaaggaccctttcgaaggactatcccaccctagcattccatgcaagcatcaacaagtcatttggcaaaggatctcttctgtcagtattgaggcagtttgctcgtttgaagaatgacaaacaagctatttctgtcgggtttgttgggtacccgaatgttggaaagtcatcagttattaacacactacggtcgaagagtgtctgcaaggttgctccgattcctggagagacaaaagtgtggcagtacatcactctcactaaaaagatctttttgattgattgtcctggtgttgtatatcagaataatgattcagaaactgatatagttctgaagggtgtggtgcgagtgacaaatttggaggatgctgctgagcacattggtgaagttcttaggcgtgttagaaaggagcatcttcaaagagcgtacaaaattcaagaatggtctgatgataatgattttcttgtccagctgtgcaggactactggaaaacttctcaagggtggggagcctgatctgacaacagcagccaagatggtacttcatgactggcagaggggtaaaattcccttttttgtaccccctccacagcaaagtgaggatggtgcatctgaaagtgctgaacctgttgggaaaaccgaagaggacggagtaagcagcgacaggactgccgctgccatgaaagccattgcaggaataatttcgtcacagcagaacatgaatgtaccctgccacaaggaacacaatgcagacaacgaagacactgagagtgcagataatgaagacattgagggcgcagataaggaagacattgatagtgcggacaacgacgagcttgcagagcaatctgagtaatctttgggtacatatgtggattggagttgatatgtcaaggctaatgagtttgtcagcccaggtattgtgtagctacttaaccatatcactggtgtgccagaaaaaaaagtttcatgttggtttgcggagcaactgggttcttttttgtaactatcgtacctgaatctttgtaatagggcaagtagagcagttttgctaggtacctggttgtatcaggatgtttatctgtactgtctactacaaatacagttacaacaattttacttaaatctagtcaagttat

SEQ ID NO: 3770 - DNA, 2170 bp, Sorghum bicolor
gccgcccactccaccgctcccatccgtctcctctgaaaaccctagcttgccaacatcgtttcctccttccctccgcctccttcgactcttcttcaccctcccttcccctctcactcgcgaactcacgagattaccaaatagacgagggagaaggagatggcgaagaagaaggagaaggcggtgaacgtgtcgggcaagccgcggcactcgaacgacgtcaaccgccccaatgacaagaagggcgcgggcggcggcgccggcggcgggagccggtccgcggccaccgtgcggcggctcaagatgtacaagacgcggcccaagagggaccgcgccgggaaggtgctcaggaacgacttccagtctaaagagctccccaacacccgcatcgtgcccgaccgccggtggttcggcaatacccgcgttgtgggccagcaacagcttgctttttttcgggaggaactcacgagtcagctttccgacaacttcagtgtcatcctgaaagaacggaagctgccactatcgctcctgcaagatcatcaaaagcaagcaagggcacatcttcttgatgttgaaccttttgagcatgcttttgggccaaagggcaagaggaaacgcccgaaactaactgctcttgactatgaatctttgctgaagaaggctgatgattcccaagatgcatttgagcaaaagtatgcttcatcaaagttgccaagggaggaagaagaagatggcttacgggatctagtgaggcatacgatgtttgagaagggacagagcaaaagaatctggggtgaactatacaaagttattgactcttcggacgttgttgtgcaggtgttggatgccagggatccaatgggcactcgatgctaccatctagagaaacatctaagagagaattgcaaacataaacacttggttttcttactaaataagtgtgatctaattcctgcttgggctacaaaaggatggttaaggaccctttccaaggactatcccaccctagcattccatgcaagcatcaacaagtcatttggcaaaggatctcttctgtcagtattgaggcagtttgctcgtttgaagaatgacaaacaagctatttctgtcgggtttgttgggtaccccaatgttggaaagtcatcagttattaacacactacggtcgaagagtgtctgcaaggttgctccaattcctggggagacaaaagtgtggcagtacatcactctcactaaaaagatctttttgattgattgtcctggtgttgtatatcagaataatgattcagaaactgatatagttctgaagggtgtggtgcgagtgacaaatttggaggatgctgctgagcacattggtgaagttcttaggcgtgttaaaaaggagcatcttcaaagagcgtacaaaattcaagaatggtctgatgataacgattttctagtacagctgtgcaggaccactggaaaacttctcaagggtggggagcctgatctaacaacagcagccaagatggtacttcatgactggcagaggggtaaaattcccttttttgtaccccctccacagcaaagtgaggatggtgcatctgaaagtgctgaacctgttgggaaaaccgaagaggacggagtaagcagcgacaggactgctgctgccatgaaagccattgcaggaataatttcgtcacagcagaacatgaatgtaccctgccacaaggaacacaatgcagacaacgaagacactgcgagtgaagataacgaagacattgagagtgcagacaacgatgagcatgcagagcaatctgagtaatctttgggtacagatgtggattagagctaatatgtccatgataatgagtttgtcagcccaggtattgtgtacctacttttaccggtgtgccaggaaaagaaagtttcatgttgatttgaggagcaactgggttcttttttgtaactgtcgtacctgaatctttgtaatagggtagagcagttttgctaggtaactggttgtatcaggatgtttatctgtactgtctactacaaatacagtcacaaaaatttcacttaaagtcaagttgtccctaatttttgtaacgctgcacactgcaattttgcggcttcatggattcctacatacctacatatgtcactcctatgaatcctatctttttcgattgtgc

SEQ ID NO: 3771 - DNA, 2208 bp, Sorghum bicolor
caaaaggctcacatgcctgacgcgcacgtgcaagtcacgccgcccactccaccgctcccatccgtctcctctgaaaaccctagcttgccaacatcgtttcctccttccctccgcctccttcgactcttcttcaccctcccttcccctctcactcgcgaactcacgagattaccaaatagacgagggagaaggagatggcgaagaagaaggagaaggcggtgaacgtgtcgggcaagccgcggcactcgaacgacgtcaaccgccccaatgacaagaagggcgcgggcggcggcgccggcggcgggagccggtccgcggccaccgtgcggcggctcaagatgtacaagacgcggcccaagagggaccgcgccgggaaggtgctcaggaacgacttccagtctaaagagctccccaacacccgcatcgtgcccgaccgccggtggttcggcaatacccgcgttgtgggccagcaacagcttgctttttttcgggaggaactcacgagtcagctttccgacaacttcagtgtcatcctgaaagaacggaagctgccactatcgctcctgcaagatcatcaaaagcaagcaagggcacatcttcttgatgttgaaccttttgagcatgcttttgggccaaagggcaagaggaaacgcccgaaactaactgctcttgactatgaatctttgctgaagaaggctgatgattcccaagatgcatttgagcaaaagtatgcttcatcaaagttgccaagggaggaagaagaagatggcttacgggatctagtgaggcatacgatgtttgagaagggacagagcaaaagaatctggggtgaactatacaaagttattgactcttcggacgttgttgtgcaggtgttggatgccagggatccaatgggcactcgatgctaccatctagagaaacatctaagagagaattgcaaacataaacacttggttttcttactaaataagtgtgatctaattcctgcttgggctacaaaaggatggttaaggaccctttccaaggactatcccaccctagcattccatgcaagcatcaacaagtcatttggcaaaggatctcttctgtcagtattgaggcagtttgctcgtttgaagaatgacaaacaagctatttctgtcgggtttgttgggtaccccaatgttggaaagtcatcagttattaacacactacggtcgaagagtgtctgcaaggttgctccaattcctggggagacaaaagtgtggcagtacatcactctcactaaaaagatctttttgattgattgtcctggtgttgtatatcagaataatgattcagaaactgatatagttctgaagggtgtggtgcgagtgacaaatttggaggatgctgctgagcacattggtgaagttcttaggcgtgttaaaaaggagcatcttcaaagagcgtacaaaattcaagaatggtctgatgataacgattttctagtacagctgtgcaggaccactggaaaacttctcaagggtggggagcctgatctaacaacagcagccaagatggtacttcatgactggcagaggggtaaaattcccttttttgtaccccctccacagcaaagtgaggatggtgcatctgaaagtgctgaacctgttgggaaaaccgaagaggacggagtaagcagcgacaggactgctgctgccatgaaagccattgcaggaataatttcgtcacagcagaacatgaatgtaccctgccacaaggaacacaatgcagacaacgaagacactgcgagtgaagataacgaagacattgagagtgcagacaacgatgagcatgcagagcaatctgagtaatctttgggtacagatgtggattagagctaatatgtccatgataatgagtttgtcagcccaggtattgtgtacctacttttaccggtgtgccaggaaaagaaagtttcatgttgatttgaggagcaactgggttcttttttgtaactgtcgtacctgaatctttgtaatagggtagagcagttttgctaggtaactggttgtatcaggatgtttatctgtactgtctactacaaatacagtcacaaaaatttcacttaaagtcaagttgtccctaatttttgtaacgctgcacactgcaattttgcggcttcatggattcctacatacctacatatgtcactcctatgaatcctatctttttcgattgtgc

SEQ ID NO: 3772 - DNA, 1998 bp, Panicum virgatum
cccaccgcctcctgcgactcctctccgttcccccctcctctccctcgcgaacccaccacaagagaatcaagaaggagagggagatggcgaagaagaaggagaaggcggtgaacgtgtcgggcaagccgcggcactcgaacgacgtcaaccgtcccaatgacaagaagggcgcgggcggtggcgccggcggcggggcccggtccgcggcgaccgtccggcggctaaagatgtacaagacgcggcccaagagggaccgctccgggaaggtgctcaggaacgacttccagtccaaggagctccccaacacccgcatcgagcccgacccccggtggttcggcaacacccgggttgtgggccagccacagcttgaattgtttcgggaggaactccagaatcgtctttctgacaacttcagtgtcatcctgaaagaacggaagctaccactatcactcctgcaggatcatcaaaagcaagcgagagcacatttgcttgatgttgaaccttttgagcatgcttttgggccaaagggcaagaggaaacgcccgaaactaactgctcttgactatgaatccttgctgaagaaagctgatgattcccaagatgcatttgagcaaaagtatgcttcctcaaagttgccaaaggaggaagaagaagatggcttacgggatctagtgaggcatacaatgtttgagaagggacagagcaaaagaatctggggtgaattgtacaaagttattgactcttcagatgttgttgtgcaagtgttggatgctagggatccaatgggcactcgatgctatcatctagagaaacatctaaaggagaattgcaaacacaaacacttggtattcttactaaataagtgcgatctaatccctgcttgggctacaaaaggatggttaaggaccctgtcaaaggactatcccaccctagcattccatgctagcatcaacaagtcatttggcaaaggatctcttctgtcagtattgaggcagtttgctcgtttgaagaatgacaaacaagctatatctgttggatttgttgggtaccccaatgttgggaagtcatctgttattaacacattacggtcgaagagtgtttgcaaggtcgcgcccattcctggagagacaaaagtgtggcaatacatcactctcactaaaaagatctttttgatcgattgtcctggcgttgtgtatcaaaataatgattcagaaactgatatagttctaaagggtgtggtacgagtgacaaatttagaggatgctgctgagcacattggtgaagttctgaggcgtgttaaaaaggagcatctgcaaagagcatacaaaattcaagattggactgatgataacgattttcttctccagctgtgcaggactactggaaaacttctcaagggtggggagcctgacctgacaacggccgccaagatggttcttcatgactggcagaggggtaaaattcccttttttgtaccccctccgcagcagagtgatgatggtgcatctgaaattgctgagcctgttgagaaaaccgaagaggatggagtaagcagcgacaggactgctgccgccatgaaagccattgcacggataatttcgtctcagcagaacctgaatgtaccttgccataaggaacatgatgcagacaatgaagacattgaaagtgaagataacgaggagatcgaacttccagagcaatcagagtaacttcgggtacggatatggactaaagttgatatgtcagcactcaggagtgtgtagttacttaacctcgttatcactgtagttccagaaaaggattcatgttggttcagccgctacaaaggatggtgatttgcttagccactcgcctaattttttgtagcttttatcgtacctaaatcttgtaatagcgcaaatagagcagttttgctagctacctcgttggatcgcagtgtttatctgcttcaaattcagttatatatacatttttcttaaaaaggaacatattatgtgc

SEQ ID NO: 3773 - DNA, 2088 bp, Setaria italica
gcacgcgccctccacccgctcccatccgtgtcctctcaaaaccctagcactccctacctcgtttcctcctctttcccaccgcctctcctacgactcttctcgccggtcgccgcccccctcgcgaacccacaagagaatcaagaacaagagggagggacatggcgaagaagaaggagaaggcggtgaacgtgtcgggcaagccgcggcactcgaacgacgtcaaccgccccaatgacaagaagggcgcgggcggcggcgccggcggcggggcccggtccgcggcgaccgtgcggcggctccagatgtacaagacgcggcccaagagggaccgctccgggaaggtgctcagaaacgagttccagtccaaggagctccccaacacccgcatcgagcccgaccgccggtggttcggcaatacccgggttgtgggccagccacagcttgcattgtttcgggaggaactccagaatcatctttctgacaacttcagtgtcatcctgaaagagcggaagctgcctctatcactactgcaggatcatcaaaagcaagcgagagcccatttgcttgatgttgagccttttgagcatgcttttgggccaaagggcaagaggaaacgcccgaaactaactgctcttgactatgaatctttgctgaagaaagctgatgattctcaagatgcatttgagcaaaaatatgcttcctcaaagttgccaagggaggaagaagaagatggcttacgggatctagtgaggcatacaatgtttgagaagggtcagagcaaaagaatctggggtgaactctacaaagttattgattcttcagatgttgttgtgcaggtgttggatgctagggatccaatgggcactcgatgctaccatctagagaaacatctaaaggagaattgcaaacacaaacacttagttttcttactaaacaagtgtgatctaatccctgcttgggctacaaaaggatggttaaggaccctgtcaaagaactatcccaccctagcattccatgctagcatcaacaagtcatttggcaaaggatctcttttgtcagtattgaggcagtttgctcgtttgaagaatgacaaacaagctatatctgttggatttgttgggtaccccaatgttgggaagtcatcagttattaacacactacggtcgaagagtgtttgcaaggtcgcgcccattcctggagagacaaaagtgtggcagtacatcactctcactaaaaagatctttttgatcgattgtcctggcgttgtgtatcaaaataatgattcagaaactgatatagttttaaagggtgtggtacgagtgacaaatttggcggatgctgctgagcacattggtgaagttctgaggcgtgttaaaaaagagcatctgcaaagagcgtacaaaattcaagattgggctgatgataacgattttcttgtccagctgtgcaggactactggaaaacttctcaagggtggggagcctgacctgacaacggtagccaagatggttcttcatgactggcagaggggtaaaattcccttttttgtaccccctcctcaacagagtgacgatggtgcatctgaaggtgccgagcctgttgagaaaactgaagaggacggagtaagcagcgataggactgctgctgccatgaaagccattgcaggaataatttcatcgcagcagaacatgaatgtaccctgccataaggaacatgatggagataatgaagacagcgaaagtgaagataatgaagacagcgaagttcctgagcaatcagagtaatcttgggtacagatatggactaaagttgatatgtcagggctcaggagtgtgtagctacttaacctcattatcactgtagtgccagaaaaaggattcatgttggttcagctgctacaaagatggtgatttgcttagcgattcgtctccttttttgtaactttattatcgtacctaaatcttgtaatagggcaagtagagcagtttgctagcctacctcgttggatcgcaatgtttatctgtacaacaattacagttacatatcttacttcaaaaaatcgagtcaggtcatccttattttttttat

SEQ ID NO: 3774 - DNA, 2185 bp, Oryza sativa
gcacgtgcgacgcacgcatctccctgtacaaaaccctagccttccccatcctcgcctcctcctctctccccccgcaccaccgcctcccctcctctcctctcctctctcccgccgaccaggagaaagaaggaaaaagaagaagaaaaatcctctgcgatggcgaagaagaaggagagggcggtgaacgtgtcggggaagccgcgccactcgctcgacgtcaaccgcgccaatgacaagaagggcgcgggcggcggcgccgggggcggcggcggcggccgctcggccgccacggtgcggcggctcaagatgtacaagatgaggcccctcagggaccgaggcgggaagatcctgaagcacgacctccagtccaaggagctccccaacacccgcatcgagcccgatcgccgctggttcggaaatacacgagtcgttaatcagaaagagcttgaattctttcgggaggaactccagagtcggctttccaataactataatgtgatactgaaagagcggaagcttccactgtcactactgcaggatcatcaaaagcaagctagggcgcatcttcttgacactgaaccttttgagcatgcatttggaccaaagggcaagaggaaacgcccaaaactaatggctcttgattacgaatctctattgaagaaagctgatgattctcaaggtgcatttgaggataagcatgctacagcgaagttgctgaaagaggaagaggaagatggcttacgagacctagtccggcacacaatgttcgagaagggacagagcaaaagaatttggggtgaactctataaagttattgactcttcagatgttgtcgtgcaggtgttggatgccagggatccaatgggtactagatgctaccatctggagaaacatctgaaggagaatgccaagcacaaacacttggtattcttactaaataagtgtgatctagtacctgcttgggccacaaaaggatggttgcgcactttatcaaaggactaccccaccctagcattccatgcaagcatcaacagttcatttggcaaaggatcacttctttcagtgttacggcagtttgcacgcctgaagagtgacaaacaagctatatctgttggttttgttggataccccaatgttgggaagtcatcagttatcaacacgttacgctccaagagtgtttgcaaagtggctccaattcctggagagacgaaggtgtggcagtacattactctgactaaaagaatatttctgattgactgccctggggttgtgtaccaaaacaatgattcagaaactgatattgttcttaagggcgtggtgcgtgtgacaaatttggcggatgcttctgagcacattggtgaagttctgagacgtgtaaaaaaggagcatcttaaaagagcttacaaaattgaagactgggttgatgataatgattttcttgtccaactgagcaagaccactggaaagctactcaggggtggggagcctgatcttacaacaacggccaagatggtgcttcatgactggcagaggggcaagattcccttttttgtgcctccaccacagcaaggtgaagatagtccatctgaaacagctgaacctgtggagaaatccgatgaggaaggggtgagcagtgacagaactgctgccgccatgaaagcgatagcgggaataatctcatcacagcagcagatgaatgttccttgccaaaaggaatttggtgtaactaatgaagatagtgaagtcgcggagcaatcagagtgatctacaaaaggctaggaaccctgcatgataaagaacagggcacaattttgccaaatacctagagattttatgaagatttggtgtctaacaggaatgttacgatgaatgttacgatcgttcagttcaccggtgcgttctactgcaacgaaagagcgttcactgcaacgaaagactggaatcaagggtgtgggactgggaaacttctgtaacttcatatattgtgtgggcctttgttgtagaccagatagagtgttttggtagcttaatataaccattttgttccaactgtacttgaaacaaatttattccgatacattaattccgcaaagtcgttcgtatttgtatggggtcaaaagtgaaatactcttttgttgacggtttaccttttcgtttcacctgcttggctgctgcctgaactgcc

SEQ ID NO: 3775 - DNA, 1836 bp, Pennisetum glaucum
cagatgtacaagacgagacccaagagggaccgctccgggaaggtgctcagaaacgagttccagtctaaggagctccccaacacccgcatcgagcccgaccgccggtggttcagcaatacccgggttgttggccagccacagcttgcactgtttcgggaggaactcaagaatcatctttctgacaacttcagtgtcatcctgaaagaacggaagctacctctatctctactgcaggatcatcaaaagcaagccagagcccatttgcttgatgttgagccctttgagcatgcttttgggccaaagggcaagaggaaacggccaaaactaactgctcttgactatgaatctttgctgaagaaagctgatgattcacaagatgcatttgagcaaaagtatgcttcctcaaagttgccaagggaggaagaagaagatggcttacgggatctagtgaggcatacaatgtttgagaaggggcagagcaaaagaatctggggtgaactgtacaaagttattgattcttcagatgttgttgtgcaggtgttggatgctagggatccaatgggcactcgatgctaccatctagagaaacatctaaaggagaattgcaaacacaagcacttggttttcctactaaataagtgtgatctaatccctgcttgggctacaaaaggatggttaaggaccctatcaaaggactatcccaccctagcgttccatgccagcatcaacaagtcatttggcaaaggatctcttttgtcagtattgaggcagtttgctcgtttgaagaatgataaacaagctatatctgttggatttgttgggtaccccaatgttgggaagtcatcagttattaacacattacggtcgaagagtgtttgcaaggtcgcgcccattcctggagagacaaaagtgtggcagtacatcaccctcactaaaaagatatttttgattgattgtcctggtgttgtgtatcaaaataatgattcagaaactgatatagttctaaagggtgtggtacgagtgacaaatttggaggatgctgctgagcacattggtgaagttctgaggcgtgttaaaaaggagcatctgcaaagagcttacaaaattcaagattggactgatgataacgattttctcgtccagctgtgcaggactactggaaaacttctcaagggtggggagcccgacctgacaacagcagccaagatggttcttcatgactggcagaggggtaaaattcccttttttgtaccccctcctcaacagagtgacgatggtgcatctgaaggtgctgagcctgtagagaaaactgaagaggacggagtaagcagtgataggactgctgctgccatgaaagccattgcaagaataatttcgtcgcagcaagacatgagtgtaccatgccataaggaacatgatggagataatgcagatagtggaagtgaagataatgaagacaatgaggttccagagcaaacagaggaaatcttgggtacagatttggactaaagttgatatgacagcgttcatgacaggagtatgtagctacttgatcccattatcactgtagtgccagaaaaaggattcatgttggttcagcaacaaggatggtgatttgcttgttgcagatggtgattttcttataagttaggttgttgaagtcatttcatgctctgtagtgatagctgatagttgtacccacaaacttcaaataagtttacatttgaagctgtttccacttctactttttaaaatatctttttagtgagggtgatgtactgccacacttttgtctctccaggaatgggcgcgaccttgcaaacactcttcgaccgt

SEQ ID NO: 3776 - DNA, 2059 bp, Secale cereale
ctcgacctcctccttcctctcgctcaggataccaggggaaggcaggggtctagggcggcactccggcgcggcggcagagggaatcagaccctcctctcctcaaggggaaaaccaaccagagagcttcacccagcgcgcgatggggaagaagaaggagcggtcagtgaatgtgtcgggcaagccccgtcactctctcgacgtcaaccgccccaatgacaagaagggtgctggcggcggcggcggcgccggcgggagccggtccgcggccacggtgcggcggctcaagatgtacaaactaaggcccatgagggaccgcggtgggaagatcgtcaagcacgaccttcagtccaaggagctccccaacacacgcatcgagcctgaccgccggtggttcggaaatacacgagttatcaatcagaaagaacttgaatatttcaggcaagaactccaggcacggcttacaaataactacagtgtgttactgaaatctaaacagctgccactatcgcttctgcaggatcatcagaagcaagctcgtgcacatcttcttgacactgagccttttgagcatgcctttggaccaaagggcaagcgtaaacgaccaaaactatccagtcttgattatgaatctctaataaagaaagctgatgattctcaagatgcatttgaggaaaaacatgcttcatcaaagttgccaaaggatgaagaggaagatggcttaagggatctagtcaggcataatatgtttgagaagggacaaagcaaaagaatttggggtgaactttataaagttcttgactcttcagatgttgttgtgcaggtgttggatgccagggatccaatgggcacgagatgctaccatctggagaaacatctgaaggagaatgccaagcacaaacacctggtattcttactaaataagtgtgatctaatacctgcttgggcaacaaaagggtggttgcgtactctatcgagggactatcccaccctagcattccatgcaagcatcaacaagtcatttggaaaaggatctcttctttcagtattaaggcagtttgcccgtttgaggagtgacaagcaagccatatctgttggatttgttggatatcccaacgttgggaagtcctcagttatcaacacattacgctccaagactgtttgcaaggtagctccgattcctggagagactaaggtgtggcaatacatcaccatgaccaaaaaaatcttcttaattgattgccctggggttgtgtaccaaaacaatgatacagagactgatgtagttcttaagggtgtggtacgggtgacaaatttggatgatgcttctgagcacattggggaagttctaaggcgtgtaaagaaggagcatctacaaagagcttacaaaatacaagactgggctgatgataatgattttctcgtccagctgagcaagatgagtggaaagctactcaagggtggggaacctgatctgacaacagcagccaagatggtacttcatgactggcagaggggcaagatacccttttttgtgcctccgccgcagcagaatgaagatggcccttctaagattactgaacctgtggagggatcgggtgaggaagtggtcagcagtgaccgggctgctgctgccatgaaagccattgcgggaattatctcttcgcagcaaactatgaatgtcccctgccagaaggaacttggcagaaatggcgaagacagtgaactcctggagcaatcagaccttttggtaaaagactgaaaggctagcaatcctgcatgagaagatccctggtatttttgcccgcaaacatcttcatgagtgccagtgaagttattcactgtttgccatggacacagttacgcaggggggacagacaatcctttgatctgtatcgttcatgttatctgtagctttctaatggattaggtagagcgttgttgccatctacatcaaaacttgtcttttgttcacctcaagttctagttggatttcacaccctgttttatacatagataccatttggttcaaaatgcaacttctgcaagtatgcctttctaa

SEQ ID NO: 3777 - DNA, 2023 bp, Brachypodium distachyon
cgtctatcctccaaaaccctagcctccccctcctcgcttcctcccttccaccgcctcctctctgccttctggtctctcacgacacagagagatcttcttcggagcgcgcgatggcgaagaagaaggagcgggcggtgaacgtgtcgggcaagccccggcactctctcgacgtcaaccgccccaatgacaagaagggcgcgggcgccggcggccgccggtccgcggccacggtgcggcggctgcagatgtacaaggttcgtcccaagagggaccgcggcgggaagatactctcgaacgactgccagtccaaggagcttcctaacacccgcatcgagcccgaccgccggtggttcggaaatacacggactgttggtcagaaagaacttgaattattcaggggcgaactggagactcggcttgcaaataattacagtgtgatattgaaagcacggaagttgccaatggcccttttgcaggatcatcaaaagcaagctagggcacatcttcttgagactgagccttttgagcatgcctttggaccaaagggcaagcggaaacgcccaaagctatccagtcttgattatgaatcgctaataaagaaagctgatgattcacaagatgcatttgaggaaaaacatgcttcatcaaagttgccaaaggatgaagaggaagatggcttacgagatctagtccgtcataatatgtttgagaagggacaaagcaaaagaatctggggtgaactttataaagtaattgactcatcggatgttgttgtgcaggttttggatgccagggatccaatgggcactagatgctaccatctagagaaacatctgaaggagaatgctaagcacaaacacattgtattcttactaaataagtgtgacctaatacctgcttgggcaactaaaggatggttgcgtacactgtcgagggactatccaaccctagcgtttcatgcaagcatcaacaagtcatttggcaaaggatcacttctttcagtattacggcagtttgcccgtctgaggagcgataaacaagctatatctgttggatttgttggatatcctaatgttgggaaatcatcggttatcaacacgctacgctccaagactgtttgcaaggtagctccaattcctggagagacgaaggtgtggcagtacatcaccatgaccaaaaggatctttttaattgattgccctggggttgtgtaccaaaacaatgattcagaaactgatgtggttcttaagggtgtggtacgtgtgacaaatttggacgatgcttctgagcacataggtgaagttcttaggcgtgtaaaaaaggagcacctacaaagagcttacaaaatacaagattgggctgatgataatgattttctcgtccagctgagcaagatgagtggtaaactgctcaagggaggagaacctgatctgacaacagcagcaaagatggtacttcatgactggcagaggggtaagatacccttttttgtgcctccaccgcagcagaacgaaggtccatctgagattgctgatcccgtcgagggatccggtgaggaagttgtcagcagtgaccgtactactgctgccatgaaagcaatctcaggaattatcacatcgcagcaaactatgaatattccctgccagaaggaatttggtacaaataaggaagatagtgaactggcagagcaatctgagtaatctcggtcattgatatggtttttgctggcaaacaaattgttttctctatagtttggcaggatggatgtaccaaaactgaaccattattagttcaaactttaatcgacagatatatcgttttggtatctacctacaggcatgtgtgtgtttgtttctaagtcgcaaattttagttgtgtttcacaactggttacacattgtgcatctttgtatgtacataggcgatctgcaggaatacatgattgcaaaaaagatactccctctgtttgggtttataagacccatgcggaattttatgccaactttgaccataaattacattag

SEQ ID NO: 3778 - DNA, 1747 bp, Brachypodium distachyon
agcgcgcgatggcgaagaagaaggagcgggcggtgaacgtgtcgggcaagccccggcactctctcgacgtcaaccgccccaatgacaagaagggcgcgggcgccggcggccgccggtccgcggccacggtgcggcggctgcagatgtacaaggttcgtcccaagagggaccgcggcgggaagatactctcgaacgactgccagtccaaggagcttcctaacacccgcatcgagcccgaccgccggtggttcggaaatacacggactgttggtcagaaagaacttgaattattcaggggcgaactggagactcggcttgcaaataattacagtgtgatattgaaagcacggaagttgccaatggcccttttgcaggatcatcaaaagcaagctagggcacatcttcttgagactgagccttttgagcatgcctttggaccaaagggcaagcggaaacgcccaaagctatccagtcttgattatgaatcgctaataaagaaagctgatgattcacaagatgcatttgaggaaaaacatgcttcatcaaagttgccaaaggatgaagaggaagatggcttacgagatctagtccgtcataatatgtttgagaagggacaaagcaaaagaatctggggtgaactttataaagtaattgactcatcggatgttgttgtgcaggttttggatgccagggatccaatgggcactagatgctaccatctagagaaacatctgaaggagaatgctaagcacaaacacattgtattcttactaaataagtgtgacctaatacctgcttgggcaactaaaggatggttgcgtacactgtcgagggactatccaaccctagcgtttcatgcaagcatcaacaagtcatttggcaaaggatcacttctttcagtattacggcagtttgcccgtctgaggagcgataaacaagctatatctgttggatttgttggatatcctaatgttgggaaatcatcggttatcaacacgctacgctccaagactgtttgcaaggtagctccaattcctggagagacgaaggtgtggcagtacatcaccatgaccaaaaggatctttttaattgattgccctggggttgtgtaccaaaacaatgattcagaaactgatgtggttcttaagggtgtggtacgtgtgacaaatttggacgatgcttctgagcacataggtgaagttcttaggcgtgtaaaaaaggagcacctacaaagagcttacaaaatacaagattgggctgatgataatgattttctcgtccagctgagcaagatgagtggtaaactgctcaagggaggagaacctgatctgacaacagcagcaaagatggtacttcatgactggcagaggggtaagatacccttttttgtgcctccaccgcagcagaacgaaggtccatctgagattgctgatcccgtcgagggatccggtgaggaagttgtcagcagtgaccgtactactgctgccatgaaagcaatctcaggaattatcacatcgcagcaaactatgaatattccctgccagaaggaatttggtacaaataaggaagatagtgaactggcagagcaatctgagtaatctcggtcattgatatggtttttgctggcaaacaaattgttttctctatagtttggcaggatggatgtaccaaaactgaaccattattagttcaaactttaatcgacagatatatcgttttggtatctacctacaggcatgtgtgtgtt

SEQ ID NO: 3779 - DNA, 2066 bp, Triticum aestivum
cgctgctcctctcctggcgccgctcgacctcctccttcctctcgctcaggataccaggagaaggcaggggtctagggcggcactccggcgcggcggcagagggaatcagaccctcctctcctcaaggggaaaaccaaccagagagcttcacccagcgcgcgatggggaagaagaaggagcggtcagtgaatgtgtcgggcaagccccgtcactctctcgacgtcaaccgccccaatgacaagaagggtgctggcggcggcggcggcgccggcgggagccggtccgcggccacggtgcggcggctcaagatgtacaaactaaggcccatgagggaccgcggtgggaagatcgtcaagcacgacctccagtccaaggagctccccaacacccgcatcgagcctgaccgccggtggttcggaaatacacgagttatcaatcagaaagaacttgaatattttaggcaagaactccaggcacggcttacaaataactacagtgtgttactgaaatctaaacagctgccactatcgcttctgcaggatcatcagaagcaagctcgtgcacatcttcttgacactgagccttttgagcatgcctttggaccaaagggcaagcgtaaacgaccaaaactatccagtcttgattatgaatctctaataaagaaagctgatgattctcaagatgcgtttgaggaaaaacatgcttcatcaaagttgccaaaggatgaagaggaagatggcttaagggatctagtcaggcataatatgtttgagaagggacaaagcaaaagaatttggggtgaactttataaagttcttgactcttcagatgttgttgtgcaggtgttggatgccagggatccaatgggcacgagatgctaccatctggagaaacatctgaaggagaatgccaagcacaaacacctggtattcttactaaataagtgtgatctaatacctgcttgggcaacaaaagggtggttgcgtactctatcgagggactatcccaccctagcattccatgcaagcatcaacaagtcatttggaaaaggatctcttctttcagtattaaggcagtttgcccgtttgaggagtgacaagcaagccatatctgttggatttgttggatatcccaacgttgggaagtcctcagttatcaacacattacgctccaagactgtttgcaaggtagctcccattcctggggagactaaggtgtggcaatacatcaccatgactaaaagaatcttcttaattgattgccctggggttgtgtaccaaaacaatgatacagagactgatgtagttcttaagggtgtggtacgggtgacaaatttggatgatgcttctgagcacattggggaagttctaaggcgtgtaaagaaggagcatctacaaagagcttacaaaatacaagactgggctgatgataatgattttctcgtccagctgagcaagatgagtggaaagctactcaagggtggggaacctgatctgacaacagcagccaagatggtacttcatgactggcagaggggcaagatacccttttttgtgcctccgccgcagcagaatgaagatggtccttctaagattactgaacctgtggagggatctggtgaggaagtggtcagcagtgaccgggctgctgctgccatgaaagccattgcgggaattatctcttcgcagcaaactatgaatgtcccctgccagaaggaacttggcagaaatggcgaagacagtgaactcccggagcaatcagaccttttggtaaaagactgaaaggctagcaatcctgcatgagaagatccctggtatttttgcccgcaaacatcttcatgagtgccagcgaagttattcacggtttgccatgaaggacacagttacgcaggggggacaatcctttgatatgtatcgttcatgttatctgtagctttctaatggattaggtagagcgttgttggcatctacatcaaaacttgtcttttgttcacctcaagttctagttggatttcacaccctgttttatacatagataaataccatttggttcaaaatgcaacttct

SEQ ID NO: 3780 - DNA, 2355 bp, Triticum aestivum
cgctgctcctctcctggcgccgctcgacctcctccttcctctcgctcaggataccaggagaaggcaggggtctagggcggcactccggcgcggcggcagagggaatcagaccctcctctcctcaaggggaaaaccaaccagagagcttcacccagcgcgcgatggggaagaagaaggagcggtcagtgaatgtgtcgggcaagccccgtcactctctcgacgtcaaccgccccaatgacaagaagggtgctggcggcggcggcggcgccggcgggagccggtccgcggccacggtgcggcggctcaagatgtacaaactaaggcccatgagggaccgcggtgggaagatcgtcaagcacgacctccagtccaaggagctccccaacacccgcatcgagcctgaccgccggtggttcggaaatacacgagttatcaatcagaaagaacttgaatatttcaggcaagaactccaggcacggcttacaaataactacagtgtgttactgaaatctaaacagctgccactatcgcttctgcaggatcatcagaagcaagctcgtgcacatcttcttgacactgagccttttgagcatgcctttggaccaaagggcaagcgtaaacgaccaaaactatccagtcttgattatgaatctctaataaagaaagctgatgattctcaagatgcgtttgaggaaaaacatgcttcatcaaagttaccaaaggatgaagaggaagatggcttaagggatctagtcaggcataatatgtttgagaagggacaaagcaaaagaatttggggtgaactttataaagttcttgactcttcagatgttgttgtgcaggtgttggatgccagggatccaatgggcacgagatgctaccatctggagaaacatctgaaggagaatgccaagcacaaacacctggtattcttactaaataagtgtgatctaatacctgcttgggcaacaaaagggtggttgcgtactctatcgagggactatcccaccctagcattccatgcaagcatcaacaagtcatttggaaaaggatctcttctttcagtattaaggcagtttgcccgtttgaggagtgacaagcaagccatatctgttggatttgttggatatcccaacgttgggaagtcctcagttatcaacacattacgctccaagactgtttgcaaggtagctccgattcctggagagactaaggtgtggcaatacatcaccatgactaaaagaatcttcttaattgattgccctggggttgtgtaccaaaacaatgatacagagactgatgtagttcttaagggtgtggtacgggtgacaaatttggatgatgcttctgagcacattggggaagttctaaggcgtgtaaagaaggagcatctacaaagagcttacaaaatacaagactgggctgatgataatgattttctcgtccagctgagcaagatgagtggaaagctactcaagggtggggaacctgatctgacaacagcagccaagatggtacttcatgactggcagaggggcaagatacccttttttgtgcctccgccgcagcagaatgaagatggtccttctaagattactgaacctgtggagggatctggtgaggaagtggtcagcagtgaccgggctgctgctgccatgaaagccattgcgggaattatctcttcgcagcaaactatgaatgtcccctgccagaaggaacttggcagaaatggcgaagacagtgaactcccggagcaatcagaccttttggtaaaagactgaaaggctagcaatcctgcatgagaagatccctggtatttttgcccgcaaacatcttcatgagtgccagcgaagttattcactgtttgccatgaaggacacagttacgcaggggggacaatcctttgatatgtatcgttcatgttatctgtagctttctaatggattaggtagagcgttgttggcatctacatcaaaacttgtcttttgttcacctcaagttctagttagatttcacaccctgttttatacatagataaataccatttggttcaaaatgcaacttctgcaagtatgcctttctaatttttgttttccacttgatgttgacatacgtggatctgcgttacccttaccttatgatactatatcatattacaaatttggctggagaaatgtgagggagagattgtactatctgattactattctttgtatcaaagacatttttctctttgttgctatctactatccctataaaagcatgaaaagcgcaagatccacaattaagcataccagctctctaatcatcaatgtaattgtctaaaaatctctcttaacgaaatggatcgctagc

SEQ ID NO: 3781 - DNA, 1920 bp, Hordeum vulgare
cgcggaaaaaccaaccaagcgagcttcacccagcgcgcgatggggaagaagaaggagcggtcatcaaatgtgtcggggaagccccgtcactctctcgacgtcaaccgccccaatgacaagaagggtgcgggcggcgccggcggcgccggcgggagccggtccgcggccaccgtgcggcggctccagatgtacaaactaaggcccaagagggaccgcggtgggaagatcgtcaagcacgatctccagtccaaggagctccccgacacccgcatcgagcctgaccgccggtggttcggaaatacacgtgttatcaatcagaaagaacttgaatatttgaggcaagaactccaggcacggctcacaaataactacagtgtgttactgaaatctaaacagcttccactgtcgcttctgcaggatcatcagaagcaagctcgtgcgcatcttctagacactgagccttttgagcatgcctttggaccaaagggcaagcgtaaacgaccaaaactatccagtctcgattatgaatctctaataaaaaaagctgatgattctcaagatgcgtttgaggaaaaacatgcttcgtcaaagttgccaaagaatgaagaggaagatggcttaagggatcttgtccggcataatatgtttgagaagggacaaagcaaaagaatttggggtgaactttataaagttcttgactcttcagatgttgttgtgcaggtgttagatgccagggatccaatgggcactagatgctaccatcttgagaaacatctgaaggagaatgccaagcacaaacacctggtattcttactaaataagtgtgatctaatacctgcttgggcaacgaaagggtggttgcgtactctatcgagggactatccgaccctagcattccatgcaagcatcaacaagtcatttggaaaaggatctcttctttcagttttacggcagtttgcccgtttgaggagtgacaagcaagccatatctgttggatttgttggatatcccaatgttgggaagtcatcagttatcaacacattacgctccaagactgtttgcaaggtagctccgattccaggagagactaaggtgtggcaatacatcaccatgactaaaagaatcttcttaattgattgccctggggttgtgtaccaaaacaatgatacagagactgatgtagttcttaagggtgtggtacgggtgacaaatttggatgatgcttctgagcacattggggaggttctaaggcgcgtaaaaaaggagcatctacaaagagcttacaaaatacaagactgggctgatgataatgactttcttgtcaagctgagcaagatgagtggaaagctgctcaagggtggggaacctgacctgacaacggcagccaagatggtacttcatgactggcagaggggcaagatccccttttttgtgcctccgccgcagcagaacgaagaaggtcctaagattactgaatccgttgagagatctggtgaggaagtggtcagcagtgaccggactgctgcggccattaaagccattgcaggaattatttcttcacagcaaactatgaatatcccctgccagaaggaatttggcaggaatggtgaagatagtgaactcccggagcaatcagaccttctggttgaagactgaaaggctagcaatcctgcatgagaaagatccctggtattttggcatgcaaacatctttatgagtgccagtgaagttattcactgtttgccacgaaggatgcagttacggagggggctcaatcctttgatatgtatcgttcatgttatctgcagctttgtaatcgatcagatagagcgttgttggtatcaaaacatctgtttttgttcaccttaagttctagttggattttagaccctgttatcaatgttgaggaaatcgttatcg

SEQ ID NO: 3782 - DNA, 1904 bp, Panicum virgatum
tctctctctctcccacgcccctcctctctcttcccttccccgatctcccccaatccgaccagaccaacaggcaccttcgacttgagcggagcaggcgaggcggaggcggagatggcgctgcgacgggctctcctcagatcggccgagatctcccccgaccgcaaggctgcaattgagtattttcattcattatcaagggcacagcctgctcgttctctcaatggtgccggcctttgccctgctagcagatcatttagtacccaggctgctactacatcaagtacaccacagcctccaccaccacctccccctccagagaagactcacttcggtggcctcaaagatgaagaccgcatttttaccaacctctatggtctgcatgacccttttctgaaaggtgcaatgaagaggggtgactggcataggaccaaggatttggtgattaagggggcagactggatagttaatgaaatgaagaaatcaggcctccggggacgtggaggtgcaggtttcccctctggtctcaaatggtcctttatgcccaaggtttcagatggacgtccttcttatcttgttgttaatgctgatgagagtgagcctggaacttgcaaagatagagaaatcatgcgtcatgaccctcacaaacttctggaaggatgccttattgctggagttggaatgagggcatccgctgcttacatctacattagaggtgaatacgtgaacgagcgtctcaaccttgagaaagcccggcaggaagcatatgcagctggacttcttggtaagaatgcttgcggatctggttatgattttgatgtgcatattcattttggtgctggtgcgtacatctgtggtgaagagactgccctactggagagccttgaagggaagcagggcaaacctaggctgaagccgcctttcccagccaatgcagggctttatggctgccccactactgtgacaaatgttgaaactgtggctgtatccccaacaattcttaggcgtggtccagaatggtttgcaagctttgggcgcaagaacaactctggaaccaaactcttctgcatctcagggcatgtgaacaaaccttgcaccgtggaggaggaaatgagcatacctctgaaggagttgctcgagaggcactgtggaggtgtgaggggaggatgggacaacctgcttgcagttattcctggtggttcatctgttccccttttaccaaaacacatatgtgatgatgtgttgatggactatgatgcactgaaggctgtgcagtctggattgggtactgcagcggtcatcgtgatggacaaatctacggatgttgttgatgcaattgctaggctgtcatacttctacaagcatgagagttgcgggcagtgcacgccttgcagggagggaacaccctggctgtggatgatcatggagaggctcaaggttggtaatgcgaagctggaggaaatcgatatgcttcaggaggtcacaaagcaaatcgaaggacatactatctgtgcccttggggatgctgcagcatggcctgtgcaggggcttatcaggcacttcaggccggagttggaaaggaggatccgtgagcgagctgaaagggagctgctggcggcttctgcttgatacgccagcaatgtcgcccctgtactagtttcctgatttctttacttaaataatgcgaactggaggagctcatttctatgtaaggaaatgcagctttcttgatttctttaaaccttcacatggatgtttatttgatgcgctcaagcagcttatgtattttgatggactagataagcgtttcaaagtagaaacaaaacaaacgtgatcattttaccgtgtatgccacatgatccatcataatgttattgtggatgtgtatgtctacctgtttttctctc

SEQ ID NO: 3783 - DNA, 1905 bp, Pennisetum glaucum
ctcctctctcccacaccctcctctctctctctcttcccctccccgagtccccccgatctccccccaatccgaccagaccggcaggcacccctcgactcgagcggagcaggcgaggcggaggcggaggcggagatggcgctgcgacgggcgctcctcagatcggtcgagatctcccccgaccgcaaggctgcaattgagtacttccattctttatcaagggcgcagcctgctcgttctctcaatggttctggcctttgccctgctagcagatcatttagcacccaggctgctactacatcaagcacaccacagcctcctcctccaccacccccgccagagaagactcactttggtgggctcaaagatgaggaccgcatttttaccaacctctatggtctgcatgacccttttcttaaaggtgcaatgaagaggggtgattggcataggaccaaggatttggtgcttaagggagcagactggatagttaatgaaatgaagaagtcaggtctccgtggacgtggaggtgcaggtttcccctcaggtctcaaatggtcctttatgcccaaggtttcagatggccgtccttcttatcttgttgttaatgctgatgagagtgagcctggaacttgcaaagatagagaaatcatgcgtcatgatccccacaagcttctggaaggatgtcttattgctggagttggtatgagggcgtcagctgcttacatctacattagaggtgaatatgttaatgagcgtctcaaccttgaaaaagcccggcaggaagcatatgcagctggacttcttggtaagaatgcttgtgggtctggttatgattttgatgtgcatattcattttggtgctggtgcgtacatctgtggtgaagagactgccttactggagagccttgaagggaagcagggcaagcctaggctgaagccacctttcccagccaatgctgggctttatggctgccccacaactgtgacaaatgttgaaactgtggctgtgtccccaacaattcttaggcgtggtcctgaatggtttgcaagctttgggcgcaagaacaactctggaaccaaactcttctgtatctcagggcatgtgaacaaaccttgcactgtggaggaggaaatgagcatacctctgaaggagttgctcgagaggcactgtggaggtgttaggggaggatgggacaacctgcttgctgttattcctggtggttcgtctgtcccccttttaccaaaacacatatgtgatgatgtgttgatggactatgatgcactgaaggctgtgcagtctggattgggtactgcagcagttatcgtgatggacaaatctacagatgttgttgatgcgattgctaggttgtcgtacttttacaagcatgagagttgtgggcagtgcacaccttgccgggaaggcacaccctggctatggatgatcatggagaggctcaaggttggtaatgcaaagttggaggaaattgatatgctccaggaggtcacaaagcaaatcgaagggcatactatctgtgcccttggggatgctgcggcatggcctgtgcaggggcttatcaggcacttcaggccggagctggaaaggaggatccgcgagcgagctgaaagggagttgctggcggcttctgcatgatacacaagccttgtcactcctgtactagtttcctgatttcttctacttaaataatgcaaactgaagaaggtcatttctatgtaaggaaatgcagctttcttgattcctttaaaccttcacatggatgtttatttgatacacttgagcagctggtgaattttgatggactagatgatcttttcatcaaaagtagaaacaaactggatcaatgtaccatgtatgctacatgatccatcataatgttatcttggatgtgta

SEQ ID NO: 3784 - DNA, 1980 bp, Setaria italica
ctcgcccacggcagccgctcccctcttcctctctccccaccctctctcttcccctccccgatctcccccaatccgaccagaccagcaggcaccctcgactcgagcggagcaggcgaggcggaggcggaggcggagatggcgctgcgacgggcgctcctcagatcggccgagatctcccccgaccgcaaggctgcaattgagtacttccattctttatcaagggcacagcctgctcgttctctcaatggtgctggcctttgccctgctagcagatcatttagcacccaggctgctactacatcaagcacaccacagcctcctcctccaccaccccctccagagaagactcactttggtgggctcaaagatgaggaccgcatttttaccaacctctacggtctgcatgacccttttcttaaaggtgcaatgaagaggggtgattggcataggaccaaggatttggtgcttaagggggcagactggatagttaatgaaatgaagaaatcaggtctccggggacgtggaggtgcaggtttcccctccggtctcaaatggtcctttatgcctaaggtttcagatggacgtccttcttatcttgttgttaatgctgatgagagtgagcctggaacttgcaaagatagagaaatcatgcgtcatgatccccacaagcttctggaaggatgccttattgctggagttggaatgagggcgtcagctgcttacatctacattagaggtgaatacgtgaatgagcgtctcaaccttgagaaagcccggcaggaagcatatgcagctggacttcttggtaagaatgcttgtggatctggttatgattttgatgtgcatattcattttggtgctggtgcatacatctgtggtgaagagactgccctacttgagagccttgaagggaagcagggcaagcctaggctgaagccacctttcccagccaatgctgggctttatggttgccccacaactgtgacaaatgttgaaactgtggctgtgtccccaacaattcttaggcgtggcccagaatggtttgcaagctttgggcgcaagaacaactctggaaccaaactcttctgtatctcagggcatgtgaacaaaccttgcaccgtggaggaggaaatgagcatacctctgaaggagttgctcgagaggcactgtggaggtgtgaggggaggatgggacaacctgcttgctgttattcctggtggttcgtctgtcccccttttaccaaaacacatatgtgatgatgtgatgatggactatgatgcactgaaggctgtgcagtctggattgggtactgcagcagttatcgtgatggacaaatctacagatgttgttgacgcgattgctaggctgtcgtacttctacaagcatgagagttgtgggcagtgcacaccttgccgggaaggcacaccctggctatggatgatcatggagaggctcaaggttggtaatgcaaagctggaggaaattgatatgcttcaggaggtcacaaagcaaatcgaaggtcatactatctgtgctcttggggatgctgcggcatggcctgtgcaggggcttatcaggcacttcaggccagagctggaaaggaggatccgcgagcgagctgaaagggagttgctggcagcttctgcatgatccgccagccattgcgctcctgtactagtttcctgatttcttttacttaaataatgcaaactgaaggagctgatttctatgtaaggaaatgcagctttcttgattcctttaaacttcacatggatgtttatttgatgcacttgagcagctggtgaattttgatggactagataagcttttcaaagtagaaacaaacttgatcaatgtaccatgtatgctacatgatccatcataatgttattgtggatgtgtatgtcgacctgtttgtctctttgatattgtggctataatgatctcgtaatttgggttaggtgtttgaaatcatgtcca

SEQ ID NO: 3785 - DNA, 2032 bp, Zea mays
cgatctgctcctcggtccaggcccaataacgcggcgtggtatcgctttcgcgtctgcgtgcgtgcgtgtgcaggcaggcaggcggctggcctccgtccgcgcatcctcttctggcgaggagctcccccacgcagccgctgctctctccacgtcctctgttccttcccctccccgatctcccccaatccgaccaaaccggcagagccggggggcggcgatggcgctgcgacgggcgctcctcagatcggcagagatctctttcgaacgcaaggctgcaattgagtacattcattctttatcaagggcacagcctgctcgttctctcaatggtgctggcctttgtcctgctagtagatcacttagcacccaggccgccactacgtcaagcacaccacagcctccgcctcccccaccccctccagagaagactcactttggtggcctcaaagacgaggatcgcattttcaccaacctctatggtctgcatgacccttttctgaaaggcgcgatgaagagaggtgactggtataggaccaaggatttggtgatcaagggggcagactggatagttaatgaaatgaagaaatcaggtcttcggggtcgtggaggtgcaggttttccttctggtctcaaatggtcctttatgcccaaggtttcagatggacgcccttcttatcttgtcgttaatgctgatgagagtgagcctggaacttgcaaagatagagaaatcatgcgccatgacccccacaagcttctggaaggatgccttattgctggagttggaatgagggcatcagctgcttacatctacattagaggtgaatacgtgaatgagcgtctcaaccttgagaaagctcggcaggaagcgtatgcagctggacttctgggtaagaatgcttgtggctctggttatgattttgatgtgcatattcattttggtgctggtgcgtacatctgtggtgaagagaccgccctactagagagccttgaagggaagcagggcaaacctaggctgaagccacctttcccagccaatgctgggctctacggctgccccacaactgtgactaatgtagaaactgtggctgtatccccaacaattcttaggcgcggtccagaatggtttgcaagctttgggcgcaagaacaactctggaaccaagctctattgcatctcagggcatgtgaacaaaccttgcaccgtggaagaggaaatgagcatacctctgaaggagttgctcgagaggcactgtggaggtgtgagagggggatgggacaacctgcttgcggtaattcctggcggttcatctgttccccttttgccaaagcacatatgtgatgatgtgttgatggactatgatgcactgaaggctgtgcaatctggattgggtaccgcagctgttatcgtgatggacaaatctacggatgtcgttgacgcgattgctaggctgtcctacttctacaagcatgagagttgtgggcagtgcacgccttgccgagagggcacaccctggctctggatgatcatggagaggctcaaggttggtgacgcgaagctggaggaaattgacatgcttcatgaggtcacgaagcaaatcgaagggcatactatctgtgcgcttggggatgctgcggcatggcctgtgcaggggcttatcaggcacttcaggccagagttggagcggaggatccgcgagcgagctgaaagggagctgttggcggcttctgcataatgtgccagccatgttgcccctgtactagtttcctgatttcttcctaccgaaataatacaaactgatggagctcctttctgtgtaaggaaatgtagccttcctggtttctttaaaccatcatttatttgatgcactcaagcagctggtgaattttgatggactagataaactttccaaagtagaaacaaactcgagggttgtaccgtgtatgctacataatattattgtggatgtgtatgtctacctgcatgtgtcttcaatgctgagctatgtatggtttgggcgtttggcttgaatgat

SEQ ID NO: 3786 - DNA, 1978 bp, Sorghum bicolor
cgcccacgccacgcagacgcagccgctcctctctctgtgtctcccccaccctctgttccttcccctccccgatctcccccaatccgaccagaccagcaggcaccttcgactcgaccggagcaggcgaggcggaggcggatatggcgctgcgacgggcgctcctcagatcggccgagatctcccccgaccgcaaggctgcaattgagtacttccattctttatcaagggcacagcctgctcgttctctcaatggtgctggcagatcatttagcacccaggctgccactacgtcaagcacaccacagcctccacctcccccaccccctccagagaagactcacttcggtggcctcaaagatgaggatcgcattttcaccaacctctatggtctgcatgacccttttctgaaaggtgcgatgaagagaggtgactggtataggaccaaggatttggtgattaagggggcagactggatagttaatgaaatgaagaaatcaggtcttcggggtcgtggaggtgcaggttttccctctggtctcaaatggtcctttatgcccaaggtttcagatggacgcccttcttatcttgttgttaatgctgatgagagtgagcctggaacttgcaaagatagagaaatcatgcgccatgacccccacaagcttctggaaggatgccttattgctggagttggaatgagggcatcagctgcttacatctacattagaggtgaatacgtgaatgagcgtctgaaccttgagaaagctcggcaggaagcatatgcagctggacttcttggtaagaatgcttgtggatctggctatgattttgatgtgcatattcattttggtgctggtgcgtacatctgcggtgaagagactgccctactagagagccttgaagggaagcagggcaaacctaggctgaagccacctttccctgccaatgctgggctttatggctgccccacaactgtgactaatgttgaaactgtggctgtatccccaacaattcttaggcgtggtccagaatggtttgcaagctttgggcgcaagaacaactccggaaccaaactcttctgtatctcagggcatgtgaacaaaccttgcaccgtcgaagaggaaatgagcattcctctgaaggagttgctcgagaggcactgtggaggtgtgagaggaggatgggacaacctgcttgcagtaattcctggtggttcatctgttcccctcttaccaaagcacatatgcgatgatgttttgatggactatgatgcactgaaggctgtgacgtctggattgggtactgcagctgttattgtgatggacaaatctacagatgttgttgacgcgattgctaggctgtcctacttctacaagcatgagagttgtgggcagtgcacaccttgccgagagggcacaccctggctctggatgatcatggagaggctcaaggttggcaacgctaagctagaggaaattgacatgcttcaggaggtcacgaagcaaatcgaagggcatactatctgtgcccttggggatgctgcggcatggcctgtgcagggacttatcaggcacttcaggccagagttggagaggaggatccgcgagcgagctgaaagggagctgttggcggcttctgcataatgtgccagccatgttgcccctgtactagttttctgatttcttcctatcgaaataatacaaactgatggagctcctttctgtgtaaggaaatgcagccttcctgatttctttaaaccatttatgtggatgtttatttgatgcactcaagcagctgtgaattttgatggactagataaacttttcaaagtagaaacaaacttgagggttgtcctgtgtatgctacatgatccatcataacattatttgtggatgtgtatgtctacctgcttgtctctttaatgctgaactatggtttggcttgaatggtctggtgattcaagttaggtgtttgaaatctg

SEQ ID NO: 3787 - DNA, 2074 bp, Saccharum officinarum
cttcgacagcaccgccccgtttaacgggcgacccacgcgtccgcgcccacgccacgcagccgctgctctctgtgtgtctcccccacaccctctgttccttcccctccccgaggacccccaatccgaccagacccggcaggcaccttcgactcgagcggagcaggcgaggcgaaggcggagatggcgctgcgacgggcgctcctcagatcggccgagatctcccccgaccgcaaggctgcaattgagtacttccattctttatcaagggcacagcctgctcgttctctcaatggtgctggcagatcatttagcacccaggctgccactacgtcaagcacaccacagcctccacctcccccaccccctccagagaagactcacttcggtggcctcaaagatgaggatcgcattttcaccaacctctatggtctgcatgacccttttctgaaaggtgcgatgaagagaggtgactggtataggaccaaggatttggtgattaagggggcagactggatagttaatgaaatgaagaaatcaggtcttcggggtcgtggaggtgcaggttttccctctggtctcaaatggtcctttatgcccaaggtttcagatggacgcccttcttatcttgttgttaatgctgatgagagtgagcctggaacttgcaaagatagagaaatcatgcgccatgacccccacaagcttctagaaggatgccttattgctggagttggaatgagggcatcagctgcttacatctacattagaggtgaatacgtgaatgagcgtctgaaccttgagaaagctcggcaggaagcatatgcagctggacttcttggtaagaatgcttgtggatctggctatgattttgatgtgcatattcattttggtgctggtgcatacatctgcggtgaagagactgccctactagagagccttgaagggaagcagggcaaacctaggctgaagccacctttcccagccaatgctgggctttatggctgtcccacaactgtgactaatgttgaaaccgtggctgtatccccaacaattcttaggcgtggtccagaatggtttgcaagctttgggcgcaagaacaactccggaaccaaactcttctgtatctccgggcatgtgaacaaaccttgcaccgtggaagaggaaatgagcatacctctgaaggagttgctcgagaggcactgtggaggtgtgagaggaggatgggacaacctgcttgcagtaattcctggtggttcatctgttccccttttaccaaagcacatatgtgatgatgttttgatggactatgatgcactgaaggctgtgacgtctggattgggtactgcagctgttattgtgatggacaaatctacagatgttgttgacgcgattgccaggctgtcctacttctacaagcatgagagttgtgggcagtgcacaccttgccgagagggcacaccctggctctggatgatcatggagaggctcaaggttggcaacgctaagctagaggaaattgacatgcttcaggaggtcacaaagcaaatcgaagggcatactatctgtgcccttggggatgctgcggcatggcctgtacagggacttatcaggcacttcaggccagagttggagaggaggatccgcgagcgagctgaaagggagctgttggcggcttctgcataatgtgccagccatgtcgcccctgtactagttttctgatttcttcctaccgaaataatacaaactgatggagctcctttctgtgtaaggaaatgcagctttcctgattcctttaaaccatttatgtggatgtttatttgatgcactcatgcagctggtgaattttgatggactagataaacttttcaaagtagaaacaaacttgagggttgtaccgtgtatgctacatgatccatcataatattattgtggatgtgtatgtcttaaaaaaaacatataataaaaaaaatattaatttaatataaaaaaccgggggcggccgtttaaggatcaaattacgtaccgtgctgcaaggcatactttttttaggcaccaaataaatcctggccggtgttac

SEQ ID NO: 3788 - DNA, 2151 bp, Sorghum bicolor
aacgcggcgtcgcatcgcgtctggcggcgtgcgtgtgcaggcctcagtccgcgcatccccttctggccaggagctcgcccacgccacgcagacgcagccgctcctctctctgtgtctcccccaccctctgttccttcccctccccgatctcccccaatccgaccagaccagcaggcaccttcgactcgaccggagcaggcgaggcggaggcggatatggcgctgcgacgggcgctcctcagatcggccgagatctcccccgaccgcaaggctgcaattgagtacttccattctttatcaagggcacagcctgctcgttctctcaatggtgctggcagatcatttagcacccaggctgccactacgtcaagcacaccacagcctccacctcccccaccccctccagagaagactcacttcggtggcctcaaagatgaggatcgcattttcaccaacctctatggtctgcatgacccttttctgaaaggtgcgatgaagagaggtgactggtataggaccaaggatttggtgattaagggggcagactggatagttaatgaaatgaagaaatcaggtcttcggggtcgtggaggtgcaggttttccctctggtctcaaatggtcctttatgcccaaggtttcagatggacgcccttcttatcttgttgttaatgctgatgagagtgagcctggaacttgcaaagatagagaaatcatgcgccatgacccccacaagcttctggaaggatgccttattgctggagttggaatgagggcatcagctgcttacatctacattagaggtgaatacgtgaatgagcgtctgaaccttgagaaagctcggcaggaagcatatgcagctggacttcttggtaagaatgcttgtggatctggctatgattttgatgtgcatattcattttggtgctggtgcgtacatctgcggtgaagagactgccctactagagagccttgaagggaagcagggcaaacctaggctgaagccacctttccctgccaatgctgggctttatggctgccccacaactgtgactaatgttgaaactgtggctgtatccccaacaattcttaggcgtggtccagaatggtttgcaagctttgggcgcaagaacaactccggaaccaaactcttctgtatctcagggcatgtgaacaaaccttgcaccgtcgaagaggaaatgagcattcctctgaaggagttgctcgagaggcactgtggaggtgtgagaggaggatgggacaacctgcttgcagtaattcctggtggttcatctgttcccctcttaccaaagcacatatgcgatgatgttttgatggactatgatgcactgaaggctgtgacgtctggattgggtactgcagctgttattgtgatggacaaatctacagatgttgttgacgcgattgctaggctgtcctacttctacaagcatgagagttgtgggcagtgcacaccttgccgagagggcacaccctggctctggatgatcatggagaggctcaaggttggcaacgctaagctagaggaaattgacatgcttcaggaggtcacgaagcaaatcgaagggcatactatctgtgcccttggggatgctgcggcatggcctgtgcagggacttatcaggcacttcaggccagagttggagaggaggatccgcgagcgagctgaaagggagctgttggcggcttctgcataatgtgccagccatgttgcccctgtactagttttctgatttcttcctatcgaaataatacaaactgatggagctcctttctgtgtaaggaaatgcagccttcctgatttctttaaaccatttatgtggatgtttatttgatgcactcaagcagctgtgaattttgatggactagataaacttttcaaagtagaaacaaacttgagggttgtcctgtgtatgctacatgatccatcataacattatttgtggatgtgtatgtctacctgcttgtctctttaatgctgaactatggtttggcttgaatggtctggtgattcaagttaggtgtttgaaatctgtccagaaaatctgtgacttaaacctgcatctacagtaaccagcattacctgcatgttagtatttggaatttaggtggtgtgtacccctcggttgctag

SEQ ID NO: 3789 - DNA, 1684 bp, Setaria italica
tgcaattgagtacttccattctttatcaagggcacagcctgctcgttctctcaatggtgctggcctttgccctgctagcagatcatttagcacccaggctgctactacatcaagcacaccacagcctcctcctccaccaccccctccagagaagactcactttggtgggctcaaagatgaggaccgcatttttaccaacctctacggtctgcatgacccttttcttaaaggtgcaatgaagaggggtgattggcataggaccaaggatttggtgcttaagggggcagactggatagttaatgaaatgaagaaatcaggtctccggggacgtggaggtgcaggtttcccctccggtctcaaatggtcctttatgcctaaggtttcagatggacgtccttcttatcttgttgttaatgctgatgagagtgagcctggaacttgcaaagatagagaaatcatgcgtcatgatccccacaagcttctggaaggatgccttattgctggagttggaatgagggcgtcagctgcttacatctacattagaggtgaatacgtgaatgagcgtctcaaccttgagaaagcccggcaggaagcatatgcagctggacttcttggtaagaatgcttgtggatctggttatgattttgatgtgcatattcattttggtgctggtgcatacatctgtggtgaagagactgccctacttgagagccttgaagggaagcagggcaagcctaggctgaagccacctttcccagccaatgctgggctttatggttgccccacaactgtgacaaatgttgaaactgtggctgtgtccccaacaattcttaggcgtggcccagaatggtttgcaagctttgggcgcaagaacaactctggaaccaaactcttctgtatctcagggcatgtgaacaaaccttgcaccgtggaggaggaaatgagcatacctctgaaggagttgctcgagaggcactgtggaggtgtgaggggaggatgggacaacctgcttgctgttattcctggtggttcgtctgtcccccttttaccaaaacacatatgtgatgatgtgatgatggactatgatgcactgaaggctgtgcagtctggattgggtactgcagcagttatcgtgatggacaaatctacagatgttgttgacgcgattgctaggctgtcgtacttctacaagcatgagagttgtgggcagtgcacaccttgccgggaaggcacaccctggctatggatgatcatggagaggctcaaggttggtaatgcaaagctggaggaaattgatatgcttcaggaggtcacaaagcaaatcgaaggtcatactatctgtgctcttggggatgctgcggcatggcctgtgcaggggcttatcaggcacttcaggccagagctggaaaggaggatccgcgagcgagctgaaagggagttgctggcagcttctgcatgatccgccagccattgcgctcctgtactagtttcctgatttcttttacttaaataatgcaaactgaaggagctgatttctatgtaaggaaatgcagctttcttgattcctttaaacttcacatggatgtttatttgatgcacttgagcagctggtgaattttgatggactagataagcttttcaaagtagaaacaaacttgatcaatgtaccatgtatgctacatga

SEQ ID NO: 3790 - DNA, 2129 bp, Triticum aestivum
gccccgtttctcctccccacaccacactagcctctccccggtttttccccaaatccgacggactcgaggccaagcggaggcggagatggcgctgcggtgggcgctgctcagatcggcggagatctctcccggtcgcaaggccgcacttgagtacttgcattctctatcaaaggcacagcctactcgttctatctcatgtgccggcctgcatcctgctggcagatcattcagcacccaggctgctactacatcaagcacaccacagcctccaccaccacccccacctccagagaagactcactttggtgaccttaaagatgaagatcgtattttcaccaacctctatggtcttcatgacccttttctgaaaggtgcaatgaagagaggtgactggtatagaaccaaggatttagtgattaaaggggcagactggatagtgaatgaaatgaagaaatcaggtctacgagggcgtggaggtgcaggttttccttctggcctcaaatggtccttcatgcccaaagtgtctgatggacgtccttcttatcttgttgttaatgctgatgagagtgaaccaggaacttgtaaagacagggaaatcatgcgtcatgacccccacaagcttctggaagggtgcctgattgctggagttggaatgagggcatcagctgcttacatctacattcgaggtgaatatgtgaatgagcgtctgaaccttgagaaagctcggcaggaagcatatgcatcaggacttcttggtaagaacgcttgcgggtcaggctatgattttgatgtacatatacattttggtgctggtgcctacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgcggaggtgtgagaggaggatgggataacctgcttgcagttatccctggcggttcatctgttcctctgttgccaaagcacatatgtgatgacgtgttgatggactatgatgcactaaaggctgtacagtccggattaggcactgcagcagttatggtgatggacaaatccacagatgtagttgatgcgattgctagactgtcatacttctataagcatgagagctgtgggcagtgcacgccttgccgtgagggtacaggatggctctggatgatcatggagaggctcaaagtgggcaatgcaaagctagaagagatcgatatgcttcaggaggtgaccaagcagattgaaggccacacgatctgtgccctcggggatgctgcagcatggcctgtgcagggtcttatcaggcacttcaggcctgagctggaaaggaggatccgtgatcgagctgatagcgagctgctgatggcagcttctgcatgagcaccacttctgttttcctgattttattcacagaaataatgcaaactggtgaagctcttctgtactagcagatgtagcttaccttattggtttgaaccttttatgtccatgttcatttgatgcgctgatgaagcctgcgtgctttgatggagaagtagaaacgaatatgaaggattgtaccctgtatgttacatgagcctgtttttcttctttaatgttaactatcctcataatctgagtgaactctaaaattatgtcggcatctgatggctaatgtttgctcaagttggtattaataatggattagtgggccacttctattcggcttcctgaacagcaggcagccgaagctaaaacgagccatagttctgtatatgcaacatatattaatgtttttcttattgttgtttgtaactaattctctcacttctatttcattttttctctttaagagtcaagcggaaggtctctgaacgcgtggctattccttccattatggcactattaaattgtagaaacgtcatta

SEQ ID NO: 3791 - DNA, 2424 bp, Oryza sativa
ggcctcacgctcgctgcctctcctcttggcccggagctcacccacgcacgcagccgtctcgtctcccttcttctctctcctctcctctcttctccggcacaccacaccccaatcctcccccgatctccccaatccgagagctccggaggagcagcgcggaggcggagatggcgctgcggcgagcgctgctcagatctgccgagatctcccccgatcgcaaggctgcacttgagtacctccattatctatcgagagcacagcctactcgttctctaacaggtgctggcctttattctgctggcaaatcattcagcactcaggctgctactacatcaagcacaccacaacctccaccaccacctccacctccggagaagactcactttggtgacctcaaagatgaggaccgcatttttaccaacctctatggtcagcatgaccctttcctgaaaggtgcaatgaagaggggtgactggcatagaaccaaggatttggtgcttaaaggggcagactggatagtgaatgaaatgaagaaatcgggacttcgagggcgtggaggtgcaggattcccttctgggcttaaatggtccttcatgccaaaggtatctgatggacgcccttcttatcttgttgttaatgctgatgagagtgagccaggaacttgcaaggacagagaaatcatgcgtcatgacccccacaagcttctggaaggctgtttgattgctggagttgggatgagggcatcggctgcttacatctacattagaggtgaatatgtgaatgagcgtctcaaccttttgaaagctcgggaggaagcatacgcagcaggtcttcttggtaagaatgcttgtggatctggttatgactttgatgtgcatatacattttggtgctggtgcctacatttgtggtgaagagactgccctactggaaagtctcgaaggcaagcaaggtaaaccaaggttgaagcctcctttccctgccaatgctggcctatatggctgccccacaactgtcacaaatgttgaaacagtggctgtgtctccaacaattctcaggcgtggtccagaatggtttgcaagctttggacgcaagaataactcgggaactaaactattctgtgtctcaggtcatgtgaacaaaccttgcactgtcgaggaggaaatgagcatacctcttaaggaattgattgaaaagcactgtggaggtgtgagaggaggatgggacaacctgcttgcaattattcctggtggttcatctgttcccttgttaccgaagcatatatgtgatgatgtgttgatggactatgatgcactcaaggctgtgcaatctggattgggtactgcagcagttattgtgatggacaagtccacagatgttgttgatgcaattgctaggctatcgtacttctacaagcatgagagttgtgggcagtgcacaccttgcagggagggaacagggtggctgtggatgatcatggagaggctcaaagtaggtaacgcgaagcttgaggagattgatatgcttcaggaggtcactaagcagattgaagggcatactatttgtgcccttggggatgctgctgcatggcctgtgcagggacttatcaggcacttcaggccagaactggaaaggagaatccgtgagcgagccgaaagggagctactggcagcttcggcttaggacactgtcaatgacgatcctgcactagtttcctgatttctttcacagaaataatgcaaactgatggagctcatctctgtatacgaaatgcagctcccctgatttgtttaaacctttatgtggatgtttatttaatgcactcagaagctggtgaattttgatggactgatgaaaacttttttaagtagaaacaaaatgcagttactgtaccatgtatgtcacatgagccagcaaaatatgatggtggatgtggacgtgtaccctgcttgtttttttttcactgttaaactatgcattgtttgaaattgtctagagttcgtgtgagctggttgaaaccatgtctacatctggggcctatgtttgcatctaatgagccagcataatctcatctgcatggcatattgttgatctgcatacttctatagggccaccggccctggcatgcatctgttcgtgattaaccaccggatgcttcatggtggttgggatatctacaaatgtattctggacctgtgtttattgtactgtttggtacagcacgtatccatcagctggtatgccgtgccgtatccagtagttgccaccgtcagatatctctggaatagttgggcttgccggttactgttcttccattttgtctccaggaatctgaatttgcaatggaacagttgagttgactgtgtccagaagatgtgtaataccaaactattttataatctctgttaagtaaaacatgagcatt

SEQ ID NO: 3792 - DNA, 2004 bp, Triticum aestivum
ggcatctccttagagctggcaaaacccccctccacacacacacacccgcggcctcgaagagcgctggtcccctcctgcacctggcctggagctcgccccgtttctcctccccacaccacactagcctctccccggtttttccccaaatccgacggactcgaggccaagcggaggcggagatggcgctgcggtgggcgctgctcagatcggcggagatctctcccggtcgcaaggctgcacttgagtacttgcattctctatcaaaggcacagcctactcgttctatctcatgtgccggcctgcatcctgctggcagatcattcagcacccaggctgctactacatcaagcacaccacagcctccaccaccacccccacctccagagaagactcactttggtgatcttaaagatgaagatcgtattttcaccaacctctatggtcttcatgacccttttctgaaaggtgcaatgaagagaggtgactggtatagaaccaaggatttagtgattaaaggggcagactggatagtgaatgaaatgaagaaatcaggtctacgagggcgtggaggtgcaggttttccgtctggcctcaaatggtctttcatgcccaaagtgtctgatggacgtccttcttatcttgttgttaatgctgatgagagtgaaccaggaacttgtaaagacagggaaatcatgcgccatgacccccacaagcttctggaaggttgcctgattgctggagttggaatgagggcatcagctgcttacatctacattcgaggtgaatatgtgaatgagcgtctgaaccttgagaaagctcggcaggaagcatatgcatcaggacttcttggtaagaacgcttgcgggtcaggctatgattttgatgtacatatacattttggtgctggtgcctacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgcggaggtgtgagaggaggatgggacaacctgcttgcagttatccctggcggttcatctgttcctctgttgccaaagcacatatgtgatgacgtgttgatggactatgatgcactaaaggctgtacagtccggattaggcactgcagcagttatggtgatggacaaatccacagatgtagttgatgcgattgctagactgtcatacttctataagcatgagagctgtgggcagtgcacgccttgccgtgagggtacaggatggctctggatgatcatggagaggctcaaagtgggcaatgcaaagctagaagagatcgatatgcttcaggaggtgacgaagcagattgaaggccacacgatctgcgccctcggggatgctgcagcatggcctgtgcagggtcttatcaggcacttcaggcctgagctggaaaggaggatccgcgatcgagctgatagcgagctgctgatggcagcttctgcatgagcaccacttctgttttcctgattttattcacagaaataatgcaaaccggtgaagctcttctgtacaagcagatgtagcttaccttattggtttgaaccttttatgtccatgtttatttgatgcgctgatgaagccttgtgtgctttgatggagaagtagaaacgaatttgaaggattgtaccctgtatgttacatgagcctgtttttcttctttaataatgttataaagaatgactatcctcataatctgagtgaactctaaaattatgtcggcatctgatggctaatgtttgctctagttgatatt

SEQ ID NO: 3793 - DNA, 1979 bp, Triticum aestivum
ggagctcgccccgtttctcctccccacaccacactagcctctccccggtttttccccaaatccgacggactcgaggccaagcggaggcggagatggcgctgcggtgggcgctgctcagatcggcggagatctctcccggtcgcaaggctgcacttgagtacttgcattctctatcaaaggcacagcctactagttctatctcatgtgccggcctgcatcctgctggcagatcattcagcacccaggctgctactacatcaagcacaccacagcctccaccaccacccccacctccagagaagactcactttggtgatcttaaagatgaagatcgtattttcaccaacctctatggtcttcatgacccttttctgaaaggtgcaatgaagagaggtgattggtatagaaccaaggatttagtgattaaaggggcagattggatagtgaatgaaatgaagaaatcaggtctacgagggcgtggaggtgcaggttttccgtctggcctcaaatggtctttcatgcccaaagtgtctgatggacgtccttcttatcttgttgttaatgctgatgagagtgaaccaggaacttgtaaagacagggaaatcatgcgccatgacccccacaagcttctggaaggttgcctgattgctggagttggaatgagggcatcagctgcttacatctacattcgaggtgaatatgtgaatgagcgtctgaaccttgagaaagctcggcaggaagcatatgcatcaggacttcttggtaagaacgcttgcgggtcaggctatgattttgatgtacatatacattttggtgctggtgcctacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgcggaggtgtgagaggaggatgggacaacctgcttgcagttatccctggcggttcatctgttcctttgttgccaaagcacatatgtgatgacgtgttgatggactatgatgcactaaaggctgtacagtccggattaggcactgcagcagttatggtgatggacaaatccacagatgtagttgatgcgattgctagactgtcatacttctataagcatgagagctgtgggcagtgcacgccttgccgtgagggtacaggatggctctggatgatcatggagaggctcaaagtgggcaatgcaaagctagaagagatcgatatgcttcaggaggtgacgaagcagattgaaggccacacaatctgcgccctcggggatgctgcagcatggcctgtgcagggtcttatcaggcacttcaggcctgagctggaaaggaggatccgcgatcgagctgatagcgagctgctgatggcagcttctgcatgagcaccacttctgttttcctgattttattcacagaaataatgcaaaccggtgaagctcttctgtacaagcagatgtagcttaccttattggttcgaaccttttatgtccatgtttatttgatgcgctggtgaagccttgtgtgctttgatggagaagtagaaacgaatttgaaggattgtaccttgtatgttacatgagcctgtttttcttctttaataatgttataaagaatgactatcctcataatctgagtgaactctaaaattatgtcggcatctgatggctaatgtttgctcaagttggtattaataatggattagtgggccacttctattcggcttcctgaacagcagccagacgaagctaaaa

SEQ ID NO: 3794 - DNA, 1918 bp, Triticum aestivum
gccccgtttctcctccccacaccacactagcctctccccggtttttccccaaatccgacggactcgaggccaagcggaggcggagatggcgctgcggtgggcgctgcttagatcggcggagatctctcccggtcgcaaggctgcacttgagtacttgcattctctatcaaaggcacagcctactcgttctatctcatgtactggcctgcatcctgctggcagatcattcagcacccaggctgctactacatcaagcacaccacagcctccaccaccacccccacctccagagaagactcactttggtgaccttaaagatgaagatcgtattttcaccaacctctatggtcttcatgaccctttcctgaaaggtgcaatgaagagaggtgactggtatagaaccaaggatttagtgattaaaggggcagactggatagtgaatgaaatgaagaaatcaggtctacgagggcgcggaggtgcaggttttccgtctggcctcaaatggtccttcatgcccaaagtgtctgatggacgcccttcttatcttgttgttaatgctgatgagagtgaaccaggaacttgtaaagacagggaaatcatgcgtcatgacccccacaagcttctggaagggtgcctgattgctggagttggaatgagggcatcagctgcttacatctacattcgaggtgaatatgtgaatgagcgtctgaaccttgagaaagctcggcaggaagcatatgcatcaggacttcttggtaagaacgcttgcgggtcaggctatgattttgatgtacatatacattttggtgctggtgcctacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgtggaggtgtgagaggaggatgggacaacctgcttgcagttatccctggcggttcatctgttcctctgttgccaaagcacatatgtgatgacgtgttgatggactatgatgcactaaaggctgtacagtccggattaggcactgcagcagttatggtgatggacaaatccacagatgtagttgatgcgattgctagactgtcatacttctataagcatgagagctgtgggcagtgcacgccttgccgtgagggtacaggatggctctggatgatcatggagaggctcaaagtgggcaatgcaaagctagaagagatcgatatgcttcaggaggtgacgaagcagattgaaggccacacgatctgcgccctcggggatgctgcagcatggcctgtgcagggtcttatcaggcacttcaggcctgagctggaaaggaggatccgcgatcgagctgatagcgagctgctgatggcagcttctgcatgagcaccacttctattttcctgattttattcacagaaataatgcaaaccggtgaagctcttctgtacaagcagatgtagcttaccttattggtttgaaccttttatgtccatgtttatttgatgcgctgatgaagccttgtgtgctttgatggagaagtagaaacgaatttgaagcattgtaccctgtatgttacatgagcctgtttttcttctttaatgttataaagaatgactatcctcataatctgagtgaactctaaaattatgtcggcatctgatggctaatgtttgctctagttgatattaataatggatt

SEQ ID NO: 3795 - DNA, 2022 bp, Hordeum vulgare
gctccccacaacacaacagtctctccctgttttttttcttccaaatccgacggactcgaggccaaccggaggcggagatggcgttgcggtgggcgctgttcagatcggccgagatctctcccggtcgcaaggctgcatttgagtacttgcattctctatcaagggcacagcctactcgttctccctcgtgtgccgacctgtatcctgctggcagatcattcagcacccaggctgctactacatcaagcacaccacagcctccaccaccacccccacctccagagaagactcactttggtgaccttaaagatgaagatcgcattttcaccaacctctatggtcttcatgatccttttctgaaaggtgcgatgaagagaggtgactggaatagaaccaaggatttagtgattaaaggggcagactggatagtgaatgaaatgaaaaaatcaggtctgcgagggcgcggaggtgcaggttttccttctggcctcaaatggtccttcatgcccaaagtctctgatggacgtccttcttatcttgttgttaatgctgatgagagtgaaccaggaacttgtaaagacagggaaatcatgcgtcatgacccccacaagcttctggaagggtgccttattgctggagttggaatgagggcatcagctgcttacatctacatcagaggtgaatatgtgaatgagcgtctgaaccttgagaaagctcggcaggaagcatatgcatcaggacttcttggtaagaacgcttgcgggtcaggctatgatttcgatgtgcatatacattttggtgctggtgcgtacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactgtactgtatctcaggtcatgtgaacaaaccttgtactgttgaggaggaaatgagtatacctctgaaggaattaatcgagaagcactgcggaggtgtgagaggaggatgggacaacctgcttgcagttatccctggcggttcgtctgttcctcttttgccaaagcacatatgtgatgacgtgttgatggactatgatgcactaaaggctgtacagtccggattaggcactgcagcagttatggtgatggacaaatccacagatgtagttgatgcgattgctagactgtcatacttctacaagcatgagagctgtgggcagtgcacgccttgccgtgagggtacaggatggctctggatgatcatggagaggctcaaagtgggtaatgcgaagctggaagagattgatatgcttcaggaggtcacgaagcagattgaaggccacacgatctgtgccctcggggatgctgcagcatggcctgtgcagggtcttatcaggcacttcagacctgagttggagaggaggatccgcgatcgtgctgatagggagctgctgatggcagcttctgcataagcaccacttcttgtttgctgattttattcacagaaataatgcaaactggtgaagctcatttctgcacatgcagatgtagcttaccttattggttgaaccttttatgtcgatgtttatttgatgcactgatgaagccagtgtactttgatggcgaagtggaaacgaatatgaaggattgtaccttgcatgttacatgaagctgtttttcttctttaatgttataaataatgacttgcttctaaatcctcataatctgagcgaactctgaaattatgttggcatcgatggctaatgtttgcttaagttgatcttaataatggcttagtgggccatttctattcggcttcttgaatgtaacacccttggattatcagctacaataacttatgtaatcaagctacaatgatcacaagtttaagctaatcca

SEQ ID NO: 3796 - DNA, 2096 bp, Hordeum vulgare
ccgccccctcaagagaccgctgcttcccctcctgcacctggcctggagctcgccccgcttctcctccccacaacacaacagtctctccctgttttttttcttccaaatccgacggactcgaggccaaccggaggcggagatggcgttgcggtgggcgctgttcagatcggccgagatctctcccggtcgcaaggctgcatttgagtacttgcattctctatcaagggcacagcctactcgttctccctcgtgtgccgacctgtatcctgctggcagatcattcagcacccaggctgctactacatcaagcacaccacagcctccaccaccacccccacctccagagaagactcactttggtgaccttaaagatgaagatcgcattttcaccaacctctatggtcttcatgatccttttctgaaaggtgcgatgaagagaggtgactggaatagaaccaaggatttagtgattaaaggggcagactggatagtgaatgaaatgaaaaaatcaggtctgcgagggcgcggaggtgcaggttttccttctggcctcaaatggtccttcatgcccaaagtctctgatggacgtccttcttatcttgttgttaatgctgatgagagtgaaccaggaacttgtaaagacagggaaatcatgcgtcatgacccccacaagcttctggaagggtgccttattgctggagttggaatgagggcatcagctgcttacatctacatcagaggtgaatatgtgaatgagcgtctgaaccttgagaaagctcggcaggaagcatatgcatcaggacttcttggtaagaacgcttgcgggtcaggctatgatttcgatgtgcatatacattttggtgctggtgcgtacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactgtactgtatctcaggtcatgtgaacaaaccttgtactgttgaggaggaaatgagtatacctctgaaggaattaatcgagaagcactgcggaggtgtgagaggaggatgggacaacctgcttgcagttatccctggcggttcgtctgttcctcttttgccaaagcacatatgtgatgacgtgttgatggactatgatgcactaaaggctgtacagtccggattaggcactgcagcagttatggtgatggacaaatccacagatgtagttgatgcgattgctagactgtcatacttctacaagcatgagagctgtgggcagtgcacgccttgccgtgagggtacaggatggctctggatgatcatggagaggctcaaagtgggtaatgcgaagctggaagagattgatatgcttcaggaggtcacgaagcagattgaaggccacacgatctgtgccctcggggatgctgcagcatggcctgtgcagggtcttatcaggcacttcagacctgagttggagaggaggatccgcgatcgtgctgatagggagctgctgatggcagcttctgcataagcaccacttcttgtttgctgattttattcacagaaataatgcaaactggtgaagctcatttctgcacatgcagatgtagcttaccttattggttgaaccttttatgtcgatgtttatttgatgcactgatgaagccagtgtactttgatggcgaagtggaaacgaatatgaaggattgtaccttgcatgttacatgaagctgtttttcttctttaatgttataaataatgacttgcttctaaatcctcataatctgagcgaactctgaaattatgttggcatcgatggctaatgtttgcttaagttgatcttaataatggcttagtgggccatttctattcggcttcttgaatgtaacacccttggattatcagctacaataacttatgtaatcaagctacaatgatcacaagtttaagctaatccattttgttaaaca

SEQ ID NO: 3797 - DNA, 1641 bp, Sorghum bicolor
tgcaattgagtacttccattctttatcaagggcacagcctgctcgttctctcaatggtgctggcagatcatttagcacccaggctgccactacgtcaagcacaccacagcctccacctcccccaccccctccagagaagactcacttcggtggcctcaaagatgaggatcgcattttcaccaacctctatggtctgcatgacccttttctgaaaggtgcgatgaagagaggtgactggtataggaccaaggatttggtgattaagggggcagactggatagttaatgaaatgaagaaatcaggtcttcggggtcgtggaggtgcaggttttccctctggtctcaaatggtcctttatgcccaaggtttcagatggacgcccttcttatcttgttgttaatgctgatgagagtgagcctggaacttgcaaagatagagaaatcatgcgccatgacccccacaagcttctggaaggatgccttattgctggagttggaatgagggcatcagctgcttacatctacattagaggtgaatacgtgaatgagcgtctgaaccttgagaaagctcggcaggaagcatatgcagctggacttcttggtaagaatgcttgtggatctggctatgattttgatgtgcatattcattttggtgctggtgcgtacatctgcggtgaagagactgccctactagagagccttgaagggaagcagggcaaacctaggctgaagccacctttccctgccaatgctgggctttatggctgccccacaactgtgactaatgttgaaactgtggctgtatccccaacaattcttaggcgtggtccagaatggtttgcaagctttgggcgcaagaacaactccggaaccaaactcttctgtatctcagggcatgtgaacaaaccttgcaccgtcgaagaggaaatgagcattcctctgaaggagttgctcgagaggcactgtggaggtgtgagaggaggatgggacaacctgcttgcagtaattcctggtggttcatctgttcccctcttaccaaagcacatatgcgatgatgttttgatggactatgatgcactgaaggctgtgacgtctggattgggtactgcagctgttattgtgatggacaaatctacagatgttgttgacgcgattgctaggctgtcctacttctacaagcatgagagttgtgggcagtgcacaccttgccgagagggcacaccctggctctggatgatcatggagaggctcaaggttggcaacgctaagctagaggaaattgacatgcttcaggaggtcacgaagcaaatcgaagggcatactatctgtgcccttggggatgctgcggcatggcctgtgcagggacttatcaggcacttcaggccagagttggagaggaggatccgcgagcgagctgaaagggagctgttggcggcttctgcataatgtgccagccatgttgcccctgtactagttttctgatttcttcctatcgaaataatacaaactgatggagctcctttctgtgtaaggaaatgcagccttcctgatttctttaaaccatttatgtggatgtttatttgatgcactcaagcagctgtgaattttgatggactagataaacttttcaaagtagaaacaaa

SEQ ID NO: 3798 - DNA, 1785 bp, Pseudoroegneria spicata
ccaaatccgacggactcgaggccaagcggaggcggagatggcgctgcggtgggcgctgctcagatcggccgagatctctcccggtcgcaaggccgcacttgagtacttgcattctctatcaagggcacagcctactcgttctatctcgtgcgccgacctgcatcctgctggcagatcattcagcacccaggctgctactacatcaagcacaccacagcctccaccacccccacctccagagaagactcactttggtgaccttaaagatgaagatcgcattttcaccaacctctatggtcttcatgatccttttctgaaaggtgcgatgaagagaggtgactggtatagaaccaaggatttagtgattaaaggggcagactggatagtgaatgaaatgaaaaaatcaggtctgcgagggcgtggaggtgcaggttttccttctggcctcaaatggtccttcatgcccaaagtctctgatggacgtccttcttatcttgttgttaatgctgatgagagtgaaccaggaacttgtaaagacagggaaatcatgcgtcatgacccccacaagcttctggaagggtgccttattgctggagttggaatgagagcatcagctgcttacatctacattagaggtgaaaatgtgaatgagcgtctgaaccttgagaaagctcggcaggaagcatatgcatcaggacttcttggtaagaacgcttgcgggtcaggctatgattttgatgtgcatatacattttggtgctggtgcctacatttgtggtgaagagactgccctactggagagccttgaaggcaagcagggtaaaccaaggctgaaaccacctttccctgccaatgctgggctgtatggctgccccacaactgtcacaaatgttgaaactgttgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgcggaggtgttagaggaggatgggacaacctgcttgcagttatccctggtggttcatctgttcctctgttgccaaagcacatatgtgatgacgtgttgatggactatgatgcactaaaggctgtacagtccggattaggcactgcagcagttatggtgatggacaaatccacagatgtagttgatgcgattgctagactgtcatacttctacaagcatgagagctgtgggcagtgcacgccttgccgtgagggtacaggatggctgtggatgatcatggagaggctcaaggtgggcaatgcaaagctagaagagatcgatatgcttcaggaggtgacgaagcagattgaagggcacacgatctgtgccctcggggatgctgcagcatggcctgtgcagggtcttatcaggcacttcaggcctgagctggaaaggaggatccgcgatcgagcggatagcgagctgctgatggcagcttctgcatgagcaccacttctattttcctgattttattcacagaaataatgcaaactggtgaagctcatttctgtacaagcagatgtagcttaccttattggtttgaaccttttatgtccatgtttatttgatgcgctgatgaagccagtgtgctttgatggagaagtagaaacgaatgaaggattgtaccctgtagcctgtttttcctcttctttaatgttataaagaatgacttgcttcta

SEQ ID NO: 3799 - DNA, 1927 bp, Avena sativa
gactctttcgctgcttccccttcctgcgcagagcacctgacccggagctcgccccggttctcctccccacaccacaccactctctctccggtttctccccaatccgagcgactcgaggccaggcggaggcggagatggcgctgcggcgggcactcctcagatcagccgagatctccctcggtcgcaaggccgtgcttgagtacttgcatcctctatcaagggcacagcctgctcgttctctcacatgtgctggcctgtatccgtctggcaaatcattcagcacccaggctgctactacgtcaagcacaccacagcctcccccaccacccccacctccagaaaagactcactttggtgaccttaaagacgaagatcgcattttcacgaacctctatggtctgcatgatccgtttctgaaaggcgcaatgaagaggggtgactggtatagaaccaaggatttagtgattaaaggggcagactggatagtgaatgaaatgaaaaaatcaggtctacgagggcgtggaggtgcaggttttccttctggcctcaaatggtccttcatgcccaaagtctctgatggtcgcccttcttatcttgttgttaatgctgatgagagtgagccaggaacttgtaaagacagagaaatcatgcgtcacgatccccacaagcttctggaagggtgcctgattgctggagttggaatgagggcgtcggctgcttacatctacattagaggtgaatatgtgaatgagcgtctcaaccttgaaaaagctcggcaggaagcatatgcatcgggacttcttggtaagaacgcttgtggatctggctatgatttcgatgtgcatatacattttggtgctggggcctacatctgtggtgaggagactgccctactggagagccttgaaggcaagcagggtaagccaaggctgaagccgcctttccctgccaatgctgggctttatggctgccccacaactgtcacaaatgttgaaactgttgctgtgtctccaacaattcttaggcgtgggccagaatggtttgcaagttttggacgcaaaaataactcgggaacaaaactgtactgcatctcaggtcatgtgaacaaaccttgcactgtcgaggaggaaatgagtatacctctgagggaattgatcgagaagcactgtggaggtgtgagaggaggatgggacaacctgcttgccattatccctggaggttcatctgttcctctgctgccaaagcacatatgtgatgatgtgttgatggactatgatgcactaaaggctgtccagtctgggttaggcactgcagcagttatggtgatggacaaatccacagatgtagttgacgcaatcgctagactgtcgtacttctacaagcacgagagctgtgggcagtgcactccttgccgtgagggtacaggatggctgtggatgatcatggagaggatgaaggtgggcaatgcaaagctggaagagattgatatgcttcaggaggtcacgaagcagattgaagggcacacaatctgtgccctcggggatgctgcagcatggccagtgcaggggcttatcaggcacttcaggcctgagctggagaggaggattcgtgaccgagctgatagggagctgttgacggcagcttctgcataagaatcatttgtactagtttcctggtttcattcacagaaataatgcaaacaggtggaactcatttctgtcaaggagatggagctttccttattggtttaaacatttatgttgatgtttatttgatgcactgaagaagctggtgtattttgatggaagtagaaacgaatatgaaggattgtacccttgtatgttacatgagccttgttttctttaaatgtttgactatcatttgcttcgaatccccagaacccgagttaatttgttaaaattgtatt

SEQ ID NO: 3800 - DNA, 2051 bp, Secale cereale
atccccctccacatacaacagccgcggcctcgaagagcactggttcccctcctgcacctggcccggagctcgccccgtttctcttccccacaccacaccagtctctccacggattttccccaaatccgacggactcgaggccaagcggaggcggagatggcgctgcggtgggcgctgctcagatcggccgagatctctcccggtcgcaaggccgcacttgagtacttgcattctctatcaaaggcacagcctactcgtcctatctcatgtgctggcctgcatcctgctggcagaccattcagcacccaggctgctactacatcaagcacaccacagcctccactcccacccccacatccagagaagactcactttggtgaccttaaagatgaagatcgcattttcaccaacctctatggtcttcatgacccttttctgaaaggtgcaatgaagagaggtgactggtatagaaccaaggatttagtgattaaaggggcagactggatagtgaatgaaatgaagaaatcaggtctacgagggcgtggaggtgcaggttttccttctggcctcaaatggtccttcatgcccaaagtttctgatggacgtccttcttatcttgttgttaatgctgatgagagtgaaccaggaacctgtaaagacagggaaatcatgcgtcatgacccccataagcttctggaagggtgcctgattgctggagttggaatgagggcatcagctgcttacatctacattagaggtgaatatgtgaatgagcgtctgaaccttgagaaagctcggcaggaagcatatgcatcaggacttcttggtaagaatgcttgcggctcaggctatgattttgatatccatatacattttggtgctggtgcctacatttgtggtgaagagactgctctactggagagcctcgaaggcaagcagggtaaaccaaggctgaagccacctttccctgccaatgctgggctgtatggctgccccacaactgtcacaaatgttgaaactgtcgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgtggaggtgttagaggaggatgggacaacctgcttgcagttatccctggcggttcatctgttcctctgttgccaaagcacatatgtgatgacgtgttgatggactatgatgcactaaaggctgtacagtctggattaggcactgcagcagttatggtgatggacaaatcgacagatgtagttgatgcgattgctagactgtcatatttctacaagcatgagagctgtgggcagtgcacgccgtgccgtgagggtacaggatggctctggatgatcatggagaggctgaaagtgggcaatgcaaagctagaagagatcgatatgcttcaggaggtgacgaagcagattgaaggccacacgatctgcgctcttggggatgctgcagcatggcctgtgcagggtcttatcaggcacttcaggcctgagcttgaaaggaggatccgcgatcgagctgatagcgagctgctgatggcagcttctgcatgagcaccacttctattttcctgattttattcacagaaataatgcaaactggtgaagctcatttctgtagaagcagatctagcttaccttattggtttgaaccttttatgtccactattttcctgattttattcacagaaataatgcaaactggtgaagctcatttatgtagaagcagatctagcttaccttattggtttgaaccttttatgtccatgtttatttgatgcgctgatgaagccggtgtgctttgatggagaagtagaaacgaatatgaaggattgtgccctgtatgttatatgagcctgtttttcttcttctttaatgttataaagaatgactatcaaattatgtcggcatctgatggcgaatgtttgctc

SEQ ID NO: 3801 - DNA, 1960 bp, Secale cereale
ccgcggcctcgaagagcactggttcccctcctgcacctggcccggagctcgccccgtttctcttccccacaccacaccagtctctccacggattttccccaaatccgacggactcgaggccaagcggaggcggagatggcgctgcggtgggcgctgctcagatcggccgagatctctcccggtcgcaaggccgcacttgagtacttgcattctctatcaaaggcacagcctactcgtcctatctcatgtgctggcctgcatcctgctggcagaccattcagcacccaggctgctactacatcaagcacaccacagcctccactcccacccccacatccagagaagactcactttggtgaccttaaagatgaagatcgcattttcaccaacctctatggtcttcatgacccttttctgaaaggtgcaatgaagagaggtgactggtatagaaccaaggatttagtgattaaaggggcagactggatagtgaatgaaatgaagaaatcaggtctacgagggcgtggaggtgcaggttttccttctggcctcaaatggtccttcatgcccaaagtttctgatggacgtccttcttatcttgttgttaatgctgatgagagtgaaccaggaacttgtaaagacagggaaatcatgcgtcatgacccccataagcttctggaagggtgcctgattgctggagttggaatgagggcatcagctgcttacatctacattagaggtgaatatgtgaatgagcgtctgaaccttgagaaagctcggcaggaagcatatgcatcaggacttcttggtaagaatgcttgcggctcaggctatgattttgatatccatatacattttggtgctggtgcctacatttgtggtgaagagactgctctactggagagcctcgaaggcaagcagggtaaaccaaggctgaagccacctttccctgccaatgctgggctgtatggctgccccacaactgtcacaaatgttgaaactgtcgctgtgtctccaacaattcttaggcgtggcccagaatggtttgcgagttttggacgcaagaataactcgggaacaaaactttactgcatctcaggtcatgtgaacaaaccttgtaccgttgaggaggaaatgagtatacctctgaaggaattgatcgagaagcactgtggaggtgttagaggaggatgggacaacctgcttgcagttatccctggcggttcatctgttcctctgttgccaaagcacatatgtgatgacgtgttgatggactatgatgcactaaaggctgtacagtctggattaggcactgcagcagttatggtgatggacaaatcgacagatgtagttgatgcgattgctagactgtcatatttctacaagcatgagagctgtgggcagtgcacgccgtgccgtgagggtacaggatggctctggatgatcatggagaggctgaaagtgggcaatgcaaagctagaagagatcgatatgcttcaggaggtgacgaagcagattgaaggccacacgatctgcgctcttggggatgctgcagcatggcctgtgcagggtcttatcaggcacttcaggcctgagcttgaaaggaggatccgcgatcgagctgatagcgagctgctgatggcagcttctgcatgagcaccacttctattttcctgattttattcacagaaataatgcaaactggtgaagctcatttctgtagaagcagatctagcttaccttattggtttgaaccttttatgtccatgtttatttgatgcgctgatgaagccggtgtgctttgatggagaagtagaaacgaatatgaaggattgtgccctgtatgttatatgagcctgtttttcttcttctttaatgttataaagaatgactatcaaattatgtcggcatctgatggcgaatgtttgctcaagttgatgttaacaatggatttagtgggcca

SEQ ID NO: 3802 - DNA, 2044 bp, Amorphophallus konjac
ggttgtatggtatctaagtaccagaatgtatttgtgttcgtaggtggtacgttgtgagcgtgccaatcatacctacaggggtgtagataagcagagtaaacgtgtggtagtttcgttagatagaataggataggagattgactgatgtatgacgtagatggaatcaaatgtcgcttgttccatggatttcctgatactgtatggtccgatggcagatcattcaaacagcgtatcagaaaatatttgactctgagttgcttatctctcgttatctgaccaggggtacggggttttgtattctgtaggcagccatcaagaagattttctctcttcccagagcttcgctggtttgtcagcgttattgggcaccagcttctgcttgtagatcatttagctctcaggcttcaactccagcaggcactcagcctccacccccgcctccgcctcccgaaaaaacgcattttggaggcctgaaagatgaggaccgcattttcaccaacctttatggcttgcatgaccctttccttaaaggtgctatgaaacgaggggactggtatagaactaaagatttggtactaaaaggttccgactggatcgtcaatgaaatgaagaagtcaggcctccgtggccgaggtggtgctggcttcccttctggtctcaagtggtcttttatgccaaaagtttctgatggacgcccttcttatcttgttgtcaatgcggatgagagtgaacctgggacatgtaaagacagagaaatcatgcgtcatgatccacacaagctacttgaaggttgcttgattgcgggggttgggatgcgtgcaacagcagcatatatctacataaggggtgagtatgtgaatgagcgtttgaatcttgataaggccagaaaagaagcatatcaagctgggcttctgggtaagaatgcatgtgggtctggttatgactttgatgtctacatccactatggggccggtgcttacatttgtggtgaagaaacagcactactggagagccttgaaggaaagcaagggaagccaaggctgaaacctccctttcctgctaatgctggtttatatggttgcccgaccacagtcacaaacgtggaaactgtggccgtgtctcctacaattttaaggagaggccctgaatggtttgccagttttgggaggaagaacaattcagggacgaagctcttttgtatatcaggccacgtcaataagccttgcactgtggaagaggagatgagtattcctttgaaggagttgttagagaggcattgtggaggagttagaggagggtgggataatttgctggcagttataccaggaggctcctctgtccctctcctacccaaacacatatgtgatgatgtcttaatggactatgatgcactgaaggcagtgcagtcaggattgggcacagctgcagttattgtgatggataaatccacagatgtggtggatgcaatagcaagactttcttacttttacaagcatgaaagctgtggacagtgtactccatgcagagagggaacaggatggctatggatgatcatggagaggctgaaggtgggtaatgcaaaactggaggagattgatatgcttcaggaagtgacaaagcagattgaaggacatacaatttgtgcattaggagatgctgccgcatggccagtgcaagggctgatcaggcatttcaggccagagcttgagaggaggattcgagaacgtgcagaaaaagagctgttggaagctgctgctgcatgagttttgtatcctggtaaatgtaattgcattgtggaataaaatgtcaaggaagattggaggctgacttggcttttttctgtcatctcctttatttgcattggtgatgttttcagaattgagcgggagtctgacttagacctttgttgtttttgtaatttgttgaagcgaaactttacctgtttaatcctttgatattatgtgactttgaaaatgattcaatggagttgatagctacttgctcatatttatgatcataaatgaaaacagtcgttgaactcaag

SEQ ID NO: 3803 - DNA, 2041 bp, Musa acuminata
atttggaacggtctacttccagcttcatcgaccggctcaaggtggccgtggaagaacgagagctcattccgtggcttctgcagagccgcttcactcaatcctctcgattccttcgcgaggcaggtgatggttcttttcaaggccagtcggcgcgttgtgtcgacaagtttgccggcaatcaaaagtggatctgtacctctcaagaacctttcttcgatctatagggctggactgattcgccattccagtggctggagatcattttctgcttgtaggtcattcagcacccagactgctacaacaggaagtacccctcagcctccacctccacctccacctccagaaaagactcattttggtggtctaaaggatgaagatcgcattttcacgaacctatatggcttgcatgatcctcttctaaaaggtgctatgaaacggggtgactggtacagaaccaaggacttggtagttaagggtagtgactggattgtcaatgaaatgaagaagtctggtctgagaggccgtggaggagctggttttccatctggtctgaagtggtctttcatgcccaaggtatctgatggccgcccttcttatcttgttgtcaatgctgatgaaagtgaacctggcacatgtaaagacagagaaatcatgcgtcatgatcctcataaacttctggaagggtgcctgattgctggagttggtatgagggcaacagctgcatacatctacgtaagaggagaatatgtaaatgaacgattgacacttgagaaggcaagaaaggaagcatatcaagctggattattggggaagaatgcttgtggatcaggttatgattttgatgttcatatacactttggtgctggagcttacatctgtggtgaagagacagcattattggagagccttgaaggcaaacaagggaaaccaagactaaagcctcctttcccagcaaatgcaggactatatggctgtccgactactgtaacaaatgtggagactgtggctgtatctcccacaattttgcggcgaggacctgaatggtttgcaagctttggccggaaaaataattctggcacaaaactgttctgtgtatctggtcatgtgaacaagccttgcacggtggaagaggagatgagtatcccactgaaggaattgatagagaggcattgtggtggcgttcgaggaggctgggacaacctgttggcagttatcccgggaggttcttctgttcccctccttcccaagcacatatgtgatgatgtcatgatggattacgatgctcttaaagctgttcagtctggactgggtactgcagcagtgattgttatggacaaatccactgatgtcgtggatgcaatagcaagactgtcttacttctacaagcatgagagttgcggtcagtgcacaccctgcagggagggaaccggatggctgtggatgattatggagaggttgaaggtggggaatgccaagctggaggagattgatatgcttcaggaagtcaccaagcagatcgaagggcacactatatgcgctctgggtgatgctgctgcatggccggtacagggacttatcaggcattttaggccagaactagaaaggagaatcagggagagggccgagagagagctcttggaggctgcagctgcttaaatcctctagcctttccttttcaagagctttctctgcttcttttcatcaaacttatgagaataatcaattgttggtggacatcctaatgagaacacagctctgcatgctgtttctgacgttgtcctctacacagacctatttgtctgaagctcttccaagatcagatccatgttgttggatccctgagcctgcaaattctgcaattgttttcgtttgtggaggagaattcatttattgtctgcccatgaatatatattgggaatcttgtcaaatttcattaatatatttttatggctttaagtttattgtacaaatccactcttatttattttgttactcaatattcatgtttgaaaagcgattgaaaaaaaaaaaagaagaatag

SEQ ID NO: 3804 - DNA, 1976 bp, Malus domestica
gacctcattaaatcatctcgatcattattaactggatggtccattttacccttctcagcatatgagatgaggtccgcttactgagctctccttcatttcccacctgagcattctcgcttcttctcccccaatctcgttctcgtcgattacctgattcggcgacgcatcgcgtttcgtccgccgcagctccaccatggcacccatcaagggtatactttctctgcagagagcagctttagctcgtcatcatggtgcgaagtggggcctagcgtttagatcattcagcactcagggagcagcaccctctactactgctcaacctccacctcctccacctcccgaaaaaactcattttggtggtttgaaagatgaagaccggattttcaccaacttatatgggttgcacgacccatttctcaagggtgccatgaaacgaggtgactggtaccgaaccaaagatctagttattaaaggtgctgattggattgtcaatgaaatgaagaagtctggcctacgtggacgtggtggtgctggtttcccatctggtctcaaatggtcttttatgccaaaagtatctgatggccgtccttcctatcttgtcgtcaatgctgatgaaagtgaacctggaacctgtaaggacagggaaattatgcgccatgacccacacaaacttttagagggttgcttgattgctggtgttgggatgagggccagtgctgcttacatctatataagaggtgaatatgtgaatgaacggttaaaccttgtaaaggctagaaatgaagcctatgcagctggattactaggaaaaaatgcttgtggatctggttatgattttgatgttcatatccactttggtgctggtgcctatatttgtggtgaagaaacagcgcttctggagagccttgaagggaaacaggggaagccaagattgaagcctcctttccctgctaatgcaggattatatggctgtcccaccactgttacaaatgtggaaacggtggctgtttctcccaccattttaaggcgtggaccagagtggtttgccagttttgggagaaagaacaattcagggacaaaattgttttgtatctcgggacatgtgaacaagccttgcactgttgaagaggaaatgagcatacccttgaaagagttactagagaggcactgtggaggtgtgaggggcggatgggacaacttacttgcagtaattccaggtggttcatctgttccattgcttaccaaggatatatgcaatgatgttttgatggattttgatgcactgaaggctgtgcagtcaggattgggaactgcagctgttattgtgatggataaatcgacggacattgtcgatgcaattgcaaggctttcttacttctacaagcatgagagttgtgggcagtgcacaccgtgtagggaggggacaggatggctatggatgatcatggaaagaatgaaagttgggaacgcaaagctggaagagattgacatgcttcaggaggtgaccaagcagattgaggggcacacaatctgtgcgttgggtgatgctgctgcttggcccgtgcaaggtctaataaggcatttcaggccagagcttgagaggaggatcagggagcgtgcagagagggaattgctggaggcagctgcttaagtgcttctctcaggttatgcttgtattagtggaaatcatggaataaaatgaagttgccccagatttcgggaggatatgtgaatcgggaggcagctggtggtccagctgctattgtttatttttaaactgtatcaactatatgacctcactgtcccagagacaatctgattcattgtggatgcgtctgggcaggatatttgtgttgtgtttccagatcttgttttcccttacacagtcggagttttgttaataaattttcgtttttcgcttccctgctttgatagatatccttcacgaattcaactttaaatctcaaaactaagag

SEQ ID NO: 3805 - DNA, 2009 bp, Musa acuminata
cgggttttgtgccacgtgatgtgcatgtgatcgatggtagaccgggcctgccccaagcccgcccatggaagtgggtcggctgcggggagcgaaccctcgtttcgtggctgccgcatcaccgcgcccctctttctccgttcccactctcccattccgcctgttcatgccctggttggttgacccgtaacgctgcgtcctcttcgcaaatatgtcggcaatcggaagaagctctgcacctctcaagaacttttcttcgcgatacaaggctgaactgcttcatcattttaaaacctggaggttaaattctgcttgtagatcactcagcacccaggctgcaacaactggaagtactcctcagcctccaccaccacccccacctccagaaaagacccattttggtggtctaaaggatgaagatcgcatcttcaccaatttgtatggcttgcacgatcctcttctgaaaggtgcgatgaaacggggtgactggtatagaaccaaggacttggtacttaagggtagtgactggattgttaatgaaatcaagaaatctggtctacgcggccgtggaggtgctggttttccatctggtcttaagtggtctttcatgcccaaggtatccgatggccgcccttcttatcttgttgtcaatgctgatgagagtgaacctggtacatgtaaagacagagaaataatgcgccatgatcctcataaattgcttgaagggtgcctgattgctggagttggtatgagggcaacagctgcttacatttacataagaggggagtatgtaaatgaacgattaactcttgaaaaggctagaaaggaagcttatcaagctggacttttggggaagaatgcttgtggatcaggttatgattttgatgtacatatacactttggtgctggagcatacatctgtggtgaagagacagcattactagagagtcttgaaggaaagcaaggaaaaccaaggctgaagcctcctttcccagctaatgctggactatatggctgtccgacaactgtaacaaatgtggagactgtggctgtatctcccacaattttgcggcgaggaccagaatggttagcaagctttggccgaaaaaataactccggcacaaaactattctgcatatccggtcatgtcaacaaaccttgcaccgtggaagaggagatgagcatcccattgaaggaattgttagagaggcactgtggtggtgttagaggaggttgggataacttgttggcagtcatcccaggaggttcctcggttcctctccttcccaagcacatatgtgatgatgtcttaatggattatgatgctctcaaagctgttcaatctggattgggcaccgcggctgtgattgtgatggacaaatccactgatgtcgtggatgcgatagcaagactatcttacttctacaagcatgagagttgtggccagtgcactccctgcagagaggggaccggatggctatggatgattatggagagattgaaggtggggaatgctatgctggaggagattgatatgcttcaggaagtcacgaagcagattgaagggcacaccatatgtgctcttggtgatgccgctgcatggccagtgcagggtcttatcaggcattttaggccagaactagaaaggaggatcagggagagagcgcagaaacagctcttggaggctgcagctgcttgagtcctctggcctgaccatgccgaacatctttcttccatttattgcagcttattatcttatctatgaaaataatgaacttcttttagaggtcatatgtaaagacaccttatatgctgttcttgagcttgtgcccttaaactagtttctgatggcatggaaagagcaggtctgttgtagctctcttgttgaacctctcagactgtaaattttgggattgcatcctttcgacttcaaagctaagaactcatttgttgcgtgtccttgaattggcactgggaatctcatcaaacctagttaatccataatttgtggc

SEQ ID NO: 3806 - DNA, 1834 bp, Gossypium hirsutum
ggatcatccgcgaaatttcactctatggcacccataaaagggcattctttccttgcaaagggcagctttgttaagagcttgcggtgaaaggtggaaactaggcactagatcatttagtactcaaggagcaacaactgctggtgctccacaggcaccccctcctccaccaccacctgaaaaacccatttggtggtttaaaagatgaagatcgtattttcaccaacttatatgggttgcatgatccttttctcaaaggtgccatgaaacgtggtgactggtatagaaccaaggatttagtactcaagggtgctgattggattgtcaatgaaatgaagaaatctggactccgaggacgtggtggtgctggatttccatcaggcctcaaatggtcttttatgccaaaagtatctgatggccgtccttcttatcttgttgtcaatgctgatgaaagtgaacctggaacctgtaaagacagggaaatcatgcggcacgatccacacaaactattggagggttgcttgattgctggggttgggatgagagctacagctgcttatatctacatcaggggtgaatatgtgaatgaacgtaaaaaccttgaaatagctagaaatgaagcatacgaagctggactgttgggcaaaaatgcatgtggttctggttatgattttgacgttcacatccattttggtgccggtgcttatatttgtggtgaagaaacagcacttctagagagccttgaaggaaaacaaggaaaacctagattgaagcctcctttccctgctaatgctgggttatatggctgtcccaccactgtcacaaatgtggagacggtggctgtttctcccacaatattgagacgtggtcctgagtggtttgccagttttgggaggaagaacaattctgggacaaaattgttttgtgtctcaggtcacgtcaacaagccttgcacagttgaggaggagatgagtataccacttaaggagttgatagagaggcactgcggaggcatcagaggtggatgggacaatttacttgcagtaataccaggaggttcatctgttccacttttacccaagcacatatgtgatgatgtcctgatggattatgatgcactcaaggctgtccagtcaggactgggaaccgctgcagtaattgtgatggataaatcaactgatgttgtagatgcaattgcgaggctttcgtacttctacaagcacgagagttgtggacagtgcacgccctgcagagaagggactggatggctatggatgatcatggaaagattgaaagttgggaatgcaaagttggaagagattgacatgcttcaggaggtgaccaagcagattgaagggcacacaatttgcgctttaggtgatgcagcagcttggcctgtgcagggtctaatacggcattttaggccagagctcgagagaaggattagggagcgtgcagaaagggagttgctcgaggcttctgcgtaatttctgctcaggttgcttctggcatctttttgactttcagtttgttagtgcatctttttcttccaaaatatgaagtactctcaacgtgcttgatttggcattttagttatcaatttccatttcgttatgtgaaaatgctcgtttctatggatgcatgctttcacaacaaactgtaccctggtatactcatgaataatttcatgagaagaaaaaataaggtgctggcttgtacaacgcctgtagatgaattaacttatttcttttaatgtccttaaggatttcattttagtttttccttatcatctggcagtggcaacctaccaatagttgcctggtcacttaaaaaagaa

SEQ ID NO: 3807 - DNA, 1983 bp, Malus domestica
gtctgacttcttgttaatttgtaggcacccatcaagggtatactttctctgcagagagcagctttagctcgtcatcatggtgcgaagtggggcctagcgtttagatcattcagcactcagggagcagcaccctctactactgctcaacctccacctccgccacctcccgagaaaactcattttggtggtttgaaagatgaggaccggatttttactaacttatatgggttgcacgacccatttctcaagggtgccatgaaacgaggtgactggtaccgaaccaaagatctagttattaaaggtgctgattggattgtcaatgaaatgaagaagtctggcctacgtggacgtggtggtgctggtttcccatctggtctcaaatggtcttttatgccaaaagtatctgatggccgtccttcctatcttgtcgtcaatgctgatgaaagtgaacctggaacctgtaaggacagggaaattatgcgccatgacccgcacaaacttttagagggttgcttgattgctggtgttgggatgagggccagtgctgcttacatctatataagaggtgaatatgtgaatgaacggttaaaccttgtaaaggctagaaatgaagcttatgcagctggattactaggaaaaaatgcttgtggatctggttatgattttgatgttcatatccactttggtgctggtgcctatatttgtggtgaagaaacagcgcttctggagagccttgaagggaaacaggggaagccaagattgaagcctcctttccctgctaatgcaggattatatggctgtcccaccactgttacaaatgtggaaacggtggctgtttctcccaccatattaaggcgtggaccagagtggtttgccagttttgggagaaagaacaattcagggacaaaattgttttgtatctcgggacatgtgaacaagccttgcactgttgaagaggaaatgagcatacccttgaaagagttactagagaggcactgtggaggtgtgaggggcggatgggacaacttacttgcagtaattccaggtggttcatctgttccattgcttaccaaggatatatgcaatgatgttttgatggattttgatgcactgaaggctgtgcagtcaggattgggaactgcagctgttattgtgatggataaatcgacggacattgtcgatgcaattgcaaggctttcttacttctacaagcatgagagttgtgggcagtgcacaccgtgtagggaggggacaggatggctatggatgatcatggaaagaatgaaagttgggaacgcaaagctggaagagattgacatgcttcaggaggtgaccaagcagattgaggggcacacaatctgtgcgttgggtgatgctgctgcttggcccgtgcaaggtctaataaggcatttcaggccagagcttgagaggaggatcagggagcgtgcagagagggaattgctggaggcagctgcttaactgcatctctcaggttgcttcttgtatctattctgcattcatttcttcattcgacttctaaaaagaagtaaataagggagaaaaacagtactagtaacttgaacttgggtacgcattggaatgtgtttgttgttgtcttgttgtaaggccacgcaacaggtggcctggtccggttggctgaatctagacatcaatgggctaaaaaaattgtcgcttggtctaatagagggttcttctgctgtgtaggttatgcttgtattagtggaaatcatggaataaaatgaagttgccccagatttcgggaggatatgtgaatcgggaggcagctggtggtccagctgctattgtttgtttttaaactgtatctcgactatatgacctcactgtcccagagacaatctgattcattgtggatgcgtctgggcaggatatttgtgttgtgtttccggatcttgttttcccttacacagtcggagttttgttaataaattttcgtttttcgct

SEQ ID NO: 3808 - DNA, 1915 bp, Artemisia annua
ccggggacatcatttcatttcattggttagtaaaacccagcactttgacgccgttggatcatatatctccctgaaacttgaaaatcatcacccataactttttaattgctgcatttcgtggtttatggcacccatgaagggcattctttctctgcagcgggctgctttgttgagacgtcaaaatgggagttggggtctagctgctagatcgtttagcactcagtctgcaacaaccgctaataccgcacagcctccaccacctccccctcctccagagagaactcactttggtggcttgaaagatgaagaccgtattttcaccaacctttatggtattcacgacccatttctcaaaggtgccatgaaacgtggtgattggcacagaaccaaagatttagtgattaagggcgctgattggatagttaacgaaatgaaaaagtctggcctacgtggacgtggtggtgctggttttccatctggtctcaagtggtcgtttatgcctaaggtgtctgatggtcgtccatcctatcttgttgttaatgctgatgaaagtgaacccggaacctgcaaggatagagaaatcatgcgtaacgacccacacaaactattagaaggatgtttgattgccggagttggtatgagggcaactgctgcttatatctacattagaggtgaatatgtgaacgagcgtcttaaccttgagaaggccaggaaagaagcctacgcagctggattactagggaaaaatgcttgcggttcgggatgattttgatgttcatatccactttggtgctggtgcttacatctgtggtgaagaaactgcacttttggagagtctcgagggtaagcaaggaaaacctagattgaagccccctttcccagctaatgccggtctatatggatgcccaacaactgttacaaatgtagaaacagtagctgtatctcctaccattctaaggcgcggccctgagtggttttctagttttgggcgaaagaacaattccggaacaaaactattttgcatttctggtcacgtgaacaagccgtgcacagttgaagaggagatgagtatttcattaaaggagcttctagagaggcactgtggtggtgttagaggtggatgggataacctacttgcggtaattcccggcggttcatctgttccattgcttccgaaagacatatgtgaggatgtgctgatggattttgatgcactcaaggctgtccagtctggattagggactgctgctgttattgtgatggataaatcaaccgatgttgtggatgccattgcaaggctttcctacttctacaagcacgagagttgtggtcagtgcacaccttgcagagagggtaccggatggctttggatgatcatggaaaggatgaaggtcgggaatgcaaagttggaggaaattgatatgctccaagaggtaacaaagcagattgaaggacacacaatttgtgcattgggtgatgctgctgcttggcctgtgcaaggtcttatcaggcattttaggccggagctcgagaggaggatcaaggagcgtgctgatagagagctgcttcaggcagctgcttaaaacagactgaagattctaatgccccacagtatgtgcaataagtacgcagaaatactccggatacctggaggaaaacaatgaatccccttacgagcttcatgatttaattttaaggcttgtattgagttacgatgttgttgaaaatactaccctctctttagatagggggtaacttttgttgtttcagtgtgtaaggatacaaagacgtcctacctttattattgatcatttaacagtgtttttggacatgttttttatgttaataaagccaaatgcaatgttgtaatgctacaatgtcaagcttttgaaagctcaaagttttcttcctgtta

SEQ ID NO: 3809 - DNA, 2083 bp, Gossypium raimondii
ccgatagccatcataaacactctaagaaatattggccgttagatcacttaccaccccctttcaatcgacattttttattttccaccgtcaatctccgttgctagataccgtagccaaccattccccaccttcaaattccctattcccttttcctccgcccttgtttctgaattttgcagtcgagccgaatcgcaaccatcaaggatcatccgcgaaatttcactctatggcacccataaagggcattctttccttgcaaagggcagctttgttaagagcttgcggtgaaaggtggaaactaggcactagatcatttagtactcaaggagcaacaactgctggtgctccacaggcacctcctcctcctccactgcctgaaaaaacccattttggtggtctaaaagatgaagaccgtattttcaccaacttatatgggttgcatgacccttttctcaaaggtgccatgaaacgtggtgactggtatagaaccaaggatttagtactcaagggtgctgattggattgtgaatgaaatgaagaaatctggacttcgaggacgtggtggtgctggatttccatcgggcctcaaatggtcttttatgccaaaagtatctgatggtcgtccttcttatcttgttgtcaatgctgatgaaagtgaacctggaacctgtaaggacagggaaattatgcggcacgatccacacaaactattggagggctgcttgattgcgggggttggaatgagagctacagctgcttatatctacatcaggggtgaatatgtgaatgaacgtaaaaaccttgaaagagctagaaaagaagcttatgaagctggactattgggcaaaaatgcatgtggttctggttatgattttgatgttcacatccattatggtgctggtgcctatatttgtggtgaagaaacagcacttttagagagccttgaaggaaaacaagggaaacctagattgaaacctcctttccctgctaatgctggattatatggttgtcccaccactgtcacaaatgtggagacagtggctgtttcgcccacaatactgagacgtggtcctgagtggtttgccagttttgggaggaagaataattccgggacaaaattgttttgtgtctcaggtcatgtcaacaagccttgcacagttgaggaggagatgagtataccacttaaggagttgatagagaggcactgtggaggtgtcagaggtggatgggacaatttacttgcagtaatacctggaggctcatctgttccacttttacccaagcacatatgtgatgatgtcttgatggattacgatgcactcaaggctgtccagtcaggactgggaactgctgcagtaattgtgatggataaatcaactgatgttgtagatgcaatcgcaaggctttcatacttctacaagcatgagagttgtggacagtgcacaccctgcagggaagggactggatggctctggatgatcatggaaagattgaaagttgggaatgcaaagttggaagagattgacatgcttcaggaggtgaccaagcagattgaagggcacacaatttgcgctttgggtgatgcagcagcttggcctgtgcagggtcttatacggcattttaggccagagctggagagaaggattagagagcgtgcagaaagggagttgctggaggcttctgcttaatctctgctcagggattacctgtgcaagtggccattatggaataaaattgaagtacccaaaacttggagaataggtgactctcaggcatctggtgttgtggaagtgttttatttgttatctcctaagctgttgtgttaacaacatttcactgttttagaaaataatgaatgtctccaatgtctgggcagggatacttgtttctcatagcatccacaacgtttcttttttggcccatttgatgaacatggttaatgatctgtattctttttatttctttttgggaacatataatggtatctgtatttttctatgatcatagatgtcgtaggataaaaataaacgttttcagagaaataaaataaagttatactactacccagatattgaaatggataa

SEQ ID NO: 3810 - DNA, 1522 bp, Ricinus communis
ttatgacaatcactatctatattatttgttttgttataggcacccattaggggcatttttaatttgcaaagagctgctttgattcggcgtcaaagtgataggttggctgtaggtatcagatcattcagcactgaagctacaaaaagtgctggtagttcccagcctctccctcctccaccacctccggagaaaacccattttggtggcttgaaagatgaggaccggatttttaccaacttgtatgggttgcatgacccttttctaaaaggtgctatgaaacggggtgattggtatagaactaaggacttggtgctcaagggtgctgattggattgttaatgaagtgaagaagtctggtcttcggggacgtggtggtgctggtttcccctctggtcttaaatggtcgttcatgccaaaagtgtctgatggtcgcccctcttatcttgttgtcaatgctgatgaaagtgaacctggaacttgtaaagatagggaaattatgaggcatgatccacataagctgttagagggctgcttaattgctggggtgggaatgagagcatctgccgcttatatctacattaggggtgaatatgtgaatgaacggataaacttggaaagagctcgaaaagaagcttatgcagctggattgttaggcaagaatgcatgtggatctggctatgattttgatgttcatatccactatggtgccggtgcttatatatgtggtgaagagactgcacttttagaaagtctagaaggaaaacaagggaaaccaaggctgaagcctcccttcccagctaatgcaggactgtatggctgtcccactactgttacgaatgtggaaacagtggctgtttctcccactattttgaggcgtggaccagagtggtttgctagttttggcaggaagaacaattctggtacaaaattgttttgtgtgtcaggtcatgtgaataagccttgcacagtcgaagaggagatgagtatacctctaaaagagttaatagagaggcactgtggaggtgttagaggtggatgggacaatctacttgcagtaatacctgggggttcttctgtccctttgcttcccaagcacatatgtgatgatgtgctgatggattatgatgcactcaaggctgtcacgtcaggactggggactgcagctgtgatcgtaatggataaatctactgatgttgtggatgcaattgcaaggttgtcttatttctacaagcatgagagttgtgggcagtgcacaccgtgcagggaggggacaccgtggctttggatgatcatggaaaggttgaaggtcgggaatgcaaagttggaagagatagatatgcttcaagaggtcacaaaacaaatcgaagggcacactatctgtgcgctgggtgatgctgcagcttggcctgtgcagggtcttataaggcattttaggccagaacttgaaagaaggattaaggagcgagcggagagggagttgctggaagctgctgcttaaggtttcttacaggttccttattgta

SEQ ID NO: 3811 - DNA, 2064 bp, Eschscholzia californica
ggtttcagggcttctctaaggtccaaacagacccttatatctttctctctctaaaactttctttctttctctattgtaatcctctcgacgggaggagcccccttctttatttcatctctattttctctctcttgatttgatttgcgaactcctctgagaaatctcatgggacctatcaagaacattctctctctacagaggacagctctagttcgtaactgcagctggagatgggacgcagtttccagatcattcagcactcaagctgcaactacttcgagcactccacaacctccaccaccacctccacccgccgagaaaactcactttggtgggctgaaagatgaagaccgcatcttcaccaacctatatggaattcacgaccctttcctaaagggcgcaatgaaacgaggtgattggtatagaaccaaagacttggtacttaagggtactgactggatcgtgaacgaaatgaagaaatctggtctccgtggtcgtggtggtgccggttttccttctggtctaaaatggtcatttatgccgaaagtttctgatggtcgtccttcatatcttgttgtcaatgctgatgaaagtgaaccaggaacatgtaaggacagagaaattatgagacatgacccacacaaattactagaagggtgtcttatcgctggagtaggaatgcgggcatccgctgcttatatctacataaggggtgaatacgtaaatgagcgtttaaacctcgaaaaagctctcaaagaagcttataaagctggacttttggggaaaaacgcatgcggatctggttacgattttgatgttcatatccattatggagcaggtgcttacatttgtggtgaagaaactgcacttcttgaaagtcttgaaggaaagcaaggtaaacctagattgaagcctcctttcccagcaaatgcaggtttatacggttgcccaacaacagttaccaatgttgaaacagtagccgtctctcccaccattttaaggagagggcctgagtggtttgctagttttggaaggaagaacaattcgggaacaaaactattctgcatttcgggtcacgtcaacaaaccttgcactgttgaagaggagatgagtataccattaaaggaattgctcgaaaggcactgtggaggagtgagaggtggatgggataatttacttgcagtaatacccggaggttcatctgttcctttacttccaaaggacatatgtgatgatgtactgatggattatgatgcactcaaggccgtgcaatccgggttaggaactgctgcagttattgtgatggataaatcaacagatgttgtagatgctattgcccgactttcttacttctataagcacgaaagctgtgggcaatgcacaccttgcagggaaggaacaggatggttgtggatggtaatggagagattgaaggttggaaatgcaaagctggaagagatagacatgcttcaggagatcacgaaacagatcgagggtcatactatctgtgcattgggtgatgctgctgcttggcctgtgcaaggactcattaggcacttcagaccagagctggagaggaggatcaaggatcgtgcagcaagagaattactcgaggcggctgcttgaacctacaaccgcgtaggttaggtctctctctctctccctcccctctctataaagtgaaagaactattcggacttcggtcagtcagtgcttgttattatttccttgttttgtattgcataactaaacaaaacccgttcttgttagcggggagtgatctcaatgggtgatgttgtcgcagatgcagaagatggatcattgatattcaactttggttcttcgagagcaaaagttggtttcgttcgaagatcataatttactgtttttatagtttcatcttatgctgtttagggatttttatctaatcaggtggatattgtggaataaaagagttgaaggaactcgagtacttttttcgtaattttaattttggctctgttgaggaagtaaactttgttttcattttgtatgcgttgcttctcagagaccgaaaacaattct

SEQ ID NO: 3812 - DNA, 1861 bp, Flaveria ramosissima
gaacaattgggagtcaagttcatctcctttcgcttcaaattcttcaccgtagtcgaatcgctgatcgttatttctcaagcttcattgctacattttgtggcgtatggcacccatgaagggcattctttctctgcaacgggctgctttgttgaggcgtcaaaatgttaattggggactaggtactagattgtttagcacccaatctgcaacaactgctaataccgcacagccaccaccacctccccctcctccggagaaaactcactttggtggcttgaaggatgaagaccgcatttttaccaacctatatggtatacatgacccgtttcttaaaggtgccatgaaacgtggtgattggtacagaactaaagatctagtgatcaagggctctgattggatagtaaatgaaatgaaaaaatctggtttacgtggacgtggtggtgctggatttccatctggtctcaaatggtcatttatgcctaaggtgtctgatggtcgtccatcctatcttgtggttaatgctgatgaaagtgaaccaggaacatgtaaggatcgtgaaatcatgcgaaacgatccacataaacttcttgaaggatgcttgattgctggagttggtatgagagcaactgcagcttatatttacattagaggtgaatatgtgaacgaacgccttaaccttgaaaaggccagaaaagaagcctatgcagctgggttacttggaaaaaatgcttgtggttcaggttatgattttgatgtgcatatccattttggtgctggtgcttacatttgtggtgaagaaacagcacttttagagagccttgaaggtaagcaaggaaaaccaagattgaaaccacctttccctgctaatgcaggtctatacggatgtcccacaactgttacaaatgtggaaacagttgctgtatcgcctaccattttaagacgagggcctgaatggttttctagttttgggagaaagaacaactcggggacgaaacttttttgcatatctggtcatgtgaacaaaccatgcactgtcgaagaggagatgagtataccattgaaggagctcctagagcggcattgtggcggtgttaggggcggatgggacaatttactggcagtaattcctgggggttcatcggtaccattgcttcctaaacacatatgtgaggatgtactgatggattttgatgcattgaaggctgtgcaatctggattagggactgcagctgttattgtgatggataagtcaactgatgttgtggatgccattgcaaggctttcttacttttataagcatgagagttgtggtcagtgtacaccttgcagggagggtactggatggctttggatgattatggaaaggatgaaagttgggaatgcaaagcttgaggaaattgatatgcttcaagaggtcactaagcagattgaaggacacacaatttgtgcattgggagatgctgctgcttggcctgttcaaggtcttatcaggcattttaggcccgaacttgagaggcggatcagggagcgtgctgatagagagttgcttcaggcagctgcttgattcaggttgaagagcttgcagccctgcaatctgtggaataaatatgcaaaagtcatcctagaggaatctggaaatcaatgaacccccttgcgagcatcttggtttaagtttaaggtttgtattgaattaccatacaattgaaaattgcactattttaataactggggtaacttttgttgtgcgttgtttttaaggatgcaattatgtcctgtttttattgttgaacttcagataaacatgttttgtatgttaataagccaaacacaatgttgtaacgttacaatcttaagcttttga

SEQ ID NO: 3813 - DNA, 1673 bp, Flaveria ramosissima
aagcttcattgctacattttgtggcgtatggcacccatgaagggcattctttctctgcaacgggctgctttgttgaggcgtcaaaatgttaattgggggctaggtactagattgtttagcacccaatctgcaacaactgctaataccgcacaaccaccaccacctccacctcctcctgagaaaactcactttggtggcttgaaagatgaagatcgcatttttaccaacctttatggtatacatgacccgtttcttaaaggtgccatgaaacgtggtgattggtatagaactaaagatctagtgatcaagggctctgattggatagtaaatgaaatgaaaaaatctggtttacgtggacgtggtggtgctggatttccatctggtctcaaatggtcatttatgcctaaggtgtctgatggtcgtccatcctatcttgtggttaatgctgatgaaagtgaaccaggaacatgtaaggatcgtgaaatcatgcgaaacgatccacataaacttcttgaaggatgcttgattgctggcgttggtatgagagcaactgcagcttatatttacattagaggtgaatatgtgaacgaacgccttaaccttgaaaaggccagaaaagaagcctatgcagctgggttacttggaaaaaatgcttgtggttcgggttatgattttgatgtgcatatccactttggtgctggtgcttacatttgtggtgaagaaacagcacttttggagagccttgaaggtaagcaaggaaaaccaagattgaaaccacctttccctgctaatgctggtctatacggatgtcccacaactgttacaaatgtggaaacagttgctgtatcgcctaccattttaagacgagggcctgaatggttttctagttttgggagaaagaacaactcggggacgaaacttttttgcatatctggtcatgtgaacaaaccatgcactgtcgaagaggagatgagcataccattgaaggagctgcttgagcggcattgtggcggtgttaggggcggatgggacaatttactggcagtaattcctgggggttcatctgtaccattgcttcctaaacacatatgtgaggatgtactgatggattttgatgcattgaaggctgtgcaatctggattagggactgcagctgttattgtgatggataagtcaactgatgttgtggatgccattgcaaggctttcttacttttacaagcatgagagttgtggtcagtgtacaccttgcagggagggtactggatggctttggatgattatggaaaggatgaaagttgggaatgcaaagcttgaggaaattgatatgcttcaagaggtcactaagcagattgaaggacacacaatttgtgcattgggagatgctgctgcttggcctgttcaaggtcttatcaggcattttaggcccgaacttgagaggcggatcagggagcgtgctgatagagagttgcttcaggcagctgcttgattcagtattcaggttgaagagcttgcagccctgtaatctgtggaataaatatgcacaagtcatcctagaggaatctggaaatcgatgaacccccttgcgagcatcttggtttaagtttaaggtttgtattgaattaccatacaattgaaaatagcactattttaataactggggtaacttttgtt

SEQ ID NO: 3814 - DNA, 1813 bp, Flaveria ramosissima
tctcctttcacttcaaatccttcaccgtagtcgaatcgctgatcgttatttccgaagcttcattgctacatttttgtggcgtatggcacccatgaagggcattctttctctgcaacgggctgctttgttgaggcgtcaaaatgttaattgggggctaggtactagattgtttagcactcaatctgcaacaactgctaataccgcacagccaccaccacctccccctcctcctgagaaaactcactttggtggcttgaaagatgaagatcgcatttttaccaacctttatggtatacatgacccgtttcttaaaggtgccatgaaacgtggtgattggtacagaactaaagatctagtgatcaagggctctgattggatagtaaatgaaatgaaaaaatctggtttacgtggacgtggtggcgctggatttccatctggtctcaaatggtcttttatgcctaaggtgtctgatggccgtccatcctatcttgtggttaatgctgatgaaagtgaacccggaacatgtaaggatcgtgaaatcatgcgaaatgatccacataagcttcttgaaggatgcttgattgctggagttggtatgagagcaactgcagcttatatttacattagaggtgaatatgtgaacgaacgccttaaccttgaaaaggccagaaaagaagcctatgcagctgggttacttggaaaaaatgcttgtggttcaggttatgattttgatgtgcatatccactttggtgctggtgcttacatttgtggtgaagaaacagcacttttggagagccttgaaggtaagcaaggaaaaccaagattgaaaccccctttccctgctaatgcaggtctatacggatgtcccacaactgttacaaatgtggaaacagttgctgtatcgcctaccattttaagacgagggcctgaatggttttctagttttgggagaaagaacaactcggggacgaaacttttttgcatatctggtcatgtgaacaaaccatgcactgtcgaagaggagatgagtataccattgaaggagctgctagagcggcattgtggtggtgttaggggcggatgggacaatttactggcagtaattcctgggggttcatctgtaccattgcttcctaaacacatatgtgaggatgtactgatggattttgatgcattgaaggctgtgcaatctggattaggaactgcagctgttattgtgatggataagtcaactgatgttgtggatgccattgcaaggctttcttacttttataagcatgagagttgtggtcagtgtacaccttgcagggagggtactggatggctttggatgattatggaaaggatgaaagttgggaatgcaaagcttgaggaaattgatatgcttcaagaggtcactaagcagattgaaggacacacaatttgtgcattgggagatgctgctgcttggcctgttcaaggtcttatcaggcattttaggcccgaacttgagaggcggatcagggagcgtgctgatagagagttgcttcaggcagctgcttgattcaggttgaagagcttgcagccctgcaatctgcggaataaatatgcacaagtcatcctaaaggaatctggaaatcaatgaacccccttgtgagcatcttggtttaagtttaaggtttgtattgaattaccatacaattgaaatagcactatttaataactgggtaactttgttgtgcgttgtgtttaagggtgcaattgcgtcctgttttttatttgttgaacttcagataaacatgtttttgtatgttaataagccgaacacaatgtt

SEQ ID NO: 3815 - DNA, 3043 bp, Gossypium raimondii
ttttgatttctccgttactgaataccatacccaactattgaactccccatttattccttttttccccctccgccattatttctgattttgcagtcgagtcgaatcgcgcagtgtcaacgaacatctgcaacattttacgctatggcacccataaagggcatcctttccttgcaaagggcagcaatgttcagagccagcagtgagaggtggaaactaggcattagatcatttagtactcaaggagcaacaactgctggtgctccacaggcatcccctcctccaccaccacccgaaaaaacccattttggtggtttaaaagatgaagatcgtattttcaccaacttatatgggttgcatgatccttttctcaaaggtgccatgaaacgtggtgactggtatagaaccaaggatttagtactcaagggtgctgattggattgtcaatgaaatgaagaaatctggactccgaggacgtggtggtgctggatttccatcaggcctcaaatggtcttttatgccaaaagtatctgatggccgtccttcttatcttgttgtcaatgctgatgaaagtgaacctggaacctgtaaagacagggaaatcatgcggcacgatccacacaaactattggagggttgcttgattgctggggttgggatgagagctacagctgcttatatctacatcaggggtgaatatgtgaatgaacgtaaaaaccttgaaatagctagaaaagaagcatacgaagctggactgttgggcaaaaatgcatgtggttctggttatgattttgacgttcacatccattttggtgccggtgcttatatttgtggtgaagaaacagcacttctagagagccttgaaggaaaacaaggaaaacctagattgaagcctcctttccctgctaatgctgggttatatggctgtcccaccactgtcacaaatgtggagacggtggctgtttctcccacaatattgagacgtggtcctgagtggtttgccagttttgggaggaagaacaattctgggacaaaattgttttgtgtctcaggtcacgtcaacaagccttgcacagttgaggaggagatgagtataccacttaaggagttgatagagaggcactgcggaggcatcagaggtggatgggacaatttacttgcagtaataccaggaggttcatctgttccacttttacccaagcacatatgtgatgatgtcctgatggattatgatgcactcaaggctgtccagtcaggactgggaactgctgcagtaattgtgatggataagtcaactgatgttgtagatgcaattgcgaggctttcgtacttctacaagcacgagagttgtggacagtgcacgccctgcagagaagggactggatggctatggatgatcatggaaagattgaaagttgggaatgcaaagttggaagagattgacatgcttcaggaggtgaccaagcagattgaagggcacacaatttgcgctttaggtgatgcagcagcttggcctgtgcagggtctaatacggcattttaggccagagctcgagagaaggattagggagcgtgcagaaagggagttgctcgaggcttctgcgtaatttctgctcaggttgcttctggcatctttttgactttcagtttgttagtgcatctttttcttccaaaatatgaagtactctcaacgtgcttgatttggcattttagttatcaatttccatttcgttatgtgaaaatgctcgtttctatggatgcatgctttcacaacaaactgtaccctggtatactcatgaataatttcatgagaagaaaaaataaggtgctggcttgtacaacgcctgtagatgaattaacttatttcttttaatgtccttaaggatttcattttagtttttccttatcatctggcagtggcaacctaacaatggttgcctggtcacttaaaaaaggtcaaaagaactgtacatattctctttattaattagtatctgtttttctggttgctagacaatgattttgttagaagaatttgaaagaataagtaggaagaaaagcaacggaaggaggcataagatatatccatatcaagtttagttatttccaagtggaaaatggcatataggaaacaattttaattaggcagtgcatccttagtcctatgtgcataacatttagctcccctttttaagccatggaaatgagtaggatagcgtacctattacctgttttcctatcctatgcatgttcttacagcgcatataaatcagttctagcaggctaccatctgaagttttctccttgacaagttgtgtcatgcaatgtgggggaattacacatgcaaaagtggatattatggagtaaaattggaagtactcgaaacttggagcataggttactcaggaacctggtggtctggtagtgttctatttggtttctgctaagctgttgtgttaacaacatttcactgttttagaaaataatgaacgtctctaatgtctggccggggggggtacttgttttgtttctcatagcatccacaacattttctttttggcccattatctgtaatttttctgttcgcaacatattatgatatatgtattttgctatatcatagatgttgcaaaaggataaaaataaatgtttcctaagatataaaattgaagttgtattatgtgctgaaatgaatagaataaaaatatgcatcagcaaaatagcttgggtgcttgtgctggagctacgggtgtaatcccgacgagtttaagcagtaacagcgcgtttggttggagggaattgctattccactccgccattccatggaatgccattccttgtttattcaacaaatttgctgaatccatatttggtggttagtggtaagaatagacaattcagcagtaatagcgattttttttattcccaatcatgtccgttttttttactgttattcttcttcatcaattttgtgtcatgcagatgatctccaatggttccaagaacaatgtggttagattttttttttacaagaaaaaagaggaaaaa

SEQ ID NO: 3816 - DNA, 2023 bp, Helianthus annuus
gtccatcgcacataacacgttacagtcttattgggccgattcgtcaactacaactcacggcccatataccctctacgcattctacaaaaccaccacaaacacaaaccggttcatctgaaccgctctaataacccactccggtttactatcccggttcatgccccaacacataaagcccgttggatgcgaaccattgggagtcaatcgagttcattttccctgttcatcaaaacttgaaattcaattaagaagcttcattgctacatttcgtatggtacccatgaagggcattctttctctgcaacgggctgctgtgttgagccgtctaaatgggaactcgagggtagctgctagattattcagcactcaatctgcaacaaccgctaataccgcacagcctccaccacctcccccgcctccggagaaaactcacttcggtggcttgaaagacgaagaccgcatatttaccaacctttatggcatacacgacccgtttctcaaaggtgccatgaagcgtggtgattggtacagaactaaagatttagtgatcaagggttcggattggatagtaaacgaaatgaaaaagtctggcctacgtggacgtggcggtgctggttttccgtccggtctcaaatggtcgtttatgccgaaggtatctgatggtcgtccgtcgtatcttgtcgttaatgctgatgaaagtgaacccggaacgtgtaaagacagggagattatgcgaaacgatccgcataaacttctagaaggatgcttgattgccggagtgggtatgcgagcaactgctgcttatatatacattcgcggcgagtatgtaaacgagcggcttaaccttgaaaaagccagaaaagaagcctacgcagctgggttacttggcaaaaatgcgtgcggttcgggttatgatttcgacgtgcatatccacttcggtgccggtgcttacatttgcggtgaagaaaccgcacttctcgagagccttgagggtaagcagggaaaaccgagattgaaaccccctttcccagctaacgcaggtctatacgggtgcccaacaaccgttacaaacgtcgaaaccgtagccgtctcacctaccattttacgacgtgggcccgagtggttttctagtttcgggagaaagaacaattccgggacgaaactgttttgcatatcgggtcatgtgaacaagccatgcacggtcgaagaggagatgagcatatcgttaaaggagctgctagagcggcattgtggcggtgttaggggcgggtgggacaatttactggcggtaattcctggtggttcgtctgtaccgcttcttccgaaacacatatgtgaggatgttttaatggatttcgacgcacttaaggcggtccagtctggattaggtacagctgcagttattgtgatggataaatcgacggatgttgtggatgcgattgcgcggctttcgtacttttataagcatgagagttgcggtcagtgtacgccatgtagagagggtacgggatggctttggatgatcatggaaaggatgaagaccgggaatgcgaaattggaggagattgatatgctacaagaggtgacgaagcagattgaaggacacacgatttgcgcgttgggtgatgctgctgcgtggcccgttcaaggtcttatcaggcattttaggcctgagctcgaaaggaggattagggaacacgctgaaagagagttgcttcaggcagctgcttgattcaggccaaagaatttacagccctgcagttggtggaataaatatgcagaaatagttgtggactaactcccttcacgagcatctcggttgtattttaagtttgtatcgaattgcattgcgatcgaaatagtaccctttttgaaattggggtaacttttgttgtttcggtgtgcttaaggatacaaatacatccttaacttcattaagccatgtttttgttatgttaataagcctgaatgcaatgttgtaacggtacaatcacaagcttttgaaagctaaagtttttttctt

SEQ ID NO: 3817 - DNA, 1476 bp, Brassica rapa
aggcacctgtgagggggattcttggtttgcagagggcggtatcagtttggaaggagagtaacagattggctccagctttgagatcattcagcacccaagctgcgtccacttccaccactccacagccacctccacctcctccgcctccggagaagactcatttcggtggtctcaaggatgaagatcggatttttaccaacctctacggtctgcacgacccgtttctcaagggggcgatgaagagaggcgattggcataggaccaaggatttggtgctcaagggtactgattggattgttaatgagatgaagaagtctggtcttcgtggacgtggtggtgctggtttcccttctggtcttaagtggtcctttatgcctaaagtctctgatgggcgtccttcttatttggttgttaatgctgatgagagtgagcctgggacttgtaaagatagggagatcatgcgtcacgaccctcacaagctgttggaagggtgtttgattgctggtgttggtatgagagctagtgcagcttatatttacatcaggggtgagtatgtgaatgaacgtttgaatctagagaaggccaggagagaggcatatgcagctggtctcttggggaagaatgcttgtggttctgggtatgactttgatgtttacatccactttggagctggtgcgtacatttgtggtgaagagactgcgcttcttgaaagcctcgaagggaagcaaggaaagcctaggttgaagcctccgttccctgctaatgctggtttgtacggttgtcccacaactgttaccaatgtggaaacggtggctgtttctcctaccattttaaggcgtggacctgagtggttttcgagttttggtaggaagaataactctgggacgaagctgttttgtatatcgggacatgtgaacaagccatgtaccgttgaagaggagatgagtatccctctcaaggaactgattgagaggcattgtggaggtgtcaggggtggatgggacaacctgcttgctatcattcctggaggttcctctgttcctttgattcctaagaacatatgcgaggatgtgctgatggatttcgatgcgctcaaggctgtccaatcagggctaggaactgcagcggtcattgtgatggataaatcgaccgacgttgtggatgcaattgcgaggctctcttacttctacaagcatgaaagctgtgggcagtgcactccttgcagagagggaacagggtggctctggatgatcatggagaggatgaaagttggcaatgcaaagctggaggagattgatatgcttcacgaggtaactaagcagatcgaaggacacacaatctgtgcattgggtgatgcagctgcatggcccgtccaaggtctgataaggcactttaggccggagcttgagagaaggatcagggaacgcgctgaaagggagttgctacaggctgctgcttaaaacccttgttaacgac

SEQ ID NO: 3818 - DNA, 2064 bp, Brassica rapa
ggagttcgtcgttctcaggtgggcataaaactcagtgcgtccacgcttcaccttcttcctcctctacatctcctcccttctcgattatagagaacaaaggctaagtcctctctctctctctccccgatttcttcgcggaaaattttcgtatccatggcacctgtgagggggattcttggtttgcagagggcggtatcagtttggaaggagagtaacagattggctccagctttgagatcattcagcacccaagctgcgtccacttccaccactccacagccacctccacctcctccgcctccggagaagactcatttcggtggtctcaaggatgaagatcggatttttaccaacctctacggtctgcacgacccgtttctcaagggggcgatgaagagaggcgattggcataggaccaaggatttggtgctcaagggtactgattggattgttaatgagatgaagaagtctggtcttcgtggacgtggtggtgctggtttcccttctggtcttaagtggtcctttatgcctaaagtctctgatgggcgtccttcttatttggttgttaatgctgatgagagtgagcctgggacttgtaaagatagggagatcatgcgtcacgaccctcacaagctgttggaagggtgtttgattgctggtgttggtatgagagctagtgcagcttatatttacatcaggggtgagtatgtgaatgaacgtttgaatctagagaaggccaggagagaggcatatgcagctggtctcttggggaagaatgcttgtggttctgggtatgactttgatgtttacatccactttggagctggtgcgtacatttgtggtgaagagactgcgcttcttgaaagcctcgaagggaagcaaggaaagcctaggttgaagcctccgttccctgctaatgctggtttgtacggttgtcccacaactgttaccaatgtggaaacggtggctgtttctcctaccattttaaggcgtggacctgagtggttttcgagttttggtaggaagaataactctgggacgaagctgttttgtatatcgggacatgtgaacaagccatgtaccgttgaagaggagatgagtatccctctcaaggaactgattgagaggcattgtggaggtgtcaggggtggatgggacaacctgcttgctatcattcctggaggttcctctgttcctttgattcctaagaacatatgcgaggatgtgctgatggatttcgatgcgctcaaggctgtccaatcagggctaggaactgcagcggtcattgtgatggataaatcgaccgacgttgtggatgcaattgcgaggctctcttacttctacaagcatgaaagctgtgggcagtgcactccttgcagagagggaacagggtggctctggatgatcatggagaggatgaaagttggcaatgcaaagctggaggagattgatatgcttcacgaggtaactaagcagatcgaaggacacacaatctgtgcattgggtgatgcagctgcatggcccgtccaaggtctgataaggcactttaggccggagcttgagagaaggatcagggaacgcgctgaaagggagttgctacaggctgctgcttaaaacccttgttaacgacagggtatttgctattattatcgatggaaataaaatctgaagcacacttagggttttggggatgcaaagctacttcagaaggagaagaaggttttgcatttgttgaaatgttcatgttgaactttattcgaaactgtatcagaaagagctctgtttgctcttttgcttattctactttctttcaatgtttgtttgttttctcatgactactgagaacacattttgggaacaacgaaccaaacaaaaccttttcatatttaaaataaaggataatggggtttttataccgttcattacactccaaataagtttataatcactggttctttttggcttgttgtggaaaatatctatagggtaatgaatgatacaatgatacccatagttgatctgtatcattgtgattagtcgcaactggtagaatcttaatctagg

SEQ ID NO: 3819 - DNA, 1917 bp, Brassica napus
gggagttcgtcgttctcaggtgggcataaaactcagtgcgtccacgcttcaccttcttcctcctctacatctcctcccttctcgattatagagaacaaaggctaagtcctctctctctctctccccgatttcttcgcggaaaattttcgtatccatggcacctgtgagggggattcttggtttgcagagggcggtatcagtttggaaggagagtaacagattggctccagctttgagatcattcagcacccaagctgcgtccacttccaccactccacagccacctccacctcctccgcctccggagaagactcatttcggtggtctcaaggatgaagatcggatttttaccaacctctacggtctgcacgacccgtttctcaagggggcgatgaagagaggcgattggcataggaccaaggatttggtgctcaagggtactgattggattgttaatgagatgaagaagtctggtcttcgtggacgtggtggtgctggtttcccttctggtcttaagtggtcctttatgcctaaagtctctgatgggcgtccttcttatttggttgttaatgctgatgagagtgagcctgggacttgtaaagatagggagatcatgcgtcacgaccctcacaagctgttggaagggtgtttgattgctggtgttggtatgagagctagtgcagcttatatttacatcaggggtgagtatgtgaatgaacgtttgaatctagagaaggccaggagagaggcatatgcagctggtctcttggggaagaatgcttgtggttctgggtatgactttgatgtttacatccactttggagctggtgcgtacatttgtggtgaagagactgcgcttcttgaaagcctcgaagggaagcaaggaaagcctaggttgaagcctccgttccctgctaatgctggtttgtacggttgtcccacaactgttaccaatgtggaaacggtggctgtttctcctaccattttaaggcgtggacctgagtggttttcgagttttggtaggaagaataactctgggacgaagctgttttgtatatcgggacatgtgaacaagccatgtaccgttgaagaggagatgagtatccctctcaaggaactgattgagaggcattgtggaggtgtcaggggtggatgggacaacctgcttgctatcattcctggaggttcctctgttcctttgattcctaagaacatatgcgaggatgtgctgatggatttcgatgcgctcaaggctgtccaatcagggctaggaactgcagcggtcattgtgatggataaatcgaccgacgttgtggatgcaattgcgaggctctcttacttctacaagcatgaaagctgtgggcagtgcactccttgcagagagggaacagggtggctctggatgatcatggagaggatgaaagttggcaatgcaaagctggaggagattgatatgcttcacgaggtaactaagcagatcgaaggacacacaatctgtgcattgggtgatgcagctgcatggcccgtccaaggtctgataaggcactttaggccggagcttgagagaaggatcagggaacgcgctgaaagggagttgctacaggctgctgcttaaaacccttgttaacgacagggtatttgctattattatcgatggaaataaaatctgaagcacacttagggttttggggatgcaaagctacttcagaaggagaagaaggttttgcatttgttgaaatgttcatgttgaactttattcgaaactgtatcagaaagagctctgtttgctcttttgcttattctactttctttcaatgtttgtttgttttctcatgactactgagaacacattttgggaacaacgaaccaaacaaaaccttttcatatttaaaataaaggataatggggtttttatac

SEQ ID NO: 3820 - DNA, 1939 bp, Gossypium hirsutum
aatcattccccatcttcaaattccctattcccttttcctccgcccttgtttctgaattttgcagtcgagccgaatcgcaacaatcaaggatcatccgcgaaatttcactctatggcacccataaagggcattctttccttgcaaagggcagctttgttaagagcttgcggtgaaaggtggaaactaggcactagatcatttagtactcaaggagcaacaactgctggtgctccacaggcacctcctcctcctccactgcctgaaaaaacccattttggtggtctaaaagatgaagaccgtattttcaccaacttatatgggttgcatgacccttttctcaaaggtgccatgaaacgtggtgactggtatagaaccaaggatttagtactcaagggtgctgattggattgtgaatgaaatgaagaaatctggacttcgaggacgtggtggtgctggatttccatcgggcctcaaatggtcttttatgccaaaagtatctgatggtcgtccttcttatcttgttgtcaatgctgatgaaagtgaacctggaacctgtaaggacagggaaattatgcggcacgatccacacaaactattggagggctgcttgattgcgggggttggaatgagagctacagctgcttatatctacatcaggggtgaatatgtgaatgaacgtaaaaaccttgaaagagctagaaaagaagcttatgaagctggactattgggcaaaaatgcatgtggttctggttatgattttgatgttcacatccattatggtgctggtgcctatatttgtggtgaagaaacagcacttttagagagccttgaaggaaaacaagggaaacctagattgaaacctcctttccctgctaatgctggattatatggttgtcccaccactgtcacaaatgtggagacagtggctgtttcacccacaatactgagacgtggtcctgagtggtttgccagttttgggaggaagaataattccgggacaaaattgttttgtgtctcaggtcatgtcaacaagccttgcacagttgaggaggagatgagtataccacttaaggagttgatagagaggcactgtggaggtgtcagaggtggatgggacaatttacttgcagtaatacctggaggctcatctgttccacttttacccaagcacttatgtgatgatgtcttgatggattacgatgcactcaaggctgtccagtcaggacttggaactgctgcagtaattgtgatggataaatcaactgatgttgtagatgcaatcgcaaggctttcatacttctacaagcacgagagttgtggacagtgcacaccctgcagggaagggactggatggctctggatgatcatggaaagattgaaagttgggaatgcaaagttggaagagattgacatgcttcaggaggtgaccaagcagattgaagggcacacaatttgcgctttgggtgatgcagcagcttggcctgtgcagggtcttatacggcattttaggccagagctggagagaaggattagagagcgtgcagaaagggagttgctggaggcttctgcttaatctctgctcagggattacctgtgcaagtggccattatggaataaaattgaagtacccaaaacttggagaataggtgactctcaggcatctggtgttgtggaagtgttttatttgttatctcctaagctgttgtgttaacaacatttcactgttttagaaaataatgaatgtctccaatgtctgggctatacttgtttctcatagcatccacaacgtttcttttttggcccatttgatgaacatggctaatgatctgtattctttttatttctttttgggaacatataatggtatctgtatttttctatgatcatagatgtcgtaggataaaaataaacgttttcagagaaataaaataaagttatac

SEQ ID NO: 3821 - DNA, 1725 bp, Flaveria ramosissima
gaacaattgggagtcaagttcatctcctttcgcttcaaattcttcaccgtagtcgaatcgctgatcgttatttctcaagcttcattgctacattttgtggcgtatggcacccatgaagggcattctttctctgcaacgggttgctttgttgaggcgtcaaaatgttaattggggactaggtactagattgtttagcactcaatctgcaacaactgctaataccgcacaaccaccaccacctccccctcctccggagaaaactcactttggtggcttgaaggatgaagaccgcatttttaccaacctatatggtatacatgacccgtttcttaaaggtgccatgaaacgtggtgattggtacagaactaaagatctagtgatcaagggctctgattggatagtaaatgaaatgaaaaaatctggtttacgtggacgtggtggtgctggatttccatctggtctcaaatggtcatttatgcctaaggtgtctgatggtcgtccatcctatcttgtggttaatgctgatgaaagtgaaccaggaacatgtaaggatcgtgaaatcatgcgaaacgatccacataaacttcttgaaggatgcttgattgctggagttggtatgagagcaactgcagcttatatttacattagaggtgaatatgtgaacgaacgccttaaccttgaaaaggccagaaaagaagcctatgcagctgggttacttggaaaaaatgcttgtggttcaggttatgattttgatgtgcatatccactttggtgctggtgcttacatttgtggtgaagaaacagcacttttggagagccttgaaggtaagcaaggaaaaccaagattgaaaccccctttccctgctaatgcaggtctatacggatgtcccacaactgttacaaatgtggaaacagttgctgtatcgcctaccattttaagacgagggcctgaatggttttctagttttgggagaaagaacaactcggggacgaaacttttttgcatatctggtcatgtgaacaaaccatgcactgtcgaagaggagatgagtataccattaaaggagctgctagagcggcactgcggcggtgttaggggcggatgggacaatttactggcagtaattcctgggggttcatctgtaccgttgcttcctaaacacatatgtgaagatgtactgatggattttgatgcattgaaggctgtgcaatctggattagggactgcagctgttattgtgatggataagtcaactgatgttgtggatgccattgcaaggctttcttacttttataagcatgagagttgtggtcagtgtaccccttgcagggagggtactggatggctgtggatgattatggaaaggatgaaagttgggaatgcaaagcttgaggaaattgatatgcttcaagaggtcactaagcagattgaaggacacacaatttgtgcattgggagatgctgctgcttggcctgttcaaggccttatcaggcattttaggcccgaactcgagaggcggataagggaacgtgctgatagagagctgcttcaggcagctgcttgattcaggttgaagagcttgcagccctgcaatctgtggaataaatatgcacaagtcatcctagaggaatctggaaatcgatgaaccccttgcgagcatcttggtttaagtttaaggtttgtattgaattaccatacaattgaaaataggactcatttaataac

SEQ ID NO: 3822 - DNA, 2030 bp, Prunus persica
gacgtcattaaatcgttttgaccattttattcggatggtccattttgcatatcaaggttcgtgaactggagctctctccatttcccacctaagcattctctctccttctctctctcagtctcgttctcgttgattgcctgattcggcgacgcatcgaggttcatctgccgcagttcttgccatggcacccatcaagggtattctttctctgccgagagcagctttagctcgtcatcatggtgagaagtggggcctagggttgagatcattcagcactcagggtgcaacaactgctactactcctcaacctccaccacctcccccacctccagagaaaacccattttggtggtttgaaagacgaagaccgaatttttaccaacttatatgggtcgcatgacccatttctcaaaggtgccatgaaacgaggtgactggcacagaaccaaagatatagttattaaaggtgctgattggattgtcaatgaaatgaaaaagtctggcctccgtggacgtggtggtgctggtttcccatctggcctcaaatggtcttttatgccaaaagtatctgatggacgtccttcctatcttgttgtcaatgctgatgaaagtgaacctggaacctgtaaggacagggaaattatgcgccatgatccacacaaacttttagagggttgcctgattgctggcgttgggatgagggccagtgctgcttacatctacataagaggtgaatatgtgaatgaacggatcaacctcgaaaaggccagaaaagaagcctatgaagctgggttactgggcaaaaatgcatgtggatctggttatgattttgatgttcatatccactttggtgctggtgcttatatttgtggtgaagaaacagcgcttctggagagccttgaagggaaacaggggaagccacgattgaagcctcctttccctgctaatgcagggttatatggctgccccaccactgttacaaatgtggaaacggtggctgtttctcccaccattttaaggcgtggaccagagtggtttgccagttttgggagaaagaacaatgcagggacaaaattgttttgtatttcaggacatgtgaacaagccttgcacagttgaagaggagatgagtatacccttgaaagagttattagagaggcactgtggaggtgtgaggggtggatgggacaacttgcttgcagtaattccaggtggttcatctgttccactacttaccaaggatatatgtaatgatgtattgatggattttgatgccctgaaggctgtccagtcaggattggggactgcagctgttattgtgatggataaatcaactgacattgtggatgcaattgcgaggctttcttacttctacaagcacgagagttgtgggcagtgcacaccatgtagggaagggacaggatggctttggatgatcatggaaagaatgaaagtcgggaatgcaaagttggaagagattgacatgcttcaggaggtgaccaagcagattgaggggcacacaatctgtgctttgggggatgctgctgcctggcctgtgcaaggtctaataaggcatttcaggccagagcttgagaggaggatcagggagcgtgcagagcgggaattgctggaggcagctgcttgagtgcttctctcaggttaaagcttgtattggtggaaatcatggaataaaataaaatatgtaccccagatttcgggaagataggttactcgggcggcagctggtggtccagctgctcgtgtttgtttttaagctgtatcaactctatgacctcactgtcccagagaaacactgatttattgtggaagtgtctgggcaggatatttatgttgtggtgtttccagataatgttttccttacacagttggaattttgttaataaattttgtttttctttccccgttttatgtaatgagattaataaagtacttgggccccgtttggtaggctagactggactggattgcattaacctctctatactagattggactggatgggatttgattgg

SEQ ID NO: 3823 - DNA, 2434 bp, Fragaria vesca
ctctctctctctctctctcaatcagacgcatcagggttccctcttgctgcgataccatggcacccatcaagggtattctttctctgcaaagggcggttttagcccggcatcatggtgcgaagtggggactaggttataggttattgagcactcaggctgcatcaactgctactactcctcaacctccaccacctcccccacctccagagaaaacccattttggtggcttgaaagatgaagatcgaatctttaccaacttatatgggttgcatgacccatttcttaaaggtgccatgaagcgaggtgactggtacagaaccaaggatttagttatcaaaggtgctgattggattgttaatgaaatgaagaagtctggcctccgcggacgtggtggtgctggtttcccatctggcctcaaatggtcttttatgccaaaggtatctgatggtcgtccttcttatcttgttgtcaatgctgatgaaagtgaacctggaacctgtaaggacagggaaattatgcgccatgatccacataagcttttagagggttgcctgattgctggggtagggatgagggccagtgctgcttacatctatataagaggtgaatatgtgaatgaacgattgagccttgaaaaggccagaaaagaggcttatgcagctgggctactgggcaaaaatgcttgtggatctggatatgactttgatgttcatatccattttggtgctggtgcttatatttgtggtgaagaaactgctcttcttgagagccttgaaggcaaacagggcaagccaagattgaagcccccttttcctgctaatgcaggattatatggctgccccactactgttaccaatgtggaaacagttgctgtttctcccaccatattaaggcgtggaccagagtggttttctagttttgggaggaagaacaatgcagggactaaattgttttgtatctcaggacatgtgaacaagccttgcactgttgaagaggagatgagtatacccttgaaagagttattagagaggcactgtggaggcgtgaggggtggatgggataatttgcttgcagtaattccaggtggttcatctgttccattgcttaccaaggacatatgtaatgatgtgttgatggattttgatgcactgaaggctgtccaatctgggttggggactgcagctgttattgtgatggataaatcaactgacattgttgatgcaattgcacggctttcttacttctacaagcacgagagctgtgggcagtgcacaccctgcagagagggaactggatggctttggatgattatggaaagaatgaaaactgggaatgcaaagttggaagagattgacatgcttcaggaggtgaccaagcagattgaggggcacacgatctgtgctttgggtgatgctgctgcttggcctgtgcaaggtctgataaggcatttcaggcctgagatggagaggaggatcagggagcgtgctgagagagagcttctggaggcaactgcataggtgtctttctcaggttgagtcttgcctcagttctagtttgcattcatttcttcctttgacttctgaaaataaaaaaacaaaggagaaaaacaatacaagtaacttcaacttgggtactttgaatttatttgttgttattttgttgtaagaccaactatcaggtggcctgatctggttggatcaatctatacatgcgggttttcttggacttgagcaaaaaggaaattttcctaaaatgttgccgggcttacccaggttgattatctgggcttatcatttgtgttgatatttagcaataagattggtgactaaattgacctcatgatggtcatattttgggttgcagcattagcacatatgtcttcttttatgtcttgtgcttccacagtcaagtgctatataactagggaaccaaatgctggcattggtgaattctcgattctatgctgtttaagactttgacgaccctgagatgatgcactttagagcttttgcaagtcatagttaattagtgagtagtcgacaagttgggagatcaatcttttttcttttgtttttgtgattagaggaccatcatttcttcttggttttcatttgatggttgtaattatacagagaacagcattacaacatactacgtgtcagacataatagattatttgacaagaactattgtcttgttgaatttaaacatgataaaatcggaagtctctgataatgcagagagagatctcacgcggtctctctctctctctgcccaaaacgccatgtatttctcactgtctgttggttttcaattcgattcttcctctggttcgtgttgctgctcgctctctaatttctggatggaatacagcaacaagagtaaacaggtgacagcatttcttgttcctgtagtaaagatgtcatgcctgaga

SEQ ID NO: 3824 - DNA, 1969 bp, Chelidonium majus
gagctcctctctctctctacctaaaaatctctgaagactgagcttggtttcccggtgccctaaaaatctggtctctctactgagagggctaatgggacccatcaagaacattctctctctgcagaggacagcagcgtcagtacgtcaatgcagtttgaggtgggattcagtttgcagatcatttagcactcaagctgcaactacctcgagcactccacaggctccaccaccaccaccacctcccgagaaaacccactttggtggtctgaaagatgaagaccgcatcttcaccaacctctatggaatacacgaccctttcctcaaaggtgcaatgaaacgaggtgattggcacagaaccaaagacttggttatcaagggagctgactggattgtcaatgaaatgaagaagtccggtcttcgtggccgtggtggtgctggttttccttctggtctcaagtggtccttcatgccaaaggtatctgatggccgtccttcctatcttgttgtgaatgccgatgagagtgagccgggaacatgtaaggacagggaaatcatgaggcatgatccacacaaactactagaagggtgccttattgctggagtaggcatgcgggccactgctgcttatatctacataaggggtgagtatgttaatgagcgtttgaaccttgaaaaggcattgaaagaatgttaccaagctggacttttggggaagaatgcatgcggctctggttatgattttgatgtttatatccactatggtgctggtgcttacatttgcggtgaagagactgcacttctggaaagccttgaagggaaacaaggaaagcctagattgaagcctcctttcccagctaatgcagggttatatggctgcccaacaacagttaccaatgtggaaactgtggctgtttctccaaccattttgaggaggggacctgaatggtttgctagttttggcaggaagaacaattccgggacaaagctattctgcatctctggtcacgtaaacaagccttgcactgttgaagaggaaatgagtatatcgttgaaggaattgttagagaggcactgtggtggagtcagaggtggatgggataatttgcttgcagtaataccagggggttcttccgtgcccttgcttcccaaggacatctgtgatgatgtgttgatggattatgatgcactcaaggctgtccaatctgggttgggaacagccgcagtgattgtgatggacaagtcaactgatgttgtggatgctattgctaggctatcttacttctacaagcacgagagctgtgggcaatgtacaccgtgcagggagggaacaggatggctgtggatggtcatggagaggttgaaggttggggatgcaaagctggaagagatcgacatgcttcaggagatcacgaaacagattgaggggcacacaatctgtgcattgggtgatgctgctgcatggcctgtgcagggtctgatcaggcattttagaccagagctggagaggaggatcagggaacgtgcagacagggaattattggaggttgctgctgcttgaagctacgacacccaggttggatcttttgatgtcctttaagttctataaagtggaagaactattcgatatttgttttcatttccccttttcgcccccttaatgtgttgcatgactagacaaacgtgccttatattatcttgaagtgacccgacgggtgatagtgttgcacatgcaaagggtgaacctcatattcaactggggtccctccttgatgtagacgaaaatttcactaggatatcgtaattcaactgtttttatagtgttttatcttctactgtgtagtaggaggattttaccttatcgggtgcatattgtcgaataaaagggttgaaggaactccatttttggttttgttttctatttcgttaatgaacataatcttttctcccccttttacatcccatttatcaa

SEQ ID NO: 3825 - DNA, 1651 bp, Tripterygium wilfordii
tagtatattatcaccgtctgtccgacacaagcacggtgctcgctaaggacgtatacgtatttccagtctccagagcttcctttcttctctacgtgcctcgatttgtcgtgttaaatcttctcgggaaagaatcggagctcaacagttgcatttcacgctatggcactcatgaagtgctttctttccttgcggcgggctgctttggttcaacatcatagtgagagatggggtgccggcttcagatcattcagcacccaaggtgcaacaactggtaccactccacaacctcccccacctcccccgcctccagagaaaacccactttggtggccttaaagatgaggacagaattttcacaaacctgtatgggttgcatgacccatttcttaagggtgccatgaaacggggtgattggtacagaaccaaagatttagtacttaagggtactgattggattgttaatgaaatgaagaagtctggcctccgcggacgtggtggtgctggttttccatctggccttaaatggtcattcatgccaaaagtatctgatggccgtccttcatatcttgttgtcaatgctgatgaaagtgaacctggaacctgtaaggacagggaaatcatgcgtcacgatccacacaaattattggagggctgtttgattgctggggttggaatgagggctactgctgcttacatctacataaggggtgagtatgtgaacgaacgtaagaaccttgaaagagccagaaaagaggcttatgaagctggacttttgggtaagaatgcatgtggatctggttatgattttgacgtacatatccattatggtgctggtgcttatatttgtggggaagagactgctcttttggagagcctagaaggaaaacaggggaaaccgaggttgaagcctccttttccggctaatgcagggttatatggctgtcccacaactgtaacaaatgtggaaacagtggctgtttctcctaccattttgaggcgtggaccagaatggtttgcaagttttggcaggaagaataattcaggtacaaaactattttgtgtgtctggtcatgtgaacaagccttgcactgttgaagaagagatgagtatacccctaaaggagctgatagagaggcactgtggaggtgttcgaggtggttgggacaatttactggcagttattccagggggttcatctgttccattgctccccaagcatatttgcgatgatgtgctgatggattacgatgcacttaaggctgttacgtcaggactggggactgcagctgtaattgtgatggataaatcaactgatgttgttgatgcaattgccaggctctcctatttctacaagcatgaaagttgtggtcagtgcacaccatgcagagaagggacaccatggctttggatgatcatggagaggttaaaggtcggcaatgcaaagttggaagagattgacatgcttcaggaagtgaccaagcagattgaagggcacacgatttgtgcactgggggatgctgctgcttggcctgtgcaaggtctcataaggcactttaggccagagctggagagaaggatcaaggaacgtgcagacaaggaattgctggaggctgctgcttaggtttgctatggagggaattacctattctggt

SEQ ID NO: 3826 - DNA, 1627 bp, Flaveria ramosissima
tatggcacccatgaagggcattctttctctgcaacgggctgctttgttgaggtgtcaaaatgttaattgggggctaggtagtagattgtttagcactcaatctgcaacaactgctaataccccacagcctccaccacctccccctcctcctgagaaaactcactttggtggcttgaaagatgaagatcgcatttttaccaatctttatggtatacatgacccgtttcttaaaggtgccatgaaacgtggtgattggtacagaactaaagatctagttatcaagggctctgattggatagttaatgaaatgaaaaatctggtctacgtggacgtggtggtgctggatttccatctggtctaaaatggtcatttatgcctaaggtatctgatggtcgtccatcctatcttgttgttaatgctgatgaaagtgaacccggaacatgtaaggatcgtgaaattatgcgaaatgatccacataaacttctagaaggatgcttgattgctggagttggtatgcgggcaactgctgcttatatttacattagaggtgaatatgtgaacgaacgccttaaccttgaaaaggccagaaaagaagcctatgcagctgggctacttggaaaaaatgcttgtggatcgggttatgattttgatgtgcatatccactttggtgccggtgcttacatttgtggtgaagaaacagcacttttggagagccttgaaggtaaacaaggaaaaccaagattgaaaccccctttccctgctaatgcaggtctatatggatgtcccacaactgttacaaatgtcgaaacagttgctgtatcacctaccatcttaagacgagggcctgaatggttttctagttttgggagaaagaataattccgggacaaaacttttctgcatatctggtcatgtgaacaaaccatgcacagttgaagaggagatgagtataccattgaaggagctgctagagcggcattgtggtggtgttaggggcggatgggacaatttactagcagtaattcccgggggttcatctgtaccattgcttcctaaaaacatatgtgaggatgtcctgatggattttgatgcattgaaagctgtgcaatctggattagggactgcagctgttattgtgatggataagtcaactgatgttgtggatgcaattgcaaggctttcttacttttataagcatgagagttgtggtcagtgtacaccttgcagggagggtaccggatggctttggatgattatggaaaggatgagagttgggaatgcaaagctggaggaaattgatatgcttcaggaggtgactaagcagattgaaggacacacaatttgtgcattaggagatgctgctgcttggcccgttcaaggtcttatcaggcattttaggcctgaacttgagaggaggattagggaacgtgctgatagagagttgcttcaggcagctgcttgattcaggccaagaatctgcagtcctgcaatctatggaataatatgcggtatagtcctggagaaactggaacccatcgaaccccttgatctcgtggttgttaagttgattgaattgatgaattgaatgtatcctatttgatgggtgtcttcgttgttgtgtagttaga

SEQ ID NO: 3827 - DNA, 1851 bp, Ambrosia trifida
gtctaaaccgttcgataacccatttcaccttgctcacctgatcaccaataaagttcatctttctatacttcaaattcctcaccatatttctgaagctacattttgtggcatatggcacccatgaagggcattctttctctgcaacgggctgctttcatgaggcgtcaaaatgttaattgggggctcggtactagattacttagcactcaatcggcgacaaccgctaataccgcacaaccaccaccacctccccctcctccagagaagactcattttggtggtttgaaagatgaagaccgcatttttaccaacctttatggtatacatgacccgtttctcaagggtgctatgaaacgtggtgattggtacaggactaaagatctagtgatcaagggtgctgattggatagtaaatgaaatgaaaaaatctggtttacgtggacgaggtggtgctgggtttccatctggtctcaaatggtcatttatgcctaaggtatccgatggtcgtccatcctatctcgttgttaatgctgatgaaagtgaaccgggaacatgtaaggatcgtgaaattatgcgaaatgatccacataaacttctagaaggatgcttgattgctggagttggtatgagggcaactgctgcgtatatttacattagaggtgaatatgttaacgaacggcttaaccttggaaaaggccagaaaagaagcatatgcagcagggttacttgggaaaaacgcttgcggttcgggttatgattttgatgtgcatatccactttggtgctggtgcttacatttgtggtgaagaaacagcacttttggaaagccttgaaggtaaacaaggaaagcctagattgaagccccctttccctgctaacgcaggtctatacggatgtcccacaactgttacaaatgtagaaacagttgctgtatcacctaccattttaagacgtgggcccgagtggttctctagttttgggagaaagaacaattctgggacaaaacttttttgcatatctggtcatgtgaacaaaccctgcacagtcgaagaggagatgagtataccattgaaggagttgctagaaaggcattgtggcggtgttaggggcggatgggacaatttactggcggtaattcctgggggctcatctgtaccattgcttactaaagacatatgtgaagatgtcctgatggattttgatgcactgaaagctgtgcagtctggattagggactgcagctgttattgtgatggataaatcgactgatattgtggatgccattgcaaggctttcttacttttataagcatgagagttgtggtcagtgtacaccttgcagggagggtacaggatggctttggatgattatggaaaggatgaaagttgggaatgcaaagttggaggaaattgatatgctccaagaggtgactaagcagattgaaggtcacacaatttgtgtattgggagatgctgctgcttggcccgttcaaggtcttatcaggcacttcaggccagaactcgagaggaggatcagggagcgtgctgatagagagttgcttcaggcagctgcttgattcaggtggagctctgcaatatgtggaataaatatgcagaagcaatcctggagggtattactgaaccttttacaagcatggtttaaatttaaggtttgtatcgaagtacgatgtgactgaaaatagcatcctcttttgtaactgggataacttttgttgtttcgatgtgttttaaggatacgaagacatcctatgtttatttttgaacatacttcatttagacatgtcaataagccgaatgcaatgttgtaatgctacaatctcaagcttttaaaccc

SEQ ID NO: 3828 - DNA, 1928 bp, Arabidopsis thaliana
caaacagcttatctcgagttcgtcggtctcaggtgggcagtgattataacttcgtctccgtgtctgttcaagctcccattcttgtggccttcacgcttcaggaacaaagaccagtatctctctgaaagactacttctcggaaattttcgtctccatggcacccgtgagggggattcttggcttgcaaagggcagtgtccatttggaaggaaagtaacagactgactccagctttgagatcattcagcactcaagctgcatccacttccaccactccacagcctcctccacctcctccgcctccggaaaagactcatttcggtggtctcaaggatgaagatcggatttttactaatctctatggtctgcatgacccatttctcaaaggcgcgatgaagagaggtgattggcataggaccaaagatttggtgctcaagggtactgattggattgtcaatgaaatgaagaaatctggacttcgtggacgtggtggtgctggtttcccttctggtcttaagtggtcctttatgcctaaagtttctgatggccgtccctcctatttggttgtcaatgctgatgagagtgagcctggaacttgtaaagatagggagatcatgcgtcatgaccctcacaaattgttggaagggtgtttgattgctggtgttggaatgagagctagtgctgcgtatatttacatcaggggtgaatatgtgaatgagcgtttgaatctagagaaggctagaagagaagcgtatgcagctggtctcttggggaagaatgcatgtggttctggttatgattttgaagtttatatccactttggtgctggtgcgtacatttgtggtgaagagactgcgcttcttgaaagccttgaagggaagcaaggaaaacctaggttgaagcctccgttccctgctaatgctggtttatatggttgtcccacaactgttaccaatgtggaaacagtggctgtttcgcctaccattttaaggcgtggacctgagtggttttctagtttcggtaggaagaataacgctgggacaaagctcttttgtatatcaggccatgtaaacaagccatgcacggtggaagaggagatgagtatacctctcaaggaactgattgagaggcattgtggaggtgttaggggtggatgggacaatctacttgctatcatccctggtggttcatctgttcctctgatccctaagaacatttgcgaggatgtgctgatggatttcgatgcgctcaaggctgtccaatcagggttaggaactgcagcagtcattgtgatggataaatcaaccgatgttgtggatgcaattgcaaggctctcttacttctacaagcatgaaagctgtgggcagtgcactccttgcagagagggaacaggttggctttggatgatcatggagagaatgaaagttggcaatgcaaagctggaagagattgatatgctgcaggaggtaaccaaacagatcgaaggacacacaatctgtgcattgggtgatgcagctgcatggcctgtgcaaggtctgataagacactttaggccagagctcgagagaaggatcagggaacgcgctgaaagggagttgctacaggctgctgcttaagtaccttgttaaccagagggagtttgctattattctccatggaaataaaatctgaatgaacaactagtaacggttttgggatgcaaagctacttcagaaggagaagaaggtaatgtaatttgtttgaatggttaatgttaaaactctcttaaagttgtatcagaaagagcgcgatttgctcttttgcattactctactttctttattgtttgcttgttatgtttattcgagtatgaaagcacattttgggaacaaccaaagaaacccttttcatgtttgaaataaagaatgctcctttttgggtttataagta

SEQ ID NO: 3829 - DNA, 1869 bp, Ocimum basilicum
cagcagcggtgaatttggtgcagtcatggcacctataaagggcattctttctcacgaaggactgcttttgtccagcgcttcagtgagaattggggctttgctcgcagattactgagcacgcaggctgcaacaacttctgccaccccacagcctccaccacctccgccgcctccagagaagacccactttggtggcctgaaagatgaggatcgcatcttcactaacgtatatggtctacatgatcctttcctgaaaggagcaatgaaacgtggagattggtacaggacaaaagatctagttattaaaggatctgattggattgtcaatgagatgaagaaatcgggacttagaggtcgcgggggtgctggttttccctctgggcttaaatggtccttcatgccaaaggcatctgatggccgcccgtcatatcttgttgttaatgctgatgaaagtgaacctggaacgtgtaaagatagagaaattatgcgacatgatcctcacaaactactcgaaggttgtctaattgctggggtagggatgagagcgagtgctgcatatatttacattcgtggtgagtatgtcaatgaaagattgaatcttgagaaagccaggaaagaagcttatgctgctggattgttgggaaagaatgcgtgtggatcaggttatgatttcgacgtgcatatccactttggtgctggggcttatatatgcggtgaagagacagctctgttggagagcctcgagggtaagcaaggaaaatctaggttgaagcctccttttccagccaatgcagggctttacgggtgccctacgacagtcacaaatgttgaaacagtggctgtctcccccaccattctaagacggggaccagaatggttttcaagttttggaaggaaaaacaattctggtacaaaactattttgcatctcagggcatgtaaacaagccttgcactgttgaagaggagatgagtataccattgagagagcttttagagagacactgcggcggtgttcgtggtggatgggataatctactcgcagttattccaggtggttcgtcagtcccgctaattccaaaacacatttgtgaggacgttctcatggattttgatgcacttaaagccgtccagtcagggttggggactgctgcggtcattgttatggacaagtccacagatgttgtcgatgctattgctagactctcttacttctacaagcacgagagctgtggacagtgtacgccttgcagagaaggcactggatggctgtggatgattatggagagaatgaaggtcggaaatgcaaagctggaagagatcgacatgctgcaggaagtgacaaagcagattgaagggcacacgatttgtgcattgggcgatgctgctgcttggccagttcagggacttatcaggcactttaggccggaactcgaaaggaggatcagggagcgggcagatagagagttgcaacaggctgctgccgcttgatctctcaccgggaaacacatcttctgctagattacatcaaataagctctttgaagtcaagatttatcagaatgtgatcattcaccctgcagccacgtcatcagctttgatatggttgtatcgcgtatgactgcactgaatttcgacttcttatatgttctgaattcttcctccaaatgataagcgttaagaatatgagtcgaagttgcatctctatttggattttatggtttttagaaccttttctcatgcagcatgtgtgcaattcttgcaataatttcggaaggcatgttggtgtcttctttgtacttctaaaatgtttatactcgctgtccggattcggttccattttgattttgtaattgagctacttttgcctaac

SEQ ID NO: 3830 - DNA, 1879 bp, Citrus sinensis
ggaaacaattgccgccttcaaatctccactccatttcttctttggtttctcgattttgagctagagcttaatcggcgactcttcttcgacgtttcatgctatggcacccatgaagggcgttttatccctgcaaagggcatcattggttagatgctacagtgagaggttgagtgtgggcttaagatcatttagcactcaaggtgcatcaactgccagtactccacaacctccgccacctcccccacctccagagaaaacccattttggtggcctgaaagatgaagacaggattttcaccaacttatatgggatgcatgacccttttctcaaaggtgccatgaaacggggtgattggcacagaactaaagacttggtactcaagggtgcagattggattgtcaatgaagtcaagaagtctggtctccgcggacgtggtggtgctggttttccctctggcctcaagtggtccttcatgcccaaggtgtctgatggccgtccttcgtatcttgttgtcaatgctgatgaaagtgaacctggaacctgtaaagacagggaaattatgcggcatgatccacataagttgttggagggctgcttgattgctggcgtaggaatgagggcttctgctgcttacatttacataaggggtgaatatgtaaatgaacgtaaaaaccttgaaagagcgaggcaagaagcttatgctgctggattgttgggcaagaatgcctgcggatctggttatgattttgatgtgcatatccactatggtgctggtgcttatatttgtggtgaagagacagctcttttggaaagccttgaaggtaaacaggggaaaccaagattgaagcctcctttccctgctaatgcaggtttatatggttgtcccaccactgtcaccaatgtggaaactgtggccgtttctcccaccattttaaggcgtggaccggactggtttgccagttttggcaggaagaacaattctggtacaaaattgttttgtgtgtcgggccatgtgaataagccttgcacagttgaagaggagatgagtattcccctcaaggagttgatagatagacactgtggtggtgttcgaggtggatgggataatttacttgcagtaataccagggggttcttcagttcctttgcttcccaaacatatatgtgatgatgtgctgatggattatgatgctctgaaggctgttcaatcaggattgggaactgctgctgtgattgtcatggacaaatcaactgatgttgtcgatgcaattgctaggctctcatacttctataagcacgaaagctgtgggcagtgcactccatgcagggagggaacaggatggctttggatgatcatggaaagattgaaggttggaaatgcaaagttggaggagattgatatgcttcaggaggtgaccaagcagattgaagggcacacaatctgtgcactgggtgatgcagctgcttggcctgttcagggtctcatacgacattttaggcctgagcttgagagaaggatcaaagagcatgctgagagggagctgctggaggccacagcttaaatttttcttctcaggtaatttttttcttcaaatggtcgatattgtggaataaaactgaggaaagcatcccagatattgggagtaattcaagcatctgaagattttgttagaatttggtttgttttaagctgtatgaattatggattcttcatttactgtcctggagaaatgatggtgtatgtatcctctgtatctgggcatggatgctaccttttttttttttataagctgggcacggatacttaaaaaagttgtttcatgtatttcttgaacatggcattttggctcatctgaggagctttgttaatatctgcatat

SEQ ID NO: 3831 - DNA, 2123 bp, Papaver somniferum
ggcgagggtcaacttactacccaatcaaatgttaggtattgttgacctaactctctgacgcgcacctcaaaacaccataagtttcacttacaccccctttctatgtagaaatccctgaagaagtttctctctcttcctcttcttcttcttgtctcgcattttgatctgtggatttcggtaactccacgaagctttttgattttacacacacctcttctctctcttctgagaggtctaatgggacccatcaagaacattctctctctgcacagggcggcagctccattacggcaaagcactagaaggtgggatgcagtttgcagatcattcagtgctcaagcagcaactaccgcaaccactccacaacctccaccaccacccccgcctcctgagaaaacccactttggtggactaaaagatgaggaccgcatcttcaccaacctttatggattgcacgaccctttcctcaaaggtgcaatgaagcgtggtgattggcacagaaccaaagacctagtactcaagggaactgactggattattaatgaaatgaagaagtcagggcttcgtggccgtggaggtgctggttttccatctggtcttaagtggtcgttcatgccaaaagtatctgatgggcgtccttcctatcttgtggtaaatgctgatgagagtgagccaggaacgtgtaaggacagagaaatcatgaggcatgatccacacaagctactagaagggtgccttattgcaggagtaggcatgagggccagcgcagcttacatctacataaggggagagtatgtaaatgagcgtttgaacctcgaaaaggccttaaaagaagcttataaagctggactattaggaaagaatgcatgtggttcaggctatgactttgatgtgcatatccactatggtgctggtgcttacatttgtggtgaagagactgcacttcttgaaagtctcgaagggaaacaaggtaaacctagattgaagcctccatttccagctaatgctgggttatatggctgcccaacaactgttaccaatgtggaaacagtggctgtttctccaaccatcttaagaagaggacctgaatggtttgctagttttggcagaaagaacaattctgggacaaagctattttgcatctcaggtcacgtgaataagccttgcactgttgaagaggaaatgagtataccattaaaggaactgttagagaggcactgtgggggagtcagaggtgggtgggataatttgcttgccgtgataccagggggttcttccgtgccattgcttcccaagcacatctgtgacgatgtcttgatggattacgatgcactcaaggctgtgacttctgggttgggaactgctgcggtgattgtcatggacaagtcaactgatgttgtggatgctattgccaggctttcgtacttctacaagcacgagagttgtggtcagtgcacaccctgtagggagggaacaggatggttgtggatggtcatggaaaggttgaaggttggagatgcaaagctggaagagattgacatgctgcaggagatcacgaaacagatagaagggcatacaatctgtgcattgggtgatgctgctgcttggccagttcagggcctgatcaggcattttagacctgagttagagaggaggattagggaacgtgcagatagggaattattggaggttgcatctgcttaagccaccttccacacccaggttggctatatctttgatggctttccctgtttcataaagtaagaaatactattcggatgtttgtcttttgttttatttttgttaatgctgtgtttacatgatcaaacaaatgtgtccttcatgaagtgtaagtgacccaatgggtaatggtgcgcatgccggaaagtgagccagatacttattgctagttacacgaaaatttggtttcaatttatttaatagtaaatcttttgccttgtagtttgcatttcacctgatctggtggatattgttgaataaaaaaggttgaaggaactaaattcgatttattcggttttggtctgtatttagaaatatgaaacaattagatatgttctttggggttttacatgcaacggtatgttcagccaaaaaaaaaaaaa

SEQ ID NO: 3832 - DNA, 2067 bp, Eutrema halophilum
agtttatctcgagctcgtcggtctcaggtgcgcagggattataacttccgattcgccttcctcctctacttccattccaatcaatcagtttatctcgagctcgtcggtctctctgtccgagttttccgcggaatattcgtctccatggcacccgtgagggggattcttggcttgcagagagcagtatcaatttggaaggaaagtaacagattggctccagcattgagatcattcagcacccaagctgcttccacttctaccactccacagccacctccaccacctcctcctccggaaaagactcatttcggtggtctcaaggatgaagatcggatttttaccaacctctatggtctgcatgacccattcctcaaaggggcgatgaagagaggtgattggcataggaccaaagatttggtactcaagggtactgattggattgtcaatgaaatgaaaaaatctggtcttcgtggacgtggtggtgctggtttcccttctggtcttaagtggtcctttatgcctaaagtatctgatggacgtccgtcctatttggttgtcaacgctgatgagagtgagcctggaacctgtaaagatagggagatcatgcgtcatgaccctcacaaattgttggaagggtgtttgattgctggtgtcggaatgagagctagtgcggcgtacatttacatcaggggtgaatatgtgaatgaacgtttgaatcttgagaaggctagaagagaagcgtatgcagctggtctcttgggaaagaatgcatgtggttctggttatgatttcgatgtttatatccactacggcgcgggtgcttacatttgtggtgaagagactgcgcttcttgaaagccttgaagggaagcaaggaaaacctaggttgaagcctccgttccctgctaatgctggtttatatggttgtcccacaactgttaccaatgtggaaacagtggctgtttctcctaccattttaaggcgtggacctgagtggttttcgagttttggtaggaagaacaactctgggacaaagctgttctgtatatcaggccatgtgaacaagccgtgcacagtcgaagaggagatgagtatacctctcaaggaactgattgagaggcattgtggaggtgttaggggtggatgggacaacctacttgctatcattcctggaggttcctctgtccctttgattcctaagaacatatgcgaggatgtgctgatggattttgatgcgctcaaggctgtccaatcagggttaggaactgcagcagtcattgtgatggataaatcaaccgatgtggtggatgcaattgcgaggctctcgtacttctacaagcatgagagctgtgggcagtgcactccttgcagagagggaacaggttggctttggatgatcatggagagaatgaaagttggcaacgcaaagctggaagagattgatatgcttcaggaggtaaccaaacagatcgaaggacacacaatctgtgcactgggtgatgcagctgcatggcccgtgcaaggtctgataagacactttaggccggagctcgagagaaggatcagggaacgcgctgaaagggaattgctacaggttgctgcgtaaaatgcgtgttaaccacagggcatttgctattgctctctatggaaataaaatctgaaagcacatttatagggtttttgggatgtgtagctgcttcagaaggagaaggaaggtaatgtatttgtttaaatggttaatgtcaaaactttattcaagttgtatgagaaagagctctatgtgctcttttgcttactctactttcttcaatgtttgcttgtttttgtatgacttatgagagcacattttgggaacaaaccaaacaaaaccttttcgtgtttaaaataaaggatgctccttttttttattttaaatagttaacattccaaataaattataatgaatggttctttttttggcattttgtggaaaatatctttagtatcaagttaaaaagtccaaaatgtttttttgtaagtaatgtataattaaattgtaattagtcgcaattgctgtcatcttaatcta

SEQ ID NO: 3833 - DNA, 1893 bp, Eutrema parvulum
ctattcattcgatgacaggcacccgtgagggggattcttggcttgcagagggcagtatcaatctggaaggaaagtaatagattgactccagctttgagatcattaagcacccaagctgcgtctacttccaccactccacagccacctccacctcctccgcctccagaaaagacccatttcggtggtctcaaggatgaggatcggatttttaccaacctctatgggatacatgacccttttctcaaaggggccatgaagagaggtgattggcataggaccaaagatttggtactcaagggtactgattggattgtcaatgagatgaaaaaatctggtcttcgtggacgtggtggtgctggtttcccttctggtcttaagtggtcctttatgcctaaagtatctgatggacgtccgtcctatttggttgtcaacgctgatgagagtgagcctggaacctgtaaagatagggagatcatgcgtcatgaccctcacaaattgttggaagggtgtttgattgctggtgtcggaatgagagctagtgcagcatatatttacatcaggggtgaatatgtgaatgaacgtttgaatctagaaaaggcgagaagagaagcatacgcagctggtctcctgggaaagaatgcatgtggttctggttatgatttcgatgtttatatccactttggggcgggtgcgtacatttgcggtgaagagactgcgcttcttgaaagcctcgaagggaagcaaggaaaacctaggttgaagcctccgtttcctgctaatgctggtttatacggctgtcccactactgttaccaatgtggaaacagtggctgtttctcctaccattctaaggcgtgggcctgagtggttttcgagttttggtaggaagaataactctgggacaaaactgttttgtatatcaggccatgtgaacaagccatgtaccgttgaagaggagatgagcatccctctcaaggaactgattgagaggcattgtggaggtgttagaggtggatgggacaacctacttgccatcattcctggaggttcctctgtccctctgattcctaagaacatatgcgaggatgtgctgatggatttcgatgcgctcaaggctgtccaatcagggctaggaactgcagcggtcattgtgatggataaatcaaccgatgttgtggatgcaatagcaaggctctcttacttctacaagcatgaaagctgtgggcagtgcactccttgcagagagggaacaggttggctctggatgatcatggagagaatgaaagttggcaatgcaaagctggaagagattgatatgcttcacgaggtaaccaaacagattgaaggacacacaatctgtgcattgggtgatgcagctgcatggcccgtgcaaggtctgataagacactttaggccagagcttgagagaaggatcagggagcgcgctgaaagggagttgctacaggctgctgcttaagatccttgttaactacagggaaaattgctattattctccatggaaataaaatctaaaagcacactattagggtttttggggtgcaaagctacttcagaaggagaagaaggtaatgtatttgtttaactttaaactttattcaaagttgtatcagaaagagctctatttgctcttttgcttactctactttcttcaatgtatgcttgttttcttatggctatgtgagagcacattttgggaacaaccaaacgaaaccttttcatgtttgaaataaaggatgctcctttcttgggttttaaatagtttacattccaaataaatttgtaatcaatcttttttttggggggtttttgtgcaaaatatctatcgttaatttgtgtcattgtgattaggcgcaattgctagaatataaatcta

SEQ ID NO: 3834 - DNA, 1776 bp, Fagus grandifolia
tctctaaactcgtttcgtcaatcacctgagagaatcgctgtcctcatcagagctcatctctcaacatttcacgctatggcacccattaagggtattctttctttgcaaaggacagctttagctcagcgtcatagtgatgtatggggtttaggctttagagcattcagcacacagggtgcaacgacggctggtactccacagcctccaccacctcctccacctccagagaaaacccattttggtggcttgaaagatgaagaccggatttttaccaacttatatgggttgcatgacccttttctcaaaggtgctatgaagcggggtgactggtacagaaccaaagacttagtactcaagggtactgattggattgttaatgaagtcaagaagtctggccttcgcggtcgtggtggtgctggttttccttctggcctcaagtggtctttcatgccaaaagtatctgatggtcgtccttcctatcttgttgtcaatgctgatgaaagtgaacctgggacctgtaaagacagggaaattatgcgccatgatccacacaaactgttggagggttgcctaattgctggtgtggggatgagggctagtgctgcttatatctatataagaggtgaatatgtgaatgaacgaataaaccttgaaagggccagaaaggaagcctatgaagctggattattgggcaagaatgcatgtggatctggttatgattttgatgttcatatccattatggtgctggtgcttatatttgtggtgaagagacagcacttttggagagtcttgaagggaaacaagggaagccaagattgaagcctcctttcccagctaatgcagggttatatggctgccctactactgttacaaatgtggaaacagtggctgtttctcccaccattttaaggcgtggcccagactggtttgccagttttggcaggaagaataattcagggacaaagttgttttgcatttctggacacgtgaacaagccttgcactgttgaagaggagatgagtataccattgaaagagttgatagaaaggcactgtggaggtgttagaggtggatgggacaatttacttgctgtaattccaggtggttcatctgtgcccctgatgcccaagaacatatgtgatgatgtgttgatggattatgatgcactcaaggctgtccaatcaggattggggactgctgctgtgattgttatggataaatcaactgatgttgtagatgcaattgctaggctttcttacttctacaagcatgagagctgtgggcagtgcacgccttgcagggagggaacgggatggctttggatgatcatggaaagattgaaagttgggaatgcaaagttggaagaaattgacatgctgcaggaggtaaccaaacagattgaagggcacacaatctgtgcattgggggatgctgctgcttggcctgtgcagggtcttattaggcattttaggccagagcttgagagaaggatcagggagcgtgcagagagggagttactggaggctgctgcttaagctttctactcaggcatattgctttagtggtggatatcatcgaataaaatgaagacggtgcccccagattttgggaggatagattattcaggcatctggtggtcctctcttcagattctgtttgtttttaagctgtatcaaatataacttcacttactgttccagagaaaacatgattcgttttggatgtgctgggaaatcataattcatgttgtctttcactaagacattttatttcac

SEQ ID NO: 3835 - DNA, 2792 bp, Theobroma cacao
taggtaaaagaaaggttcatttgtgaataatcttgggccttttgaactttgcagacttaaactagattacgaaacttaggaagcccaaactatcagcattacccataaatgcaacagtagacgtggcccattaatcatagccgttgataggtggctcaaacgacatccacgccatctctacgtatcatcgaaaaccatcaccaacttcagaaaaaaaaatcaaccgttagatcgccaccgccccatcaatcaaccctttccaaaaccaatctccattgtatctggcttttgtagtcaagctgaatcgcgaagcatcaaggctcatccgcgacatttcatgctatggcacccataaagggcattctttccctgcaaagggctgctttgttcagaaatagcagtgagaggtggggtctaggcattagatcatttagtactcaaggagcaacaactactggtgctccacagcctccccctcctcctccaccaccagagaaaacccattttggtggtctaaaagatgaagaccgtattttcaccaacttgtatgggttgcatgacccttttctcaaaggtgctcagaaacgtggtgactggcatagaaccaaggatttagtactcaagggtgctgattggattgtcaatgaaatgaagaagtctggactacgaggacgtggtggtgctggatttccatcaggccttaaatggtctttcatgccaaaagtatctgatggccgtccttcttatcttgttgtcaatgctgatgaaagtgaacctggaacctgtaaagacagggaaatcatgcggcatgatccacacaaattattggagggctgcttgattgctggggtagggatgagagctacagctgcttatatctacataaggggtgaatatgtgaatgaacgtaaaaaccttgagagagctagaaaagaagcttatgaagctggacttttgggtaaaaatgcatgtggttctggttatgattttgatgttcatatccattatggtgctggtgcttatatttgtggtgaagaaacagcacttttggagagccttgaagggaaacaagggaaacctagattgaagcctcctttccctgctaatgccggattatatggctgtcccaccactgtcacaaatgttgaaacagtggctgtttctcctacaatactgagacgtggtccagagtggtttgccagttttgggaggaagaataattctgggacaaaattgttttgtatctcaggtcatgtaaacaagccttgcacagttgaggaggagatgagtataccacttaaggagttgatagagaggcattgtggaggtgtcagaggtggatgggacaatttacttgcagtaataccaggaggttcatcggttccacttttacctaagaacatctgtgacgatgttctgatggattatgatgcactcaaggctgtccagtcagggctgggaactgctgctgtgattgtgatggacaaatcaaccgatgttgtagatgcaattgcaaggctttcttacttctacaagcatgagagttgtggacagtgcacaccctgcagggaaggaactggatggctatggatgatcatggaaagactgaaaattgggaatgcaaagttggaagagattgacatgcttcaggaggtgaccaagcagattgaagggcatacaatctgcgctttgggtgatgcagccgcttggcctgtgcagggtcttataaggcattttaggccggagctggagagaaggattagagagcatgcagaaagggagttgctggaggcttctgcttaatttctgctcagggaaattccactgcaagtggccattcctgaataagattgaagtacccaaaaattggaggatacgtgactcaggcatctggtggtctgttagcattttgtttgttttctcctaagctgtattgacaacatttcactgtctgagaaaataatgaatgtctctaatgtctgggcggggatacttgtgtttcacagcatccacaactttttctttttggcccgtttgaggaacattgttaatgatatctgtattctttctgctttgaccatttaatggtatctatattttgctgtgttataggtgtcattcatctggtaaccaacaataggtcaaaaaacattaccaggaaattgaaataaaagttgtgcagtgcagatattccaaaatgaaatgaaaataacttgcattgaataaaaatatgcagcagctgaatagcttggatgggttaggcttgaggctggaccagggttgagcttaacttgcttgaggaagtttggatctttgtcctaaaaagcttgagcttgttaacaagcatggcccaaattctagttccagcaactgacgtcctgttagactttggctgacgcccatgtttaactaagacattttaatttgtatttatttttgactctgtctttagttttagacataaagtagcaggttgttaacttgcttttttccattctttttccgttggctatttagtggtggaagtcctcttcaggttcgtgtactaatccttttagtttggtaaagaaacattcctaatgaacttgatggtggagggtataatactaaaaattgtatatggacccacgttctattttcagttcgattctttctcttttctgctttgggttgttaacaagtcagttttcctggcaaactctcaactttcaagttgttccattcatttgcttttctattctggaacattgtaatatttgttcattctctttcaatatatactatttttgatt

SEQ ID NO: 3836 - DNA, 1910 bp, Tripterygium wilfordii
agggcagatgcgtatttccattctccatagcctacctttcttctcgacatacctggatttgtcgtgttaaggctgcatcgggaacgaatcggagctcaacagttgcgtttaacgttatggcacccatgaggagctttctttccttgcggcaggcagctttggtacgacatcacagtgagagatggggtgctggcttcagatcattcagcacccaaggtgcaccaactgctagtactccacagcctcccccacctcccccacctcctgaaaaaacccacttcggtggccttaaagatgaggacagaattttcacaaacctgtatgggttgcatgacccatttcttaagggttcaatgaaacggggtgattggtacagaaccaaagatttggtacttaagggtgctgattggattgttaatgaaatgaagaagtctggcctccgcggacgtggtggtgctggatttccatctggccttaaatggtcattcatgcccaaagtatctgatggccgcccttcatatcttgttgtcaatgctgatgaaagtgaacctggaacctgtaaggacagggaaatcatgcgtcacgatccacacaaattattggagggctgtttgattgccggggttggaatgagggctactgctgcttacatctacataaggggtgagtatgtgaatgaacgtaagaaccttgaaagagccagaaacgaggcttatgaagctggacttttggggaagaatgcatgtggatctggttatgattttgatgtacatatccattatggtgcgggtgcttatatttgcggggaagagacagcccttttggagagccttgaaggaaaacaggggaaaccaaggttgaagcctcctttcccggctaatgcagggttatatggctgtcccacaactgtaacaaatgtggaaacagtggctgtttctcctaccattttgaggcgtggaccagaatggtttgcaagttttgggaggaagaataattcaggtacaaaacttttttgtgtgtctggtcatgtgaacaagccttgcactgttgaagaagagatgagtatacccctaaaggagctgatagagaggcattgcggaggtgttcgaggtggatgggacaatttactggcagttattccagggggttcatctgttccattgctccccaagcatatttgtgatgacgtgctgatggattatgatgcacttaaggctgttacatcaggactggggactgcagctgtaattgtgatggataaatcaactgatgttgtagatgcaattgccaggctatcttatttctacaagcatgaaagttgtggccagtgcacaccatgcagagaggggacaccatggctttggatgatcatggagaggttaaaggtcggtaatgcaaagttggaagagattgacatgcttcaggaggtgaccaagcagattgaaggacacacgatttgtgcacttggcgatgctgctgcttggcctgtgcaaggtctcataaggcattttaggccagagctggagagaaggatcagggagcgtgcagacaaggaattactggaggctgctgcttaggtttgctatggagggaatgtcctatattggcgaataataaagatgaagaaagtacagcgaacattggcagaattgtttgcttgaggcatctggtattccagtttcaatttatttttccccatttcgaacctgtatcaatgattaacttcattcactgttgcgaagatatcaatagacttaccgttgtatccgggcagaagtcttgtgtttaccaaacatcccttttggtacatgttaataatgtctgtagtctatgttttatgtacacttaaactatgttttgatttacgttccatctagtcaatgtgaacctgaaaggcgaagggttcaaat

SEQ ID NO: 3837 - DNA, 1576 bp, Flaveria ramosissima
aagcttcattgctgcattttgtggcctatggcacccatgaagggcattctttctctgcaacgagctgctttgttgaggcgtcaaaatattaattggggactaggtactagattacttagcactcaatctgcaacaaccgctaataccccacagacgccaccacctccccctcctcctgagaaaactcactttggtggtttgaaagatgaagatcgcatttttaccaacctttatggtatacatgacccgtttcttaaaggtgccatgaaacgtggtgattggtacagaactaaagatctagttattaagggctctgattggatagtcaatgaaatgaaaaaatcgggtctacgtggacgtggtggtgctggatttccatctggactcaaatggtcatttatgcctaaggtatctgatggtcgtccatcctatcttgttgttaatgctgatgaaagtgaacccggaacatgcaaggatcgtgaaattatgcgaaatgatccacataaacttctagaaggatgcttgattgctggagttggtatgagggcaactgctgcttatatttacattagaggtgaatatgtgaacgaacgccttaaccttgagaaggccagaaaagaagcctatgcagctgggttacttggaaaaaatgcttgtggatcgggttatgattttgatgtgcatatccactttggtgccggtgcttacatttgtggtgaagaaacagcacttttggagagccttgaaggtaaacaaggaaaaccaagattgaaaccccctttccctgctaatgcaggtctatacggatgtcccacaactgttacaaatgtagaaacaattgctgtatcacctacgatcttaagacgagggcctgaatggttctctagttttgggtagaaagaataattccgggactaaaactttttagtcatatctggtcatgtcaacaaaccgtgcacagtcgaagaggagatgagtataccattgaaggagctgctagagcggcattgtggcggtgttaggggtggatgggacaatttactggcagtaattcccggaggttcatctgtacgttgcttcctaaacacatatgtgaggatgtcctgatggattttgatgcattgaaagctgtgcaatctggattagggactgcagctgtaattgtgatggataagtcaactgatgttgtggatgcaattgcaaggctttcttacttttataagcatgagagttgtggtcagtgtacaccttgcagggagggtaccggatggctttggatgattatggaaaggatgaaagttgggaatgcaaagcttgaggaaattgatatgcttcaggaggtgactaagcagattgaaggacacacaatttgtgcattaggagatgctgctgcttggcccgttcaaggtcttattaggcattttaggcctgaacttgagaggaggatcagggaacgtgcggatagagagttgcttcaggcagctgcttgattcaggctgaagaatttacagtcctgcaatctatggaataaatatgcagtagtccttgaggaaactagaaaccaatgaacccctta

SEQ ID NO: 3838 - DNA, 1910 bp, Arabidopsis lyrata
ttatctcgagttcgtcggtctcaggtgggcagtgattataactccgtctgttcaagctcccattcttgtggccttcacgcttcaggaaccaaagaccagtctctctctgtacgactacttctcggaaatttcgtctccatggcacccgtgagggggattcttggcttgcaaagggcagtgtccatttggaaggaaattaacagagtggctccagctttgagatcattcagcactcaagctgcatccacttctaccactccacagccacctccacctcctccgcccccggaaaagactcatttcggtggtctcacggatgaagatcggatttttactaatctctatggtctgcatgacccatttctcaaaggcgcgatgaagagaggtgattggcataggaccaaagatttggtactcaagggtactgattggattgtcaatgaaatgaagaaatcgggtcttcgtggacgtggtggtgctggtttcccttctggtcttaagtggtcctttatgcctaaagtttctgatggccgtccctcctatttggttgtcaatgctgatgagagtgagcctggaacttgtaaagatagggagatcatgcgtcatgaccctcacaaattgttggaagggtgtttaattgctggtgtcggaatgagagcaagtgcagcgtatatttacatcaggggtgaatatgtgaatgagcgtttgaatctagagaaggctagaagagaagcatatgcagctggtctcttggggaagaatgcatgtggttctggttatgattttgatgtttatatccactttggtgccggtgcttacatttgtggtgaagagactgcccttcttgaaagccttgaagggaagcaaggaaaacctaggttgaagcctccgttccctgctaatgctggtttatatggttgtcccactactgttaccaatgtggaaacagtggctgtttcgcctaccattttaaggcgtggacctgagtggttttctagtttcggtaggaaaaataacgctgggacaaagctgttttgtatatcgggccatgtaaacaagccatgcacggtggaagaggagatgagtatacctctcaaggaactgattgagaggcactgtggaggtgttagaggtggatgggacaatctacttgctatcatccctggtggttcatctgttcctctgattcctaagaacatttgcgaggatgtgctgatggattttgatgcgctcaaggctgtccaatcagggttaggaactgcagcagtcattgtgatggataaatcaactgatgttgtggatgcaattgcaaggctctcttacttctacaagcatgaaagctgtgggcagtgcactccttgcagagagggaacaggttggctttggatgatcatggagagaatgaaagttggcaatgcaaagctggaagagattgatatgctgcaggaggtaaccaaacagatcgaaggacacacaatctgtgcattgggtgatgcagctgcatggcccgtgcaaggtctgataagacactttaggccagagctcgagagaaggatcagggaacgagctgaaagggagttgctacaggctgctgcttaagtaccttgttaatcagaggacatttgctattattctccatgaaaataaaatctgaatgcacactattagtggttttgggatgcaaagctacttcagaaggggaagaaggtaatgtatttgtttgaatggttaatgttaaaactctcttcaagttgtatcagaaaagagcggtatttgctcttttgcattactctactttcttttattgtttgcttgttatgttattgactatgagagcacattttgggaacaaccaaacaaacccttttcatgtttgaaataaagaatgctcctttttgggtttataagta

SEQ ID NO: 3839 - DNA, 1833 bp, Brassica napus
gcttcaccttcttcctcctctacatcctcccttctcgattatagagaaacaaaggctaagtcctctctgtatccgatttcttcgcggaaaattttcgtatccatggcacctgtgaggaggattcttggtttgcagagggcagtatcagtttggaaggagagtaacagacttgctccagctttgagatcattcagcacccaagctgcgtccacttccaccactccacagccacctccacctccacctcctccgcctccggagaagactcatttcggtggtctcaaggatgaagatcggatttttaccaacctctacggtctgcacgacccgtttctcaagggggcgatgaagagaggtgattggcatcggaccaaggatttggtgctcaagggtactgattggattgttaatgagatgaaaaagtctggtcttcgtggacgtggtggtgctggtttcccttctggtcttaagtggtcctttatgcctaaagtctctgatgggcgtccttcttatttggttgtcaacgctgatgagagtgagcctgggacttgtaaagatagggagatcatgcgtcatgaccctcacaagttgttggaagggtgtttgattgctggtgttggtatgagagctagtgcagcttatatttacatcaggggtgagtatgtgaatgagcgtttgaatctagagaaggcgaggagagaggcatatgcagctggtctcttggggaagaatgcatgtggttctgggtatgacttcgatgtttacatccattttggagctggtgcgtacatttgtggtgaagagactgcgcttcttgaaagtctcgaagggaagcaaggaaagcctaggttgaagcctccgttccctgctaatgctggtttgtacggttgtcccacaactgttaccaatgtggaaacggtggctgtttctcctaccattttaaggcgtggacctgagtggttttcgagttttggtaggaagaataactctgggacgaagctgttttgtatatcgggccatgttaacaagccatgtaccgttgaagaggagatgagtatccctctcaaggaactgattgagaggcattgtggaggtgtcaggggtggatgggacaacctgcttgctatcattcctggaggttcctctgtccctttgattcctaagaacatatgcgaggatgtgctgatggatttcgatgcgctcaaggctgtccagtcagggctaggaactgcagcggtcattgtgatggacaaatcgaccgatgttgtggatgcaattgcgaggctctcttacttctacaagcatgaaagctgtgggcagtgcactccgtgcagagagggaacagggtggctctggatgatcatggagaggatgaaagttggcaatgcaaagctggaggagattgatatgcttcacgaggtaaccaagcagatcgaaggacacacaatctgtgcattgggtgatgcagctgcatggccagtgcaaggtctgataaggcactttaggccggagcttgagagaaggatcagggaacgcgctgaaagggagttgctacaggctgctgcttaaagcccttgttaacgacagggtatttgctattattttcaacggaaataaaatctgaagcacattattagggttttggggatgcaaagctacttcagaaggagaagaaggtactgtatttgttgaaatggttcatgttaaactttaatcaaactgtatcagaaagagctctgtttgctcttttgcttattctactttctttcaatgtttgtttgttttctcatgactactgagagcacattttgggaacaaccaaccaaactaaac

SEQ ID NO: 3840 - DNA, 1633 bp, Brassica napus
accaatactaagtcgcagctgtatccatggcacccatgagggggattctcggcttgcagagagcagtatcaacttggaagggaagtaacagattggctccatctttgagatcactcagcacccaagctgcgtccacttccgccactccacagccaccaccacctcctccgcctccggaaaagactcatttcggtggtctcaaggatgaagatcggattttcaccaacctctatggcctacacgacccttttctcaaaggagcgatgaagagaggtgactggtacaggaccaaagatttggtactgaaaggtactgattggattgttaacgagatgaaaaagtctggtcttcgtggacgtggcggtgctggtttcccttctggtcttaagtggtcttttatgcctaaggtttctgatggacgtccgtcttatttggttgtgaacgctgatgagagtgagcctgggacttgtaaagatagggagatcatgcgtcatgaccctcataagctgttggaagggtgtttgattgctggtgttgggatgagagctagcgcggcgtatatttacatcaggggtgagtatgtgaatgagcgtttgaatcttgagaaggctagaagggaagcttatgcagctggtctgttggggaagaatgcgtgtggttctggttatgattttgatgtttatatccattttggagctggtgcgtacatttgtggtgaagagactgcgcttcttgagagccttgaagggaagcaagggaagcctaggttgaagcctccgttccctgctaatgctggtttatatggttgtcccactactgttaccaatgtggaaacagttgctgtgtctcctactattctaaggcgtggacctgagtggttttcgagcttcggtaggaagaataacgctgggacaaagctgttttgtatctcggggcatgtgaacaagccgtgtactgttgaagaggagatgagtatacctctcaaggaactgattgagaggcattgtggaggtgttaggggtggatgggacaacctacttgctatcattcctggaggttcctctgtccctttgattcctaagaacatatgcgaggatgtgctgatggatttcgatgcgctcaaagctgttcagtcagggctaggaactgcagcggtgattgtgatggataaatcaaccgatgttgtggatgcaattgcgaggctctcgtacttctacaagcatgaaagctgtgggcagtgcaccccttgcagagaagggacaggttggctttggatgatcatggagagaatgaaggttggcaatgcaaagctggaagagattgatatgcttcacgaggtaacgaagcagatcgaaggacacacaatctgtgcattgggagatgcagctgcatggcccgtgcaaggtctgataaggcactttaggccggagcttgagagaaggatcagggaacgtgctgaaagggagttgctacaggctgctgcttaaaaatccttgctaaccacagggaatttgctattattctccatggaaataaaatctgaagcatactattagagtttttgggggttggcaaagctacttgagaaggagaagaaggtaatgtgtatttgtgttgaatgcttcatgttaaa

SEQ ID NO: 3841 - DNA, 1800 bp, Manihot esculenta
gaatccctagtctccattcctcaccttctaattccttctattctccgttgccttcctcgatttagctgactggccgaattctaaacgctaatctgtgacgtttctcattatggcacctattaggggcatttttacattgcacagagctactttcgttcagcgtcatagtgaaaagttggttataggcatcagatcattcagcacccaagctgcaacaaatgctggtaatccacagcctccaccacctcctccaccgccggagaaaacccattttggtggtttgaaagatgaggaccggatttttaccaacttgtatggcctgcatgacccttttctcaaaggtgccatgaaaaggggtgactggtatagaactaaggacttggtactcaagggtactgattggattgtcaatgaagtcaagaagtctggcctccggggacgtggtggtgctggtttcccctctggcctcaaatggtcattcatgccaaaagtatctgatggccgtccctcctaccttgtggtcaatgctgatgaaagtgaacctggaacttgcaaagacagggaaattatgcgccatgatccacacaagttgttagagggatgcttaattgctggggtgggaatgagagcttctgctgcttatatctacattaggggtgaatatgtgaatgaacgtataaacctggaaagagcacgaaaggaagcttatgaagctgggttgttgggcaagaatgcatgtggatctggctatgattttgatgttcatatacactatggtgctggtgcttatatttgtggtgaagagactgcacttttagaaagcctagaaggaaaacaagggaaaccaaggctgaaacctcccttcccagccaatgcaggtttgtacggttgccctacaactgttacaaatgtggaaacagtggcggtgtctcccaccattttgaggcgtggaccagagtggtttgctagttttggcaggaagaacaattctggaacaaaattgttttgtgtgtcgggtcacgtgaataagccttgcacagttgaagaggagatgagtattcctctaaaagagttaatagagaagcactgtggaggtgttcgagggggatgggataatctgcttgcagtgataccagggggttcttctgtcccattgcttcctaagcacatatgtgatgatgtgctaatggattatgatgcacttaaggctgtccagtccgggctggggactgcagctgtgattgtaatggataaatctactgatgttgtggatgcaattgcgaggttgtcatacttttacaagcatgagagttgtgggcagtgcactccatgcagggaggggacaggatggctttggatgatcatggaaaggttgaaggtcggaaatgcaaagttggaagagatagatatgcttcaagaggtgacaaaacaaatagaaggtcacactatctgtgcattgggtgatgctgcagcgtggcctgtgcagggcctcataaggcattttagaccagagcttgaaagaaggattaaggagcgtgcagagagggagttgctggaggctgctgcataagggaaatgatgccaatgatggacttgtggaataaatgaactactgtttagttttgtggttagttgactctggaatcaagcagtcctatgagatcacttatttgtttgggaactgtatcaaatatgagtttcactgccccagataagtagtgaattatttgggaagtgatgatttattattagttcatgtgttttaacgtttatctggggaccatttttgaatgggaaata

SEQ ID NO: 3842 - DNA, 1832 bp, Citrus sinensis
ctcctctccatttcttctgtggtttctcgattttgagctagagcttaatcggcgactcttcttcgacgtttcatgctatggcacccatgaagggcgttttatccctgcaaagggcatcattggttagatgctacagtgagaggttgagtatgggcttaagatcatttagcactcaaggtgcatcaactgccagtactccacaacctccgccacctcccccacctccagagaaaacccattttggtggcctgaaagatgaagacaggattttcaccaacttatatgggatgcatgacccttttctcaaaggtgccatgaaacggggtgattggcacagaactaaagacttggtactcaagggtgcagattggattgtcaatgaagtcaagaagtctggtctccgcggacgtggtggtgctggttttccctctggcctcaagtggtccttcatgcccaaggtgtctgatggccgtccttcgtatcttgttgtcaatgctgatgaaagtgaacctggaacctgtaaagacagggaaattatgcggcatgatccacataagttgttggagggctgcttgattgctggcgtaggaatgagggcttctgctgcttacatttacataaggggtgaatatgtaaatgaacgtaaaaaccttgaaagagcgaggcaagaagcttatgctgctggattgttgggcaagaatgcctgcggatctggttatgattttgatgtgcatatccactatggtgctggtgcttatatttgtggtgaagagacagctcttttggaaagccttgaaggtaaacaggggaaaccaagattgaagcctcctttccctgctaatgcaggtttatatggttgtcccaccactgtcaccaatgtggaaactgtggccgtttctcccaccattttaaggcgtggaccggactggtttgccggttttggcaggaagaacaattctggtacaaaattgttttgtgtgtcgggccatgtgaataagccttgcacagttgaagaggagatgagtattcccctcaaggagttgatagatagacactgtggtggtgttcgaggtggatgggataatttacttgcagtaataccagggggttcttcagttcctttgcttcccaaacatatatgtgatgatgtgctgatggattatgatgctctgaaggctgttcaatcaggattgggaactgctgctgtgattgtcatggacaaatcaactgatgttgtcgatgcaattgctaggctctcatacttctataagcacgaaagctgtgggcagtgcactccatgcagggagggaacaggatggctttggatgatcatggaaagattgaaggttggaaatgcaaagttggaggagattgatatgcttcaggaggtgaccaagcagattgaagggcacacaatctgtgcactgggtgatgcagctgcttggcctgttcagggtctcatacgacattttaggcctgagcttgagagaaggatcaaagagcatgctgagagggagctgctggaggccacagcttaaatttttcttctcaggttgcttcttggatcctttttgctaacattacttaaagtggacatttcccccaagaataaattaccgtgaacttgtgtgatttggataattaattattacaaacatgaaatgtgtttggaaatattatctggttatgtatgcaattccatgatcgaggccattcttttcgttgcatttatccctcagataatggttctgttttttctttggctgtaagatgcttgtccataatcacagaatggtataaggttctaaatgatgtatggataaattgtcaaa

SEQ ID NO: 3843 - DNA, 1819 bp, Linum usitatissimum
gatcgaccccgaacaatcgccggagcaatccacggccgtctccgatcgttctctgatatggcacccattaggggcatctttgccatgcaaagtgcagctttggttcggcgtcatgctgacaaattgggtgtaggatttagatcgttgagcacccaagctgcgagcaattctggggctccacagccaccaccaccaccaccacctcctgagaagactcattttggtggcctgagtgatgaggatcggatattcactaacttgtatggactgcacgatccatttcttaagggtgcaatgaaaaggggtgattggtatagaaccaaggacttggttctgaaaggtactgattggattgtgaatgaagtgaagaagtctggtctccgaggacgtggtggagctggttttccctcgggactcaaatggtcattcatgcctaaggtttcagatggtcgtccttcctatcttgtggtcaatgctgatgaaagtgaacccggtacttgcaaagacagagaaatcatgcgtcacgatccccacaagctgttggaaggctgcttgattgctggggtaggaatgcgagctagtgctgcgtatatctacattaggggtgagtacgtcaatgaacggaataaccttgagatagcaaggaaagaagcttacgcagctgggcttctaggcaagaatgcctgtggatccggctacgattttgatgttcatatccactatggtgctggtgcttacatttgcggggaagagactgcacttttggaaagccttgaaggaaagcaaggcaagccaaggttgaagcctcctttccctgccatgctggattgtacggctgtcccacaacagtcacaaatgtggaaacagttgctgtatctcccaccatattaaggcgtggaccagaatggtttgctagtttcggcaggaagaataactccggaacaaagttgttctgtgtctccggtcacgtgaacaagccctgcacagttgaagaggaaatgagtatcccactcaaggaactaatcgagcgacactgtggaggtgtccgcggtggatgggacaaccttcttgcagtaatcccaggaggttcttcagtcccgttactgcccaaaaacatatgtgacgatgtacttatggactatgatgcacttaaggccgtcacatcaggattgggaaccgcagctgtgatcgtgatggacaaatcgaccgatatcgtcgatgcgatcgcgaggttgtcttacttctacaagcacgagagctgcgggcagtgcactccgtgcagagagggcaccccctggctgtggatgatgatggaaagattgaaggtcggaaatgctaagttggaagagatcgatatgcttcaggagctcaccaagcagattgaagggcatacgatttgtgctcttggtgatgccgcagcttggcctgtacagggtcttattagacatttcaggccagagcttgagagaaggatcagggagcgtgccgacagggagttgttggaggctgctgcttaaacttctttaaaggaaactcgttgcttacagaaggtgctgaagattgtggaataaacacagcaaagctacattgttagtttcaagcagtctctctcattagtaatttctcccctgccttcctttccagagctgctgtactaatactataacttgcatattttacttgtatggcaaagagggggatgatgatgatgatatttatcttgtttcttcattctgtttgagactcgacttttggaaggattcttgaagttgtctaaataagatcctgtaatcgagattttacgacgattttgaactcg

SEQ ID NO: 3844 - DNA, 1928 bp, Mimulus guttatus
ctctatcgctctgataatcagctgcgacgccggttcatcacagcacctctgcccgttccacattttgatgcgctcatggcacctataaagagcattctttctctacgaaggaccgcttatgctcagcgctctggtgaaaattggggcctagcgaggaaattattcagcacccaggctgcaacaacttctcccacccctcagcccccaccccctccacctcctccagagaaaacccactttggcggcctgaaagatgaggatcgcattttcactaacgtatatgggctgcatgatccattcctcaaaggagccatgaaacgtggagactggcacaggacaaaagaccttgtaattaagggaactgattggattgtcaacgagatgaagaaatctggtcttcgaggaagaggtggagctggatttccatctgggcttaaatggtcctttatgccaaaggtatccgatggtagaccttcatatcttgttgttaatgccgatgagagtgaacctggaacatgtaaagatagggaaattatgcgtcacgatccgcataaattactcgaaggttgtctaattgctggagtaggtatgagggctagtgctgcgtatatttatatccgtggcgagtatgtgaatgaaagattgaacctcgaaaaggctaggaaagaagcgtacgacgctggactgttgggaaagaatgcgtgtggatcgggttatgatttcgatgtgcatatccacttcggtgctggagcttatatatgcggggaagagacagctcttcttgagagcctcgagggcaagcaagggaaacctagattgaagcctcctttcccagccaatgccgggctatacggttgcccgacaactgtcacaaacgtcgaaacagtggctgtttcgccaaccatactaaggcggggcccagagtggttcgctagttttggaaggaaaaacaattccggaacaaaactgttctgtatttcaggccatgtgaacaagccatgcactgtggaagaggagatgagtataccgctgaaggagctcatcgagcggcactgtggcggtgttcgtggcgggtgggacaatctgctagctgtcatcccaggtggctcgtctgttcctttaatcacaaaggacatatgcgaggatgtgttgatggattttgatgcgcttaaggctgtccaatctgggctaggaacagcagctgtgattgtaatggataagtccaccgatgtggtggatgctattgctaggctgtcttacttttacaagcacgagagctgtgggcagtgtacaccttgcagagaaggcacgggttggctttggatgataatggagagaatgaaggttgggaatgcaaagctggaggagattgatatgcttcaggaggtgactaagcagattgaagggcatacgatttgtgcacttggtgatgctgctgcttggcccgttcaggggcttattagacatttcagaccggagcttgagaggaggattagggagcgggctgatagagagcttcaacaggctgctgctgcttaattcttctcctataaagggagatatttttgctgttagatcccgtttaataaaccgtgataaagtggcgagacatttcagaatgatatccatgttcggatttttttaatggtttgtattattgcatttgaatgtaataagattctaaacttgtatgtgtttgagctctgctgcaactttaaaggatgtggaaagctgaagttccatcctgctggaatatttattgttttaaagaaccttcgaattgtaatttttggtttatactttaaccggcatgtcgattatttatcgattacttaaccatttggtcggacacatcttacaggccggaatgttttctactgtttgtgattaataataccgtttatcagaatacactctgtttcaaactg

SEQ ID NO: 3845 - DNA, 1855 bp, Papaver somniferum
aaatgggacccgtcaagaacattctctctctgcacagggcggcagctccattacggcaaagcactagaaggtgggattcagtttgcagatcattcagtgctcaagcagcaactaccgcaaccactccacaacctccaccaccacccccgcctcctgagaaaacccactttggtggactaaaagatgaggaccgcatcttcaccaacctttatggattgcacgaccctttcctcaaaggtgcaatgaagcgtggtgattggcacagaaccaaagacctagtactcaagggaactgactggattattaatgaaatgaagaagtcagggcttcgtggccgtggaggtgctggttttccatctggtcttaagtggtcgttcatgccaaaagtatctgatgggcgtccttcctatcttgtagtaaacgctgatgagagtgagccaggaacgtgtaaggacagagaaatcatgaggcatgatccacacaagctactagaagggtgccttattgcaggagtaggcatgagggccagcgcagcttacatctacataaggggagagtatgtaaatgagcgtttgaacctcgaaaaggccttaaaagaagcttataaagctggactattagggaagaatgcatgtggttctggctatgactttgatgtgcatatccactatggtgctggtgcttacatttgtggtgaagagactgcacttcttgaaagtctcgaagggaaacaaggtaaacctagattgaagcctccatttccagctaatgctgggttatatggctgcccaacaactgttaccaatgtggaaacagtggctgtttctccaaccatcttaagaagaggacctgaatggtttgctagttttggcagaaagaacaattctgggacaaagctattttgcatctcaggtcacgtgaataagccttgcactgttgaagaggaaatgagtataccattaaaggaactgttggagaggcactgtgggggagtcagaggtgggtgggataatttgcttgccgtgataccagggggttcttctgtgccattgcttcccaagcacatctgtgacgatgttttgatggattacgatgcactcaaggctgtgacttctgggttgggaactgctgcggtgattgtcatggacaaatcaactgatgtagtggatgctattgccaggctttcgtacttctacaagcacgagagttgtggtcagtgcacaccctgtagggagggaacaggatggttgtggatggtcatggaaaggttgaaggttggagatgcaaagctggaagagattgacatgctgcaggagatcacgaaacagatagaagggcacacaatctgtgctttgggtgatgctgctgcttggccagttcagggcctgatcaggcattttagacccgagttagagaggaggattagggaacgtgcagatagggaactactggaggttgcatctgcttaagccaccttccacacccaggttggctatatctttgatggctttccctgttccgtaaagtaagaatactattcggatgtttgtcttttgttttatttttgttaatgctgtgtttacatgatcaaacaaatgtgtccttcatgaagtgtaagtgacccaatgggtaacggtgcgcatgccggaaagtgagccagatacttattgctagttacaggaaaatttggtttcactagcaaatcatatttatttaatagtaaatcttttgccttgtagtttgcagttcacctgatctggtggatattgttgaataaaaaaggttgaaggaactaaattcgatttgctcggttttggtatatgttctttggggttttacatgcaatggtatgttc

SEQ ID NO: 3846 - DNA, 1930 bp, Raphanus sativus
  misc_feature (79)..(79): n is a, c, g, or t
  misc_feature (732)..(732): n is a, c, g, or t
gggcactcaggtgggggcataaacacagagcgtccacgcttcaccttcttcctcctatacatcccccattctcgattanagagaacaaaggccaagtctctctgtatcccaattcttcgcggaaatttcgtttccatggcaccggtgagagggattcttggtttgcagagggcagtatcagtttggaaggagagtaacagattggctccagctctgagatcattcagcaccacagctgcgtccacttccaccactccacagccacctccacctcctccgcctccggagaagactcatttcggtggtctcaaggatgaagatcggattttcaccaacctctacggtctgcacgacccgtttctcaagggggcgatgaagagaggtgattggcataggaccaaagatttggtgctcaagggtactgattggattgttaatgagatgaaaaagtccggtcttcgtggacgtggtggtgctggtttcccttctggtcttaagtggtcctttatgcctaaagtctctgatggtcgtccttcttatttggttgtcaacgctgatgagagtgagcctgggacttgtaaagatagggagatcatgcgtcatgaccctcacaagctgttggaagggtgtttgattgctggtgttgggatgagagctagtgctgcttatatttacatcaggggtgagtatgtgaatgaacgtttgaatctagagaaggcgaggagagaggcntatgcagctggtctcttggggaagaatgcatgtggttctgggtatgatttcgatgtttatatccattttggagctggtgcctacatttgtggtgaagagactgcgcttcttgaaagccttgaagggaagcaaggaaaacctaggttgaagcctccgttccctgctaatgctggtttgtatggctgtcccactaccgttaccaatgtggagacggtggctgtttctcctaccattttaaggcgtggaccagagtggttttcgagttttggtaggaagaataactctgggacaaagctgttttgtatatccggccatgtgaacaagccatgtaccgttgaagaggagatgagtatccctctcaaggaactgattgagaggcattgtggaggtgttaggggtggatgggacaacctgcttgctatcattcctggaggttcatctgtccctttgattcctaagaacatatgcgaggatgtgctgatggatttcgatgcgctcaaggctgtccaatcagggctaggaactgcagcggtcattgtgatggataaatcaaccgatgttgtggatgcaatcgcgaggctctcttacttctacaagcacgaaagctgtgggcagtgcactccttgcagagagggaacaggttggctctggatgatcatggagagaatgaaagttggcaatgcaaagctggaagagattgatatgcttcacgaggtaaccaagcagatcgaaggacacacaatctgtgcattgggtgatgcagctgcatggccagtgcaaggtctgataaggcactttaggccggagcttgagagaaggatcagggaacgcgctgaaaaggagttgctacaggctgctgcttaaaacccttcttaacgacagggtatttgctatcattatcgatggaaataaaatctgaagcacattattagggttttggggatgcaaaactacttcagaaggagaagaaggtaatgtatttgttgaaatggttcatgttgaactttaatcaaactgtatcagaaagagactgtttgctcttttgcgtattctactttctttcaatgcgtgtttgtttttctcatgactatgctgagatcacattttgggaacaaccaaccaaagaaaaccttttcatatttgaaataatgtatgctctttttggggtttataatcaatcaatggttctatttggcta

SEQ ID NO: 3847 - DNA, 1877 bp, Brassica napus
cggcacgagggttcgtcggtctcaggtgccgttatcgccttcctcctctacttcccctccgtgtagccttctcgcttagaggaaccaatactaagtctcagctgtatccatggcacccatgaggggggttctcggcttgcagagagcagtatcaacttggaagggaagtaacagattagctccatctttgagatcattcagcaccacccaaggtgcgtccacttccgccactccacagccaccaccacctcctccgcctccggaaaagactcatttcggtggtctcaaggatgaagatcggattttcaccaacctctatggcctacacgacccttttctcaaaggagcgatgaagagaggtgactggtacaggaccaaagatttggtactgaaaggtactgattggattgttaacgagatgaaaaagtctggtcttcgtggacgtggcggtgctggtttcccttctggtcttaagtggtcttttatgcctaaggtttctgatggacgtccgtcttatttggttgtgaacgctgatgagagtgagcctgggacttgtaaagatagggagatcatgcgtcatgaccctcataagttgttggaagggtgtttgatcgctggtgttgggatgagagctagcgcggcgtatatttacatcaggggtgagtatgtgaatgagcgtttgaatctagagaaggctagaagggaagcttatgcagctggtctgttggggaagaatgcgtgtggttctggttatgatttcgatgtttatatccattttggagctggtgcgtacatttgtggtgaagagacagcgcttcttgagagtctcgaagggaagcaagggaagcctaggttgaagcctccgttccctgctaatgctggtttatatggttgtcccacgactgtcaccaatgtggaaacagttgctgtgtctcctactattctaaggcgtggacctgagtggttttcgagtttcggtaggaagaataacgctgggacaaagctgttttgtatctcagggcatgtgaacaagccatgtaccgttgaagaggagatgagcatacctctcaaggaactgattgagaggcattgtggtggcgttaggggtggatgggacaacctacttgctatcattcctggaggttcctctgtccctttgattcctaagaacatatgcgaggacgtgcttatggatttcgatgcgctcaaagctgttcagtcagggctaggaactgcagcggtcattgtgatggataaatcaaccgatgttgtggatgcaattgcaaggctctcgtacttctacaagcatgaaagctgtgggcagtgcactccttgcagagaagggacaggttggctttggatgatcatggagaggatgaaggttggcaatgcaaagctggaagagattgatatgcttcacgaggtaacgaagcagatcgaaggacacacaatctgtgcgttgggtgatgcagctgcatggcccgtgcaaggtctgataaggcactttaggcccgagcttgagagaaggatcagggaacgtgctgaaagggagttgctacaggctgctgcttaaaaatccttgctaaccacagggaatttgctattattctccatggaaataaaatctgaagcatactattagagtttttgggggttgcaaagctacttgagaaggagaagaaggtaatgtgtatttgtgttgaatgcttcatgttaaaactttattcaagttgtatcagaaagagctgtatttgctcttttgattagtctttctttcttcaatgtttgtttgttttattatgactatattgagagcacattttgggaacaaccaaacagaaccttttcatgattgaataaaggaagttccttatagg

SEQ ID NO: 3848 - DNA, 1451 bp, Ambrosia trifida
ggtacccatgaagggtattctctctctgcaacgggctgctttgttgaggcgtcgaaaatgggaactcgggggtaggtgctagattatttagcactcaatctgcaacaaccgctaataccgcacaacctccaccacctccccctcctcctgagaaaactcactttggtggcttgaaagatgaagaccgcatatttaccaacctttatggtatacatgacccgtttctcaaaggtgccatgaagcgtggtgattggtatagactaaagatttggtgatcaagggtactgactggatagtaaatgaaatgaaaaagtctggcctacgtggacgtggtggtgctggatttccatctggtctgaaatggtcatttatgcctaaggtatctgatggtcgtccgtcgtatctcgttgttaatgctgatgaaagtgaacctggaacctgtaaagacagggagattatgcgaaacgatccacataaacttctagaaggatgcttgattgctggagtgggtatgagggcaagtgctgcttatatttacattagaggtgagtatgtgaacgagcggcttaaccttgaaaaagccagaaaagaagcctatgcagctgggttacttgggaaaaacgcgtgcggttcgggttatgattttgatgtgcatatacactttggtgccggtgcttacatttgtggtgaagaaacggcacttctggagagccttgagggtaagcaaggaaaacctagattgaaaccccctttcccggctaatgcaggtctatacgggtgtccaacaactgttacaaatgtagaaacagtagctgtctcacctaccattttaagacgtgggcccgagtggttttctagtttcgggagaaagaacaattccgggacgaaactgttttgcgtatctggtcatgtgaacaagccatgcacagtcgaagaggagatgagcatatcattgaaggagctgctagagcgacattgtggcggtgttaggggcggatgggacaatttactggcggtaattcccggggggtcctctgtaccgttgcttcctaaacacatatgtgaggatgtcctgatggattttgatgcactcaaggctgtccagtcaggattaggtacagctgctgttattgtgatggataaatcaaccgatgttgtggatgccattgcacggctttcgtacttctataagcatgagagttgtggtcagtgtacgccttgtagagagggtaccggatggctttggatgatcatggaaaggatgaagactgggaatgcaaaattggaggagattgatatgctccaagaggtgactaagcagattgaaggacacacgatttgcgcattgggtgatgctgctgcttggcccgtttaaggtcttatcaggctattttaggcctgagctcgagaggaggatcaaggagcgcgctgaaagagagttgcttcaggca

SEQ ID NO: 3849 - DNA, 1553 bp, Rosa hybrid cultivar
aacttactttcttcccacttctctcaaatcttgttcattatcagacgcatcagggttcgtctgctgcgattcatgccatggcacccatcaagggtattcttaatctgcagagggcagttttagcccgacatcatggtgagaagtggggcctagggtataggttattgagcactcaggctgcatcaagttctactactcctcaacctccaccacctcccccacctccagagaaaacccattttggtggcttgaaagatgaagaccgaatttttaccaacttatatggattgcatgacccatttctcaaaggtgccatgaagcgaggtgactggcacagaaccaaagatttagttatcaaaggttctgattggattgttaatgaaatgaagaagtctggcctccgcggacgtggtggtgctggtttcccatctggcctcaaatggtcttttatgccaaaggtatctgatggtcgcccttcctatcttgttgtcaatgctgatgaaagtgaacctggaacctgtaaggacagggaaataatgcgccatgatccacataagcttttagagggttgcctgattgctggcgtagggatgagggccagtgctgcttatatctatataagaggtgaatatgtgaatgaacgattgaaccttgaaaaggccagaaaagaagcttatgcagctgggctactgggcaagaatgcttgtggatctggttatgactttgatgttcatatccattatggtgctggtgcttatatttgtggtgaagaaactgcacttctggagagccttgaaggcaaacagggaaagccaagattgaagcctcctttccctgctaatgcaggattatatggctgtcccactactgttacaaatgtggagacggtggctgtttctcccaccattttaaggcgtggaccagagtggttttccagttttgggaggaagaacaatgcagggacgaaattgttttgtatctcaggacatgttaacaagccttgcactgttgaagaggagatgagtatacccttgaaagaattattagagaggcactgtggaggcgtgaggggtggatgggataacttacttgcagtaattccaggtggttcatctgttccattgcttaccaaggacatatgtaatgatgtattgatggattttgatgcactgaaggctgtccaatctgggttggggactgctgctgttattgtgatggataaatcaactgacattgtggatgcaattgcacgactttcttacttctacaagcatgagagctgtgggcagtgcacaccgtgcagagaggggactggatggctttggatgatcatggaaagaatgaaagttgggaatgcaaagttggaagagattgacatgcttcaggaggtgaccaagcagattgaggggcacacgatctgtgctttgggtgatgctgctgcttggcctgtgcaaggtctgataaggcatttcaggccagagatggagaggaggatcagggagcgtgctgagagggagctgctggaggcagctgcctaatgtctttctcaggtt

SEQ ID NO: 3850 - DNA, 1839 bp, Helianthus annuus
cccccacccccttgggactccctgtacttcaatttctgatcgttatttctgaagctcgattgctacatttcgtgtcacatggcacccatgaagggcattctttctctgcaacgggctgctttgttgaggcgtcaaaatgttaattgggggctaggtactagattatttagcactcaatctgcaacaaccgctaataccgcacaaccaccaccacctccccctcctcctgagaaaactcacttcggtggtttgaaagacgaagaccgcatctttaccaacctttacggtattcatgacccgtttctcaagggtgccatgaaacgtggtgattggcacagaactaaagatctagtgatcaagggttctgattggatagtaaatgaaatgaaaaaatctggtctacggggacgtggtggtgctggatttccatctggtctcaaatggtcgtttatgcctaaggtatccgatggtcgtccatcctatcttgttgttaatgctgatgaaagtgaacccggaacatgtaaggatcgtgaaatcatgcgaaatgatccgcataaacttctagaaggatgcttgattgctggagttggtatgagggcaactgctgcttatatttacattagaggtgaatatgtgaatgaacgtcttaacctcgaaaaggccagaaaagaagcgtatgcagcagggttacttgggaaaaacgcttgtggttcgggttatgattttgatgtgcatatccactttggtgctggtgcgtacatttgcggtgaagaaaccgcacttttggagagccttgaaggtaaacaaggaaagccgagattgaagcccccgttccctgctaacgcaggtctatacggatgtcccacaactgttacaaatgtagaaacagttgctgtatcacctaccattttaagacgtgggcccgagtggttttctagtttcgggagaaagaacaattctgggacgaaactcttttgcatatctggtcatgtgaacaaaccgtgcacagtcgaagaggagatgagtataccattgaaggagctgctagagcggcattgtggcggtgttaggggcggatgggacaatttactggcggtaattcctggtggttcgtctgtaccattgcttactaaagacatatgtgaggatgtattgatggattttgatgcactgaaagctgtgcagtctggattagggactgcagctgttattgtgatggataaatctactgatattgtggatgccattgcaaggctttcgtacttttataagcatgagagttgtggtcagtgtacaccttgcagggagggtactggatggctttggatgattatggaaaggatgaaagttgggaatgctaagctggaggaaattgatatgcttcaagaggtgactaagcagattgaaggtcacacgatttgtgcattgggagatgctgctgcttggcccgttcaaggtcttatcaggcactttaggcccgaactcgagaggaggatcagggagcgtgctgatagagagttgcttcaggcagctgcttgattcaggcggagccctgcaatctgtggaataaacatgcagaagtaatcctggaggaaattgatgaaccttttacgagcatggtttaaatttaagatttgtattgaagtattatataatgtgactgaaagtagcatcctctttttgtaactggggaaacttttgttgtttcagtgtggtttaaggatacgaagacgtcctatgtttattattgaacatacttcatttagacatgttaataagccgaatgcattgttgtaatggtacattctcaagcttttgaaacctcaaatttctttgtta

SEQ ID NO: 3851 - DNA, 1651 bp, Ambrosia trifida
acccatctgctaacaattgggactcaacttcatctcccatttcgtttgattgctacattttgtggcatatggcacccatgaagggcattctttctctgcaacgggctgctttgttgaggcgtcaaaatgttaattgggggctaggtactagattatttagcactcaatctgcaacaactgctaataccgcacagccaccaccatctccccctcctccggagaagactcattttggtggtttgaaagatgaagaccgtatttttaccaacctttatggtatacatgacccgtttctcaagggtgctatgaaacgtggggattggtgcaggactaaagatctagtgatcaagggtgctgattggatagtaaatgaaatgaaaaaatctggtttacgtggacgtggtggtgctgggtttccatctggtctcaaatggtcgtttatgcctaaggtatctgatggtcgtccatcctatcttgttgttaatgctgatgaaagtgaaccaggaacatgtaaggatcgtgaaattatgagaaatgatccacataaacttttagaaggatgcttgattgctggagtgggtatgagggcaactgctgcttatatttacattagaggtgaatatgtgaacgagcggcttaaccttgaaaaagccagaaaagaagcctatgcagctgggttgcttgggaaaaacgcttgtggttctggttatgattttgatgtgcatatccactttggtgctggtgcttacatttgtggtgaagaaacagcacttttggagagccttgaaggtaaacaaggaaagcctagattgaagccccctttccctgctaacgcaggtctatacggatgtccaacaactgttacaaatgtagaaacagttgctgtatcacctacgattttaagacgtgggcccgagtggttttctagttttgggagaaagaacaattctgggaccaaactattttgcatatctggtcatgtgaacaagccgtgcacagttgaagaggagatgagtataccattgaaggagctgctagaaaggcattgtggcggtgttaggggcggatgggacaatttactggcagtaattcctgggggttcatctgtaccattgcttactaaagacatatgtgaggatgtcctgatggattttgatgcactgaaagctgtgcagtctggattagggacagcagctgttattgtgatggataaatctactgatattgtggatgccattgcaaggctttcttacttttataagcatgagagttgtggtcagtgtacaccttgcagggagggtacaggatggctttggatgattatggaaaggatgaaagttgggaatgcaaagttggaggaaattgatatgctccaagaggtgactaagcagattgaaggtcacacaatttgtgcattgggagatgctgctgcttggcccgttcaaggtcttatcaggcacttcaggccagaactcgagaggaggatcagggagcgtgctgatagagagttgcttcaggcagctgcttgattcaggtggagctcagcaatatgtggaataaatatgcagaagcaatcctggagggtattactgaaccttttacaagcatggtttaaatttaaggtttgtatcgaagtacgatgttaccgaaa

SEQ ID NO: 3852 - DNA, 2013 bp, Brassica rapa
aaaccatactactaaagactaattcataaaacatactactaagagtgaattgattatatgggccaagcccaataaaggcctagaaacatagaaaggttaacgtcacgaagacgcggactaatctgaaccaagcagttatctcgagttcgtcggtctcaggtgccgttatcgccttcctcctctacttcccctccgtgtagccgtctcgcttagaggaaccaatactaagtctcagctgtatccatggcacccatgagggggattcttggcttgcagagagctgtatcaatctggaaagagagtaacagattggctccatctttgagatcattcagcaccacccaaggtgcctccacttccaccactccacagcccccaccaccacctccgcctccggaaaagactcatttcggtggtctcaaggatgaagatcggattttcaccaacctctatggtctacacgacccttttctcaaaggagcgatgaagagaggtgactggtacaggaccaaagatttggtgctcaagggtactgattggattgttaatgagatgaaaaagtctggtcttcgtggtcgtggtggtgctggtttcccttctggtcttaagtggtcttttatgcctaaggtttctgatggacgtccgtcttatttggttgtgaacgctgatgagagtgagcctgggacttgtaaagatagggagatcatgcgtcatgaccctcataagttgttggaagggtgtttgatcgctggtgttgggatgagagctagcgcggcgtatatttacatcaggggtgagtatgtgaatgagcgtttgaatctagagaaggctagaagggaagcttatgcagctggtctgttggggaagaatgcgtgtggttctggttatgatttcgatgtttatatccattttggagctggtgcgtacatttgtggtgaagagacagcgcttcttgagagtctcgaagggaagcaagggaagcctaggttgaagcctccgttccctgctaatgctggtttatatggttgtcccacgactgtcaccaatgtggaaacagttgctgtgtctcctactattctaaggcgtggacctgagtggttttcgagtttcggtaggaagaataacgctgggacaaagctgttttgtatctcagggcatgtgaacaagccgtgtactgttgaagaggagatgagtatacctctcaaggaactgattgagaggcattgtggaggtgttaggggtggatgggacaacctacttgctatcattcctggaggttcctctgtccctttgattcctaagaacatatgcgaggacgtgcttatggatttcgatgcgctcaaagctgttcagtcagggctaggaactgcagcggtcattgtgatggataaatcaaccgatgttgtggatgcaatcgcgaggctctcgtacttctacaagcatgaaagctgtgggcagtgcactccttgcagagagggaacagggtggctctggatgatcatggagaggatgaaagttggcaatgcaaagctggaggagattgatatgcttcacgaggtaactaagcagatcgaaggacacacaatctgtgcattgggtgatgcagctgcatggcccgtccaaggtctgataaggcactttaggccggagcttgagagaaggatcagggaacgcgctgaaagggagttgctacaggctgctgcttaaaaatccttgctaaccacagggaggttgttattattctccatggaaataaaatctgaagcacattattagagtttttgggttgcaaagctacttcagaaggagaagaaggtaatgtatttgtgttaaatggttcatgttaaaactttattcaagttgtatcagaaagagctgtatttgctcttttgattactctactttattcaaatgtttgtttttttcttctgagtatattgagagcacattttgggaacaaccaaacaaaactttttcatttgaaataaaggatgcttctttcttgggtttaaa

SEQ ID NO: 3853 - DNA, 1903 bp, Helianthus annuus
aacccagttccccttactcatccggttaccaataaaacccattttacgccgttggatcccccacccccttgggactccctgtacttcaatttctgatcgttatttctgaagctcgattgctacatttcgtgtcacatggcacccatgaagggcattctttctctacaacgggctgctttgttgaggcgtcaaaatgttaattgggggctaggtactagattatttagcactcaatctgcaacaaccgctaataccgcacaaccaccaccacctccccctcctcctgagaaaactcacttcggtggtttgaaagacgaagaccgcatctttaccaacctttacggtattcatgacccgtttctcaagggtgccatgaaacgtggtgattggcacagaactaaagatctagtgatcaagggttctgattggatagtaaatgaaatgaaaaaatctggtctacggggacgtggtggtgctggatttccatctggtctcaaatggtcgtttatgcctaaggtatctgatggtcgtccatcctatcttgttgttaatgctgatgaaagtgaacccggaacatgtaaggatcgtgaaatcatgcgaaatgatccgcataaacttctagaaggatgcttgattgctggagttggtatgagggcaactgctgcttatatttacattagaggtgaatatgttaacgaacgtcttaacctcgaaaaggccagaaaagaagcgtatgcagcagggttacttgggaaaaacgcttgtggttcgggttatgattttgatgtgcatatccactttggtgctggtgcgtacatttgcggtgaagaaaccgcacttttggagagccttgaaggtaaacaaggaaagccgagattgaagcccccgttccctgctaacgcaggtctatacggatgtcccacaactgttacaaatgtcgaaacagttgctgtatcacctaccattttgagacgtgggcccgagtggttctctagtttcgggagaaagaacaattctgggacgaaactcttttgcatatctggtcatgtgaacaaaccgtgcacagtcgaagaggagatgagtataccattgaaggagctgctagagcggcattgtggcggtgttaggggcggatgggacaatttactggcggtaattcctggtggttcgtctgtaccattgcttactaaagacatatgtgaggatgtattgatggattttgatgcactgaaagctgtgcagtctggattagggactgcagctgttattgtgatggataaatctactgatattgtggatgccattgcaaggctttcgtacttttataagcatgagagttgtggtcagtgtacaccttgcagggagggtactggatggctttggatgattatggaaaggatgaaagttgggaatgctaagctagaggaaattgatatgcttcaagaggtgactaagcagattgaaggtcacacgatttgtgcattgggagatgctgctgcttggcccgttcaaggtcttatcaggcactttaggcccgaactcgagaggaggatcagggagcgtgctgatagagagttgcttcaggcagctgcttgattcaggcggagccctgcaatctgtggaataaacatgcagaagtaatcctggaggaaattgatgaaccttttacgagcatggtttaaatttaagatttgtattgaagtataatataatgtgactgaaagtagcatcctctttttgtaactggggaaacttttgttgtttcagtgtggtttaaggatacgaagacgtcctatgtttattattgaacatacttcatttagacatgttaataagccgaatgcattgttgtaatggtaaaaaaaagaggatgctactttcagtcacattatacttcaataca

SEQ ID NO: 3854 - DNA, 1661 bp, Triphysaria pusilla
ttgatgccaccatggcacctataaagagcattctttctctgcaaaggactttcctcttcaacgtgcaagtgaaaactggggcccagcaaggagattactcagcacccaggctgcaaccacttctccgaccccacaggccccacccccacccccacctcccgagaaaacccacttcggcggcctgaaagacgaggatcgcatcttcactaatctatatggaatacatgatccctttctcaagggcgccatgaaacgaggtgactggcaccggactaaagacctagtgctcaagggaactgattggattgtcaacgagatgaagaaatccggcctccgtggccgcggtggggccggtttcccatcggggctaaaatggtcattcatgcccaaggtctccgacggccgtccctcgtaccttgtcgtcaacgccgacgagagtgagcccgggacgtgcaaggatagagaaatcatgcgtcacgacccgcataaattgttggaaggctgtttgatagccggagtcggaatgcgtgccagcgcagcgtatatttatatccggggcgagtacgtgaacgagaggctgaacctcgagaaagcccggaaagaagcttacgcagctgggctactgggaaagaacgcgtgcgggtcgggctacgatttcgacgtgcacatccatttcggggccggggcttatatttgcggcgaggagactgcgcttcttgaaagcctcgagggtaaacagggaaaaccgaggctcaagccgccttttcccgccaacgcgggcctttacggctgcccgacgaccgttaccaatgtcgagactgtagctgtttctccgacgattttaagacgcgggcccgagtggttctctagcttcgggaggaaaaacaattccgggacgaagctgttttgtatctcgggccatgtgaataagccctgcacggtcgaggaggagatgagtatctcgttaaaggagcttctcgagaggcattgcggtggggtccgtggcgggtgggataatttgctggcggttattcctggcggttcgtctgttcctttacttccgaagaatgtttgcgaggatgttctgatggatttcgacgcgctaaaggctgtgcagtcgggtttggggacagctgctgtgatcgtgatggataagtcgacggacgttgtggatgcgatctcgaggctgtcgtatttttacaagcacgagagctgtgggcagtgcacgccgtgtagggaagggacgggatggctgtggatgataatggagaggatgaaggtgggaaatgcgaagctggaggagattgatatgctgcaggaggtgacgaagcaaatcgaggggcacacgatttgtgcgttgggtgatgcagcagcttggccggttcaggggctgattaggcattttagaccggagatggagaggaggattagggagcgggcggaaagggagttgcagcaggctgccgcggcttgatttcttcggtaatgcatttgctgaaagatcattgttgaataaagtgaagatacgttttccgaattctatctatattctatcgttcgactttgtagtgttgtattgcataattgactaagattctacattgatatatttcgagtaccatatggtgtttatgcttgaaaagaacctttcgattagtttg

SEQ ID NO: 3855 - DNA, 2018 bp, Musa acuminata
gaccggagaggtcgactcgaagcttttagtgctccgggcgtttgtacctcacgacaatcttcgatcccagttgcgctcttccgattgccaatccgcttttgcatggagtgatcgactgatcgcgtgaggcgggcagcgcattatttttgacaaacatgtcggcaattggaagtggatccgcacccatcaagaacctttgtttgctatataggactgaactggttcatcatttcagtggctggaggttaagttctgcttctaggtcattaagcacacaagctgcaacaacaggaaatacacctcagcccccaccaccacctccacctccagaaaagactcattttggtggtttgaaggatgaagatcgcatttttaccaacctttatggtttgcatgatcctttgctcaaaggtgccatgaagcggggtgactggtatagaaccaaggatttggtaattaagggtagtgactggattgttaatgaaatcaagaaatctggtctacgaggtcgtggaggagctggttttccatctggccttaagtggtctttcatgccaaaggtatctgatggccgcccttcttatcttgtcgtcaatgctgatgaaagtgaacccggtacatgtaaggacagagaaatcatgcgccatgatcctcataaactgcttgaagggtgtttgattgctggagttggtatgaaggcaacagctgcttacatatacattagaggggagtacgtaaatgagcgattgactttggagaaagctagaaaagaagcatatcaagctggattgttgggaaggaatgcttgtggatcaggttatgattttgatgtgcatatacactatggtgccggtgcttacatctgcggtgaagagacagcattgttggagagccttgaagggaaacaagggaaaccaagactgaagcctcctttcccagctaatgccggattatatggctgcccaacaactgtaacaaatgtggagactgtggctgtttctcccacaattttgcggcgagggcctgaatggtttgcaagctttggccggaaaaataattctggtacaaaactattctgtatttctggtcatgtgaataaaccttgcacggtggaggaggagatgagcatcccattgaaggaattgctcgagaggcattgtggtggtgttagaggaggttgggacaaccttttggcagtcatcccaggaggttcctctgttcctctccttcccaagcacatttgtgatgatgtcctgatggattatgatgctctcaaagctgttcagtctggactgggtacggcagccgtgatcgtgatggacaagtccacagatgttgtggatgcaatagcaaggctgtcttacttctacaagcatgaaagctgtggtcagtgcacaccttgcagggaggggactggatggctgcggatgattatggagaagttgaaggtggggaatgccatgctggaggagattgatatgcttcaggaagtcacaaagcagattgaagggcacactatatgtgctctgggtgatgctgctgcatggcccgtgcaggggcttatcaggcattttaggccagaactagaaaggaggatcaaggagagagcgcagaaagagctcttggaggctgcagctgcttgagtcctctggtttgaccatgtcgaagtgcctactttttagcttacgtacgaaaataatgaactgcagtatgaaaaatgcagcctttgtgcttcttcggacactgtccttgatgcaacagaaccatttttctgagcttttcctagagcaggtctcatgcagctccgtggccaaaaccctgaaacttcaggttctggaataatttcctttctaccttcaagctgagaattcatttattgtgtcattaaaactttaaattcagtgaaataaaatctgttcaactttcctaaaccatttggctgctttagtatacatttcaaataacagtgatgataacttgatctagtccagtctggtgataacaatccagaatccttc

SEQ ID NO: 3856 - DNA, 1616 bp, Ambrosia trifida
aaccgttcaataacccacactggttcatctcataatgcatacaaaacccataatttgatcctccatgttctcgaaaatcttcaccataaatcgaaactcaattgagaagctttattaattgttattgctacatttcgtagggtacccatgaagggcatactttctctgcaacgggctgctttgttgaggcgtcaaaatgggaactcgggggtaggtgctagattatttagcactcaatctgccacaactgcgaataccgcacagcctccaccgcctccccctcctccggagaaaactcactttggtggcttgaaagatgaagaccgcatatttaccaacctttatggtatacatgatccatttctcaaaggtgccatgaagcgtggtgattggtatagaactaaagatttagtgatcaagggtactgactggatagtaaatgaaatgaaaaggtctggcctacgtggacgtggtggtgctggatttccatctggtctcaaatggtcatttatgcctaaggtatctgatggtcgtccgtcgtatcttgttgttaatgctgatgaaagtgaacctggaacctgtaaagacagggagattatgcgaaacgatccacataaactgctagaaggatgcttgattgctggagtgggtatgagggcaagtgctgcttatatttacattagaggtgagtatgttaacgagcggcttaaccttgaaaaagccagaaaagaagcgtatgcagctgggttacttgggaaaaacgcatgtggttcgggttatgattttgatgtgcatatacactttggcgctggtgcttacatatgtggtgaagaaacagcacttctggagagccttgagggtaagcaaggaaaacctagattgaaaccccctttcccagctaatgcaggtctatacgggtgtccaacaactgttacaaatgtagaaacagtagctgtctcacctaccattttaagacgtgggcccgagtggttttctagtttcgggagaaagaacaattccgggacgaaactattttgcatatctggtcatgtgaacaagccatgcacagtcgaagaggagatgagcatatcattgaaggagctgctagagcgacattgtggcggtgttaggggcggatgggacaatttacttgcagtaattcctggtggttcctctgtaccgttgcttccaaaacacatatgtgaggatgtcctgatggattttgatgcactcaaggctgtccagtcaggattaggtacagctgctgttattgtgatggataaatcaaccgacgttgtggatgccattgcacggctttcttacttctataagcatgagagttgtggtcagtgtacaccttgtagagagggtactggatggctttggatgatcatggaaaggatgaagactgggaatgcaaaattggaggagattgatatgctccaagaggtgactaagcagattgaaggacacacgatttgcgcattgggtgatgctgctgcttggcccgttcaaggtcttatcaggcattttaggcctgagctcgagaggaggatcaaggagcacgctgaaagagagttgcttcaggcaactggttgaatcaggccaaaaaatgt

SEQ ID NO: 3857 - DNA, 1740 bp, Ambrosia trifida
aaaatgttaattgggggctaggtactagattatttagcactcaatctgcaacaacttctaacaccgcacagccaccaccacctccccctcctccggagaagactcattttggtggtttgaaagatgaagaccgtatttttaccaacctttatggtatacatgacccgtttctcaagggtgctatgaaacgtggtgattggcacaggactaaagatctagtgatcaagggtgctgattggatagtaaatgaaatgaaaaaatctggtttacgtggacgtggtggtgccgggtttccatctggtctcaaatggtcatttatgcctaaggtatccgatggtcgtccatcctatcttgttgttaatgctgatgaaagtgagccaggaacatgcaaggatcgtgaaattatgcgaaatgatccacataaacttctagaaggatgtttgattgctggagttggtatgagggcaactgctgcttatatttacattagaggtgaatatgttaacgaacggcttaaccttgaaaaggccagaaaagaagcatatgcagcagggttacttgggaaaaacgcttgcggttcgggctatgattttgatgtgcatatccactttggtgctggtgcttacatttgtggtgaagaaacagcacttttggaaagccttgaaggtaaacaaggaaagcctagattgaagccccctttccctgctaacgcaggtctatacggatgtcccacaactgttacaaatgtagaaacagttgctgtatcacctaccattttaagacgtgggcccgagtggttctctagttttggaagaaagaacaattctgggacaaaacttttttgcatatctggtcatgtgaacaaaccctgcacagtcgaagaggagatgagtataccattgaaggagctgctagaaaggcattgtggcggtgttaggggcggatgggacaatttactggcggtaattcccgggggttcatctgtaccattgcttactaaagacatatgtgaggatgtcctgatggattttgatgcactgaaagctgtgcagtctggattagggactgcagctgttattgtgatggataaatctactgatattgtggatgccattgcaaggctttcttacttttataagcatgagagttgcggtcagtgtacaccttgcagggagggtacagggtggctttggatgattatggaaaggatgaaagttgggaatgcaaagttggaggaaattgatatgctccaagaggtgactaagcagattgaaggccacacaatttgtgcattgggagatgctgctgcttggcccgttcaaggtcttatcaggcacttcaggcctgaactcgagaggaggatcagggagcgtgctgatagagagttgcttcaggcagctgcttgattcaggtgaagctctgcaatatgtggaataaatatgcagaagcaatcctggacgatattactgaaccttttacaagcatagtttgaatttaaggattgtatcgaagttcgatgtgactgaaaatagcatcctccctttgtaaccggggtaacctttgttgtttcgttgtgttttaaggatacgaggacatcctatgtttattattgaaacatacttcatttagacatgttaataagccgaatgcaatgttgtaatggtacaatttcaagcttttgaaaacttgaatttctttgttgttagaagcaactgcaagtaaattaacttattggagtac

SEQ ID NO: 3858 - DNA, 1839 bp, Arnica chamissonis
catagttgaatcgctgattgttatttctgaagcttgattgcagcatttcgtggtgtatggcacccatgaagggcattctttctctgcaacgggctgctttgttgaggcgtcaaaatgttaattgtgggctaggtactagattatttagcactcaatctgcaacaaccggtaataccgcacagccaccaccacctcctcctcctcctgagaaaactcactttggtggtttgaaagatgaagaccgcatttttaccaacctttatggtattcatgacccttttctcaaaggtgccatgaaacgtggtgattggcacagaactaaagatctagtgatcaagggtactgattggatagtaaatgaaatgaaaaaatctggtctgcgtggacgtggtggtgctggatttccatctggtctcaaatggtcatttatgcctaaggtatccgatggtcgtccatcctatcttgttgttaatgctgatgaaagtgaacccggaacgtgtaaggatcgtgaaatcatgcgaaatgatccacataaacttctagaaggatgcttgattgctggagttggtatgagggcaactgctgcttatatttacattagaggtgaatacgtgaatgaacgccttaaccttgagaaggccagaaaagaagcctatgcggctgggttacttgggaaaaacgcttgtggttcaggttatgattttgatgtgcatatccattttggtgctggtgcttacatttgtggtgaagaaacagcacttttggaaagccttgaaggtaaacaaggaaaacctagattgaaacctcctttcccggctaattcaggtctatacggatgtcctacaactgttacaaatgtagaaacagttgctgtatcacctaccattttaagacgtgggcccgagtggttttctagttttgggagaaagaacaattccgggacgaaacttttttgcatatctggtcatgtgaacaaaccgtgcacagtcgaagaggagatgagtataccattgaaggagcttctagagcggcattgtggtggtgttaggggtggatgggacaatttactggctgtaattcccgggggttcatctgtaccattgcttcctaaaaatgtatgtgaggatgtcctcatggattttgatgcacttaaagctgtgcagtctggattagggactgcggctgttattgtgatggataagtcaaccgatgttgtggatgccattgcaaggctttcttacttctataagcatgagagttgtggtcagtgtacaccttgtagggagggtactggatggctttggatgattatggaaaggatgaaagttgggaatgcaaagctggaggaaattgatatgcttcaagaggtgactaagcagattgaaggacacacaatttgtgcattgggagatgctgctgcttggcccgttcaaggtcttatcaggcattttaggcccgaacttgagaggaggatcagggagcatgctgatagagagttgcttcaggcagctgcttgattcaggccgaagcatttccagcactgcaatcttgtttaataaatatgcagaagtggtcctggaggaaatcaatgaaccctttacgaacatccttaaaatttaaggtttgtattgaattacgatgcggttgaaaatagcatcctctgttataaccgggttgacttttgttgtttggttgtgtttaaggatacagtgacctgtttattattgaagttcatttagacatgttaataagcagaatgcaatgttgtaatggtacaatctcaagcttttgaaacctcaaaatgtatgtcttgttacatgcaagtaagtaaattatcat

SEQ ID NO: 3859 - DNA, 1926 bp, Musa acuminata
gggtgaccggagaggtcgactcgaagcttttagtgctccgggcgtttctacctcacgacaatcttcgatcccagttgcgctcttccgattgccaatccgcttttgcatggagtgatcgactgatcgcgtgaggcgggcagcgcattatttttgacaaacatgtcggcaattggaagtggatccgcacccatcaagaacctttgtttgctatataggactgaactggttcatcatttcagtggctggaggttaagttctgcttctaggtcattaagcacccaagctgcaacaacaggaaatacacctcagcccccaccaccacctccacctccagaaaagactcattttggtggtttgaaggatgaagatcgcatttttaccaacctttatggtttgcatgatcctttgctcaaaggtgccatgaagcggggtgactggtatagaaccaaggatttggtaattaagggtagtgactggattgttaatgaaatcaagaaatctggtctacgaggtcgtggaggagctggttttccatctggccttaagtggtctttcatgccaaaggtatctgatggccgcccttcttatcttgtcgtcaatgctgatgaaagtgaacccggtacatgtaaggacagagaaatcatgcgccatgatcctcataaactgcttgaagggtgtttgattgctggagttggtatgaaggcaacagctgctcacatatacattagaggggagtacgtaaatgagcgattgactttggagaaagctagaaaagaagcatatcaagctggattgttgggaaggaatgcttgtggatcaggttatgattttgatgtgcatatacactatggtgccggtgcttacatctgcggtgaagagacagcattgttggagagccttgaagggaaacaagggaaaccaagactgaagcctcctttcccagctaatgccggattatatggctgcccaacaactgtaacaaatgtggagactgtggctgtatctcccacaattttgcggcgagggcctgaatggtttgcaagctttggccggaaaaataattctggtacaaaactattctgtatttctggtcatgtgaataaaccttgcacggtggaggaggagatgagcatcccattgaaggaattgctcgagaggcattgtggtggtgttagaggaggttgggacaaccttttggcagtcatcccaggaggttcctctgttcctctccttcccaagcacatttgtgatgatgtcctgatggattatgatgctctcaaagctgttcagtctggactgggtacggcagccgtgatcgtgatggacaagtccacagatgttgtggatgcaatagcaaggctgtcttacttctacaagcatgaaagctgtggtcagtgcacaccttgcagggaggggactggatggctgtggatgattatggagaagttgaaggtggggaatgccatgctggaggagattgatatgcttcaggaagtcacaaagcagattgaagggcacactatatgtgctctgggtgatgctgctgcatggcccgtgcaggggcttatcaggcattttaggccagaactagaaaggaggattaaagagagagcgcagaaagagctcttggaagctgcagctgcttgagtcctctggtttgaccatgtcgaagtgcctactttttagcttacgtacgaaaataatgaactgcagtatgaaaaatgcagcctttgtgcttcttcggacactgtccttgatgcaacagaaccatttttctgagcttttcctagagcaggtctcatgcagctccgtggccaaaaccctgaaacttcaggttctggaataatttcctttctaccttcaagctgagaattcatttattgtgtcattaaaactttaaattcagtgaaataaaatctgtgcaac

SEQ ID NO: 3860 - DNA, 5544 bp, Ricinus communis
aatcaaaacgcacagcaaagcattaatagcatctcatcgaatcacagccgttcactgtgtgtcgcggcaccccggcggcatcacaacgtgttgctcataaaaatcacacgcaataaacgatcatcaccgtccatttagcatactccaagtcgcgagcgactagggaactacagatacacctttcttcgttctctaccttcttagtgcttgttgcctatctcgatttggcgtaatcgccggtttgaaaaacgctaatctgcgacgcttctcgctaatggcacccattaggggcatttttaatttgcaaagagctgctttgattcggcgtcaaagtgataggttggctgtaggtatcagatcattcagcactgaagctacaaaaagtgctggtagttcccagcctctccctcctccaccacctccggagaaaacccattttggtggcttgaaagatgaggaccggatttttaccaacttgtatgggttgcatgacccttttctaaaaggtgctatgaaacggggtgattggtatagaactaaggacttggtgctcaagggtgctgattggattgttaatgaagtgaagaagtctggtcttcggggacgtggtggtgctggtttcccctctggtcttaaatggtcgttcatgccaaaagtgtctgatggtcgcccctcttatcttgttgtcaatgctgatgaaagtgaacctggaacttgtaaagatagggaaattatgaggcatgatccacataagctgttagagggctgcttaattgctggggtgggaatgagagcatctgccgcttatatctacattaggggtgaatatgtgaatgaacggataaacttggaaagagctcgaaaagaagcttatgcagctggattgttaggcaagaatgcatgtggatctggctatgattttgatgttcatatccactatggtgccggtgcttatatatgtggtgaagagactgcacttttagaaagtctagaaggaaaacaagggaaaccaaggctgaagcctcccttcccagctaatgcaggactgtatggctgtcccactactgttacgaatgtggaaacagtggctgtttctcccactattttgaggcgtggaccagagtggtttgctagttttggcaggaagaacaattctggtacaaaattgttttgtgtgtcaggtcatgtgaataagccttgcacagtcgaagaggagatgagtatacctctaaaagagttaatagagaggcactgtggaggtgttagaggtggatgggacaatctacttgcagtaatacctgggggttcttctgtccctttgcttcccaagcacatatgtgatgatgtgctgatggattatgatgcactcaaggctgtcacgtcaggactggggactgcagctgtgatcgtaatggataaatctactgatgttgtggatgcaattgcaaggttgtcttatttctacaagcatgagagttgtgggcagtgcacaccgtgcagggaggggacaccgtggctttggatgatcatggaaaggttgaaggtcgggaatgcaaagttggaagagatagatatgcttcaagaggtcacaaaacaaatcgaagggcacactatctgtgcgctgggtgatgctgcagcttggcctgtgcagggtcttataaggcattttaggccagaacttgaaagaaggattaaggagcgagcggagagggagttgctggaagctgctgcttaagggaaatggagacattgctgaataaatgaagaattactgtttagtttgatcaatagttcactctggcatatggagctctcttgtttgttttaaagctgtgtatcaaatatgaactaatttcactgctccagagaaataatgatttgtctgggaagcgacaatttgctgttagttcatgtgatttaacaatctttctagacacattttgaaggaggagaagaaacattgttaataacatccctattttactctctacaggtttcttttttgtgttccagcggatatgcttgacacattcaattgattaacttaaagtacttctcaatgaaataatgatcaagccattcaagcatgtatattgagcattggcgaaggaaggagactggcaaaagaaaagcattaataatgatagcagcattccttacaaaatccattcggcaacacattaaatacacaaaaagagaaatcaacatgactaaaaaccataagaagcaacaaaattcttaacaacaattaccttaaaccccaccgaactttgtcccacaaatgatctaggaaatgaaaatatgcatgcctccattgtctgttaaccactaacggaccaaatgctccccaaaatcccacaatgaatccaagtgccatgctcacatagaacccattcacttcaaaaccaccgtcactttttctattttcatttgaactttcagttctaggttgaactccaggtacagtgcaattgtttgtcaatggaggtccgcagaggcctttgttcccggtgaaactagaagcattaaaactctgcaactgagtgcctgtaggaattgtgccgctcaagttgttatctgataggttcaagtcgctcaaatatgtcaattttgtcatgctttgagggatttctccgaataattgattttgtgaaaaatcaatagcttccacctcaaccatagcaccaatatcctcaggaattcttcctgataaaagattatccgataaattcaacgattgtagtcctataagttttgtcagtacctctggaatgtctcccgataaattgttgccagaaagatctaaactttttacaaatccaagaatagagaaatactcaactattcttcctttcgacacaattgtagcataatctgaagcagatgcataaaggctccgataaccatagaagctagctgcaggattactggtagtcatagcacttaacttgtcaatacagctcggaatagtccgagcgagatcattgtgagcaagatctaggatttgtagagaggctaattggcaaagttccggaggtatatggccatgaaatttattttcacggaggttgagaaaagccatagatggaaaacttgcacccatccaaggtggaatgtgccctatgagttgattttctccaaggtcaagagagactaaagatgtacaatctcttagtgacaatggtatttctcctgaaaggctattattgcgaagatgcaaagacttaaggaaggttaaagttccaattgacctgggaatattgccactaaaattgttgttgcttaatcttatgtactctaagtttgaccaactagaccaacaatctcgtatttgtccagacaaaaaattattatcaaggttaataagtctcattctcttcaccttgtggatcttgcgacatacgaagtgtgatatagaacctgagaataaattattagaaagatataaatcagttacattggaggagacatggggcagtggtccttgaaaatgattcgaactcaagtcaattgttgagtaatagtagtaatgagaaaagtaaggaatatctggaatgtttccataaatttggttgtgggagagatttaagtaaaaaagttgtgaagatgagttccaaaaccaaaatggaatgttactcgaaattttagagttcgacaaatccaaaacagctaaggacttcagcaaagaaagccaccttggaaattgtgggccaatagcccaagaacttaattgcaagacttggaggtgaattggaggtggaatccaatcagaactaactctcaacatcaaatgattctcggatgcatcaaagtatcttaattttatcagttttgcaaaatgaatgtctgaaacattaccttccaataaattgtcagaaatgcttaacgactccaaatttgtaagccctccaagagaaacaggcatacttccattcaatttgttattatcaaggtacaaatatctcaaggacatcaattctcccaaagccaatggaattggaccggagatggaattagatgaaaggtaaaggctgaccaaagccttaaaatggataaggtgattgctcaactgaccaaataaatgacatccacttaatctcaatgactccagcccatttgaaacacatccttgtagaatctcaaggacggcatttatgtcttggcttagtttgagactttccaaagaaagggacttcaaattgcaaagatttttgaaggatgttggaattcctccttcaagttgaagatctgaattgagtgacaagtcaaggctagcgagagaggtcatgtttccaatggtgctcggaattttaccttgcaaggcattggaaacaagactgagaagctcaagatgaggtaaattgaataaacaatcggcaccgaagaattgaaatcattgacagagaggtcaagttcctgaagtgaagtcatgtttcgaaaatctttagggattggtccgtaaaagaagttgcgcgctaaattaagagatttgagagatttaagaagaaatatccatttaggaactaaagaaaaagaattccatgacaaatcaagaatagaaagagatgaaaagttgacatttactaatgacggaataggaacaagctcgcaacctgacaagtgcacttcttctagaaaagggagcgtgttcatcacttccaaccaattgaagctttggctaagctccacataactcaaatcaaggaattctagcaaagaaagactagaaagccaatggaaactgtcaacatataatgtcccatagcccgagagctcattgagattaagatattgcaaattggaaagattggccagttcatgaggaatcattcccccaaatcctgcaccagagagattaaggtatcttaaactccctatagagccaaggaatttgggaatttgaattcctccaaaatcattattgcttaaatctaagaacctcaattccttcaagttgagcaaagatggactaatcttaccaccaaatgttgacttcatgcggtactcttcataatcatatcggccgagatcataatattcttggtgcgatagacttcgaagatggagttcaagaacatggccagttaagttgtcgcaaatgactccagaccaactgcaacaatctccatcaccaacccatgttgtaagcctttttgaaggatctttgagctcatgcttgaacttcaagagggcttctctttcgctcggactgcaccctgaaatattaaaactcccatagcagaagccaagactagtggttgcaatgaagaaaaaacaaaagaaaggaattataagtataccactcattgattttcccatgaacattcacttcactgcaagaatctttgcctaagggttgcctttttatagtgctctacaattgtaagctttacacttgaaagatgtccaagcataattgctggataagtagtacttagaagatgtgtgggagcatcatcctctcatcttcagcttgcatagaaatttcaaaagttatattgtgattagttttgattgataacaaatcaaggtcactaaattggc

SEQ ID NO: 3861 - DNA, 1815 bp, Flaveria ramosissima
tcgtcaggcttttgcgaacaattgggagtcaagttcacctcctttcacttcaaattcttcaccatagttgaatcgctgatcgttgtttctgaagcttcattgctacattttgtggcgtatggcacccatgaagggcattttttatctgcaacgggctgctttgttgaggcgtcaaaatgtattgggggctaggtactagattatttagcactcaatctgcaacaaccgctaacaccgcacagccaccaccacctccccctcctcctgagaaaactcactttggtggcttgaaggatgaagaccgcatttttaccaacctatatggtatacatgacccgtttcttaaaggtgccatgaaacgtggtgattggtacagaactaaagatctagtgatcaagggctctgattggatagtaaatgaaatgaaaaaatctggtttacgtggacgcggtggcgctggatttccatctggtctcaaatggtcatttatgcctaaggtgtctgatggccgtccatcctatcttgtggttaatgctgatgaaagtgaacccggaacatgtaaggatcgtgaaatcatgcgaaatgatccacataagcttcttgaaggatgcttgattgctggagttggtatgagagcaactgcagcttatatttacattagaggtgaatatgtgaacgaacgccttaaccttgaaaaggccagaaaagaagcctatgcagctgggttacttggaaaaaatgcttgtggttcgggttatgattttgatgtgcatatccactttggtgctggtgcttacatttgtggtgaagaaacagcacttttggagagccttgaaggtaagcaaggaaaaccaagattgaaaccccctttccctgctaatgcaggtctatatggatgtcccacaactgttacaaatgtggaaacagttgccgtatcgcctaccattttaagacgagggcctgaatggttttctagttttgggagaaagaacaactcggggacgaaacttttttgcatatctggtcatgtgaacaaaccgtgcactgtcgaagaggagatgagtatacctttaaaggagctgctagagcggcattgcggcggtgttaggggcggatgggacaatttactggcagtaattccagggggttcatctgtaccgttgcttcctaaacacatatgtgaagatgtactgatggattttgatgcattgaaggctgtgcaatctggattagggactgcagctgttattgtgatggataagtcaactgatgttgtggatgccattgcaaggctttcttacttttataagcatgagagttgtggtcagtgtaccccttgcagggagggtactggatggctttggatgattatggaaaggatgaaagttgggaatgcaaagcttgaggaaattgatatgcttcaagaggtcactaagcagattgaaggacacacaatttgtgcattgggagatgctgctgcttggcctgttcaaggccttatcaggcattttaggcccgaactcgagaggaggataagggaacatgctgatagagagttgcttcaggcagctgcttgattcaggttgaagagcttgcagccctgcaatctgtggaataaatatgcacaagtcatcctagaggaatctggaaatcgatgaaccccttgcgagcatcttggtttaagtttaaggtttgtattgaattaccatacaattgaaaataggactcatttaataactggggtagcttttgttgtgtcgttgtgtttaaggatgcaattacatcctgttttgttgttgaacttcagataaacat

SEQ ID NO: 3862 - DNA, 1931 bp, Tropaeolum majus
gccgtcgagctcaggggaaaacatttctcgccttgaaatctcgccttcttcccctttttgaaggcattctcgtcttcctcttcttcggtttttggcgaatcacatccttcatcatctcgtgttaatggcacctgtaaagggtatcctttccctgcagcgtacagctgcactcttgcaacaaagtaagagatggagtctagcctcaagatcattcagtactcaaggcccggcaacttcgagtactccacagcctcctccaccacccccacctccagaaagaactcattttggcggccttaaagatgaagaccgcatttttaccaacttgtatggattgcatgacccttttcttaaaggtgcaatgaaaaggggtgactggtacagaaccaaagacctggtaataaagggtgctgattggattgtcaatgaaatgaagaaatccggtcttcgaggacgtggtggtgctggtttcccctctggtcttaagtggtcattcatgcctaaagtgtctgatggccgtccatcataccttgttgtcaatgctgatgaaagtgaacctggaacgtgcaaagatagggaaatcatgcgtcatgatccccacaaattattggagggctgcttgattgctggggtaggaatgagagccactgctgcatacatttacattaggggtgaatacgttaacgaacgcttaagtttagagaaggcaaggaaagaggcttatgcagcaggattgttgggaaagaatgcatgtggttctggttatgattttgatgttcatatccactttggtgctggcgcttatatttgtggtgaggagacagcacttctggaaagtcttgaagggaatcaagggaaaccaagattgaagcctccttttcctgctaacgtagggttatatggctgcccgaccactgttacaaatgttgaaacagtagctgtttctccaaccattttaaggcgtggaccagagtggttttccagttttggcaggaagaataatgctgggacaaaattgttttgtatttcaggccatgtcaataaaccatgcactgttgaagaggagatgagtatttcactgaaggagctacttgagaggcattgtggaggtgttagaggtggatgggacaatttacttgcggtgatacccggggggtcttctgtaccactgctacctaaggagatatgtgatgatgtgttgatggatttcgatgcactcaaagctgtccagtccggattggggactgcagcagtgatagtgatggacaagtcaactgatgttgtggatgcaattgcaaggctctcttacttctacaagcatgagagctgcgggcagtgtacgccatgcagagagggaacaggttggctttggttgatgatggaaagactgaaagttggaaatgccaaattggaagagatcgatatgcttcatgagattacaaagcagattgaaggacacacaatttgtgcattgggtgatgctgctgcatggcccgtgcagggtcttataaggcattttagacctgaacttgagagaaggatcagggagcatgcagagaaagaactgctggcagctaatgcttaatattcctaccaagggatcttgtgcgtgtatggatagtgaccaataaattgaagaaacatccctagctctacggctaaatgtgacatgtagtggtgttcctatcagcaatttgtttttcagaactgtactgaagaagtgatgaattcttctatttttttctgggcggggatactgccaatgtggtgttatttgtagacctacaataagtggaacatatatttaatttatgcaagaaatagacaagtttatggaaatgcattatagttttacttttagaatgttcatcctctttgttttttcaaggaatagggatcttagaatataatatctttttagtttctcttcg

SEQ ID NO: 3863 - DNA, 1812 bp, Quercus alba
gagactctaaaaactcgttcttgtcaaaatcacctgaaacacaaaatcgcatcggagcagctcatcttccaagcatttctcgctatggcacccatcaagggtattctttctttgcaaagggcagctttagctcagcgtcacagtaattcattgggcctaggctttagaacattcagcactcagggtgcaacaacagctgctactccaccaccacctcctccacctccagagaaaacccattttggtggcttgaaagatgaagaccggatttttaccaacttatatgggttgaatgacccttttctcaaaggtgctatgaaacggggtgactggtacagaacgaaggacttagtactcaagggtgctgattggattgttaatgaagtcaagaaatctggccttcgtggacgtggtggtgctggttttccatctggcctcaagtggtctttcatgccaaaagtatctgatggtcgtccttcctatcttgttgtcaatgctgatgaaagtgaacctgggacctgtaaagacagggaaattatgcggcatgatccacacaaattattggagggttgcctaatggctggtgtagggatgagggctagtgctgcttatatctatataagaggtgaatatgtgaatgaacgattaaaccttgaaagggccagaaaggaagcctatgaagctggatttttgggcaagaatgcatgtggatctggatatgattttgatgttcatatccactatggtgctggtgcttatatttgcggtgaagaaacagcacttctggagagtctagaagggaaacaagggaaaccaagattgaagcctcctttcccggctaatgcagggttatatggctgccctaccactgttaccaatgtggaaacagtggctgtttctcccacaattttaaggcgtggcccagagtggtttgccagttttggcaggaagaataattcagggacaaagttgttttgcgtttctggacacgtgaacaagccttgcactgttgaagaggagatgagtataccattgaaagagttgatagaaaggcactgtggaggtgttagaggtggatgggacaatttacttgctataattccaggtggttcatctgtgccgttgattcccaagaacatatgtgatgatgttttgatggattatgatgctctcaaggccgtccaatcaggattgggaactgctgctgtgattgtgatggataaatcaactgatgttgtggatgcaattgccaggctttcttacttctacaagcatgagagctgtgggcagtgcacgccttgcagggagggaacaggatggctttggatgatcatggaaagattgaaagttgggaatgcaaagttggaagaaatcgacatgcttcaggaggtaaccaaacagattgaggggcacacaatctgtgcattgggggatgctgctgcttggcctgtgcagggtcttattaggcattttaggccagagcttgagagaaggatccgggggcgtgcagagagggagttgctagaggctgctgcttaatcactcaggcgtattgctttagtggtggatatcatcgaataaaatgaagacagtgcccccagattttgggaggatagattattctggtggtcattttcatattctgtctgtttttaagctgtattaaatttgtcttcacttactgtcccggagaaaacatgattcgttctggatgtgctgggaaatcataattcatgttttgtgtttcactaagatatttatttcacattttgatgaatttgttaataatatctgtgttttgactaaaaaaaa

SEQ ID NO: 3864 - DNA, 2067 bp, Arachis hypogaea
aggcgtggccaaagaagagtccataagagaggaagcgaaaatcacactataatctcacaacaaagggatcgaaaagaagaaacccacccaacaacgacaattgaacaatcagaatcacttccaattcatcggtctccgccagatcccaccgccaacgcctccaggcaaccatgagaggaattctttctctgaagagggcagctttggcttcccgtcatagcgagaagttgggtgtcagtttcagattgcttagcactcaggctgcatcaaatgctagcacaccacagcctcctccaccacctccacctccagagaaaacccattttggtggactcaaggatgaggacaggatttttaccaacttatatgggttgcacgatccttttcttaaaggtgctatgaagcggggtgactggtatcgcaccaaagacctggtacttaagggcactgattggattgtgaatgaaatgaagaagtctggcctccgtggacgtggtggtgctggttttccttctggactaaaatggtcattcatgccaaaaacatctgatggacgcccttcctatcttgttgtcaatgctgatgaaagtgaacctgggacttgcaaagacagggaaattatgaggcacgacccacataagttgctagagggttgcttgattgctggagtgggaatgagggctagtgctgcttacatttatattcggggtgaatatgtgaatgaacgtataaatcttgaaaaggctaggaaagaggcttatgcagctggtttgttgggtaagaatgcttgcggctcaggctatgactttgatgttcatatacactatggcgctggtgcttatatttgtggcgaggaaactgccctcttggagagccttgaaggaaaacaaggtaaaccaagattgaagccgcctttcccagccaatgcaggattgtatggctgtcccacaaccgtgacaaatgtggaaactgtggctgtttctccaaccatccttaggcgtgggccagaatggtttgccagttttggtaggaagaacaactctgggacaaaattgttttgtgtgtctggacatgtgaacaaaccttgcactgttgaagaagaaatgagtataccactgaaggagttaatagagagacactgtggaggtgttagaggaggatgggataatttacttgcagtaattcctggaggatcatctgttcccttgattccaaagaatatctgtgatgatgtgttgatggattacgatgcattgaaggctgtccagactggattgggaactgccgctgttattgtgatggataaatcaactgatgttgtggatgccattgcaaggctttcttacttctacaagcatgagagctgtgggcagtgtacaccatgcagggagggaacaggatggctttggatgatcatggaaagaatgaaagttgggaatgcaaagctagaagaaattgatatgcttcaggaggtgactaagcaaattgaaggacacaccatctgtgcattgggtgatgccgctgcatggccagtgcagggtcttatcaggcattttaggccagaacttgagaagaggattagggagcgagcagaaagggagttgctgcaagctactggttaggcatatgttaaggtaaacaatgctggtagatagcaaaaattgaaataaggctgtgcgttttgattcggaaatatagggcagctcaagtcctctggtttcatcaactttcgtttactttaatgctgtggcagacttgttcttgtgccagaaaagaaaaatgtctgagcaagataaaatttgtttcctgaacttgtgttgtcatttggcacattttcatgtaatttttttcaaataatatatatacactgttgttgactttgttaagcatttcatgatcatgtttattgtttatcaatgagtgatgagcgatatcttcagcaaaatcaccatgctaaggtttttctgggatttaaattgttgctgtcattaaacatttttgagatttgtgttgattaatgtttatatggaataaaacttgatgataggagattaataattttgagct

SEQ ID NO: 3865 - DNA, 2046 bp, Vigna unguiculata
ggacacaaaaaaaaaaaacacggaacggaacgatcctcatagcaatcaaatccagaacacaacacagagcagcaggaagaagtgttcccatttcaacactcatcagatcccattgaacaatcaattgcatctccactggtaaggcaatcatgaggggaattctttcactaaggacagccttggttcaacatcgtagtgagaaattgggttttggtttaagacaatttagcactcagggtgcttctactcctacctcaccacagccgccaccacctcctccaccgccagaaaaaacccattttggtggccttaaggatgaggacaggatatttactaacttatatgggctacatgacccttttctgaaaggtgccatgaaacgtggtgattggtatcgaacgaaagatctcgtaaccaagggtactgattggattgtgaatgaaatgaaaaagtctggcctccgtgggcgtggtggtgctggtttcccttcgggccttaaatggtcattcatgcccaaagtatctgatggccgcccttcctatcttgtcgttaatgctgatgaaagtgaacctggaacttgcaaagacagggagatcatgcggcatgacccacataagctgttagaaggttgcttaattgctggagtgggaatgagggctactgctgcctacatctacatcaggggtgaatatgtgaatgaacgtaagaatcttgaaaaggccaggcaagaggcttacgcagctggtttattgggtaagaatgcttgtggctcaggctatgattttgatgttcatatccactttggtgctggagcttatatttgtggtgaggaaacagccctcttggagagtcttgaagggaaacaaggtaaaccaagattgaagccacctttcccagccaatgctgggttgtatggttgtcctaccactgttacaaacgtggagactgtggctgtttctccaaccattctaaggcgtgggcctgaatggtttgccagttttggtaggaagaacaatgctgggacaaagctgtattgtgtgtcagggcatgtcaacaagccttgcactgttgaagaggaaatgagtattccactgaaggagttgatagagaggcactgtggaggtgttagaggaggatgggataatttacttgcagtgatcccaggaggatcgtctgttcctctgcttccaaagaatatatgtgatgatgtcttgatggattatgatgcgttaaaggctgtccagtctgggttgggaactgcagctgtaattgtgatggataaatctactgatgttgtggatgctattgcaaggctttcttacttctacaagcatgagagctgtgggcagtgcaccccatgcagggagggaactggctggctttggacgatcatggaaagaatgaaagttggcaatgccaagctagaagaaattgatatgcttcaggagttaactaaacaaattgagggtcatacaatttgtgcattgggtgatgctgctgcatggccagtgcagggtcttatcaggcatttcaggcctgagcttgagagaaggattagagagaatgctgaaagggagctgctgcaggccactggttaggctattactaaggggtatgactgtctggtggataaaaagaatcagaataaaacattaccagtcattttgcaaaaataggtggatcaggttactgtagctttatcgctacttctatttacttttttcatgttgtagcagttattggctggaccatacctgggaatccatttgggagagtttaaactgtgtacctgcttgtcatttgacacattttcctgtaatttgttaataatatctgtatactgtattaattttgagaaacaattcatgcttacgcatgttatcagtgaatcatgaggtatcatgtccaccggatttgattgaattatttatttgggttaactttcttagaagaacatgttattcaacaaccattctcaacttgcttgttcgaagtctgttgattcatatgcatggactgaaacatatgtataaaaaaaaaaaaaaa

SEQ ID NO: 3866 - DNA, 2032 bp, Vigna unguiculata
  misc_feature (28)..(28): n is a, c, g, or t
ggacacaaaaaaaaaaaacacggaacgnaacgatcctcatagcaatcaaatccagaacacaacacagagcagcaggaagaagtgttcccatttcaacactcatcagatcccattgaacaatcaattgcatctccactggtaaggcaatcatgaggggaattctttcactaaggacagccttggttcaacatcgtagtgagaaattgggttttggtttaagacaatttagcactcagggtgcttctactcctacctcaccacagccgccaccacctcctccaccgccagaaaaaacccattttggtggccttaaggatgaggacaggatatttactaacttatatgggctacatgacccttttctgaaaggtgccatgaaacgtggtgattggtatcgaacgaaagatctcgtaaccaagggtactgattggattgtgaatgaaatgaaaaagtctggcctccgtgggcgtggtggtgctggtttcccttcgggccttaaatggtcattcatgcccaaagtatctgatggccgcccttcctatcttgtcgttaatgctgatgaaagtgaacctggaacttgcaaagacagggagatcatgcggcatgacccacataagctgttagaaggttgcttaattgctggagtgggaatgagggctactgctgcctacatctacatcaggggtgaatatgtgaatgaacgtaagaatcttgaaaaggccaggcaagaggcttacgcagctggtttattgggtaagaatgcttgtggctcaggctatgattttgatgttcatatccactttggtgctggagcttatatttgtggtgaggaaacagccctcttggagagtcttgaagggaaacaaggtaaaccaagattgaagccacctttcccagccaatgctgggttgtatggttgtcctaccactgttacaaacgtggagactgtggctgtttctccaaccattctaaggcgtgggcctgaatggtttgccagttttggtaggaagaacaatgctgggacaaagctgtattgtgtgtcagggcatgtcaacaagccttgcactgttgaagaggaaatgagtattccactgaaggagttgatagagaggcactgtggaggtgttagaggaggatgggataatttacttgcagtgatcccaggaggatcgtctgttcctctgcttccaaagaatatatgtgatgatgtcttgatggattatgatgcgttaaaggctgtccagtctgggttgggaactgcagctgtaattgtgatggataaatctactgatgttgtggatgctattgcaaggctttcttacttctacaagcatgagagctgtgggcagtgcaccccatgcagggagggaactggctggctttggacgatcatggaaagaatgaaagttggcaatgccaagctagaagaaattgatatgcttcaggagttaactaaacaaattgagggtcatacaatttgtgcattgggtgatgctgctgcatggccagtgcagggtcttatcaggcatttcaggcctgagcttgagagaaggattagagagaatgctgaaagggagctgctgcaggccactggttaggctattactaaggggtatgactgtctggtggataaaaagaatcagaataaaacattaccagtcattttgcaaaaataggtggatcaggttactgtagctttatcgctacttctatttacttttttcatgttgtagcagttattggctggaccatacctgggaatccatttgggagagtttaaactgtgtacctgcttgtcatttgacacattttcctgtaatttgttaataatatctgtatactgtattaattttgagaaacaattcatgcttacgcatgttatcagtgaatcatgaggtatcatgtccaccggatttgattgaattatttatttgggttaactttcttagaagaacatgttattcaacaaccattctcaacttgcttgttcgaagtctgttgattcatatgcatggactgaaacatatgtata

SEQ ID NO: 3867 - DNA, 1628 bp, Ambrosia trifida
accatatttctgaagctacattttgtggcatatggcacccatgaagggcattctttctctgcaacgggctgctttgttgaggcgtcaaaatgttaattgggggctaggtaccagattatttagcactcaatctgcaacaactgctaatgccgcacagccaccaccacctccccctcctccggagaagactcattttggtggtttgaaagatgaagaccgcatttttaccaacctttatggtatacatgacccgtttctcaagggtgctatgaaacgtggtgattggtacaggactaaagatctagtgatcaagggtgctgattggatagtaaatgaaataaaaaaatccggtttacgtggacgaggtggtgctgggtttccatctggtctcaaatggtcatttatgcctaaggtatccgatggtcgtccatcctaccttgttgttaatgctgatgaaagtgaaccaggaacatgtaaggatcgtgaaattatgagaaatgatccacataaacttttagaaggatgcttgattgctggagtgggtatgagggcaactgctgcttatatttacattagaggtgaatatgtgaacgagcggcttaaccttgaaaagccagaaaagaagcctatgcagctgggttgcttgggaaaaacgcttgtggttctggttatgattttgatgtgcatatccactttggtgctggtgcttacatttgtggtgaagaaacagcacttttggagagccttgaaggtaaacaaggaaagcctagattgaagccccctttccctgctaacgcaggtctatacggatgtccaacaactgttacaaatgtagaaacagttgctgtatcacctaccattttaagacgtgggcccgagtggttttctagttttgggagaaagaacaattctgggaccaaactattttgcatatctggtcatgtgaataaaccgtgcacagttgaagaggagatgagtataccattgaaggagctgctagaaaggcattgtggcggtgttaggggcggatgggacaatttactggcagtaattcctgggggttcatctgtaccattacttactaaagacatttgtgaggatgtcctgatggattttgatgcactgaaagctgtgcagtctggattagggactgcagctgttattgtgatggataaatctactgatattgtggatgccattgcaaggctttcttacttttataagcatgagagttgtggtcagtgtacaccttgcagggagggtacaggatggctttggatgattatggaaaggatgaaagttgggaatgcaaagctggaggaaattgatatgcttcaagaggtgactaagcagattgaaggacacacaatttgtgcattgggagatgctgctgcttggcccgttcaaggtcttattaggcattttaggcctgaactcgagaggaggatcagggagcgtgctgatagagagttgcttcaggcagctgcttgattcaggtggagctctgcaatatgtggaataaatatgcagaagcaatcctggacgatattattgaaccttttatgagcatggtttgaatttaaggattgtatcgaagtgactgaaaatagcatcctctttttgtaact

SEQ ID NO: 3868 - DNA, 2062 bp, Catharanthus roseus
tccgaaagtttcagctcaatcggctctgtatctgagcttcttcacaaaacagcatttcatgctcttatggcacccctaaagggcatcctttctttacagcggactgcttttcttaggcgtcaggagggttggcgcctcagcagtagattattcagcacacaagccacatcaactcccaataaccctcaggcccaacagcctcctccaccccctccacctcctgaaaaaaccccattttggtggcctcaaagatgaggaccgcatttttacgaacgtttatggtttgcatgaccctttcctcaaaggtgctatgaaacgaggtgactggtatagaacaaaagacttggtactcaagggctctgactggatcgtcaatgaaatgaagaagtctggccttcgtgggcgaggtggtgctggctttccatctggtcttaaatggtcctttatgccaaagcaatctgatggacgcccttcctatctggtagtcaatgctgatgaaagtgaacctggaacttgtaaagatagagagatcatgcgtcatgatccgcacaagttattagaaggttgtttgattgctggtgttggcatgagagcaagtgctgcatacatttatatcaggggtgaatatgtgaatgagaggaagaatctggagagagcaaggaaagaagcttatgaagctggtcttctgggaaaaatgcatgtggttctggttatgactttgatgtacatatccacttcggtgctggagcctacatttgtggtgaagagacggctctccttgagagccttgaggggaaacaaggtaaacctagattgaagcctccttttcctgctaatgcagggctatatggttgtccgactaccgttacaaatgtggaaactgtagctgtttcacccactatcttgaggcgagggccagagtggtttgctagttttggtaggaagaataattctggtacaaaactattttgcatttcgggacacgtcaacaagccttgcacagttgaggaggagatgagtatccctttgaaggagctactagagaggcattgtggaggtgtccggggtggctgggataatttacttgctgttattcctggtggttcatcggttccattgcttcccaagcacatatgtgaggatgtgcttatggacttcgatgctctcaaggctgtgcagtcagggctcgggactgctgctgtaattgtgatggataagtcaactgatgtagtagatgcaattgcaaggctctcttatttctataaacatgagagttgtggtcagtgcacaccttgcagggaaggtacaggatggctttggatgatcatggaaagaatgaaggttggaaatgccaaattggaggagattgacatgcttcaagaagtgaccaagcagatcgaagggcacacaatatgtgcacttggtgatgcagctgcttggccagttcagggtctgatccggcacttcagaccagagcttgagaggaggattcgagagcgtgcagagagagaactactagaagctgctgcttaatacttctattcagcacggagctttctcaagtaagatcccgaggaataaaaatatccaaacctctctaagctattggtagaggtgctcaagccttacaaaacagcacatttatttcttattcttgcataaaaaaactatgagttgctggatccattatatgttatctcagaggattttgtgggatacaagtttgaggttataagactctctatccttaactgccaatggctatttgaacatcctagtcttaattgtcaataaagtaaaaccttattctgctgtattgggacactgtctacagtccagttgcaatgaagaagttgaaagatttcattgaggtctgctcacatgtattaacctatagtttctcccttattgtgttttgtttcttgaagaaaatcgagtacaaatgttatgctctaaattcttagtactctcggggcagtttgtacgtgccaatttcttacgaatggctagaaggtcgaatgtttgaatgatcatagcgttttgaaatgttaagagctcgttc

SEQ ID NO: 3869 - DNA, 1845 bp, Arnica chamissonis
atgcgaaccatcgggagtcaaattcattctccctgtacttcgaaatcttcccataattgaattgttgaagctcacttaagaagcttgattgctacattcatcgggggtatggtacccatgaagggcattctttctctgcaacgggctgctttattaaggcgtcaaaatgggaattgggggctaggtgctagattatttagcactcaatctgcaacaactgctaataccgcacagccttcaccccctccccctccccctgagaaaactcactttggtggcttgaaagatgaagaccgcatttttaccaacctttatggtatacatgacccatttcttaaaggtgccatgaaacgtggtgattggcataggactaaagatttagtgatcaagggttctgattggatagtaaatgaaatgaaaaagtctggcctacgtggacgtggtggtgctggatttccttctggtctcaaatggtcatttatgcctaaggtatctgatggtcgtccatcctatcttgttgttaatgctgatgaaagtgagccaggaacctgtaaagacagggagattatgcgaaatgatccccataaacttctagaaggatgcttgattgctggagtgggtatgagggcaactgctgcttatatctacattagaggtgaatatgtgaacgaacgccttaaccttgagaaagccagaaaagaagcttatgcagctgggttacttggaaaaaacgcgtgtggttcgggttatgattttgatgtgcatatacactttggtgctggtgcctacatttgtggtgaagaaacagcacttctagagagccttgagggtaagcaaggaaaacctagattgaaaccccctttcccagctaattcaggtctatacgggtgtccaacaactgttacaaatgtagaaacagtagctgtctcacctaccattttaaggcgcgggcctgagtggttttctagttttgggagaaagaacaattcggggacgaaactgttttgcatatctggacatgtgaacaagccatgcaccgtggaggaggagatgagtatatcattgaaggagctgctagagcgacattgtggtggtgttaggggtggatgggacaatctactggctgtaattcccgggggttcctctgtaccattgcttcctaaaaacgtatgtgaggatgtcctgatggattttgatgcactcaaggctgtccaatctggattaggtacagctgctgttattgtgatggataaatcaaccgatgttgtggatgcgattgcgcggctttcttacttctataagcatgagagttgtggtcagtgtacaccttgtagagagggtactggatggctttggatgatcatggaaaggatgaaggttgggaatgcaaagttagaagagattgatatgctccaagaggtgactaagcagattgaaggacacacgatttgtgcattgggtgatgctgctgcttggcccgttcaaggtctcatcaggcattttaggcccgagctcgagaggaggataagggaacacgctgaaagagagttgcttctggcagctgcttgaatcaggcctgcagttggtggaataaatatgcagaaatagtggtgaagtaaatccttttatgagcatctcggttacattttaaggtttgtattgaattacaatgcgattgaaaatagtaccctttttgaaaccggggtaacttttgttgtttcggtgtcttaaggatacaaagacatccttaacttcattttgccatgttttttattgttaataagccgaatgcaatgttgtaatggtacaatataaagcttttgaaagctcaagttccgttcttgt

SEQ ID NO: 3870 - DNA, 1618 bp, Flaveria ramosissima
caaaatgttaattggggacaaggtactagattacttagcactcaatctgcaacaactgctaataccccacagccaccaccacctccccctcctcctgagaaaactcactttggtggtttgaaagatgaagatcgcatttttaccaacctttatggcatacatgacccgtttcttaaaggtgccatgaaacgtggtgattggtacagaactaaagatctagttatcaagggctctgattggatagtcaatgaaatgaaaaaatcgggtctacgtggacgtggtggtgctggatttccatctggactcaaatggtcatttatgcctaaggtatctgatggtcgtccatcctatcttgttgttaatgccgatgaaagtgaacccggaacatgcaaggatcgtgaaattatgcgaaatgatccacataaacttctagaaggatgcttgattgctggagttggtatgagggcaactgctgcttatatttacattagaggtgaatacgtgaacgaacgcctaaaccttgcgaaggccagaaaagaagcctatgcagctgggttacttggaaaaaatgcttgtggatcaggttatgattttgatgtgcatatccacttcggtggctggtgcttacatttgtggtgaagaaactgcacttttggagagccttgaaggtaaacaaggaaaaccaagattgaaaccccctttccctgctaatgcaggtctatacggatgtcccacaactgttacaaatgtagaaacagttgctgtatcacctacgatcttaagacgagggcctgaatggttctctagttttgggagaaagaataattctgggacaaaactttttgtcatatctggtcatgtcaacaaaccgtgcacagtcgaagaggagatgagtataccattgaaggagctgctagagcggcattgtggcggtgttaggggtggatgggacaatttactggcagtaattcccggaggttcatctgtaccgttgcttcctaagcacatatgtgaggatgtcctgatggattttgatgcattgaaggctgtgcaatctggattagggactgcagctgtaattgtgatggataagtcaactgatgttgtggatgcaattgcatggctttcttacttttataagcatgagagttgtggtcagtgtacaccttgcagggagggtaccggatggctttggatgattatggaaaggatgaaagttgggaatgcaaagctggaggaaattgatatgcttcaagaggtcactaagcagattgaaggacacacaatttgtgcactgggagatgctgctgcttggcccgttcaaggtcttatcaggcattttaggcccgaactcgagaggcggatcagggaacatgctgatagagagttgcttcaggcggctgcttgattcaggttgaagagcttgcagccctgcaatctgtggaataaatatgcataactcatcctagagaaatctggaaattgatgaacccccttgcgagcatcatggtttaagtttaaggtttgtattgaattaccatacaattgaaaatagcactctttatataattggggtaacttttgttgtgcgttgtgtttaaggatgcaataacatcct

SEQ ID NO: 3871 - DNA, 1819 bp, Carica papaya
agttgtttggctcaatcaacgaagggtagatttcagtaactcttgctatggcacctgttaagggcattctttccctgcaacgcacagcttcacgttggcagcaaagtaacagatggggccaaaccatgagatcattcagcactcaaggtgctgcaccttcaaatactgcacagcctcctccacctcccccgcctcctgagaaaactcattttggtggtcttaaagatgaagacaggatttttaccaacttgtacgggttgcatgatccttttctcaaaggtgccatgaaacgtggggattggtatagaactaaagacctggtactaaagggtgctgattggattgtcaatgaagtcaagaagtctgggttgcgtggacgtggtggtgcaggtttcccgtctggccttaaatggtcattcatgccaaaagtatccgatggtcgtccatcatatctagttgtcaatgctgatgaaagtgaacctggcacatgcaaagatagggaaatcatgcgacatgatccccacaagttattggaaggctgcttgattgctggggtaggaatgagagctactgctgcctatatttacataaggggtgagtatgtgaatgaacgtaaaaatctagagagggctagaaaagaggcttatgaagctggatttttgggaaaaaatgcatgtggctctgattatgattttgatattcatatccattttggtgctggtgcttatatttgtggtgaggagacagcacttctggaaagtcttgaagggaagcaaggcaaaccaaggttgaagcctcctttccctgccaatgctggattatatggttgtcccaccactgttactaatgtggaaacagtggctgtatctcccaccattttaaggcgtgggccagagtggtttgccagttttggcaggaagaataattctgggacaaaactgttctgcgtctccggacatgtgaacaagccttgcacagtggaagaggagatgagtataccacttaaggagttgattgagagacactgtggaggtgttagaggtggatggaataatttacttgctgtgataccaggaggttcatctgttccgctgcttcctaagcacatatgtgatgatgtgcttatggattatgatgcgctcaaggcagtccagtcaggactgggcactgcagctgtgatcgtaatggataagtcaactgatgttgtggatgcaattgcaaggctgtcttacttttacaagcatgagagctgtgggcaatgcacaccatgcagggaggggacaggttggctttggatgataatggagagattgaaagttgggaacgcaaaattggaagagattgatatgcttcaggaggtgaccaagcagattgaaggacacaccatttgtgcattaggtgatgcagctgcatggcctgtgcagggtcttatacggcactttaggccagagcttgagagaaggattcggaagcgtgcacaaagggaattattggaggcttctgcttaatttgttttgccaaggaatttcctgtgctagtggatgttctggaataaaattgaagaagggtccgtagatgggggaagataggtgactcagtagctgttggtactgctgcagtttgttttttagctgtatactcttgacttatttcaactatcccaaaggaatgattatttgttctatttgtctgggagtagattctccagagattgtttattgtatctcccatctttcctgggcgtcttcttgcacatttgaggtactctgttaataatatttgaagtattttgttctgcactaggcagacagttttctag

SEQ ID NO: 3872 - DNA, 1956 bp, Populus trichocarpa
tggcagtcacagcagtcgggtgtctctgcgacgtgttacccgtggtcatcacaagcaccccattaagatcgaaaatcatagccgtccatcttgcatacttagcgacagtcggatttcgatatattttctctcaagagtccatttctcatctggatttgttgcagctgaatcgactcgaatcatcaaagcttacctgccacatttctttccatggcacccattaggggtattttttctttgcaaagaacagctttggtgcgtcaaagtgagaggttgggagttggcttcaggtcattcagtacccaagctccaacaaatgctggtgcgcctcagcctccgccacctcccccacctccggagaaaactcattttggaggcctcaaagatgaggaccgaatttttactaacgtgtacggattgcatgaccctttcctcaaaggtgccatgaaacggggtgactggtatagaactaaggacttggtgctcaaaggtactgactggattgttaatgaagttaagaaatctggtctccgaggacgcggtggtgctggtttcccatctggtctcaaatggtcatttatgccaaaaacatctgatggtcgcccttcctatcttgtcgtcaatgctgatgaaagtgaacctggaacctgcaaagacagggaaatcatgcggcatgatccacacaagctcttagagggatgcttgattgctggggtaggaatgagagcttctgctgcatatatctacattaggggtgaatatgtgaatgaacgaataaatctggaaagagccagaaaagaagcttatgaagctgggctgttgggcaagaatgcatgtggatctggttatgattttgatgtccatatccactacggtgctggtgcttatatttgtggtgaagagacagcgcttttggaaagccttgaaggaaaacaagggaaaccaagattgaagcctcctttcccagctaattctgggctgtatggctgccccaccactgttacaaatgtggaaacagtggctgtctctcccaccattttaaggcgtggtccagagtggtttgcaagttttggccgaaagaacaactctgggactaaattattttgtgtgtcaggtcatgtgaacaagccttgcacagttgaagaggagatgagcataccactgaaggagttaatagagaggcactgtggaggtgttcgaggtggatgggacaatttacttgctgtgataccagggggttcttctgtcccactgcttcccaagcacatatgtgatgacgtgcttatggattatgatgcacttaaagctgtcacatcaggattagggactgcagcggtgattgtgatggataaatctactgatgtcgtggatgcaattgcaaggctgtcttacttctacaagcacgagagctgtggacagtgcaccccatgcagggagggaacaggatggctttggatgatcatggaaaggttgaaggttgggaatgcaaagttggaagagatagatatgcttcaggaggtgaccaaacagattgaaggccacaccatctgtgcattgggtgatgctgcagcttggcctgtacagggtcttataaggcattttaggccagagcttgagagaaggattaaggagcgtgcagaaagggaattgctggaggctgctgcttaagaattttatacagggaatgcttaattggtgaacatcttgaaataaatgaagaaactaccgaaatagtgtgggtggttagtaacctaaaggcaccagcagtcctgctattttttttttcaaagctgtatcaactgagattcactgtcccatagagattatgattcttctgggaaggataattcgatgtttgctcatgtgcttttaacatgtctttggacacttttggaaaatgtagtcaataatctgtgtttcatttatatcactttcatttatttattatcatcacca

SEQ ID NO: 3873 - DNA, 2080 bp, Euonymus alatus
gggggatttcccccgtctgtccgacacacgcacggtgctcgcgaaggagatatacgtatttcccgtccccagagcttccctttcttctctccatacctcgatttgtcgtgttaaagcttctcgggaacgaatcggagctcaaccgttgcatttcacgctatggcacccatgaagtgctttctttccttgcggcaggctgctttggttcgacatcacagtgagagatggggtgctggcttcagatcattcagcacccaaggtgcaacacctggtagtactccacagcctcccccgcctcccccaccaccggagaaaactcactttggtggccttaaagatgaggacagaattttcacaaatctgtatgggttgcatgacccatttcttaagggttccatgaaacggggtgattggtacagaaccaaagatttagtactcaagggtgctgattggattgttaatgaagtgaagaagtctggcctccgcggacgtggtggtgctggttttccatctggccttaaatggtcattcatgccgaaagtgtctgatggccgtccttcatatcttgttgtcaatgctgatgaaagtgagcctggaacctgtaaggacagggaaatcatgcgtcatgatccacacaaattattggagggatgtttgattgccggggttggaatgagggctactgctgcttacatctacattaggggtgagtatgtgaacgaacgtaagaaccttgaaagagcccgaaaagaggcttatgaagctggacttttggggaagaatgcatgtggatctggttatgattttgatgtacatatccattatggtgctggcgcttatatttgcggggaagaaactgcccttttggagagccttgaaggaaaacaggggaagccaaggttgaagcctcctttcccggctaatacaggtttatatggctgccccacaactgtaacaaatgtcgaaacagtggccgtttctcctaccattttgaggcgtggaccagaatggtttgcaagttttggcaggaagaataattcaggaacaaaactattttgtgtgtctggtcatgtgaacaagccttgcactgttgaagaagagatgagtatacccctaaaggagctgatagagaggcactgtggaggtgttcgaggtggatgggacaatttactggcagttattccggggggttcatctgttccattgatccccaagcatatttgtgatgatgtgctgatggattatgatgcacttaaggctgttacgtcaggactggggactgcagctgtcattgtgatggataaatcaactgatgttgtggatgcaattgccaggctctcctatttctacaagcatgaaagttgtggtcagtgcacaccatgcagagaggggacaccatggctttggatgatcatggagaggttgaaggtcggtaatgcaaagttggaagagattgacatgcttcaggaggtgaccaagcaaattgaagggcacacaatttgtgcactgggcgatgctgctgcttggcctgtgcaaggtctcataaggcactttaggccagagctggagagaaggatcaaggagcgtgcaagcaaggaattgctggaggctgctgcttaggtttgctatggaggtaatttcctattctgccgaataataaagatgaagaaagtacagccatcatttgcagaattgtttgtttgaggcatctgccgttccagttacaatttttttccctttttgaagctgtatcaatgatcaacttcattcacttttctgaaaatattataccgtcttaccgttgtatctgggcagaagtgcatctgctggttcatgtgtttcccgtttccgctaaacatccctaaattggtacatggtactagtgccagtagttttgttttatgatatacttattgaaatcaataagtgcaaaaactgtcttctgatttatgttccatccagtcgattgatgttaacctgaaaggcaaagggttcagatttccatgttgaatcctcaagtacagccggtaaattagctgttgtttgctgcttctgaatgattgagattggtaactgggtg

SEQ ID NO: 3874 - DNA, 1801 bp, Vaccinium corymbosum
tatggcaaccattaagggcattcttactcttcataggatggctttggttcagcgtatcagcgagaggtgggtccaaggcaacagagtattagcacccaaggtgcaacaactgctagcaccccgcagcctcctccacctcccccacctcctgagaaaacccattttggtggcctaaaggatgaagaccgcattttcaccaacgtgtatggtttgcacgatcctttccttaaagggctatgaaacgaggcgactggtatagaaccaaagacctagtactcaagggtgctgagtggattgttaatgaaatgaagaagtcaggtttacgcggacgtggtggtgctggttttccatctggactcaaatggtccttcatgccaaaagtatctgatggtcgcccttcttatcttgttgttaatgctgatgaaagtgaacctggaacgtgtaaggatagggaaataatgcggcatgatccccacaaacttattgaaggttgcctaatagccggggttgggatgagggctactgctgcatatatctacatcaggggtgagtatgtgaatgaacgcaagaaccttgaaaaggctttgaaagaagcttatgaagccggacttatcggaaaaaatgcatgtggatctggttacgattttgacattcatatccactatggtgctggtgcctatatctgtggtgaagagacagcactactggaaagcctcgagggtaaacaagggaaaccgagattgaagcctccttttccagctaatgcagggttatatggttgtccaacaactgttaccaatgttgaaacggtcgccgtttctcctaccattttaaggcgcgggccagagtggtttgctagttttggtaggaagaataactctgggacaaagctgttttgcgtatcaggtcatgtgaacaaaccctgcacagtcgaagaggagatgagtattccactgaaagaactgatagagagacattgtgggggtgttagaggtggatgggacaatttacttgctgtgatacccgggggttcgtctgtgccattgcttcctaaggacatatgtgatgatgtaatgatggactacgatgcgctcaaggccgtccaatcaggattagggactgcagctgtgatcgtgatggacaaatctactgatgttgtggatgcgatctcgaggctttcttatttttacaagcatgagagctgtggtcagtgtacgccttgtagggaaggtacagggtggctttggatgattatggagaggttgaaagttgggaatgctaagttggaagagattgacatgcttcaggaggtgacaaagcagattgaagggcacactatttgtgcactgggtgatgctgctgcttggcctgttcagggtcttattaggcatttcaggccagagcttgagaggaggattagggagcgtgccgagagggagttattggaggctgctgcttgagtcttgaattcagggaaacacctttgttgctggattgtagattaaaaacggcggaaagggaagtactcccaacgttagacttgactctggcagttggctgtccaagtgagtgacatgtttatttttaggattttgtatcagtaacaattgcatcagagatgctataattcctccccaacttgtgtaggactggatttttattgtgaattcttctgtttttgagccttgaggacatggtattgacagcttgaagaaacttgtgcacggcaggaactacactcccgatttgaagacatcgagtagactataattaaaatgtatattggcggatgccggattga

SEQ ID NO: 3875 - DNA, 1597 bp, Cannabis sativa
cagtgttctcctccatcttcgtctcgctcccaaatcttctcccgttcaccactcgacacttctcgttctcgttctcctctcagatcggttcacggcgactacctcatacgccgactcaggcacccatgaggggtattatgtctttgcgaagagcagctttggctcggggccacagtgagaagtgggcaacgtgctttagatcgttcagtacccagggtgcagcaactggtaccacaccacaaccaccaccaccagaaaaaacccattttggtggcttgaaagatgaagaccgaattttcaccaacctttatggtttgcatgacccttttttgaaaggagcgatgaagagaggtgactggcatagaaccaaagatttggttatcaagggtgctgattggattgtaaatgaaatgaagaagtctggccttcgtggtcgtggtggtgctggttttccatctggccttaaatggtcttttatgccgaaagtttcagatggtcgtccttcctaccttgttgtcaatgctgatgagagtgaacctggaacctgtaaagatcgggaaattatgagacatgatccacacaaactgttggagggttgcttaattgctggtgtgggtatgagggctactgctgcctacatctatatcagaggtgagtatgtgaatgagcgcctaaaccttgaaaaggccagaaaagaagcatatgcagctggattgttgggaaagaatgcttgcgggtcgggttacgattttgatgttcatatccattatggggcaggtgcttatatttgtggtgaagaaacagctcttttggagagccttgaagggaaacaagggaaaccaagattgaagcctcctttcccagcaaatgcaggtttatatggctgccctaccactgttacaaatgttgaaactgtagctgtttctccaaccattttaaggcgtggaccagagtggtttgccagctttgggaggaagaataactcagggacaaaattgttttgtgtgtctgggcatgtaaataagccttgcactgtggaagaggaaatgagtatacctttgaaagagttgattgaaaggcactgtgggggagttagaggtggatgggacaatttacttgctattattccaggtggttcatctgtcccactgcttcctaagaacatttgtgatgatgtccttatggattatgatgcactcaaagcagttcaatcaggattagggactgctgctgttattgtaatggataagtcgactgatgtcgtggatgcaattgctaggctctcttacttttacaagcacgagagttgtggacagtgcacaccatgcagagagggaacaggatggctctggatgattatggaaagaatgaaagttggaaatgcaaagttggaagaaattgacatgcttcaggagctgaccaagcagattgaagggcacactatctgtgccttgggtgatgctgctgcttggcccgtgcaaggtcttattaggcattttaggccagagcttgagagaaggatcaggcagcgtgcagagcgggaattgctggaggctgctgcttagatgtctttcaggtagtaattctttcttcatct

SEQ ID NO: 3876 - DNA, 2219 bp, Cannabis sativa
gagaaattatgttgtggatgtgatctttttattctcagattaatgtgtattcattgatattgcttgtgaagaaatgtggaaatcatactctcaatcatggctttttaaaatgttatattatttgaattgtattgctttccagtttttattagtgggtgaaccctgaaatctgaatgaggcatgttttagctacatgtatcgtttaggcagttcaacttattttatgcaacatatgattattgcataggcacccatgaggggtattatgtctttgcgaagagcagctttggctcggggccacagtgagaagtgggcaacgtgctttagatcgttcagtacccagggtgcagcaactggtaccacaccacaaccaccaccaccagaaaaaacccattttggtggcttgaaagatgaagaccgaattttcaccaacctttatggtttgcatgacccttttttgaaaggagcgatgaagagaggtgactggcatagaaccaaagatttggttatcaagggtgctgattggattgtaaatgaaatgaagaagtctggccttcgtggtcgtggtggtgctggttttccatctggccttaaatggtcttttatgccgaaagtttcagatggtcgtccttcctaccttgttgtcaatgctgatgagagtgaacctggaacctgtaaagatcgggaaattatgagacatgatccacacaaactgttggagggttgcttaattgctggtgtgggtatgagggctactgctgcctacatctatatcagaggtgagtatgtgaatgagcgcctaaaccttgaaaaggccagaaaagaagcatatgcagctggattgttgggaaagaatgcttgcgggtcgggttacgattttgatgttcatatccattatggggcaggtgcttatatttgtggtgaagaaacagctcttttggagagccttgaagggaaacaagggaaaccaagattgaagcctcctttcccagcaaatgcaggtttatatggctgccctaccactgttacaaatgttgaaactgtagctgtttctccaaccattttaaggcgtggaccagagtggtttgccagctttgggaggaagaataactcagggacaaaattgttttgtgtgtctgggcatgtaaataagccttgcactgtggaagaggaaatgagtatacctttgaaagagttgattgaaaggcactgtgggggagttagaggtggatgggacaatttacttgctattattccaggtggttcatctgtcccactgcttcctaagaacatttgtgatgatgtccttatggattatgatgcactcaaagcagttcaatcaggattagggactgctgctgttattgtaatggataagtcgactgatgtcgtggatgcaattgctaggctctcttacttttacaagcacgagagttgtggacagtgcacaccatgcagagagggaacaggatggctctggatgattatggaaagaatgaaagttggaaatgcaaagttggaagaaattgacatgcttcaggagctgaccaagcagattgaagggcacactatctgtgccttgggtgatgctgctgcttggcccgtgcaaggtcttattaggcattttaggccagagcttgagagaaggatcaggcagcgtgcagagcgggaattgctggaggctgctgcttagatgtctttcaggtagtaattctttcttcatctgtattcatttccttcgaagctttaaataacattaatggcaatttaaagagattatggagtcataagctttgctgggattctatttggtattttcttgctgaaaattgagataaaaagtcatagtttgggtgaattagaatgctgaatcaaaaggctgtttctaatttgtggttggtattgtgtttacaagaaagatcatattttagaagttcttaaattccttcaaatggatatggacttagtctttagttcattataatgttaattatttattttatgcattttgtttgtgctggaatccttgctgtcttctgagtctttgtataaagccttcagcatagaagggagagaagctctgtatttgaacctgaaattaattttattttctgtaagaaaaactggtttgggactattttggtccgtttatacgtgctcatgaaactaactgtgtcaagtttagttgtacggtattccaaacatagaaatcatctaat

SEQ ID NO: 3877 - DNA, 1738 bp, Lactuca sativa
tagaaccgctgccccacaataaaaacccatttaaggtcgttggattactcgggcgacgattttgggggtcaagttgatttccttatactttacttcaaaatcttctccatagttgaattgctgataatcagttcagaagcttgtttgctgcatttcctggtgtatggcaccaatgaagggcattctttctctgcaaagggctgttctatcaaggcatcaaaatgcaaactgggggataaatgctaccgctagacttttcagcacgcagtctgcgacaaccgccaccaccgcccaaccaccaccgccaccacctccaccagaaaaaacccactttggtggcctgaaagatgaagaccgcatcttcacaaacctatacggtttacacgacccctttctcaaaggcgcaatgaaacgtggcgattggcatagaactaaagacatagtaatcaaaggtgctgattggatagtaaacgaaatgaaaaaatctggcttacgtggacgtggaggtgctggtttcccatcagggctaaaatggtcattcatgccaaaagtatccgatggtcgtccatcttatcttgttgtaaacgcagacgaaagtgaacccggaacttgcaaagatagagaaatcatgcgtaacgatccacacaagcttctagaaggatgtttaatagctggagtaggtatgcgtgcaaccgctgcctacatttacatcaggggcgaatacgtaaatgaacgtttgaatttagaaaaagcaagaaaagaagcatatgcagctggattacttggaaaaaacgcgtgtgggtccgggtatgatttcgatgtccatatccatttcggagccggagcctacatttgtggtgaagaaaccgcgcttctcgaatccctcgagggcaaacaaggaaaaccgcgtttgaagccgccttttcccgccaacgcggggttatacgggtgtcccacaaccgtcacaaatgtcgaaacaatcgcggtgtcgccgactattctaagacgtgggcccgagtggttttctagctttggtagaaagaacaattcggggactaaacttttctgtatatcgggtcatgtgaacaaaccgtgtacagtggaagaggagatgagtattccattgaaggagttgttggagcggcattgtggcggtgtgaggggcggatgggacaatttgctagcggtgattccgggtggttcttctgttcctttgcttacaaaggatttatgcgaagacgtgttgatggattttgatgcgttgaaagctgttcaatctggattagggactgctgctgttattgtgatggataagtcgactgatattgtggatgcgattgcgaggctttcgtatttttataagcatgagagttgtggtcagtgtacgccttgtagggagggaactgggtggctttggatgattatggaaaggatgaaagttgggaatgcgaaattggaggagattgatatgcttcaggaagtgactaagcagattgaagggcatactatttgtgcacttggtgatgctgctgcttggcctgttcaagggcttattagacattttaggcctgagatggagaggaggatcagggagcgtgctgatcgggagttgcttcaagcagctgcttgaaatcaggttgaatggttgtacaaaataacattctgctttactctttttttttttttaccaatttgtgaaatatacattactaatgtaattacaatttttttactaatt

SEQ ID NO: 3878 - DNA, 2038 bp, Aquilegia formosa
gagaaaaatacaaatccatcagtgaccatcacacacagcttctaagttgtatcgggcgtgtgttgtgcttgtttcttcttcttcttcttctttggatcgaatcattcgatctgtaaatccggcattaagcaagcaaacaaacatctttgaaaagaagagctcggtttatttctctttctttgttcatgggttcggtaaagaaaattctctctctgccgagagcagctctgcttcgccattatagtgagaggtgtagcacagtttatagatcatttagtacccaagctgcgagcacctcaagtacaccacaacctcccccaccacccccaccaccagagaaaacccattttggtggcttgaaagatgaagatcgcatattcaccaatctttatgggttgcatgatccattccttaaaggtgctatgaagcgaggtgactggcacagaaccaaagacatagtcaccaagggagctgattggatcgtcaatgaaatgaagaagtctggtcttcgtggccgtggtggtgctgggtttccatctggcctcaaatggtccttcatgccaaaggtatctgacggacgcccttcttatcttgttgtcaatgctgatgagagtgaaccaggtacgtgtaaggacagagaaatcatgaggcatgacccacacaaactactagaagggtgcttgattgctggggtggccatgcgggccactgctgcttacatttacattcggggagaatatgtaaatgagcgtctgaaccttgtgaaggccaggaatgaagcttatcaagctggacttttggggaaaaatgcatgcggatctggttatgactttgatgttcatatccattttggtgctggtgcttacatatgcggtgaagagacggcattattggagagtctggaagggaaacaagggaaaccaaggttgaagcctcctttcccagctaatgcagggctatatggatgtccaacaactgttacaaacgttgaaactgtagctgtttctccaacaatcttaaggcgtggacctgagtggtttgccagtttcggaaggaagaacaatgctgggactaaactattttgtgtgtcaggccatgtgaacaagccttgtacagttgaagaggagatgagtataccattaaaggagttgatagagagacactgcggtggagttagaggtggatgggacaatttgcttgcagtaataccaggtggttcatctgtcccactgcttcctaagaacgtatgtgaagatgttctgatggacttcgatgccctcaaggctgtccaatctgggttgggaactgctgcagtgattgtgatggacaagtcgacagatgttgtggatgcgattgctaggctttcatacttctacaagcacgagagctgcgggcaatgtacaccatgtagggagggaacaggatggctttggatgataatggaaagacttaaggttgggaatgcaaaactggaggagatagacatgcttcaggaagttactaagcaaattgaggggcacactatctgtgctttaggtgatgctgctgcttggcctgttcagggtctcataaggcattttagaccagagcttgaaaggaggatcaaggaacgtgcagatagagaattgattgaggctgctgcttgagccttgtagcaaggttcatcttgatctggtagctgttgtggaataaaggttgaaatggctccatgttgtcctaccaagtatttatgtctgaatatttgtttcagaaattgaatttggtcttatgttgtataatccaacgaagatgttgactttctgcacatttgattgatgatcagcataattcctgtattttcaggagaataacctttacgcgattttgttttggtaatcgcagactaatcaaaacttactataaaaagatgttacaattgtctgtattggataatttcatctgaaactttgtctcattgtctgcccctctgttttatttgctttcatatatgtttgaactgtatcttgtttataacataagtgattaagaggagttagag

SEQ ID NO: 3879 - DNA, 1775 bp, Castanea mollissima
cctgaaaccacaaaaccgcatcggagcagagctcatcttccaaacatttctcgctatggcacccatcaagggtattctttctttgcaaagggcagctttagctcggcgtcacagtaattcattgggcctaggctttagaaaattcagcactcagggtgcaacaacagctgctactccaccacctcctccacctccagagaaaacccattttggtggcttgaaagatgaagaccggatttttaccaacttatatgggttgaatgacccttttctcaaaggtgctatgaaacggggtgactggtacagaacgaaggacttagtactcaagggtgctgattggattgttaatgaagtcaagaagtctggccttcgtggacgtggtggtgctggttttccatctggcctcaagtggtctttcatgccaaaagtatctgatggtcgtccttcctatcttgttgtcaatgctgatgaaagtgaacctgggacctgtaaagacagggaaattatgcggcatgatccacataaactattggagggttgcctaatggccggtgtagggatgagggctagtgctgcttatatctacataagaggtgaatatgtgaatgaacgattaaaccttgaaagggctagaaaggaagcctatgaagctggatttttgggcaagaatgcatgtggatctggatatgattttgatgttcatatccactatggtgctggtgcttatatttgcggtgaagaaacagcacttctggagagtcttgaggggaaacaagggaagccaagattgaagcctcctttcccggccaatgcagggttatatggctgccctaccactgttaccaatgtggaaacagtggctgtttctcccacaattttaaggcgtggcccagagtggttttccagctttggcaggaagaataattcagggacaaagttgttttgcgtttctggacacgtgaacaagccatgtactgttgaagaggagatgagtataccattgaaagagttgatagaaaggcactgtggaggtgttagaggtggatgggacaatttacttgctataattccaggtggttcatccgtgccgttgattcccaagaacatatgtgatgatgttttgatggattatgatgctctcaaggccgtccaatcaggattggggactgctgctgtgattgtgatggataaatcaactgatgttgtggatgcaattgccaggctttcttacttctacaagcatgagagctgtgggcagtgcacgccttgcagggagggaacaggatggctttggatgatcatggaaagattgaaagttgggaatgcaaagttggaagaaatcgacatgcttcaggaggtaaccaaacagatcgaggggcacacaatctgtgcattgggggatgctgctgcttggcctgtgcagggtcttattaggcattttaggccagagcttgagagaaggatccgggggcgtgcagagagggagttgctagaggccgctgcttaagcactcaggcatattgctttagtggtggatatcatcgaataaaatgaagacagtgcccccagattttgggaggatagattattctggcggtcattttcatattctgcctgtttttaagctgtattaaatttgacttcacttactgtcccggagaaacacatgattcgttctggatgtgctgggaaatcataattcatgttatgtgtttcactaagatatttatttcacattttgatgaatttgttaataatatctgtattttgactaa

SEQ ID NO: 3880 - DNA, 2040 bp, Actinidia deliciosa
  misc_feature (623)..(623): n is a, c, g, or t
  misc_feature (1013)..(1013): n is a, c, g, or t
  misc_feature (1023)..(1023): n is a, c, g, or t
  misc_feature (1065)..(1065): n is a, c, g, or t
gtggaagctcatactggttacttcgcaaggattcgtctctcttcttcttccttaaattcccatctgattatcgtctgaatcagacgatacatcacaggcttcactgctcactccgacgaatttgcgaaattatggcacccgttaagggcattcttgctcttcacaggacggctttgattcagcgttacagtgagaggtgggtctcaggcagtagattattcagcacccaaggtgcaacaactgctagcacctcgcagcctcccccacctcccccacctcctgagaaaacccattttggtgacctgaaagatgaagaccgcattttcaccaacctgtacggtattcatgatccctttctcaaaggagccatgaaacgcggtgactggcatagaactaaagacttagtactcaagggtgctgattggattgttaatgaaatgaagaagtctggcctacgcggacggggtggtgctggttttccatctggtctcaaatggtccttcatgccaaaagtatctgatggccgtccttcttatcttgttgttaatgctgatgaaagtgaaccaggcacctgtaaagatagggaaataatgcggcatgaccctcacaaactattagagggntgcctgatagctggggtgggaatgagggctactgctgcatatatatacatcagaggtgagtatgtgaatgaacgcattaaccttgagaaggctaggaaagaagcttatcaagcaggactgcttgggaagaatgcttgcggatctggttatgattttgacgtgcatatccactatggtgctggtgcctatatctgtggtgaagagacggcacttctggagagccttgaagggaaacaagggaaaccaagattgaagcctccttttccagctaatgcagggctatatggttgtcctacaactgttacaaatgttgaaacagtggctgtttctcctaccattttaaggcgtgggccagagtggtttgctagttttggcaggaagaacaattcngggacaaagntattttgcgtgtcaggtcatgtgaacaagccttgcacagtanaagaggagatgagtataccactgaaagagctgatagagaggcactgcgggggtgtcagaggtgggtgggacaatttactggcagttataccagggggttcatctgtgccattgcttcccaagcacatatgtgacgatgtgatgatggactatgatgcactcaaggccgttcagtcaggcttgggaactgcagctgtgattgtaatggacaagtctactgatgttgtggatgccattgcaaggctctcttacttttacaagcatgagagctgtggacagtgtacaccttgcagggaaggtacgggatggctttggatgattatggaaagattgaaagttgggaatgctaaattggaggagattgacatgcttcaggaggtgacaaagcagatagaagggcacactatatgtgcattgggagatgctgctgcttggcccgttcagggtcttatcaggcatttcaggccagagcttgagaagcggattagggagcgtgcagaaagggagttactggaggctgctgcttgagcctttaattcagggaaatgcttccggtgctgaacagtagaataaaaatgtgggaagtagtccaaccattaggagaagtgactccagaagctggctggcttaatgagtgacaagcttttttcatgtttgtaattgcttcccgaatgtctgggtcaggataatctatttctattcatgcatcttgaggctcgaggatatgatatcatcccctgcttattctcgagtctttgacagcttgaagaaactctatagtatttctttatttcgtcaataaaaagaaatgccatgctgtagatttgagataccactgggaggaatacccatttgccctgggcaaggaatggcctggtactgcatggaacatccaacaccaaaacttcttttttttccttgagatgattatatatacatttatgacaatgaaaaattgtttgacttgcaaaaaaaa

SEQ ID NO: 3881 - DNA, 1887 bp, Lactuca sativa
agttgatttccttatactttacttcaaaatcttctccatagttgaattgctgataatcagttcagaagcttgtttgctgcatttcctggtgtatggcaccaatgaagggcattctttctctgcaaagggctgttctatcaaggcatcaaaatgcaaactgggggataaatgctaccgctagacttttcagcacgcagtctgcgacaaccgccaccaccgcccaaccaccaccgccaccacctccaccagaaaaaacccactttggtggcctgaaagatgaagaccgcatcttcacaaacctatacggtttacacgacccctttctcaaaggcgcaatgaaacgtggcgattggcatagaactaaagacatagtaatcaaaggtgctgattggatagtaaacgaaatgaaaaaatccggcttacgtggacgtggaggtgctggtttcccatcagggctaaaatggtcattcatgccaaaagtatccgatggtcgtccatcttatcttgttgtaaacgcagacgaaagtgaacccggaacttgcaaagatagagaaatcatgcgtaacgatccacacaagcttctagaaggatgtttaatagctggagtaggtatgcgtgcaaccgctgcctacatttacatcaggggcgaatacgtaaatgaacgtttgaatttagaaaaagcaagaaaagaagcatatgcagctggattacttggaaaaaacgcgtgtgggtccgggtatgatttcgatgtccatatccatttcggagccggagcctacatttgtggtgaagaaaccgcgcttctcgaatccctcgagggcaaacaaggaaaaccgcgtttgaagccgccttttcccgccaacgcggggttatacgggtgtcccacaaccgtcacaaatgtcgaaacaatcgcggtgtcgccgactattctaagacgtgggcccgagtggttttctagctttggtagaaagaacaattcggggactaaacttttctgtatatcgggccatgtgaacaaaccgtgtacagtggaagaggagatgagtattccattgaaggagttgttggagcggcattgtggcggtgtgaggggcggatgggacaatttgctagcggtgattccgggtggttcttctgttcctttgcttacaaaggatttatgcgaagacgtgttgatggattttgatgcgttgaaagctgttcaatctggattagggactgctgctgttattgtgatggataagtcgactgatattgtggatgcgattgcgaggctttcgtatttttataagcatgagagttgtggtcagtgtacgccttgtagggagggaactgggtggctttggatgattatggaaaggatgaaagttgggaatgcgaaattggaggagattgatatgcttcaggaagtgactaagcagattgaagggcatactatttgtgcacttggtgatgctgctgcttggcctgttcaagggcttattagacattttaggcctgagatggagaggaggatcagggagcgtgctgatcgggagttgcttcaagcagctgcttgaaatcaggttgaatggtttcctacctggaggaaaacatgaggtgactttggactttggagcataatatgattaatgtttaaggtttgtgttgctgttgaactacaatgtgattgaaaacagtacccttctctttagattgggggtaacttttgtgtgtttaaggatacaaagacatcctattgttattattgaacttcagttagccatatgcttttggacacatgtcaaaatgttaataagccgagtgcattgttgtaatcatacaatggaagcttttcataagctcaagtttcatgccttgtcagaacattaaccgttggtggtttgg

SEQ ID NO: 3882 - DNA, 1867 bp, Papaver somniferum
tctgtggatttcgataactccacgaagctttgattttacacacacctcttctctctcttctgagaggtctaatgggacccgtcaagaacattctctctctgcacagggcagcagctccattacggcaaagcactagaaggtgggatgcagtttgcagatcattcagtgctcaagcagcaactaccgcaaccactccaccaccacccccgcctcctgagaaaacccactttggtggactaaaagatgaggaccgcattttcaccaacctttatggattgcacgaccctttcctcaaaggtgcaatgaagcgtggtgattggcacagaaccaaagaccttgtactcaagggaactgactggattattaatgaaatgaagaagtcagggcttcgtggccgtggaggtgctggttttccatctggtcttaagtggtcgttcatgccaaaagtatctgatgggcgtccttcctatcttgtggtaaatgctgatgagagtgagccaggaacgtgtaaggacagagaaatcatgaggcatgatccacacaagctactagaagggtgccttattgcaggagtaggcatgagggccagcgcagcttacatctacataaggggagagtatgtaaatgagcgtttgaacctcgaaaaggccttaaaagaagcttataaagctggactattaggaaagaatgcatgtggttctggctatgactttgatgtgcatatccactatggtgctggtgcttacatttgtggtgaagagactgcacttcttgaaagtctcgaagggaaacaaggtaaacctagattgaagcctccatttccagctaatgctgggttatatggctgcccaacaactgttaccaatgtggaaacagtggctgtttctccaaccatcttaagaagaggacctgaatggtttgctagttttggcagaaagaacaattctgggacaaagctattttgcatctcaggtcatgtgaataagccttgcactgttgaagaggaaatgagtataccattaaaggaactgttagagaggcactgtgggggtgtcagaggtgggtgggataatttgcttgccgtgataccagggggttcttctgtgccattgcttcccaagcacatctgtgacggtgttttgatggattacgatgcactcaaggctgtgacttctgggttgggaactgctgcggtgattgtcatggacaagtcaactgatgttgtggatgctattgccaggctttcgtacttctacaagcacgagagttgtggtcagtgcacaccctgtagggagggaacaggatggttgtggatggtcatggaaaggttgaaggttggagatgcaaagctggaagagattgacatgctgcaggagatcacgaaacagatagaagggcacacaatctgtgctttgggtgatgctgctgcttggccagttcagggcctgatcaggcattttagacccgagttagagaggaggattagggaacgtgcagatagggaattattggaggttgcatctgcttaagccaccttccacacccaggttggctatatctttgatggctttccctgtttcgtaaagtaagaaatactaattcggatgtttgtcttttgtttttatttttgttaatgctgtgtttacatgatcaaacaaatgtgtcctcttcatgaagtgtaagtgacccaatgggtaacggtgcgcatgccggaaagtgagccagatacttattgctagttacaggaaaatttggtttcactagcaaatcatatttatttaatagtaaatcttttgccttgtagtttgcagttcacctgatctggtggatattgttgaataaaaaggttgaaggaactaaattcgat

SEQ ID NO: 3883 - DNA, 2119 bp, Senecio madagascariensis
tggatcccccgggctgcaggctaaaaatcatccccaatttttctcactaatttcttcaatataattgaagtctaccatatgctaaatcaattcggcccattctgtatccacgcgtcccattataccatcacacattcccattcaatctaaaccgtaggaacccagttggaccggtttatgtcgcaatattgattgaaccgctaccggcctagcccaccattaaaactcatttcatttgacgtcatctccctatacacttagaaattgttaattctcagttacatttcgttgtatattatggcacccatgaagggccttctttctttgcaacgggcagctttaatgaggcgtcatagtggaaattggggggtaagtgctagattgtttagcacccagtctgcaacaactgctactaccgcacagcctccaccaccacctcctcctcctgagagaactcactttggtggtttgaaagatgaagatcgtatttttactaatctttatggtattcatgacccatttcttaaaggtgccatgaaacgtggtgattggcatagaactaaagatttagttatcaagggtgctgattggatcgtgaatgagatgaaaaaatctggcctccgtggacgtggtggtgctggatttccatctggtcttaaatggtcgtttatgcctaaagtatccgatggtcgtccatcttatcttgttgttaatgctgatgaaagtgaacccggaacctgcaaggatcgtgaaattatgcgtaacgatccacataaactattagaaggatgcctcattgctggagtgggtatgagggcaactgctgcttatatctacattagaggtgaatatgttaacgagcgccttaaccttgaaaaagcccgaaaagaagcttatgcagctggcttacttgggaaaaacgcttgtgggtcgggttatgattttgatgtgcatatccactttggtgctggtgcttacatttgtggtgaagaaacagcacttctggagagtcttgagggtaaacaagggaaacctagattgaagcccccatttcccgctaattcaggtctatatggatgtcccacaactgttacaaatgtagaaacagtagcagtatcacctaccattctacggcgtggacccgagtggttttctagttttggaagaaagaacaattctgggacgaaactattctgcatatctggtcatgtgaacaagccatgcacagtcgaagaggagatgagtatatcattgaaggagcttctagagaggcattgtggtggtgttagaggtggttgggacaatttactggcggtaattcctggtggttcatctgtaccattgcttcctaaagacgtctgtgaggatgtgctgatggatttcgatgcactcaaagctgtacagtctggtttagggactgctgctgttattgtgatggataagtcaactgatgttgtcgatgctattgcaaggctttcctacttttacaagcatgagagttgtggtcagtgcacgccttgcagggagggtactggatggctttggatgataatggaaaggatgaaggttgggaatgcaaagttggaagagattgatatgctccaggaggtgacaaagcaaatcgaagggcacacaatttgtgctctgggtgatgctgctgcttggcccgttcaaggtcttatcagacatttcaggccggagatggaaaggaggatcagggagcgtgctgatagagagttgcttcaggcagctgcttaaatcaggccgaagaaatatctgcctgcattgtaagtctgtggaataaatatgcaaaaatactccaggcacctggaggaaaacaatgagtactttacgaacatgatggttaaatttgaagatttgtattgaataggatgtgattggaaataccaccctctctcgagaggtgggttataacgttttttgttgtttcagtgtgtggttaaggatacaaatatatcctattgttattgttgaacttaattagtcatgtttttggacatgtctgtttatgttaataagctgaatgcaatatgttgtaatcatacaaactcaagcttttaaaagctcaactttcttttctttccaaaaaaaaaaaacg

SEQ ID NO: 3884 - DNA, 2041 bp, Aquilegia formosa
gagaaaaatacaaatgcatcagtgaccatcacacacacacacagcttctaagttgtatcgggcgtgtgttgggcttgtttcttcttcttcttctttggatcgaatcattcgatctgtaaatccggcattaagcaagcaaacaaacatctttgaagagaagagctcggtttatttctctttctttgttcatgggttcggtaaagaaaattctctctctgccgagagcagctctgcttcgccattatagtgagaggtgtagcacagtttatagatcatttagtacccaagctgcgagcacctcaagtacaccacaacctcccccacctcccccaccaccagagaaaacccattttggtggcttgaaagatgaagatcgcatattcaccaatctttatgggttgcatgatccattccttaaaggtgctatgaagcgaggtgactggcacagaaccaaagacatagtcaccaagggagctgattggatcgtcaatgaaatgaagaagtctggtcttcgtggccgtggtggtgctgggtttccatctggcctcaaatggtccttcatgccaaaggtatctgacggacgcccttcttatcttgttgtcaatgctgatgagagtgaaccaggtacgtgtaaggacagagaaatcatgaggcatgacccacacaaactactagaagggtgcttgattgctggggtggccatgcgggccactgctgcttacatttacattcggggagaatatgtaaatgagcgtctgaatcttgtgaaggccaggaatgaagcttatcaagctggacttttggggaaaaatgcatgcggatctggttatgactttgatgttcatatccattttggtgctggtgcttacatatgcggtgaagagacggcattattggagagtctggaagggaaacaagggaaaccaaggttgaagcctcctttcccagctaatgcagggctatatggatgtccaacaactgttacaaacgttgaaactgtagctgtttctccaacaatcttaaggcgtggacctgactggtttgccagtttcggaaggaagaacaatgctgggactaaactattttgtgtgtcaggccatgtgaacaagccttgtacagttgaagaggagatgagtataccattaaaggagttgatagagagacactgcggtggagttagaggtggatgggacaatttgcttgcagtaataccaggtggttcatctgtcccactgcttcctaagaacgtatgtgaagatgttctgatggacttcgatgccctcaaggctgtccaatctgggttgggaactgctgcagtgattgtgatggacaagtcgacagatgttgtggatgcgattgctaggctttcatacttctacaagcacgagagctgcgggcaatgtacaccatgtagggagggaacaggatggctttggatgataatggaaagacttaaggttgggaatgcaaaactggaggagatagacatgcttcaggaagttactaagcaaattgaggggcacactatctgtgctttaggtgatgctgctgcttggcctgttcagggtctcataaggcattttagaccagagcttgaaaggaggatcaaggaacgtgcagatagagaattgattgaggctgctgcttgagccttgtagcaaggttcatcttgatctggtagctgttgtggaataaaggttgaaatggctccatgttgtcctaccaagtatttatgtctgaatatttgtttcagaaattgaatttggtcttatgttgtataatccaacgaagatgttgactttctgcacatttgattgatgatcagcataattcctgtattttcaggagaataacctttacgcgattttgttttggtaatcgcagactaatcaaaacttactataaaaagatgttacaattgtctgtattggataatttcatctgaaactttgtctcattgtctgcccctctgttttatttgctttcatatatgtttgaactgtatcttgtttataacataagtgattaagaggagttagag

SEQ ID NO: 3885 - DNA, 1891 bp, Cichorium intybus
attttccctttaaagttgatttccgtatagtagacttcaaaatcttcgccacagttgaattgctgataattagttcagaagcttgattgctatatttcgtggtgtatggcaccaatgaagggcattctttctctacaaagggctgttttgttgagccgtcaaaatgtgaatcgtgggctaagtgctagactgtttagcactcagtcagcaacaaccgccaacaccgcccaacctccaccaccaccacctccaccggaaaaaacccactttggtggcctgaaagatgaagaccgcatcttcacaaacctctacggtttacacgacccgtttctcaaaggcgcaatgaaacgaggcgattggcataggaccaaagacatagtaatcaaaggcgccgattggatagtaaacgaaatgaaaaaatccggcctacgtggacgtggtggtgccggtttcccctcagggctaaaatggtcattcatgccaaaagtatccgacggccgcccgtcttatctcgttgtaaacgcggacgaaagtgaaccgggaacctgcaaagatagagaaatcatgcgtaacgacccccacaagcttctagaaggatgtttaatagctggagtaggtatgcgagcaaccgctgcttacatttacatcaggggcgaatacgtaaacgaacgtttgaatctagaaaaagcccgaaaagaagcgtacgcagctggattgctcgggaaaaacgcgtgtgggtccgggtacgacttcgatgtccatatccattacggtgccggtgcttacatttgcggtgaagagaccgcgcttttggaatccctcgagggcaaacaaggaaaaccgcgtttgaaaccgccttttccagctaacgcaggtctatacggatgcccgacaaccgtcacaaacgtggaaacaatcgcggtgtcgcctacaattctaagacgcgggcccgagtggttttctagtttcggtaggaagaacaattcgggtactaagttgttctgtatatcaggccacgtgaataaaccgtgtacagtggaagaggaaatgagtattccattgaaggagttgttggagcgacactgtggcggtgtgaggggcggatgggacaatttactggcggtgattcctagcggttcgtctgtcccgttgcttacaaaggatttatgtgaggacgtgttgatggatttcgatgcattgaaagcggttcaatctggactcgggactgctgctgttattgtgatggataaatcgactgatattgtggacgcgatcgcaaggctttcatatttttataaacacgagagttgtggacagtgtacgccgtgtagggaggggactggatggctttggatgattatggaaaggatgaaagttgggaatgcgaaattggaggagattgatatgcttcaggaggtgactaagcagattgaagggcatactatttgtgcacttggtgatgctgctgcttggcctgttcaggggcttattagacattttaggcctgagatggagaggaggatcagggagcgtgctgaccgcgagttgctccaagctgctgcttgattcagggtgaacgatttcctaccttgcagtctgaaagaagacacctggaggaaaaagattagccccctttggacaacatgattaacgttttaagatttatgttgaactacaatgtgattgaaaatactaccctctctttagattgggggcaacttttgtgtgttttaaggatacaaaaacatcctatcgttattattgaacttctgttagccatgcttttggacatgtcttgtatgttaataagctgaatgcaatgttgtaatgttatgttacaaatgatgagcttttgaaagctagatataaactattggtggtttaaccaaaa

SEQ ID NO: 3886 - DNA, 1726 bp, Cirsium arvense
attcaccatacttggaattgtctgtttctctaatcagaagctcgattgctgcatttcctgttgtatggcacccatgaagtgcattctttctctacaaagggcggctttattaaggcgtcaaaatgggaattgggtgcttggtgctagatcattcagcactcagtctgcaaccaccgctaccaccgcacaaccgccaccgcctcccccaccgccagagagaacccactttggtggtttaaaagacgaagatcgcatttttaccaatctttatggtttgcacgacccttttctcaaaggtgccatgaaacgtggtgattggcatagaactaaagatatagttatcaaaggtgctgattggatagtaaacgaaatgaaaaaatctggtcttcgtggacgtggtggtgctggatttccatctggtctcaaatggtcgttcatgcctaaagtttctgatggccgtccatcttatcttgttgttaatgctgatgaaagtgaacccggaacctgtaaagatagggaaattatgcgtaacgatccgcataagttattggaaggatgtctgattgctggagtcggtatgcgggcaactgctgcttatatatatattagaggcgaatatgttaatgaacgacttaatcttgaaaaagcccgaaaagaagcttatgcagctggcttactcgggaaaaacgcttgtggttcgggttacgattttgatatccatatccatttcggtgctggtgcttatatttgtggtgaagaaaccgctcttttggagagtctcgagggtaaacaaggaaaaccgagattgaaaccaccttttccggctaatgctggtctttacggctgtccaacaaccgttacaaatgtcgaaactatagctgtatcgccgaccatattaagacgtgggcctgaatggttttctagtttcggtagaaagaacaattccgggactaaactattttgcatatcgggccatgtgaataagccgtgtacagtcgaagaggaaatgagtatctcgttaaaggagttgttagagcggcactgtggcggtgttaggggcggatgggacaatttactggcggtgattcctggcggttcgtctgtaccattgcttccaaaagacgtttgtgaggatgtcttaatggatttcgatgcattaaaagctgttcaatctggattagggacagctgctgtgatcgttatggataagtcgactgatgttgttgatgctattgctagattgtcttatttctataagcacgaaagttgtggtcagtgtacaccttgtagggaaggtactggatggctatggacgattatggaaaggatgaaagttgggaatgcaaagttggaggagattgatatgttacaagagataacgaagcagattgaaggacatacgatttgtgcgttgggtgatgcagctgcgtggccagttcaagggcttattaggcattttaggccggagatggagaggaggatcagggagcatgctgatagagagttgcttcaggcggctgcttgaaatcagatgtaagtctttggaataaatattcagaaatactctggacagatggaggaaaatggttctgagcatcatggttaagtttttaatgtctgtattgaaccaggatgtgactgaaaatactattcagcctttcttctcgatgattcagatgggggtaactttttgctgttttggtgttggtgtgattaagacatgtta

SEQ ID NO: 3887 - DNA, 1993 bp, Euonymus alatus
tcaaaattcaacacctgattaacatatctccaccgtctattccacggtcgcacgttggtcgtgtggtagatacgtgtttccattctccagagcctccccgtcttctctactgatacctggatttgtcctgttaaagcttcgccgggaacgatcggagctgagcagtttcatttcacgctatggcacccatgaagagctttctttccttgcggcaggcagctttggttcgacatcacagtgagagatgggttgctggcttcagatcattcagcacccaaggtgcaacaactggtagtactcccccgcctcccccacctccagagaaaacccactttggtggccttaaagatgaggacagaattttcacaaacctgtatgggttgcatgatccatttcttaagggttccatgaaacggggtgattggtacagaaccaaagatttggttcttaagggtgctgattggattgttaatgaagtgaagaagtctggcctccgcggacgtggtggtgccggttttccatctggccttaaatggtcattcatgcctaaagtatctgatggccggccttcatatcttgttgtcaatgctgatgaaagtgaacctggaacctgtaaggatagggaaatcatgcgtcatgatccacataaattattggagggctgtttgattgccggggttggaatgagggccactgctgcttacatctacataaggggtgagtatgtgaacgaacgtaagaaccttgaaagagccagaaaagaggcttatgaagctggacttttgggaaagaatgcatgtggatctggttatgattttgatgtacatatccattatggtgcgggtgcttatatttgcggtgaagagactgcccttttggagagccttgaaggaaaacaggggaaaccaaggttgaagcctcctttcccagctaatacagggttatatggctgtccgacaactgtaacaaatgtggaaacagtggctgtttctcctaccattttgaggcgtggaccagaatggtttgcaagttttgggaggaagaataattcaggtacaaaactattttgtgtgtctggtcatgtgaacaagccttgcactgttgaagaagagatgagtatacccctaaaggagctaatagagaggcattgcggaggtgttcgaggtggatgggacaatttattggcagttattccagggggttcatctgttccattgatccctaagcatatctgtgatgatgtgctgatggattatgatgcacttaaggctgttacgtcaggactggggactgcagctgtgattgtgatggataaatcaactgatgttgtggatgcaattgccaggctctcctatttctacaagcatgaaagctgtggccagtgcacaccatgcagagaggggacaccgtggctttggatgataatggagaggttaaaggttggtaatgcaaagttggaagagattgacatgcttcaggaggtgaccaagcagattgaagggcacacgatttgtgcacttggtgatgctgctgcttggcctgtgcaaggtctcataaggcactttaggccagagctggagagaaggatcagggagcgtgcagacaaggaattgctggaggctgctgcttaggtttgctatggagggaatgtcctatactagcgaataataaagatgaagaaattacagccaacatcggcagaattgattgcttgaggcatctggaattccagtcacaatttctttttgccattttttgaacctgtgtcaatgatcaaactccattcactgttgcgaagattaatattatatacttatcgttgtatccaggcagaagtcatgtaatttcactggaatttagctaatgctgttcatttaggaataagaaatacatggccatacatttaaagccgtgccaagcttcaaatgaaattgttttcaagtttttgacggagttatgtatcttaaattacaatgagatatcttagatgctg

SEQ ID NO: 3888 - DNA, 2085 bp, Cajanus cajan
gctaaacaaagcccaaaaatctaacccaacaccaaataataaattaaaagacccaaaaaaaaaaaaacaaaaaacgatcgagagaagacaacctgagagtaaccaaacgcacaacacaagcagcacaagaagttgctccattttcaacactcaatcagatcccatacatcaatagcttcgtcactggtaaggcaaccatgaggggcattctttctgcaaggacagccttggttcaacgtcagagtgagaagtgggcccttggtttcagactatttagcactcagggtgcttccactgctagtaccccacagccaccaccaccgcctccaccgccggagaaaacccattttggtggacttaaggatgaggacaggatatttaccaacttatatgggctgcatgatccttttctcaaaggtgccatgaaacggggtgattggcatcgaactaaagatttggtacttaagggtaccgattggattgtgaatgaaatgaagaagtctggcctccgtggacgtggtggtgctggttttccttcaggcctcaaatggtcattcatgccaaaagtatctgatggccgcccttcttatcttgttgttaatgctgatgaaagtgaacctggaacttgcaaagacagggaaatcatgcgacatgacccacataaattgttagaaggttgcttgattgctggagtgggaatgagggctagtgctgcttacatctacatcaggggtgaatatgtgaatgaacgtaagaatctcgaaaaggctaggcaagaggcttatgcagctggtttattgggtaagaatgcttgcggctcaggctatgattttgatgttcatatccactttggtgctggagcttatatttgtggtgaggaaacggccctcttggagagccttgaagggaaacaaggtaaaccaagattgaagccgcctttcccagctaatgcagggttatatggctgtcctaccactgtaacaaatgtggaaactgtggctgtctctccaaccattttaaggcgtggtcctgaatggtttgccagttttggtaggaagaacaattctggtacaaagttgttctgtgtgtctgggcatgtgaacaagccctgcactgttgaggaggaaatgagtattccactgaaggagttgatagagaggcactgtggaggtgttcgaggaggatgggataatttacttgctgtgattccaggaggatcatctgttcctctgattccaaagaatatatgtgatgatgtcttgatggattatgatgcattgaaggctgtccagtcagggttgggaactgcagctgtaattgttatggataaatctactgatgttgtggatgccattgctaggctttcctacttctacaagcatgaaagctgtgggcagtgcacaccatgcagggaggggactggttggctttggacgatcatggaaagaatgaaagttgggaatgccaagctagaagaaatcgatatgcttcaggagttgactaaacaaatcgaagggcatacaatttgtgccttgggtgatgctgctgcatggccggtgcagggtcttatcaggcatttcaggcctgagcttgagagaaggattagagagaatgcagaaagagaactgctacaggccactggttaggcttttactaaggggtgtgactgtactggtggatagcaataatgcgaataagacggtgccagtcattttggaaatataggtggctcaggttactgtagcttaatcgctacttctatttacttttatgctgtagcaattatggctggaccatacctgagaaaccagtttaaactgtgtacctgcttgtcatttggcacattttcatgtaatttgttaataatatctgtatactgttattaattttgagaaacaattcatgattacttttgttatcgattaatgatgaaggataatgtccactggattaccaagactttgattatgatatgggattgtattatttattgggattaacattttagaagaacgtgtcactgttctaaaaccagcctcaactttcttgtatgaagtctgttgatccatgcatgggctaaaacat

SEQ ID NO: 3889 - DNA, 1629 bp, Amborella trichopoda
ggacccatgaggaaccttctctcttttcctagatcatcactcactcagcactacagcaagggattggtgccattcaacaggtctttcagcacacaagccccaactacatcaagtactccccagcctccatcccctccaccaccccctgagaaaacccacttcggtggcctcaaggatgaggaccgcatctttaccaacctctatggtataaatgatccattcctcaaaggggccatgaaaaggggtgactggtaccaaaccaaagacctcatcctcaaaggctctgattggatcgtcaatgaaatgaaaaagtcgggccttcgaggacgtgggggtgccggcttcccatcgggtctcaaatggtcttttatgccaaaggtctctgatggccgcccctcttacttagttgtgaacgccgatgaaagtgagccaggaacttgcaaagaccgagaaatcatgcggcatgaccctcataaactcctagagggttgcttgattgctggcgttggcatgcgagctagtgcagcctatatctatattcgcggtgagtatgtgaatgagcggctcaacctcctcaaggcccgaaaagaagcctacgaggtcggtttgctcggcaagaatgcctgtggctcgggctatgactttgatgtgcatattcactttggcgctggtgcttacatttgtggtgaagagacggcactattggagagccttgagggcaagcaagggaagccgaggcttaagccccctttccctgcaaatgcagggctttatgggtgccccaccaccgtaacaaatgttgagacagtcgctgtgtcgccgaccatattgcgcaggggccccgagtggtttgcgagctttggtcgaaagaacaactcgggcacaaagctcttttgcatttcgggccatgtgaacaagccttgcactgttgaggaggagatgagcatacccctcaaggagcttatcgaaaggcattgtaaaggtgttcgaggagggtgggacaacctattggctataatccctggtggctcatcggtccccctcttgccaaaggacatatgtgatgatcttttgatggattttgatgctctcaaagctgtacaatcagggttgggtacagctgctgtcattgtgatggacaagtcaactgatgttgttgatgcaattgcaaggctgtcgtacttttacaagcacgagagttgtgggcaatgcacaccttgtagggagggaacagggtggctttggatgataatggagaggttgaaggttgggaatgctaagctggaggagattgatatgcttcaagaggtaacaaagcagatcgaagggcacactatttgtgctttgggggatgcagcggcctggcctgtgcagggtttgataaggcatttcaggcccgagcttgaaaggaggattaaggatagggcacagagagagttattggaatcagctgccgctgcctgagaaggaatgatgggttttcctgttttttgttgattaaatttctgtgtgaactggccacgggctcctgtgaaataagaggagaggaacttgggagaagaacatttgtattaattaaatattattattttattgaacatatggaagagtatggatttgttccggtaa

SEQ ID NO: 3890 - DNA, 2155 bp, Brachypodium distachyon
attcggtccaaatcgtcaagaactcaagacccaagagcaccaactagccgcgtgcatccgtccacgagggcagaacaggtaggagacacaaacgaaaatgctgcgccgcgccgcccaccgcctcgcctcccgcgccgccgccacgggcggcgctggctccgtcgcccgcaggaccctggccgcggcggaggtgcccgtgcaggcgcccgcggactccgcgttcgtgggaatcgccgccaacaaggaggttgagcatttgaattatctatcaaggccacagcctactcgttctatcacatgtgccagactgtatcctgctggcagatcattcagcacccaggctgctagtacatcaagcacaccacagcctccaccaccaccaccacctccagagaagactcactttggtgatcttaaagatgaagatcgcatttttaccaacctctatggtctgcatgatccttttctgaaaggtgcaatgaagaggggtgactggtatagaaccaaggacttagtgattaaaggggcggattggatagtgaatgaaatgaagaaatcaggtttgcgaggccgtggaggcgcaggttttccttcaggcctcaaatggtccttcatgcccaaggtctctgatggacgcccatcttatcttgttgttaatgctgatgagagtgagccaggaacttgtaaagacagggaaatcatgcgccatgacccccacaagcttctggaagggtgcctgattgctggagttggaatgagggcatcagccgcttacatatatattagaggtgaatatgtgaatgagcgtctcaaccttgagaaagcccgactggaagcatatgcatctggacttcttggtaagaatgcttgtggatctggttatgattttgatgtgcatatacattttggtgctggtgcctacatctgcggtgaagagactgccctactcgagagccttgaaggcaagcagggaaaaccaagactgaagccgcctttccctgccaatgctgggctgtatggttgccccacaactgtcacgaatgttgaaactgttgctgtagctccaacaattcttaggcgtggcccagaatggtttgcaagttttggacgtaagaacaactcagggacaaaactgtactgtatctcaggccatgtcaacaaaccttgcaccgtggaggaggaaatgagcatacctctgaaggaattgatcgagaagcattgtggaggtgtaagaggaggatgggacaacctgcttgcagttattcctggtggttcatctgttcccctgttaccaaagcacatatgtgatgatgtgttgatggactatgacgccctaaaggctgtccaatctggattagggactgcagcagttatggtgatggacaaatccacggatgttgttgatgcaatcgctagactgtcatacttctacaagcatgagagctgtgggcagtgcacaccttgccgtgaaggcacaggatggctttggatgatcatggagaggctcaaggtaggcaatgccaagctagaggagatcgatatgcttcaggaggtcacaaagcagattgaagggcatacgatctgtgcccttggggatgctgcagcatggcctgtgcagggtcttatcaggcacttcaggcctgagctggaaaggaggatccgcgaccgagctgatagggagctgctgacagcagcttctgcataagcaccattgcacacctgttctagtttcctgatttctttcacagaaataatccaaactgatggagctcatttctgtacaacgagatgcagcatcctgatttgtttaaacctttatgtggatgtttatttgatgcgctgaagcagctggtgtattttgatggacaagcgacacttttgaagtagaaacaaatatgaaggtttgtaccctgtatgttacataagcctgcttgtttctgatgaatgttaagtaagattgtctcctaagttctccagaatctgagtaaatttgttgaaaatatactaccatgtttggccaatgcttgcagaagatgtagagattattctttctacataatatggcatttttcgggcctggtgctagacaccagactctcaatcagccttcaaattgtgatttacctttgcactattagctcctttgtactccatg

SEQ ID NO: 3891 - DNA, 1777 bp, Amsonia hubrichtii
agctcaatcgtcgtggtgtgtcctttacgacagcatttcatgctcttatggcacccataaagggcatcctttctctacagcagactgcttttgttaggcatcaggagggttggcgccttggcagtagattattcagcactcaggccacatcaactactagtgctcctcaggcccaacagcctcctccacctcctccacctcctgagaaaacccactttggtggcctcaaagatgaggaccgtattttcacaaacctttatggtttgaatgaccctttcctcaaaggtgccatgaaacgaggtgactggtatagaacaaaagacatggtactcaagggctctgattgggtcgtcaatgaaatgaagaaatctggccttcgtgggcgaggtggtgctggctttccatctggacttaaatggtccttcatgccaaagcaatctgatggccgcccttcctatcttgttgtcaatgctgatgaaagtgaacctggaacttgtaaagatagagagattatgcgtcatgatccacacaagttattagaaggttgtctgatagctggtgttggtatgagggctagtgctgcatatatttacatcaggggtgaatatgtgaatgagaggaagaatctggagaaggcaaggaaagaagcttatgcagctggtcttctgggaaaaaatgcatgtggctctggttatgactttgatgtacatatccactatggtgctggagcctacatttgtggtgaagagacagctctcctagagagccttgaggggaaacaaggtaaacctagattgaagcctccttttcctgctaattcagggttatatggttgccccactactgtcacaaatgtggaaactgtagctgtttcacccaccatcttaaggcgtgggccagagtggtttgctagttttggtaggaagaacaattctggtacaaaattgttttgtatctcgggacatgtgaacaagccttgcacagttgaggaggagatgagtatacctttgaaggagctaatagagaggcactgtggtggcgttcggggtggctgggataatttacttgctgttatacctggtggttcgtctgtcccattgattcccaagcatatatgtgaggatgtgcttatggactttgatgcactcaaggctgtgcagtcagggcttgggacagctgctgtaattgtgatggataagtcaactgatgttgtagatgcaattgcaaggctctcttatttctataaacatgagagttgtggtcagtgcacaccttgcagggaaggtacaggatggctttggatgatcatggaaagaatgaaagttggaaatgccaagttggaggagattgacatgcttcaagaagtgacgaagcagattgaagggcacacaatctgtgcactcggtgatgctgctgcttggccagttcagggtctgatcaggcacttcagaccagagcttgaaaggaggattagggagcgtgcagacagggaactattagaggctgctgcttgattcttctattcagggggaaagcattttccagttagagtgccgtggaataaaaatatacaagcatctgagacgttggccaaggtgcattcaggcctgccaaagcagcatgtttgatttttagtcttgtatcaaactatgagttgctggatccattatgttatttcagaagattaaatggatacaagtttcagaagactatcctgtcaaagcatgatgatttgaaaaccttagttttaattgtcaataaaagtaaacctcatttt

SEQ ID NO: 3892 - DNA, 1845 bp, Phaseolus coccineus
aatcccaaatcacaacacagagcagcagaagaaagtgttccaatttcaacactcatcagatcccagtgatcaatcaattgcatcgccactggtaagacaaccatgaagagaattttttctcaaaggacagccttggttcaacatcgtagtgagaatttgggtcttggtttgagactatttagcacacagggtgcttctactgctacttcaccacagccgccaccaccacctccaccgccagaaaaaacccattttggtggccttaaggatgaggacaggatatttaccaacttatatgggctacatgacccttttctgaaaggtgcaatgaaacgtggtgattggtatcgaacgaaagatctggtaatcaagggtactgattggattgtaaatgaaatgaagaagtctggcctccgtgggcgtggtggtgctggtttcccttcaggcctgaaatggtcattcatgcccaaagtatctgatggccgcccttcctatcttgttgtcaatgcagatgaaagtgaacctggaacttgcaaagacagggaaatcatgcggcatgacccacataagctgttagaaggttgcttgattgctggagtgggaatgagggctactgctgcttacatctatatcaggggtgaatatgttaatgaacgtaagaatcttgaaacggctaggctagaggcttatgcagctggtttattgggtaagaatgcttgtggctcaggctatgattttgatgttcatattcactatggtgccggagcttatatttgtggtgaggaaacagccctcttggagagtcttgaagggaagcaaggtaaaccaagattgaagccacctttcccagccaatgctgggttgtatggttgtcctaccactgttacaaatgtggagactgtggctgtttctccaactattctaaggcgtgggcctgaatggtttgccagttttggtaggaaaaacaatgctgggacaaagctgtattgtgtgtcagggcatgtgaacaagccttgcaccgttgaagaggaaatgagtattccgctgaaggagttgatagagaggcactgtggaggtgttagaggaggatgggataatttacttgcagtgattccaggagggtcgtctgttcctctgcttccaaagagtatatgtgatgatgtcttgatggattatgatgcattaaaggctgtccagtctgggttgggaactgcagctgtaattgtgatggataaatctactgatgtcgtggatgctattgcaaggctttcttacttctacaagcatgaaagctgtgggcagtgcacaccatgcagggagggaactggctggctttggaccatcatggaaagaatgaaagttgggaatgcaaagctagaagaaattgatatgcttcaggagttaactaaacaaattgaaggtcatacaatttgtgccttgggtgatgctgctgcatggccagtgcagggtcttatcaagcatttcaggcctgagcttgagagaaggattagagagaatgctgaaagggagctgctgcaggccactggataggctattactaaggggtatgactgtctggtggatatcaagaatcagaataagatagtaccagtcattttggaaagataggtggctcaggttactatagctttatggctacttctatttactttttttatgctgtagcaattattggctggaccatacctgggaaaccatttgggagagtttaaactgtgtacctgtttgtcatttgacacattttcctgtaatatgttaataatatctgtatactgtattatttttgagaaacagttcatggttacgcatgttaccagtgaatca

SEQ ID NO: 3893 - DNA, 1956 bp, Brachypodium distachyon
gagggcagaacaggtaggagacacaaacgaaaatgctgcgccgcgccgcccaccgcctcgcctcccgcgccgccgccacgggcggcgctggctccgtcgcccgcaggaccctggccgcggcggaggtgcccgtgcaggcgcccgcggactccgcgttcgtgggaatcgccgccaacaaggaggttgagcatttgaattatctatcaaggccacagcctactcgttctatcacatgtgccagactgtatcctgctggcagatcattcagcacccaggctgctagtacatcaagcacaccacagcctccaccaccaccaccacctccagagaagactcactttggtgatcttaaagatgaagatcgcatttttaccaacctctatggtctgcatgatccttttctgaaaggtgcaatgaagaggggtgactggtatagaaccaaggacttagtgattaaaggggcggattggatagtgaatgaaatgaagaaatcaggtttgcgaggccgtggaggcgcaggttttccttcaggcctcaaatggtccttcatgcccaaggtctctgatggacgcccatcttatcttgttgttaatgctgatgagagtgagccaggaacttgtaaagacagggaaatcatgcgccatgacccccacaagcttctggaagggtgcctgattgctggagttggaatgagggcatcagccgcttacatatatattagaggtgaatatgtgaatgagcgtctcaaccttgagaaagcccgactggaagcatatgcatctggacttcttggtaagaatgcttgtggatctggttatgattttgatgtgcatatacattttggtgctggtgcctacatctgcggtgaagagactgccctactcgagagccttgaaggcaagcagggaaaaccaagactgaagccgcctttccctgccaatgctgggctgtatggttgccccacaactgtcacgaatgttgaaactgttgctgtagctccaacaattcttaggcgtggcccagaatggtttgcaagttttggacgtaagaacaactcagggacaaaactgtactgtatctcaggccatgtcaacaaaccttgcaccgtggaggaggaaatgagcatacctctgaaggaattgatcgagaagcattgtggaggtgtaagaggaggatgggacaacctgcttgcagttattcctggtggttcatctgttcccctgttaccaaagcacatatgtgatgatgtgttgatggactatgacgccctaaaggctgtccaatctggattagggactgcagcagttatggtgatggacaaatccacggatgttgttgatgcaatcgctagactgtcatacttctacaagcatgagagctgtgggcagtgcacaccttgccgtgaaggcacaggatggctttggatgatcatggagaggctcaaggtaggcaatgccaagctagaggagatcgatatgcttcaggaggtcacaaagcagattgaagggcatacgatctgtgcccttggggatgctgcagcatggcctgtgcagggtcttatcaggcacttcaggcctgagctggaaaggaggatccgcgaccgagctgatagggagctgctgacagcagcttctgcataagcaccattgcacacctgttctagtttcctgatttctttcacagaaataatccaaactgatggagctcatttctgtacaacgagatgcagcatcctgatttgtttaaacctttatgtggatgtttatttgatgcgctgaagcagctggtgtattttgatggacaagcgacacttttgaagtagaaacaaatatgaaggtttgtaccctgtatgttacataagcctgcttgtttctgatgaatgttaagtaagattgtctcctaagttctccagaatctgagtaaatttgttgaaaatatactaccatgtttggccaa

SEQ ID NO: 3894 - DNA, 1725 bp, Phalaenopsis aphrodite
cgcaccagcagcgagagaagcaggatccgtggcttccccaaatccatatgcttcttcgtgttcctcgactttatctagcggagataatctagtaagttgcgatttctaagcccataaacgcgctctcggctgccgccggtggtgatgggttacgccaatgagctggtactggctcgacgcctcaaggatcctcttaggagcctatttgccctaccaaggtctcattttccacaaagctgcctgagtaagaggtttaatgttgcatgcagcttcttcagcactcaggcggccagcacagcaggcactccacctccaaccccacctccgcctccgcctccagaaaaaacccattttggtggacttaaggacgaggatcgcattttcaccaatctctatggcttgcatgaccctttcctcaaaggcgccatgaaacgaggtgactggtatcggactaaggatttggtgctgaaaggatctgactggatagtaaatgagatgaagaaatctggtctgcgtggtcgcggaggagctggctttccatcaggcctcaagtggtcattcatgcccaaggtatctgacggccgcccttcctatcttgttgtcaatgctgatgagagcgaacccggaacttgcaaggacagggaaatcatgcgacatgatccacacaaactcatagagggatgcttaattgcaggagttggcatgagggctacagcagcttacatctacataagaggagagtatgtcaatgagcgcttgaacctcgaaaaggccaggaaagaagcctatcatgccggcttcttgggtaagaatgcttgtggctctggctacgatttcgatgttcacattcactatggagcaggtgcttacatttgtggagaagaaactgctttattggaaagcctcgaagggaaacagggaaagcctagacttaaaccaccttttcctgcgaatgctggattgtatggctgcccgaccacagtcacaaatgtagagacagtcgcagtttctcccactatacttagacgaggccctgaatggttcgcgagcttcggtcggaagaacaattctggtaccaagctgtactgcatttccggccatgtcaacaaaccttgcaccgtggaagaggaaatgagcataccattaaaggaactaatagagaggcattgcggcggcgtcaggggaggttgggataacttgcttgctattatacctggtggatcttccgttcctctgttgccgaagcacatctgcgacgatgtactgatggattacgatgcactcaaggctgttcaatctggattaggaacagctgctgttatggtgatggacaagtccacagatgtggtggatgctattgcaaggctatcatacttttacaaacatgagagctgtggtcaatgcactccttgcagggagggaactggatggctgtggatgataatggagagattgaaggttggtaatgcgaagattgaggagatcgatatgcttcaggaggtatcgaagcagattgaggggcataccatctgtgcgctgggtgacgcggcggcgtggcctgttcaggggctcatcaggcacttcaggcccgagctggaaaggaggatacgagatagggctgcacgggagctgctggaagctgctgcggcataagctggaagctatgttgtatttctggaattcaagtctgtccaataatgaaagttttttcttactttggatttg

SEQ ID NO: 3895 - DNA, 1401 bp, Cleome gynandra
ttgaggtcactcagcacccaagctgcaaccacctccaacactccacagccaccgccacctccaccacctccagaaaagactcattttggtggtctcaaggatgaagacaggatctttaccaacctctatggtctgcatgatccatttctgaaaggggctatgaaaagaggtgattggtacaggacaaaagatttggtactcaagggttctgattggattgtcaatgaaatgaaaaagtctggtcttcgtgggcgtggtggtgccggtttcccatctggccttaagtggtccttcatgcccaaagtatccgatggtcgcccatcgtatctggttgtcaatgctgatgaaagtgaacctgggacttgtaaagatagggaaatcatgcggcatgatccccacaaattattggaagggtgtttgattgctggtgtgggcatgagagctagagctgcatacatttacattagaggtgaatacgtgaacgaacgtaaaaatctggagaaggccagaagagaagcctatgaagctggtctcttagggaagaacgcgtgtggctctggttatgactttgatgtttatatccactttggtgctggggcatacatttgtggtgaggagaccgcacttatagaaagccttgaagggaagcaagggaaacccagactgaagcctccattccctgctaatgctggtttatatggttgtcccaccactgttaccaacgtggaaacagtggctgtttctcctaccattttaaggcgtggaccagagtggtttgctagttttggtaggaagaacaactccggtacaaagttgttctgtatatctgggcatgtgaataagccttgcacggtcgaagaggagatgagtatacctctcaaagaactgattgagaggcactgcgggggtgttagaggtggatgggacaatctacttgctgtcattcccgggggttcatcagtccctttgattcctaagaacgtatgcgaggatgttctgatggattttgatgcactcaaggctgtccaatcaggtctgggaactgcagcggtcattgtgatggataagtcgactgacgtggtggatgccattgcacgattatcgtacttttacaagcatgaaagctgcgggcagtgcactccttgcagagagggcacaggatggctttggatgataatggaaagaatgaaagttgggaatgcaaagctggaagagatcgatatgctccaggaagtgacaaaacaaatagaaggacacacaatatgtgcattgggtgatgcagccgcatggcctgtgcagggtttgataagacattttaggccagagcttgaacgaaggatccgtgaacgtgctgaaagggagttgcttgaggctgctgcttaagcagctcttgtattcagg

SEQ ID NO: 3896 - DNA, 2111 bp, Vitis vinifera
gggtttgtggttgcagcgagaagctccggtccactcttcacgaaagcattaaatcatttcttctccaaacgcagcgattcgtttgatctccgagttcaaggtggagtgacgtctgcctacagatacttgttaagtttaaagatcacatcccaaatggcacccatcaggggcattcttactctgcaaagaatggcattagtttcacgtcaaagcaaaaagtggggcccaggctgtagagcttttagcactcaggctgcaacaactgcaagtgcttcacagcctccaccacctcctccacctccagagaaaacccattttggtggcctgaaagatgaggaccgcatcttcaccaatctttatgggttgcatgacccatttcttaaaggtgccatgaaaaggggcgactggtacaggaccaaagacatagtactcaagggttctgattggattgtaaatgaaatgaagaaatctggtctccgtggacgtggtggtgccggttttccatctggcctcaaatggtccttcatgccaaaagtatctgatggccgtccttcctatcttgttgtcaatgctgatgaaagtgaacctggaacatgtaaagacagagaaataatgcggcatgatccacacaaactattagagggctgcttgattgctggggttggaatgagggctactaccgcttacatctacataaggggtgaatatgtgaatgaacgtaaaaaccttgaaagggccaggaaagaagcttatgaagctggattactgggcaagaatgcatgtggatctggttatgattttgatgtccatatccattatggtgctggtgcttatatttgtggtgaggaaacagcacttttggagagtcttgaagggaaacaagggaagccgagattgaagcctcccttcccagctaatgcaggattatatggttgtcccaccactgttacaaatgtggaaactgtggctgtttcacccaccatcttaaggcgtggaccagagtggtttgctggttttggaaggaagaacaatgctgggacaaaattgtattgtgtttcaggtcatgtgaacaaaccttgcactgttgaagaggagatgagtataccattaaaggaactgatagagaggcactgtggaggtgttagaggtggatgggacaatttacttgcagtaatacctgggggttcatccgttcctctccttcccaagcacatatgtgatgatgtcctgatggattatgatgcactcaaggctgtccagtcggggttggggactgcagctgtgatcgtgatggataagtctactgatgtcgtggatgcaattgcaaggctgtcttacttttacaagcatgagagctgtggacagtgtacaccatgcagggagggaacaggttggctattgatgatgatggaaagattgaaagttgggaatgcaaacttggaggagattgacatgcttcaggaagtgacaaagcagattgaagggcacacaatctgtgcattgggtgatgcagctgcttggcctgttcagggtcttatcaggcattttagaccagaacttgagagaaggatcagggagcgtgcggagagggagttgctggaagtggccgctgcttaagtattttatgcagggaaacaccggaactggtgggtaatgtggaataaaatgaagaacaacaaatgttaggagcggaaggcaactccaggcatctggctgtcgaattggtatttcgtttatttcctcccctgtataacctctgtgactcactcttggagtgattagcactactccataatgttgcaaatcggggataatttgagttatttcttctgtttgtgattataccaccattgaaacttgcctttcgactcattttgaggaactttgctctagtaatttgtttttctttatgtgaaatgctgatcatgtttctgttttatcaataaaacatagttgtatgttgcagctttgatgttattcttaggtatagcattataatagctgaatttggggttggggggtgtgttagggtggagggcgtggtgggttgggtgttgggggtggcgcggtggggaaatatttcagatacgagtaagttatctaatggttat

SEQ ID NO: 3897 - DNA, 2165 bp, Cucumis melo
cagccgttcggtgcccgattccaacaaatacgatgacgatcaatgaatcctagccgtagatcttgtttactagaggtcgccactggccagttcgtctttctcccctctcacccccattttctccatcgtttctgtaaacctcccagcttgagctagggaaagatattcaatctaccatttgagatttttgtgaaggaagaaaacaagtttctagttggatctccctcaatcgcctgcgcgtctcaggattgaagcacttcatgctatggcaccttttaggggcatgctttatcttcaacatagaacattggcaaggcgttatattgatcagtggggcataggattgagagcgtttagcagtcagggtgcagcagctcctggcagtcctcagcctcccccacctcccccacctccagagaaaactcattttggtggcttgaaggatgaggaccgaatctttaccaacttgtacggtttacatgatccctttcttaaaggtgccatgaaacgtggtgattggcacagaactaaagatttagtacttaagggtgctgattggattgtcaatgaagtaaagaagtctggcctccgtggtcgtggaggtgctggatttccatctggacttaaatggtcattcatgcccaaagtatccgatggtcgcccttcctatctcgttgtcaatgctgatgaaagtgaacctggaacctgtaaggacagggaaatcatgcggcacgatccacacaaactcttggagggttgtctgattgctggagttgggatgagggctactgctgcttacatatacatcagaggtgagtatgtgaatgaacgaaagaatcttgagaaggccagaaaggaggcttatgaagctggactgttgggcaagaatgcatgtggatctggttatgattttgacgtccacatccactatggtgctggtgcttacatttgtggtgaagaaacagctctgttagagagccttgaagggaaacaagggaaaccacggttgaagccaccttttcctgctaatgcaggattatatggatgtcccaccactgtgacaaatgtggagacagtagccgtttctcctactattttaaggcgtggaccagaatggtttgccagttttgggagaaagaacaactctggtaccaagttgttttgtgtctcgggacatgtgaataagccgtgcactgttgaagaggaaatgagcattccactgaaggaattaattgaaaggcactgtggaggtgttagaggaggatgggataacttgcttgctgttattcccggaggttcttcggttccattgcttcccaagcatatatgtgatgatgttctcatggattatgatgcactaaaggctgtccagtctggattgggcactgcagctgtaatagttatggataaatcaacggatattgtggatgctattgcaaggctctcttatttttacaagcatgaaagttgtggacagtgcactccctgcagggaaggtacgggatggctatggatgataatggaaagaatgaaagttggaaatgcaaagctggaagaaattgacatgctacaagaggttaccaagcagattgaagggcataccatttgcgcccttggtgatgctgctgcttggcctgtgcaaggtcttataaagaattttaggccggagcttgagagaaggattagagagcgtgcagaacgggagttgatccaggctgctgcataggaaattccaactttgatgggaattgcaaataatgaaactgccccagatatttggtgtgttcaagcgtctggaggtcatgtctgcattttgtttgctatttcaaaatgacttatcaatgcccttaagaaactcgtttccggtttttgaagtggcttttgaggctagaattattaatacacatatttttttttatttagtgtaatttgaatgcctctcttaacgccatttaatggttggatacctctatgattacttcttgtgttgtactcttctgaacagaaatttcatctccctgtggaacatcaataaatgggaaagttaaactatttcttctaattttatgggtcctgacactaaatataaatttgttttctaggattcaactatggtgaacttggaaccatgttttattgtatggtttgagtgagagatgttgaaa

SEQ ID NO: 3898 - DNA, 1869 bp, Citrullus lanatus
tttctagttggatctccctaatcgcttgcgcgtcgcaggattgaagcacttcatgctatggcaccttttaggggcatgctttatcttcgacgaacaacattggcaaggagttatattgatcggtggggcgtaggattgagagcatttagcaatcagggtgcagcagctactggcagtcctcagcctcccccacctcccccacctccagagaaaactcattttaggggcttgaaggatgaggaccgaatctttaccaacttgtacggtttacacgatccatttctcaaaggtgccatgaaacgtggtgattggtacagaactaaagatttagtactcaagggtgctgattggattgttaatgaagtaaagaagtctggcctccgtggtcgtggaggtgctggatttccatctggacttaaatggtcattcatgcctaaagtatctgatggccgcccttcctatcttgttgtcaatgctgatgaaagtgaacccggaacctgtaaggacagggaaatcatgcgacatgatccacacaaactcttggagggttgtcttattgctggagttgggatgagggctactgcagcgtacatatacatcagaggtgagtatgtgaatgaacgaaagaatcttgagaaggccagaaaagaggcttatgaagctggattgttgggcaagaatgcatgtggatctggttatgattttgacgtccacatccactatggtgctggtgcttacatttgtggtgaagaaacagctctgttagagagccttgaagggaaacaagggaaaccacggttgaagcctccttttcctgctaatgcaggattatacggatgtcctaccactgtgacgaatgtcgagacagtggctgtttctcctactattttaaggcgtggaccagaatggtttgccagttttgggagaaagaacaactctggtaccaaattgttttgtgtctcgggacatgtgaataagccttgcactgttgaagaggaaatgagcattccactgaaggaattgattgaaaggcactgtggaggggttagaggtggatgggataacttgcttgctgtaattcccggaggttcttcagttccattgcttcccaagcatatatgtgatgatgtactcatggattatgatgcactaaaggctgtccagtctggattgggcactgcagctgtaattgttatggataaatcaactgatattgtggatgctattgcaaggctctcttatttttacaagcatgaaagctgtggacagtgcactccctgcagagaaggtacaggatggctgtggatgataatggaaagaatgaaagttggaaatgcaaagctggaagaaattgatatgctacaagaggttaccaagcagattgaagggcacaccatatgtgcccttggtgatgctgctgcgtggcctgtgcagggtcttgtaaagaattttaggcctgagcttgagagaaggattagagaacgtgcagaacgggagttgatccaggccgctgcataggaaattccaactttaatgggaattgcaggtaatgaaactgccccagatatttggatgattgattcaagcgtctggaggtcatgtctgcattttgtttcctatttcaaaatgacttatcaatgcccttaagaaactcgttttcattttttttgatgaagtgtctttgaggctagaattattatacatattttttcccttagtgtaatttgaatgcccctcttaacgccattcgatggttgatattgatatctatgctttcttcttattttgtactcatctcaacagaaatttcatctccctgtggaacgtcaataataaacaggaaagttaagctatttctccaaattttct

SEQ ID NO: 3899 - DNA, 2069 bp, Phaseolus coccineus
caaagctcagaaaatcaatcccaaatcacaacacagagcagcagaagaaagtgttccaatttcaacactcatcagatcccagtgatcaatctattgcatcgccactggtaagacaaccatgaagagaattttttctcaaaggacagccttggttcaacatcgtagtgagaaattgggtcttggtttgagactatttagcacacagggtgcttctactgctacttcaccacagccgccaccaccacctccaccgccagaaaaaacccattttggtggccttaaggatgaggacaggatatttaccaacttatatgggctacatgacccttttctgaaaggtgcaatgaaacgtggtgattggtatcgaacgaaagatctggtaatcaagggtactgattggattgtaaatgaaatgaagaagtctggcctccgtgggcgtggtggtgctggtttcccttcaggcctgaaatggtcattcatgcccaaagtatctgatggccgcccttcctatcttgttgtcaatgcagatgaaagtgaacctggaacttgcaaagacagggaaatcatgcggcatgacccacataagctgttagaaggttgcttgattgctggagtgggaatgagggctactgctgcttacatctatatcaggggtgaatatgtgaatgaacgtaagaatcttgaaacggctaggctagaggcttatgcagctggtttattgggtaagaatgcttgtggctcaggctatgattttgatgttcatattcactatggtgccggagcttatatttgtggtgaggaaacagccctcttggagagtcttgaagggaagcaaggtaaaccaagattgaagccacctttcccagccaatgctgggttgtatggttgtcctaccactgttacaaatgtggagactgtggctgtttctccaactattctaaggcgtgggcctgaatggtttgccagttttggtaggaagaacaatgctgggacaaagctgtattgtgtgtcagggcatgtgaacaagccttgcaccgttgaagaggaaatgagtatgccgctgaaggagttgatagagaggcactgtggaggtgttagaggaggatgggataatttacttgcagtgattccaggagggtcgtctgttcctctgcttccaaagagtatatgtgatgatgtcttgatggattatgatgcattaaaggctgtccagtctgggttgggaactgcagctgtaattgtgatggataaatctactgatgtcgtggatgctattgcaaggctttcttacttctacaagcatgaaagctgtgggcagtgcacaccatgcagggagggaactggctggctttggaccatcatggaaagaatgaaagttgggaatgcaaagctagaagaaattgatatgcttcaggagttaactaaacaaattgaaggtcatacaatttgtgccttgggtgatgctgctgcatggccagtgcagggtcttatcaagcatttcaggcctgagcttgagagaaggattagagagaatgctgaaagggagctgctgcaggccactggataggctattattaaggggtatgactgtctggtggatatcaagaatcagaataagacagtaccagttattttggaaagataggtggctcaggttactatagctttatggctgcttctatttactttttttatgctgtagcaattattggctggaccatacctgggaaaccatttgggagagtttaaactgtgtacctgtttgtcatttgacacattttcctgtaatatgttaataatatctgtatactgtattatttttgagaaacagttcatggttacgcatgttaccagtgaatcatgaggtatcatgtccaatggataaccataactttgatctttgattgaattattcatttggattaactttttttgaagaacatgtcattgttcaacaaccattcccaacttgcttgtatgaagtctgttgatccatatgcatggactaaagcatgttcatatatactttgataattttcggctagaataataatctcggcaccaaggtc

SEQ ID NO: 3900 - DNA, 2082 bp, Medicago truncatula
ctctttcatcatttaaatctccataacctcttttcataagtatgcaacgtggctaaacaaaagcccaaagttcaaacaacccaactcgtgttatttctttctttctaccaaacaaaaagctaaatcgaaaaaacaaaacaagaagaagaacaacaaggttctccatttccaacacttcttagatccgcaggttggataaccatgaggggcattctttctttaaagagggcagtgttggttcgacaacatagcgaaaagttgggtcttggtgttagattatttagcactcagggtgcctcaactgcaagtactccgcagcctccaccaccacctccacctccagagaaaacccattttggtggacttaaggatgaggacaggatttttaccaacttgtatgggctgcatgatcctttcctgaaaggtgccatgaaacgtggtgattggcatcgcactaaagatttggtaattaagggtactgattggatcgttaatgaaatgaagaagtctggtctccgcggacgtggtggtgccggttttccttctggccttaaatggtcatttatgccaaaagtatctgatggtcgtccttcttaccttgttgttaatgctgatgaaagtgaacctggcacctgcaaagacagggaaatcatgcgccacgacccacataagttgttagaaggttgcttaattgctggagtgggaatgagggctactgctgcttacatctacatcaggggtgaatatgtgaatgaacgtttaaatcttgaaaaggctaggaaagaggcttatgcagctggtcttttgggtaagaatgcttgtggctcaggctatgattttgatgttcatatccactatggtgctggagcttatatttgtggtgaggaaacagctctcttggagagccttgaagggaaacaaggtaaaccaagattgaagcctcctttcccagccaatgcaggattgtatggttgtcccaccactgtcacaaatgtggaaaccgtagctgtctctccaaccattttaaggcgtgggccagaatggtttgccagttttggtaggaagaacaacgctgggacaaagttgtattgtgtgtcaggacatgtgaacaagccttgcactgttgaggaggaaatgagtatgccactgaaggaattgattgagaggcactgtggaggtgttagaggaggatgggacaatttgcttgctattattccaggaggatcatctgttccactgattccaaaacatgtatgtgatgatgttctgatggattatgatgcgttgaaggctgttgggtcagggttggggactgcagctgtgattgtgatggataagtctactgatgttgtggatgccattgcaaggctctcgtacttctacaagcatgaaagctgtgggcagtgcacaccatgcagggagggaacaggatggctttggatgatcatggaaagaatgaaagttggtaatgccaagctagaagaaattgatatgcttcaggaggtgactaagcaaattgaagggcacacaatctgtgccttgggtgacgctgctgcatggccagtgcagggacttatcaggcatttcaggcccgagcttgagagaaggattaaagagaatgcacagagggagttgctgcaggccactggttagaggcctagaccaaggggttgtgactgtactgatgatagctaaaatcaaaataaagcagtgccagtcattttggaaagataggtggctcaggttcctttggctttattgctacttcgttttacttttatgccatagcaattatggctggataataccagagaatcatctgggccggtataaactatgctacctagacttgtcatttggcacattttcatgtgatttgttaataatatctgtatactgtcattaattttgagaaacatatcatgtttatgtttgttatttatcaatgaatgatgagggataatgtccactggatatcaatggctttgatttgggattaacttcatttggatcgactatttgtttatttgtatgacaatgttcaacaaccaatattaacttgcttttatgaagtctattaat

SEQ ID NO: 3901 - DNA, 1847 bp, Antirrhinum majus
  misc_feature (78)..(78): n is a, c, g, or t
  misc_feature (121)..(121): n is a, c, g, or t
  misc_feature (141)..(141): n is a, c, g, or t
  misc_feature (1084)..(1084): n is a, c, g, or t
  misc_feature (1096)..(1096): n is a, c, g, or t
  misc_feature (1115)..(1115): n is a, c, g, or t
  misc_feature (1123)..(1123): n is a, c, g, or t
  misc_feature (1172)..(1172): n is a, c, g, or t
  misc_feature (1180)..(1180): n is a, c, g, or t
  misc_feature (1219)..(1219): n is a, c, g, or t
  misc_feature (1231)..(1231): n is a, c, g, or t
  misc_feature (1282)..(1282): n is a, c, g, or t
  misc_feature (1294)..(1294): n is a, c, g, or t
  misc_feature (1589)..(1589): n is a, c, g, or t
cctaaacttttagttgaatcatcagatcatctttgctcttgcaacatttgatgctatcatggcacctataaaaagcantctatctctacaaagggctgctttggttcggcgctccagtganaattgggggctgccaagtanattattaagcactcaggctgccacaacttcaaccacaccccaggccccaccccctcccccacctccaaaaaaaacccactttggcggcctgaaaaatgaaaatcgcattttcactaatgtctacggtatccatgatccctttctgaaaggcgccatgaaacgaggaaactggtaccggacaaaaaaccttgtacttaagggaactgattggattgttaatgaaatgaaaaaatctggtctgcaaggacgtggtggagctggttttccatctgggcttaaatggtcctttatgccaaaggtatccgatggccgtccttcatatcttgtcgttaatgctgatgaaagtgaacctggaacatgtaaagatagagaaattatgcgtcacgatccacacaagttactcgaaggttgtttaattgctggtgtaggaatgagggctagagctgcatatatttacattcggggtgaatatgtgaacgaaagactgaaccttgagaaggcaaggagagaagcttatgaagctggattgttgggaaagaatgcatgcggatctggttatgattttgatgtacacatccacttcggtgccggggcttatatttgtggtgaagagacagctcttctggagagccttgaaggtaagcaaggtaaaccaaggctaaagcctccttttccagccaatgcaggactatacggttgccctactactgttacaaatgtcgaaactgtggcggtttcccccaccatactaagacgtggcccagaatggtttgctagttttggaagaaaaaacaattctggcaccaaactattttgcatctcaggccatgtcaacaagccttgcactgttgaagaggagatgagtatcccattaaaagagctcatagagcgacactgtggtggtgttcgtggtgggtgggataatttacttgcagttattccnggtggttcatcngtcccattaattcccaagnacttatgngaggatgtgcttatggattttgatgcacttaaggctgtgcagtcgggantaggaacngcggctgtcattgtgatggataaatcaactgatgttgtngatgctattgcnagactctcttacttttataagcacgagagttgtggtcagtgtacgccttgnagagaaggcacnggatggctatggatgattatggagagattgaaggtgggaaatgcaaagttggaggaaattgacatgcttcaggaggtgactaagcagattgaaggacacacgatttgtgccttgggtgatgctgctgcttggccggttcaggggcttatcaggcactttaggccagagcttgagagaaggattagggagcgggctgatagagagttacaacaggctgctgctgcttgataatttattcaagagaatcagatctgctgatagattccagagaataagtcattgataaagtggaagngacatttgaggatgcgtgcatcagtgcctccggcatgttcagtttaatgtttgtatcgcacgactgcattaaaattctacgttctatattgatgtgttcagccttcactaaatgttgttctaggctgaaaaagtgtaagatgattgatgttttatcgtcatgtctaggtttttataatttaaagaacattcatatgaatttgtttaatatatgatgatgttcctgaagatattggctttgaattgaaaaaccgatcga

SEQ ID NO: 3902 - DNA, 2032 bp, Olea europaea
tggattagatacacgcggtgcaaaatttccaaaatattctgctccgtccattttcccaaatctctctccattctgactctgcaaatcagaaaaatcagttgaataaccagtcgatcatagattcaaatcatgtcacctatgaagaacatactttctctgcaaaagactgctttgattcggcttcccactgagaaatggggcctagccagtagatttttcagcacccagactgcaaccacttcgactaccccacagcctccgccacctccaccacctccagagaaaactcattttggtggcttgaaagatgaggatcgtattttcacaaatgtttatgggttgcatgacccatttcttaaaggtgccatgaaacgaggagattggtatagaacaaaagacctagtactcaagggaactgattggattgtcaatgaaatcaagaaatctggacttcgtggacgtggtggtgctggatttgcttctggtcttaaatggtccttcatgccaaaggtttctgacggtcgtccttcatatcttgttgttaatgctgacgaaagtgaacctggaacgtgtaaagatagagaaattatgcgtcatgatccacacaaattactagagggttgtctaattgctggagtaggaatgagggccagagctgcatatatttacattcggggtgaatatgtgaatgaaaggttgaaccttgagaaggccaggagagaagcttatgaggccggattattggggaagaatgcatgtggatcaggttatgattttgacgtacatatccactttggtgccggtgcttatatttgtggtgaagaaacagctcttttggagagccttgaggggaaacaaggaaaacctaggttgaagcctccttttccagctaatgcaggtctatatggttgcccaacgactgttacaaatgtggaaacagtagctgtctcacccaccatattaaggcgtgggccggaatggtttgctagctttggcaggaaaaataattccggtactaaactattttgcatctcaggccatgtaaacaagccttgtactgttgaagaggagatgagtataccattgaaagagcttttagagagacactgtggcggtgttcgtggtggatgggacaatttactcgcagttacaccgggcggttcatctgtgcctttacttcccaagcacatatgtgaggacgtgctcatggatttcgatgctctcaaagctgtgcagtctggtttgggaacagcagccgtaattgtgatggataagtcaacagatgttgtagatgcaattgcaaggctatcttacttctacaagcatgagagttgcggtcagtgtacaccttgtagagaaggtacaggatggctctggatgatcatggagagattgaaggtgggaaatgcgaagttggaggagattgacatgctacatgaagtgacgaagcagattgaaggacacacaatctgtgccttaggtgatgctgctgcttggccagttcaaggtcttattaggcactttcgaccagagcttgagcgaaggatcagggagcatgctgagagagagttacagcaggctgctgctgcttgatccttctatacaggaaaatgcaaactagtccagctgaataaacttactgaaagtggagagagatttcagaatgccatccattccaagaagcagtgtgtttaatttattgattgtactggacaaaactgcatttagattctctgactatttcttgatgtgtctaaaatttgccataagtcttggttgcttgaggatacaagttcagcccatgaaaggacgttgttgtcagtttgtctgttataactattttgcacaataatttcaacgcctttctgatgtttctcgactcatgctttgagggctcatattatctactcgcaaacgtggtacatcttcacgtgttcaataatttcgatcacctgacaatatgtccattaatgtatcacgtaccttcgcatacatgggagccctgctttgcatgttaatcttggccggaatc

SEQ ID NO: 3903 - DNA, 1827 bp, Solanum tuberosum
cagcttcaatctcaccctaatctgctggagaatcagctgaatttcaccgattcatcacatttctgcttcaatattcatggcacctataaagggccttctttctctgcaacggactgcattagctcaacgttctagtgaaagatggggcctatatggtaggttatttagcactcaggctgcatcaactgctagcactccccaacctacacccccacccccacctcccgagaggactcactttggtggccttaaagatgaggatcgtattttcacaaatctctacggattgcatgacccttacctcaaaggtgccatgaagcgaggagattggtacagaacaaaagatcttgtcatcaagggttctgactggatcgtgaatgaaatgaagaaatctggtcttcgaggacgtggtggtgctggttttccatctggtctcaaatggtccttcatgccaaagacaacagatggccgtccttcatatcttgtcgtcaatgctgatgaaagtgaacctggaacctgtaaagacagggaaatcatgcggcatgacccacacaagttgttggaaggctgtctgattgcaggagtggggatgagggctaaagctgcttatatttatatcaggggagagtatgtgaatgaaaggaagagccttcagaaggctagacaagaagcctatgaagctggattgttggggaaaaatgcttgtggatctggttatgattttgacgtatatattcattttggtgctggtgcctatatttgtggtgaagagacagctcttctggagagccttgagggcaaacaaggcaaaccaagattgaagcctccatttccagctaatgcaggactatatggatgtccaacaactgtcacaaatgttgaaacagtagctgtttcaccaaccatcttaaggcgtgggccggagtggtttgctagttttggccggaagaataatgccgggacaaagctgttttgcatctcaggccatgttaacaagccctgcacagttgaagaggaaatgagtatttcattgaaggagctgatagagaggcactgtggtggtgttcgtggaggatgggacaatttgcttgctgttataccaggaggttcatctgttccattgcttcccaagaacatatgtgaggatgtacttatggattttgatgcactcaaagctgtgcagtcagggttggggactgctgctgtaattgtcatggacaagtcaactgatgttgtagatgcaattgcaaggctctcatacttctataagcacgagagctgtggtcaatgtacaccatgtagggaaggcacagggtggctttggatgatcatggaaagaatgaaggttggcaatgcaaagttggaagagattgacatgctccaagaggtgacaaaacagattgaagggcataccatttgtgccttgggtgatgctgctgcttggccagtgcagggtcttattaggcactttagaccagagctagaaaggaggatcagggagcacgcagagagagagctacaacaggcggctgctgcttgatttttttaaaagtttgctgtttgataccatggaataaattttgagaagtaccagaagtatgaatgtgggaggggaaagcaggacgcagagcttccctatatccagccgctttttattgtcaaacttgtgtaaaactattgttacattgttggcccaatgggtaatttatgtttcagagctggtacatctaatgtcttaatgtttccttacattatcattgccatggctttgatagttgaaagatgctttaatatttgtcatgttgaataagagctacactttggcaa

SEQ ID NO: 3904 - DNA, 1854 bp, Solanum phureja
tttttttccttcttttttttgagaaagacagcttcaatctcaccctaatctgctggagaatcagctgaatttcaccgattcatcacatttctgcttcaatattcatggcacctataaagggccttctttctctgcaacggactgcattagctcaacgttctagtgaaagatggggcctatatggtaggttatttagcactcaggctgcatcaactgctagcactccccaacctacacccccacccccacctcccgagaggactcactttggtggccttaaagatgaggatcgtattttcacaaatctctacggattgcatgacccttacctcaaaggtgccatgaagcgaggagattggtacagaacaaaagatcttgtcatcaagggttctgactggatcgtgaatgaaatgaagaaatctggtcttcgaggacgtggtggtgctggttttccatctggtctcaaatggtccttcatgccaaagacaacagatggccgtccttcatatcttgtcgtcaatgctgatgaaagtgaacctggaacctgtaaagacagggaaatcatgcggcatgacccacacaagttgttggaaggctgtctgattgcaggagtggggatgagggctaaagctgcttatatttatatcaggggagagtatgtgaatgaaaggaagagccttcagaaggctagacaagaagcctatgaagctggattgttggggaaaaatgcttgtggatctggttatgattttgacgtatatattcattttggtgctggtgcctatatttgtggtgaagagacagctcttctggagagccttgagggcaaacaaggcaaaccaaggttgaagcctccatttccagctaatgcaggactatatggatgtccaacaactgtcacaaatgttgaaacagtagctgtttcaccaaccatcttaagacgtgggccggagtggtttgctagttttggccggaagaataatgctgggacaaagctgttttgcatctcaggccatgttaacaagccctgcacagttgaagaggaaatgagtatttcattgaaggagctaatagagaggcactgtggtggtgttcgtggaggatgggacaatttgcttgctgttataccaggaggttcatctgttccattgcttcccaagaacatatgtgaggatgtacttatggattttgatgcactcaaagctgtgcagtcagggttggggactgctgctgtaattgtcatggacaagtcaactgatgttgtagatgcaattgcaaggctctcgtacttctataagcacgagagctgtggtcaatgtacaccatgtagggaaggcacagggtggctttggatgatcatggaaagaatgaaggttggcaatgcaaagttggaagagattgacatgctccaagaggtgacaaaacagattgaagggcataccatttgtgccttgggtgacgctgctgcttggccagtgcagggtcttattaggcactttagaccagagctagaaaggaggatcagggagcacgcagagagagagctacaacaggcagctgctgcttgatttttttaaaagtttgctgtttgataccatggaataaattttgagaagtaccagaagtatgaatgtgggaggggaaagcaggacgcagagcttccctatatccagccgctttttattgtcaaacttgtgtaaaactattgttacattgttggcccaatgggtaatttatgtttcagagctggtacatctaatgtcttaatgtttccttacattatcattgccatggctttgatagttgaaagatgctttaatatttgtcatgttgaataagagctacactttggca

SEQ ID NO: 3905 - DNA, 1909 bp, Solanum lycopersicum
tcatgattcacaaatcgcaacagcttcattttcccttatttttttcttatttttatgagaaagagagcttcaatctcaccctaatctgctggagaatcagctgaatttcgtcgattaatcacatttctgcttcaatattcatggcacctataaagggccttctttctctacaacggactgcattagctcagcgttctagtgaaagatggggccaatatggtaggttatttagcactcaggctgcatcaactgctagcactccccaacctacacccccacccccacctcccgagaggactcactttggtggccttaaagatgaggatcgtattttcacaaatctctacggattgcatgacccttacctcaaaggtgccatgaagcgaggagattggtacagaacaaaagatcttgtcatcaagggttctgactggatcgtgaatgaaatgaagaaatctggtcttcgaggacgtggtggtgctggttttccatctggtctcaaatggtccttcatgccaaagacaacagatggccgtccttcatatcttgtcgtcaatgctgatgaaagtgaacctggaacctgtaaagacagggaaatcatgcggcatgacccacacaagttgttggaaggctgtctgattgcaggagtggggatgagagctagagctgcttatatttatatcaggggagagtatgtgaatgaaaggttgagccttcagaaggctagacaagaagcctatgaagctggattgttggggaaaaatgcttgtggatctggttatgattttgacgtatatattcattttggtgctggtgcctatatttgtggtgaagagacagctcttctggagagccttgagggcaaacaaggcaaaccaagattgaagcctccatttccagctaatgcaggactatatggatgtccaacaactgttacaaatgttgaaacagtagctgtttcaccaaccatcttaaggcgtggtccagagtggtttgctagttttggccggaagaataatgccgggacaaagctattttgcatctcaggccatgttaacaagccctgtacagttgaagaggaaatgagtatttcattgaaggagctgctagagaggcactgtggtggtgtgcgtggaggatgggacaatttgcttgctgttataccaggaggttcatctgttccactgcttcccaagaacatatgtgaggatgtacttatggattttgatgcactcaaagctgtgcagtcagggttggggactgctgctgtaattgtcatggacaagtcaactgatgttgtagatgcaattgcaaggctctcgtacttctataagcacgagagttgtggtcaatgtacaccatgtagggaaggcacaggatggctttggatgatcatggaaagaatgaaggttggcaatgcaaagttggaagagattgacatgctccaagaggtgacaaaacagattgaagggcacactatttgtgccttgggtgacgctgctgcttggccagtgcagggtcttattaggcactttagaccagagctagaaaggaggatcagggagcatgcagagagggagctacaacaggcagctgctgcttgattcttttatgagtttgctgtttgataccatggaataaattttgagaagtaccagaagtatgaatgtgggaggggaaagcaggacgcagagcttccctatatccagccgctttttattatcaaacttgtgtagaactattgttacattgttggcccaatgggtaatttatgtttcagagctggtacatctaatgtcttaatgtttccttacattatcattgccatggttttggtagttgaaagatgctttaatatttgtcatgttgcgttaaataagatctacactttggcaattccaattttccc

SEQ ID NO: 3906 - DNA, 1842 bp, Citrullus lanatus
tcatacgattgaattactttaggcaatttttaggggcatgctttatcttcaacgaacaacattggcaaagagttatattgatcggtgtggcataggattgagggcgtttagcaatcagagtgcagcagctactggcaatcctcagcctcccccacctccagagaaaactcattttggtggcttgaaggatgaggatcgaatctttaccaacttgtacggtttacatgatccctttctcaaaggtgccatgaaacgtggtgattggtacagaactaaagatttagtactcaagggtgctgattggattgttaatgaagtaaagaagtctggcctccgtggtcgtggaggtgctggttttccatctggccttaaatggtcattcatgcctaaagtatctgatggccgtccttcctatcttgttgtcaatgctgatgaaagtgaacccggaacttgtaaggacagggaaatcatgcggcacgatccacacaaactcttggagggttgtttgattgctggagttgggatgagggctactgcagcttacatatacatcagaggtgagtatgtgaacgaacgaaagaatcttgagaaggcaagaaaagaggcttatgcagctggattgttggggaagaatgcttgtggatctggttatgattttgatgtccacatccactatggtgctggtgcttacatttgtggtgaagaaacagctctgttagaaagccttgaagggaaacaagggaaaccaagattgaagcccccttttcctgctaatgcaggattatatggatgtcctaccactgtgacaaatgtggagacagtggctgtttcccctactattttaaggcgtggaccagaatggtttgctagttttgggagaaagaacaactctggtaccaaattgttttgtgtctcgggacatgtgaataagccctgcactgttgaagaggaaatgagcattccattaaaggaattaattgaaaggcactgtggtggggttagaggtggatgggataacttgcttgctgtaattcctggaggttcttcagttccattgcttcccaagcatatatgtgatgatgtacttatggattatgatgcattaaaggctgttcaatctggattgggcactgcagctgtaattgttatggataaatcaactgatattgtggatgctattgcaaggctctcttatttttacaagcatgaaagctgtggacagtgcactccctgcagagaaggtacaggatggctgtggatgataatggaaagaatgaaagttggaaatgcaaagctggaagaaattgacatgcttcaagaggttaccaagcagattgaagggcacaccatttgtgcccttggtgatgccgctgcttggccagtgcagggtcttataaagaattttaggcctgagcttgagagaaggattagagaacgtgcagaacgggagttgatccaggccgctgcgtaggaaattccaactttgatgggaattgcaaataatgaaactgccccagatatttgaatgattggtaagattcaagcgtctggaggtgatgtctgcgttttgtttgctgtttcaaaatgactgagtctttgaggctagaattattgaacattttttttcctagtgtaatttgaatgcctctcttaacgccatttgatggttgatatctatgcttattacttcttatgttgtactcatctgaacagaaatttcatctccctgtggaacatcaataaacgggaaagttaagctatttttcgaaattttctgagtcctgaccctaaatataaagtatgttccaaagattcaaccatggtgaacttggaatcatggtt

SEQ ID NO: 3907 - DNA, 2360 bp, Tabernaemontana elegans
acagtagtataggaaggagatcgtcgcgttttcatctgccggagagtagatcacctgaaaattctcgggtgtctgttgttccgtttgttgccggcaacttgatctgctagtaaccacggttgccatcaaagacacatctccgccgtgcttcaacttcgtacatatcactcccttcttgccctgttccggagcattctcatcagttctccgagagacaaactcagctcaatcgtggttgcatttctatttcttcacggcagcatttcatgctctaatggcacctataaagggcatcatatctttacaacgtgctgcttttgctaggcgtcaggagtgttggcgcattggcagtagattattcagcactcagtccacagcaactgctagcactcctcaggcccaacagcctcctccacctcccccacctcctgagaaaacccactttggtggccttaaagatgaggatcgcattttcacaaacctttatggtttgaatgaccctttcctcaaaggtgccatgaaacgaggagactggtataggacaaaagaattggtcctcaagggctctgattggattgtcaatgaaatcaagaagtctggccttcgtgggagaggtggtgctggctttccatctggtcttaaatggtccttcatgccaaagcagtctgatggccgcccttcctatcttgttgtcaatgcggatgaaagtgaacctggaacctgtaaagatagagagattatgcgccatgatccacacaagttattagaaggttgtctgattgctggtgttggtatgagggctagtgctgcatatatttatatcaggggtgaatatgtgaatgagaggaagaatctggagaaggcaaggaaagaagcttatgaagctggtcttctggggaaaaatgcatgtggctctggctacgactttgatatacatatccactttggtgctggagcctatatttgtggtgaagagacggctctcctagagagccttgagggaaaacaaggtaaacctagattgaagcctccttttcctgctaatgcaggtttatatggttgtcccactactgtcacaaatgtggaaactgtagccgtttcacccaccatcttaaggcgtgggccagaatggtttgctagttttggcaggaagaacaattcaggtacaaaactattttgcgtctcgggacatgtgaacaagccttgcacagtcgaggaggagatgagtatacctttgaaggagctaatagagaggcattgtggtggtgttcggggtggctggaataatttacttgctgttattcccggtggttcatctgtcccattaattcccaagaacatatgtgaggatgtgcttatggactttgatgcactcaaggctgtgcagtcagggctggggactgctgctgtaattgtgatggataagtcaactgatgttgtagatgcaatcgcaaggctttcttatttctataaacacgagagttgtggtcagtgcacaccttgcagagaaggtacaggatggctttggatgataatggaaagaataaaggttggaaatgccaagttggaggagattgacatgcttcaagaagtgacaaagcaaattgaagggcacacaatctgtgcacttggtgatgctgctgcttggccagttcagggtctgatcaggcacttcagaccagagcttgagaggaggattagagagcgtgcagagagggaactactagaggctgctgcttgattcttctgttcagggggaaagctttttcctgttagagcaccatggaataaaaatatccaagcgtctgagatattggtcaaggtgcattgaggcctgccaaaacagcactcaatttttattcttgtattgatggatctgttatgttgtttcagaagaagattaaatggatacgagtttgaggttataagactatcctgtcaaagcatgatcagatgaaagccttacttttaattgtcaataaaaattgaaccttacttggctgtattgagaccttacccaaagtctactggcattgaagaggttgagagatttgacgactatatatgcatttacgtatacattactttcccgggttgtgttctatttcttgagaaatctgtggcagaatgtccatactgttgaaagattctggaaaagctagagtttctgtcgtcctgcttgcattgatagttgatgctaatcactgcacctaaaagagtattcttttttccaaacgggttttctattatctgttgcactgtctgctttgatagtgaatgccgggttgcagatgcattggtttatataggaaattctcaagctgtcttgtcatggtcctgtccccttccctcacaaaaca

SEQ ID NO: 3908 - DNA, 1742 bp, Vinca minor
acgacatcatttcatgctcttatggcacccataaagggtatcctttctttacaacggactgcttttgctagacgtcaggaaggttgccgcgtcggcagtaaattatttagcactcaggcaacatcaactgctagttctcctcaggcccaacagcctcctccacctcccccacctcctgagaaaacccattttggtggcctcaaagatgaggaccgaattttcacaaacctttatggtttaaatgaccctttcctcaaaggtgccatgaaacgaggtgactggtatagaacaaaagacttggtactcaagggcactgattggatcgtcaatgaaatgaagaagtctggccttcgtgggcgaggtggtgcaggcttcccgtctggtcttaaatggtccttcatgccaaagcaatctgatggccgcccttcctatctagttgtcaatgctgatgaaagtgaacctggaacttgtaaagatagagagatcatgcgtcatgatcctcacaagttattggaaggttgtctgatagctggtgttggcatgagggcaagcgctgcatatatctacatcaggggggaatatgtcaatgaaaggatgaatttggagagggcaaggaaagaagcttacgaagctggtcttctggggaaaaatgcatgtggctctggttacgatttcgatgtacatatccactttggtgccggagcctacatttgtggtgaagagactgctctccttgagagccttgaggggaaacagggtaaacctagattgaagcctccttttcctgctaatgcaggtctatatggttgtccgactaccgtcacaaatgtggaaactgtagccgtttcaccaaccatcttaaggcgtgggccagagtggttttctagttttggtaggaagaataattctggtacgaagctattttgcatctcgggacacgtcaacaagccctgcacagttgaggaggagatgagtattcctttgaaggagctaatagagaggcattgtggaggtgtccggggtggctgggataatttactggctgttattcctggtggttcatctgttccattgattcccaagaacatgtgcgaggatgtgcttatggactttgatgcactcaaagctgtgcagtcgggtctggggactgctgctgtaattgtaatggataagtcaactgatgtagtagatgcaatcgcaaggctctcttatttctacaagcatgagagttgtggtcagtgcacaccttgcagggaaggtacaggatggctttggatgatcatggaaagaatgaaggtcggaaatgccaaattggaggagattgacatgcttcaagaagtgacaaagcagatcgaagggcacacgatctgtgcacttggtgatgcagctgcttggccagttcagggtctgatcaggcacttcagaccggagcttgagaggaggattagagagcgtgcagacagggagctactagaggccgctgcttaatttttatgctcaggtggaaaaccttttccagtaagatcccaatgaataagaatattcaagatattggtctcgaggtgcatctaggcctcccggatttcatttttattgttgcatcaaacttctgaattgctggatccattatgttatttcagaagattagatagattcaagtttgaggatataagactatctatccccccaaagaatgttgatttggaaaccttagttttgattgtcaataaaagcactcactt

SEQ ID NO: 3909 - DNA, 1949 bp, Trigonella foenum-graecum
aaaaacgaaactcagaacaataacaataacaaggttctccatttccaacacttcctagatccacaggttggataaccatgagggggattctttctttaaagagggcagcgttggttcgacaacatagtgaaaagttgggtcttggtgttagactgtttagcactcaaggtgcttcaactgcaagtactccacagcctccaccaccacctccacctccagagaaaacccattttggtggacttaaggatgaagacaggatttttaccaacttgtatgggctgcatgatcctttcctgaaaggtgccatgaaacgtggtgattggtatcgcactaaagatttggtaatcaagggtactgattggatcgttaacgaaatgaagaagtctggtctccgcgggcgtggtggcgctggttttccttctggtcttaaatggtcatttatgcccaaagtatctgatggtcgcccttcttaccttgttgttaatgctgatgaaagtgaacctggtacttgcaaagacagggaaatcatgcgccacgacccacataagttgttagaaggttgcttaattgctggagtgggaatgagggctactgctgcttacatctacatcaggggtgaatatgtgaatgaacgtttaaatcttgaaaaggctcggaaagaggcttatgcagctggtcttttgggtaagaatgcttgtggctcaggctatgattttgatgttcatatccactatggtgccggagcttatatttgtggcgaggaaacagctctcttggagagccttgaagggaaacaaggtaagccaagattgaagccccctttcccagccaatgcagggttgtatggttgtcccaccactgtcacaaatgtggaaaccgtagctgtctctccaaccattttaaggcgtgggccagaatggttttccagttttggtaggaagaacaacgctgggacgaagttgtattgtgtgtcaggacatgtgaacaagccttgcactgttgaggaggaaatgagcatgccactgaaggaattgattgagaggcactgtggaggtgttagaggaggatgggacaatttacttgctattattccaggaggatcatctgttccactgatgccaaaacatgtatgtgatgatgttctgatggactatgatgcgttgaaggctgtcggatcagggttggggactgcagctgtgattgtgatggataagtctactgatgttgtggatgccattgcaaggctctcgtacttctacaagcacgaaagctgtgggcagtgcacaccatgcagggagggaacaggatggctttggtcgatcatggaaagaatgaaagttgggaatgccaagctagaagaaattgatatgcttcaggagttgactaagcaaattgaagggcacactatctgtgccttgggtgacgctgctgcatggccagtgcagggacttatcaggcatttcaggcccgagcttgagagaaggattaaagagaatgcacagagggagttgctgcaggccactggttaggtctagactaaggggtctgactgtactggcgatagctaaaatcaaaataaagcaatgccagtcattttggaaagataggtggctcaggttcctttggttttattgctacttcttttttacttttatgctgtagcaattgtggctggataataccagagaaaccatctgggtcggtataaactatgctacctaaacttgtcatttggcacattttcatgtaatttgttaataatatctgtatactgtcattaattttgtgaaacatatcatgtttacgtttgttatttatcaatgaatgatgagggataatgtccactggatagcaatggctttgatttgggattaaactgttcatttggattgactttttgcttatttgtatgtcaaatgttcaagaaccaatctcaacttgcttttatg

SEQ ID NO: 3910 - DNA, 1880 bp, Triphysaria pusilla
gacgcaccattgaaattgtagctcgctttcccctttgaaacctgcaatcccaatctatatactgagcaagaataatcagctgcatcgtcgccttgtagcaattgatgccatcatggcacctataaagagcattctttctctgcaaaggatttcgttcgctcaacgcgtaagtgaaaactgggccccagcaaggaaattactcagcacccaggctgcaaccacttctccgaccccacaggcaccgccgcctcctccaccccctgagaaaacccacttcggcggcctgaaagatgaagatcgcatcttcaccaatctatatggactacacgatcccttccttaagggtgccatgaaacgcggtgactggcaccggaccaaagacctagtgctcaagggaactgattggatcatcaacgagatgaagaaatctggcctccgtggacgcggtggagctggtttcccatcagggctaaaatggtcattcatgcccaaggtctccgacggccgtccctcgtaccttgtcgtgaatgccgacgagagtgagcccgggacgtgcaaagatagagagatcatgcgtcatgacccacataaattgttagagggctgtttgatagctggagttggaatgcgggccagcgcggcctatatttatatccggggcgagtatgtgaatgagaggctgaacctcgagaaagccctgaaagaagcttatgcagccgggctactgggaaagaacgcgtgtgggacgggctacgatttcgacgtgcacatccatttcggggctggggcttatatttgcggtgaggagactgcacttcttgagagcctcgagggtaaacagggaaaaccaagactcaagccgccatttcccgccaacgcaggcctatacggctgccctacgaccgttaccaacgtcgagactgtagctgtttcgccgacgatcctgagacgcgggccagagtggttttctagcttcgggaggaaaaacaattccggaacaaagctgttttgtatctcgggccatgtgaacaagccttgcacggtcgaggaggagatgagtatttcgttaaaggagcttctggagaggcattgtggtggggtccgtggcggttgggataatttgctggcggttattcctggagggtcgtctgttcctttacttccgaagaatgtgtgcgaggatgtgctgatggatttcgatgctctcaaggctgtgcagtcgggtttggggactgctgctgtgatcgtgatggataagtcgacggacgtcgtggatgcaatctccaggttgtcgtatttttataagcacgagagctgtgggcagtgcacgccgtgcagggaagggacaggttggctgtggacgataatggagaggatgaaggttgggaatgcaaagctagaggagatcgatatgctgcaggagttgacgaagcagattgaggggcacacgatttgtgcgttgggggatgcagcagcttggccggtgcaggggctgattaggcattttaggccagagatggagaggaggattaaagagcgggcggagagggagttgcagcaggctgctgcggcttgatttcttctttaagaataaggtttcgcatttgctgttagatctctgttgaataaagtcaagatacattttccgaattcctatccattgttcgacattttacagctgtattgttgtgtatgactgtactctaagattctacattgatatatttatgcctaaagatgtaaggttgaacttcatctgctctgaatttatttctatttgtaaaccttgtaagaacccttcgatcagtttgttagtcaataatcgacccgaaggaccaaaaacacgctctgtttgattggcctgaactttgctttgcaag

SEQ ID NO: 3911 - DNA, 1690 bp, Aristolochia fimbriata
cattcagcacacaatctgcaaccacagctggcacaccacagccagcccctcctcctcctcctgagaaaacccactttggtggcctcaaagatgaagaccgaatttttactaacttgtatggcttgcatgaccctttcctgaaaggagccatgaagaggggtgactggtataggaccaaagatttagtattgaaaggttctgattggattgtcaatgagatgaaaaaatcaggtcttcgtggtcgtgggggtgctggttttccatctggtctgaagtggtcatttatgcccaaagtatctgatggtcgtccttcgtatttggtggtgaatgctgatgaaagtgaacctggaacatgcaaagacagagagattatgcgtcatgatccacataaattgttggaagggtgtcttattgccggtgttggtatgagagcaactgcagcttacatctacattaggggtgaatatgtcaatgagcgccgtgcacttgaaaaggccaggcaagaagcttacaaggctggcttgctaggaaagaatgcatgtggatctggttatgactttgatgtgcatatccattatggtgctggtgcttacatttgtggtgaggagactgcactactggagagtcttgaggggaaacaaggtaaaccaagactgaagcctccttttccagcaaatgctggattatatggctgccctacgacggtcactaatgtagagactgttgctgtgtctccttccatcttaaggcgtggcccagagtggtttgctagctttggtcgaaagaataattcaggcacaaagctgttctgtgtgtcaggccatgtgaataaaccttgcacagtggaagaagagatgagtatttcattaaaggagttgattgagcggcactgtggtggagttagaggtgggtgggataatttattggcagttattccaggaggttcatctgtccctttacttcccaaacacatatgtgatgatgttttgatggattatgatgcactcaaggctgttcaatctggactagggactgcagcagtaatagtgatggacaaatcaactgatgtggttgacgcaattgcaaggctatcgtacttttacaagcatgaaagctgtggtcaatgcacaccttgccgagagggaacggggtggctttggatgattatggagagattgaaggtgggtaatgcaaagttagaggagattgacatgcttcaggaggttactaagcagattgaggggcatacaatttgtgccttgggtgatgctgctgcttggcctgtacaagggcttattaggcatttcagaccagagttggagaggagaatccgggagagggccgagagggagttactggaggctgctgcatctgcttagagagatattctaccaaggagatgcaatgcagcaaggttgatgtcgtggaataaaaggatgaaggaattccctgtttttggagggacagctctttctttcttcattttgtagtttttaagagagatctagatcttcctctgaaaccaattgttgacccgactgaatttgtgtagcagcgtcattctggctatctgtgaaacccataaatcaacttaaaagcttcaataaattttcacccttgtgaatgaaattggaaaattcaccgtattgaatttacggtcgttaaaataattttattggtcacattattc

SEQ ID NO: 3912 - DNA, 2053 bp, Elaeis guineensis
ccatcaaatttatgtgccttctgtgcacaacttttctagttgtcttccaaattttattgtgtgctcagagtgatcctcttacctcatccgtcatatataaactgttgatttgcttattggctcgtgctttgtttccagcagcaaacttttctgactgaaaaggttatgatgctaaaagaagttcaagttcgttcatgtctggtctttttgtcagggagccgtcaagaacttcttttgtccaccaagggcacaactgtgtcatcatttcaatggtgggaggtttaattctgtttataggtcatttagcacccaggctgcgacaacagcaagtacaccacagcctccctcacctcctccacctccagagaagacccacttcggtggtcttaaagatgaagatcgtatttttaccaacctttatggtttgcatgacccattccttaaaggtgcgatgaagcggggggactggtatggaaccaaagacttggtgctcaagggctctgattggattgtcaatgaaatgaagaagtctggtcttcgaggtcgtggaggggctggttttccatctggcctcaagtggtccttcatgccaaaggtatctgatggccgtccttcatatcttgttgttaatgctgatgagagtgaacctggtacatgtaaagatagagaaatcatgcgccatgagccccacaaactacttgaagggtgcctgattgcaggagttggcatgcgcgctactgctgcttacatctacataagaggtgagtatgtaaatgaacgtttgactcttgagaaggcaagaaaggaagcatatcaagctggattgttggggaagaatgcatgtggatcaggttataattttgatgttcatattcactacggtgctggtgcctacatctgtggggaagagaccgctctattggaaagccttgaagggaaacaagggaaaccgagactcaagcctcctttcccagctaatgcaggcttatatggctgtccaacaactgttaccaatgtggaaacggtggctgtatctcccacgattctaaggcgaggaccagaatgattcgcgagctttggccggaaaaacaactcggggacaaagctgttctgtatctcaggccatgtaaacaaaccttgcactgtggaagaggagatgagcataccattgaaagagctgatagagaggcattgtggtggtgtcagaggagggtggaataacttgttggcggttataccaggtggatcctctgtacctctcctacctaagcacatatgtgatgatgtcttgatggactatgatgcgcttaaggctgtccagtctggattgggcacagcagcagtgatcgtgatggtcaaatctactgatgtggtggatgcgatagctaggctgtcgtacttctacaagcgtgagagctgtggtcagtgcacaccatgcagggaggggacagggtggctctggatgatcatggagaggcttaaggtggggaatgcgaagctggaggagatcgatatgcttcaggaggtcacgaagcagatcgaagggcatacaatctgtgcattgggggatgctgctgcttggccagtccaagggctgatcaggcatttcaggccagaactagaaagaaggattcgggagcgagcagacaaggagctgctggaggccgcagctgcttgagtgacttggccaaattactttccaaaactttgtcatcttctagtttcaatttaattatgggtgaaaaataatgaaggatgctagtataactcatttctgtttgaaaacacagctctgttgtggccaagttggtcttttgtatggcatcatccgtcctaatctctttcatggctgaaaagtttgtacaattatgatctggaaatcgaagccaggaaaggcaggaacggtgcttgctttttgcatcgcgggatctttaatttctgtgtccaaaattctggattagaaacctgtttaaatttctaccgtggtttaacattgtgtgttattatggtgataatgatcatcaaattataataaattccgtgtgaatgctgc

SEQ ID NO: 3913 - DNA, 1978 bp, Amborella trichopoda
aagtggaccgtcggagtacttcccggtcttcaccgacgaaaagagtctctctctctatctcagagatcggacctctctcactcaccaaccgtccctctctcactcaccattcgtccctctctccagcttcaacgtgagcgtgatcccctctgcaattgcttggaccacgcaattcagcttggaatccttagtcggggacccatgaggagccttctctcacttcccaggtcgtcacttactcaccactgtaggaagagttgcaagccattctataggtatttgaacacgcaagccccaaccacatcaagcactccccagctcccaccccctccacctccccccgagaaaactcacttcggtggcctcaaggatgaggatcgcatcttcaccaacctttatggcatgcatgacccattcctcaaaggagccatgaaaaggggtgactggtgccgaaccaaagacctcgtcctcaaaggctctgattggattgtcaacgagatgaaaaaatcaggtcttcgaggacgaggaggtgccggcttcccttcaggcctcaaatggtcttttatgccaaaggtctctgatggccgcccctcttaccttgttgtgaacgctgatgaaagtgagccgggaacctgcaaagaccgcgaaattatgcgtcatgaccctcataaactccttgagggttgcttgattgctggtgttgccatgcgagctagtgcagcctatatctatattcggggtgagtatgtcaatgagaggctcaacctcctcaaggcccgaaaagaagcctatgaggctggattgcttggtaagaatgcatgtggctcgggctatgactttgatgtacacattcactttggggctggtgcttacatttgtggtgaagagacggcactattggagagccttgagggcaagcaagggaaaccaaggcttaagcctcctttccctgcaaatgcggggctttatgggtgccccaccaccgtaactaatgttgagacagtggctgtgtcaccaaccatattgcgcaggggccccgagtggtttgtgagctttggtcgaaagaacaactcagggacgaagctcttttgcatttcgggccatgtgaacaagccttgcactgtcgaggaggagatgagcatacccctcaaagagcttatcgagaggcactgtggaggggttcgaggaggttgggataacctattggctataatccctggtggctcatcggtccctctcttgccaaaaaacatttgtgatgatgttttgatggattttgatgcgctcaaagctgttcaatccggtttgggtacagccgctgttatagtgatggacaagtcgactgacgttgttgatgcaatcgcgaggctatcgtatttttacaagcacgagagttgtgggcaatgcacaccttgtagggaaggcacggggtggctttggatgatgatggagaggttgaaggttgggaatgctaagctcgaagaaatcgatatgcttcaagagatcactaagcagattgagggccacacaatttgtgctttgggggatgcggcagcctggcctgtgcagggcttgataaggcatttcaggcccgagctcgagaggaggattaggagtagggcagagagagagttactggaatcagcttctgctgcctctgcttgacagagagagagagagagagggagagagtaatgggttttcagttttttgttggttaaattcccctgcaggagctttcgaacaattgatcggctcctgtgaaataaaaggggaggagctttggagatgaataattgtatttattaagtgttattgaatatttgtgtagccgactccatattaattggaaattagttgaggaaatgttattgatcatgtgaaaagaacgtggattttggatatgcgaaaagaacgtggattttggatttgctttggtaacatgatgttatgttttgttggttggtggtgtaaactt

SEQ ID NO: 3914 - DNA, 1937 bp, Cucumis sativus
gtttctgtaaacctcccagcttgtgctagggaaagatattgaatctaccatttgagatttttgtgaaggaagaaaacaagtttctatttggatctccctcaaccgcctgcgcgtctcaggattgaagcacttcatgctatggcaccttttaggggcatgctttatcttcaacgtagatcattggcaaggtgttatattgatcagtggggcataggattgagagcgtttagcagtcagggtgcagcagctcctggcagtcctcagcctcccgcacctcccccacctccagagaaaactcattttggcggtttgaaggatgaggaccgaatctttaccaacttgtacggtttacatgatccctttcttaaaggtgccatgaaacgtggtgattggcacagaactaaagatttagtactcaagggtgctgattggattgttaatgaagtaaagaagtctggcctccgtggtcgtggaggtgctggatttccatctggacttaaatggtcattcatgcccaaagtatctgatggtcgcccttcctatctcgttgtcaatgctgatgaaagtgaacctggaacctgtaaggacagggaaatcatgcggcatgatccacacaaactcttggagggttgtctgattgctggagttgggatgagggctactgcagcttacatatacatcagaggtgagtatgtgaatgaacgaaagaatcttgagaaggccagaaaggaggcttatgaagctggattgttgggcaagaatgcatgtggatctggttatgattttgacgtccacatccactatggtgctggtgcttacatttgtggtgaagaaacagctctgctagagagccttgaagggaaacaaggaaaaccacgactgaagcctccttttcctgccaatgcaggattatacggatgtcccaccactgtgacaaatgtggagacagtagctgtgtctcctactattttaaggcgtggaccagaatggtttgccagttttgggagaaagaacaactctggtaccaaattgttttgtgtctcgggacatgtgaataagccttgcactgttgaagaggaaatgagcattccattgaaggaattaatagaaaggcactgtggaggggttagaggaggatgggataacttgcttgctgtaattcccggaggttcttcagttccattgcttcccaagcatatatgtgatgatgttctcatggattatgatgcactaaaggctgtccagtctggattgggcactgcagctgtaatagttatggataaatcaactgatattgtcgatgctattgcaaggctctcttatttttacaagcatgaaagttgtggacagtgcactccctgcagggaaggtacgggatggctatggatgataatggaaagaatgaaagttggaaatgcaaagctggaagaaattgacatgctacaagaggttactaagcagattgaagggcataccatatgcgccctcggtgatgctgctgcttggcctgtgcaaggtcttataaagaattttaggccggagcttgagagaaggattagagagcgggcagaacgggagttgatccaggctgctgcataggaaattccaacttcgatgggaattgcaaataatgaaaccaccccagatatttggtgtgattcaagcgtctggaggtcacgtctgcattttgtttgctatttcaaattgacttatcagtgcccttaagaaactcgttttcgatttttgaagtggcttttgaggctagaattattaatacatatatatattttttctctttagtgtaatttgaatgcctctcttaacgccatttaatggttgatacctctatgattacttcttttgtgttgtactcatctgaacacaaatttcatctccctgtggaacatcaataaatgggaaagttaagctatttcttc

SEQ ID NO: 3915 - DNA, 2010 bp, Cicer arietinum
tctttctgcattcaaacctcgacaacctcttttccgaaaagtgcaacgtggctaaacaaaggcccaaagtgtaaccaaacccaagtttacattgtttgtaaatcgaaaaacaaaaactagaacaaaaagaagaacaaaaatacagaatccaagaagctccattttcaacacttccgagatcccagtgaagtgatcaacttcatctccaccggtaggataaccatgaggggcattctttctttaaagagggcagtgttggttcgacaacagagtgagaaggtgggtcttggttgtagattatttagcactcagggtgcttcaactgcaagtactccacagcctccaccaccacctccacctccagagaaaacccattttggtggacttaaggatgaggacaggatttttaccaacttgtatgggctgcatgatcctttcctgaaaggtgccatgaaacggggtgattggcaccgcactaaagatttggttgttaagggtactgattggattgttaatgaaatgaagaagtctggcctccgcggtcgtggtggtgctggttttccttctggcctcaaatggtcatttatgccaaaagtatctgatggccgtccttcttaccttgttgttaatgctgatgaaagtgaacctggtacttgcaaagacagggaaattatgaggcatgacccgcataaattgttagaaggttgcttaattgctggagtaggaatgagggctactgctgcttacatctacatcaggggtgaatatgtaaatgaacgtttgaatcttgaaaaggctaggaaagaggcttatgaagctggttttttgggtaagaatgcttgtggctcaggatatgattttgatgttcatatccactatggtgctggagcttatatttgtggtgaggaaacagccctcttggagagccttgaagggaaacaaggtaaaccgagattgaagccccctttcccagccaatgcagggttgtatggttgtccaaccactgtcacaaatgttgaaactgtagctgtctctccaactattttaaggcgtgggccagaatggtttgccagttttggcagaaagaacaacgccgggacaaagttgttctgtgtgtcaggacacgtgaacaagccttgcactgttgaggaggaaatgagtataccattgaaggagttgatagagaggcactgtggaggagttagaggaggatgggacaatttacttgctgtgattccaggaggatcgtctgttccactgattccaaaaaatatttgtgatgatgtgatgatggattatgatgctttgaaggctgtcaatacagggttagggactgcagctgtgattgtgatggataagtctaccgatgttgtggatgccattgcaaggctctcgtatttctacaaacatgaaagctgtggacagtgcacaccatgcagggagggaacaggatggctttggatgatcatggaaagaatgaaagttgggaatgccaagctagaagaaattgatatgcttcaggagttgactaagcaaattgaaggtcacacaatctgtgccttgggtgatgctgctgcatggccagtgcagggacttatcaggcatttcaggcccgagcttgagagaaggattagagagaatgcacaaagggagttgctgcaggcctctggttaggcctagactaaggggtgtgactgtactggtggatagcacaaatcaaaataaggcagtgccagttatcatttaggaaagatgagtggctcaagttgctgtggatttattgctacttttatttgtttttatgctgtagcaattatggctggaccatatcagagaaaccttctgggaggatttaaactatgctacctaaacttgtcatttggcacattttaatgtaatttgttaataataatatctgtatactgtcaattaattttgagaaacatatcatggttatgtttgttatttatcaatgaatgatgagggataatgtccactcactgaatagcc

SEQ ID NO: 3916 - DNA, 1754 bp, Euphorbia peplus
acgggaagacgggggtatctcaacgtgttaccgtcgatgatcacaagaattaatctgatatcgtgaagcatcagacgatcataaccgttgattttggtaaaatcaagctccgacagagcaggtgctttcttctccgttgcatatctcgatcctgagctgaatcgcggattcctaagacgtttatcgcaatggcacccattaggggtatcttttcattgcaaaaagctgctttgcttcagcgctatagcgataagtgttatacaggcttcagatcattaagcactcaagctccaggtgctggtagttctaagcctccaccacccccggcgagtgctggtagcgcacagcctccaccacctccggcaagtgctggtagcgcacagcctaccccacctccccctcctcccgagaaaacccattttggtggtttgaaagatgaggaccggatctttaccaacttgtatggtttgcatgatccatttctcaaaggtgccatgaaacggggtgactggtatagaactaaggatttggttctcaagggcactgattggattgtgaatgaagttaagaaatctggcctccgtggacgaggtggtgctggtttcccctctggcctcaaatggtcattcatgcctaaggtatctgatggccgcccttcatatcttgtggtcaatgccgatgaaagtgaaccaggaacttgcaaagacagggagattatgcgtcatgatccacataagcttttagaaggctgcttaattgctggtgtcggaatgagagcctctgctgcttatatctacattagaggtgaatatgttaacgagcgtcttaacctcgaaagagcaagaaaagaagcttacgaagctggtctgttgggtaagaatgcatgtgggtctggctatgattttgatgtccacatccactatggtgctggtgcttacatttgtggtgaagagactgcacttttagagagcctagaaggaaaacaaggaaaacccaggttgaagcctccgttcccggctaatgctggattgtacggctgcccaactactgttacaaatgtggaaaccgtggctgtatctccaaccattttgagacgtggaccagaatggtttgctagcttcggaagaaagaacaactctggaacaaaattgttttgtgtgtcaggtcatgtgaataagccttgcacagttgaagaagagatgagtatacccctaaaagagttaatagagaggcactgtggaggtgttagaggcggatgggataatcttcttgcagtgatacccgggggttcctctgtccctttgcttccaaagcacatatgtgatgacgtgcttatggactatgatgctctcaaggctgtcacatcaggacttggaactgcagctgttatcgtgatggataagtctactgacgttgtggatgcaatcgctaggttgtcgtacttctacaagcatgaaagctgtggtcagtgcacgccgtgtagggaggggacaggatggctttggatgattatggaaagactaaaggttgggaatgcaaaattggaagagatagatatgcttcaggaggttacaaaacagattgaagggcacaccatctgtgcgttaggtgatgcagcagcttggcctgtgcagggcctcatcaggcattttaggccggaacttgagagaaggataaacgagcgtgcacaaatggagttgctgcaggcttctgcataagataattacagggaagggcatcaatggtgacgttgt

SEQ ID NO: 3917 - DNA, 1632 bp, Brassica juncea
gcacccaagctgcgtccacttccgccactccacagccaccaccacctcctccgcctccggaaaagactcatttcggtggtctcaaggatgaagatcggattttcaccaacctctatggtctacacgacccttttctcaaaggagcgatgaagagaggtgactggtacaggaccaaagatttggtactgaaaggtactgattggattgttaacgagatgaaaaagtctggtcttcgtggacgtggtggtgctggtttcccttctggtcttaagtggtcctttatgcctaaagtctctgatgggcgtccttcttatttggttgtcaacgctgacgagagtgagcctgggacttgtaaagatagggagatcatgcgtcatgaccctcacaagttgttggaagggtgtttgattgctggtgtcggaatgagagctagtgcagcttatatttacatcaggggtgagtatgtgaatgaacgtttgaatcttgagaaggcgaggagagaggcatatgcagctggtctcttggggaagaatgcgtgtggctctgggtatgacttcgatgtttacatccactttggagcgggtgcgtacatttgtggtgaagagactgcgcttcttgaaagccttgaagggaagcaaggaaagcctaggttgaagcctccgttccctgctaatgctggtttgtatggttgtcccacgactgttaccaatgtggaaacggttgctgtttctcctaccattctaaggcgtggacctgagtggttttcgagtttcggtaggaagaataacgctgggacgaagctgttttgtgtttcggggcatgtgaacaagccgtgtaccgttgaagaggagatgagtatacctctcaaggaactgatcgagaggcattgtggaggcgttaggggtggatgggacaacctgcttgctatcattcctggaggttcctctgtccctttgattcctaagaacatatgcgaggatgtgctgatggatttcgatgcgctcaaggctgtccaatcagggctaggaactgcagcggtcattgtgatggataaatcaaccgatgttgtggatgcaattgcaaggctctcttacttctacaagcatgaaagctgtgggcagtgcactccttgcagagagggaacaggttggctctggatgatcatggagagaatgaaagttggcaatgcaaagctggaagagattgatatgcttcacgaggtaacgaagcagatcgaaggacacacaatatgtgcattgggtgatgcagctgcatggcctgtccaaggactgataaggcactttaggccggagcttgagagaagaatcagggaacgcgctgaaagagagctgctacaggccgctgcttaaaatccttgttaaccacagggaatttgctatttttcttctatggaaataaaatctgaagcacaatattatggttttggggggggacgcattcagaaggagaagaaggtaatgtatttgttgaaatggttcatgttaaaactttattcaagttgtatcagaaagagctatatttgctcttttactctactttctttcaatgtttgcttgttttcttatgactatgagataacaatttgggaacaaccaaccaaacaaaaccttt

SEQ ID NO: 3918 - DNA, 2033 bp, Pinus pinaster
acatgggaggcagagccaaaaagaacggaacacgggggcattcgaaagggaaaaaccagagagcgtgctgctgccggaagaggaggcccgaggcatgtggcgtattattccggcggatcgctgcatagaagactgaggacagccaagtaaccagctcgtggcccgtggtgaaggtccaactgattgaggtctgttataaattgacaattatagatgacgaaccttgttcagccaaccaggagaatcttagcatatcattatggcaggaaatgggattcagtgcttaggagtctcagcacccaggctgcaagtacttccactaccccacagccacctccaccccctccacctccagagaaaacccactttggaggactcaaagatgaggatcgcattttcacaaatttatatggattgcatgatccatttctgaaaggagccatgaaacgtggggattggtacagaacaaaggatttggtactaaaaggttctgattggattgtgaatgaaatgaagaaatcaggtctacgtggccggggaggtgcaggatttccatccggtttaaaatggtcatttatgccaaaagtatcggatggacgaccatcatatcttgttgtgaatgccgatgagagtgaaccagggacctgcaaagatagagagattatgagacatgatccccacaagcttattgagggatgcttgattgcaggtgtcggtatgcgtgctagtgctgcatacatttacattagaggggaatatgtaaatgagaggaaagccttacagaatgctctcaatgaagcatatgcagcaggattcttagggaaaaatgcctgtggttcaggttatgattttgatgttcatattcactttggagctggtgcttacatatgtggggaagagactgctttacttgagagcttggagggaaaacaaggcaagcctcgattgaaacctccttttcctgccaatgcaggtctttatggctgtccaacaacagttacaaatgtggagacagtggctgtttcgccaactatactccgcaggggccctgagtggtttgccagctttggccgcaagaacaattcggggacaaagcttttttgcatttcaggacatgtgaacaagccgtgcactgtggaagaggagatgagtatctctctcaaggaactaattgagagacatgcaggaggtgtacgaggtgggtgggacaatttgttagcagtcatccctggaggttcttctgttcctctccttcccaaaaacatttgtgatgatgtattgatggattatgatgcgttgaaagctgtgatatcaggtcttggaacagctgctgttattgtcatggataagtcaactgatgtagtagatgcaatagctcgtctttcctatttctataagcatgaaagctgtggtcagtgtaccccatgcagagaagggacgggatggctttggatgatcatggaaagactgaaggttgggaatgctaaacttgaagagatagacatgctccaagaattgacaaagcagattgaaggtcatacaatttgtgcattgggtgatgctgcagcatggcccgtccaaggtcttattcgtcatttcaggcctgagctggaaaaaagaattcgtgaacgagctaggatggaagtcatggaagctgtgggttaaataggtttaatacttctgagcttctgaatgggaatatggtttattgagactttatgtttaaacactaatagcttctgctttttattttttattctaattttgttctttcattgcctggggaaacacaatcatcaaagtttttaataaactggaagaacatagggattaatttcttcaaatggaggtcactacagagatcttagctgctgtaaacaccaaggatcttgccattaagaattgtgactgcagaaatatgaatgctatacaggataatgtttcataaatttgcaccactttccagtgcttgatattgcttcgttcagtagttcaatttttgaagatgaaccgtagatacttcaataagtgac

SEQ ID NO: 3919 - DNA, 2272 bp, Elaeis guineensis
tccctctttcctccagtcccttccatcttccttctccccctcttctctcctccgatcgtcgcggatcgcccgccaagctcccatatagctgccggaagcggaagccgcccagatctccctcctccgccttccaactccccatccgtccaagatttctccctcttgtccgtctccgtgaccaaggcataaatacgtggccgctcaagctgccacgttgctattccacgtgcaagtcaggcgcactacgcaacgggtggatttgataggctcggagttcattcaagttaacccctcccacgagatcggtcgaagagggaacgaagccgagggcggagagcaacgatgagcgcggcgaagaaggcggcggaggtggccacgaaggccaccgccagatcgatgatggcgaggctcctcgtcgccgatgagggcatcggagccaagctaggccggggagctgtcaagaacttcttttgtccaccaagggcacaactgtgtcatcatttcaatggtgggaggtttaattctgtttataggtcatttagcacccaggctgcgacaacagcaagtacaccacagcctccctcacctcctccacctccagagaagacccacttcggtggtcttaaagatgaagatcgtatttttaccaacctttatggtttgcatgacccattccttaaaggtgcgatgaagcggggggactggtatagaaccaaagacttggtgctcaagggctctgattggattgtcaatgaaatgaagaagtctggtcttcgaggccgtggaggggctggttttccatctggcctcaagtggtccttcatgccaaaggtatctgatggccgtccttcatatcttgttgttaatgctgatgagagtgaacctggtacatgtaaagatagagaaatcatgcgccatgacccccacaaactacttgaagggtgcctgattgcaggagttggcatgcgggctactgctgcttacatctacataagaggtgagtatgtaaatgaacgtttaactcttgagaaggcaagaaaggaagcatatcaagctggattgttggggaagaatgcatgtggatcaggttataattttgatgttcatattcactacggtgctggtgcctacatctgtggggaagagaccgctctattggaaagccttgaagggaaacaagggaaaccgagactcaagcctcctttcccagctaatgcaggcttatatggctgtccaacaactgttaccaatgtggaaacggtggctgtatctcccacgattctaaggcgaggaccagaatggttcgcgagctttggccggaaaaacaactcggggacaaagctgttctgtatctcaggccatgtaaacaaaccttgcactgtggaagaggagatgagcataccattgaaagagctgatagagaggcattgtggtggtgtcagaggagggtggaataacttgttggcggttataccaggtggatcctctgtacctctcctacctaagcacatatgtgatgatgtcttgatggactatgatgcgcttaaggctgtccagtctggattgggcacagcagcagtgatcgtgatggacaaatctactgatgtggtggatgcgatagctaggctgtcgtacttctacaagcatgagagctgtggtcagtgcacaccatgcagggaggggacagggtggctctggatgatcatggagaggcttaaggtggggaatgcgaagctggaggagatcgatatgcttcaggaggtcacgaagcagatcgaagggcatacaatctgtgcattgggggatgctgctgcttggccagtccaagggctgatcaggcatttcaggccagaactagaaagaaggattcgggagcgagcagacaaggagctgctggaggccgcagctgcttgagtgacttggccaaattactttccaaaactttgtcatcttctagtttcaatttaattatgggtgaaaaataatgaaggatgctagtataactcatttctgtttgaaaacacagctctgttgtggccaagttggtcttttgtatggcatcatccgtcctaatctctttcatggctgaaaagtttgtacaattatgatctggaaatcgaagccaggaaaggcaggaacggtgcttgctttttgcatcgcgggatctttaatttctgtgtccaaaattctggattagaaacctgtttaaatttctaccatggtttaacattgtgtgttattatggtgataatgatcatcgaattataataaa

SEQ ID NO: 3920 - DNA, 1988 bp, Pinus taeda
agaaaggggaaagacggaaagggtaggagaaggcagagccaaaaaacgaaacaggtgggcattcgaaagggaaaaaccagagagcgtgctgctgccggaagagggaggcccgaggtatgtggcgtattattccggcggatcgctgcatagaagactgaggacagccaagtaaccagctcgtcgcccgtggtgaaggtccaactgattgaggtctgttataaattgacaaattaacaattatagatgaggaaccttgttcagccaaccaggagaatcttagaatatcatcatggcgggaaatgggattcagtgcttaggagtctcagcacccaggctgcaagtacttccactaccccacagccacctccaccccctccacctccagagaaaacccactttggaggactcaaagatgaggatcgcattttcacaaatttatatggattgcatgatccatttctgaaaggagccatgaaacgtggggattggtacagaacaaaggatttggtactgaaaggttctgattggattgtgaatgaaatgaagaaatcaggtctacgtggccggggaggtgcaggatttccatccggtttaaaatggtcatttatgccaaaagtatcggatggacgaccatcatatcttgttgtgaatgccgatgagagtgaaccggggacctgcaaagatagagagattatgagacatgatccccacaagcttattgagggatgcttgattgcaggtgtcggtatgcgtgctagtgctgcatacatttacattagaggggaatatgtaaatgagaggaaagccttacagaatgctctcaatgaagcatatgcagcaggattcttagggaaaaatgcctgtggttcaggttatgattttgatgttcatattcactatggagctggtgcttacatatgtggggaagagactgctttacttgagagcttggagggaaaacaaggcaagcctcgattgaaacctccttttcctgccaatgcaggtctttatggctgtccaacaacagttacaaatgtggagacagtggctgtttcgccaaccatactccgcaggggccctgagtggtttgccagctttggccgcaagaacaattcggggacaaagcttttttgcatttcaggacatgtgaacaagccatgcactgtggaagaggagatgagtatctctctcaaggaactaattgagagacatgcaggaggtgtacgaggtgggtgggacaatttgttagcagtcatccctggaggttcttctgttcctctccttcccaaaaacatttgtgatgatgtattgatggattatgatgcgttgaaagctgtgatatcaggtcttggaacagctgctgttattgtcatggataagtcaactgatgtagtagatgcaatatctcgtctttcctatttttataagcatgaaagctgtggtcagtgtaccccatgcagagaagggacgggatggctttggatgatcatggaaagactgaaggttgggaatgctaaacttgaagagatagacatgctccaagaattgacaaagcagattgaaggtcatacaatttgtgcattgggtgatgctgcagcatggcccgtccaaggtcttattcgtcatttcaggcctgagctggaaaaaagaattcgtgaacgagctaggagggaagtcatggaagctgtgggttaaataggtttaatacttctgagcttctgaatgggaatatggtttattgagactttatgtttaaactttaaacactaatagcttctgcttttttatttttttattctaattttgttctttcattgcctggggaaacacaatcatcaaagtttttaataaactggaagaacgtagggattaattttttcaagtggaggtcactacagagatcttagctgctgtaaacaccaaggatcttgccattaagaattgtgactgcagaaatatgaatgctatacaggataatgtttcataaa

SEQ ID NO: 3921 - DNA, 1933 bp, Glycine max
agaacaagagaaggcaacctgagagtaataacggaagcaacccacaaaagcagcacaagaacactcatcagatcccagtgatcaattcaatttgcgttcatcactggtaaggcaaacatgaggggcattctttccgtaaggacagccttggttcaacatcatagtgagaaattgggccttggtttcagagtatttagcactcagggtgcttccactgctagtaccccacagccgccaccaccacctcctccgccggagaaaacccattttggcggccttaaggatgaggacaggatatttactaacttatatgggctgcatgatccttttctcaaaggtgccatgaaacgtggggattggcatcgaacgaaagatttggtagttaagggtactgattggattgtgaatgaaatgaagaagtctggcctccgtgggcgtggtggtgctggtttcccttcgggtctcaaatggtcattcatgccaaaagtatctgacggccgcccttcatatcttgttgttaatgctgatgaaagtgaacctggaacttgcaaagacagggaaatcatgcggcatgacccgcataaattgttggaaggttgcttgattgctggagtgggaatgagggctagtgccgcttacatctacatcaggggtgaatatgtcaatgaacgtaagaatctcgaaaaggctagggaagaggcttatgctgctggtttgttgggtaagaatgcttgtggctcaggctatgattttgatgttcatatccactacggtgctggagcttatatttgtggtgaggaaacagccctcttggagagccttgaagggaaacaaggtaaaccaagattgaagccgcctttcccagccaatgctgggttgtatggatgtcctaccactgtcacaaatgtggaaactgtggctgtgtctccaaccattctaaggcgtggacctgaatggtttgccagttttggtaggaagaacaatgctgggacaaagttgttttgtgtgtcagggcatgtgaacaagccttgcactgttgaggaggaaatgagtattccactgaaggaattgatagagaggcactgtggaggtattcgaggaggatgggataatctacttgcagtgattccaggaggatcatccgttcctctgattccaaagcatgtatgtgatgatatcttgatggattatgatgcattgaaggctgttgggacagggttggggactgcagctgtaattgtgatggataaatctacggatgttgtggatgctattgcaaggctttcctatttctacaagcatgaaagctgtgggcagtgcaccccatgcagagaggggactggttggctttggacgatcatggaaagaatgaaagttgggaatgccaagttagaagaaattgatatgcttcaggagttgactaaacaaattgaagggcatacaatttgtgccttgggtgatgctgctgcatggccagtgcagggtcttatcaagcatttcaggcctgagcttgagagaaggattagagagcatgcagaaagggagcttctgcaggccactggctaggcgtttactaaggggtgtgactgtactggtggatagcaagagtcagaataagacagtgccagtcattttggaatgataggtggctcaggttactgcagctttatcgctacttctgttttcttttatgctgcagcaattatggctggaccatacctgggaaaccatttgggcgagtttaaactgtgtacccacattttcgtgtaatttgttaataatatctgtatactgttattaattttgaaaaacaattcatgattatatgcatgttatcaagtgaatgatgagggatgatgtctactggataacctaacttatttgtgattgaattattcatttggaataactttttagaaggacatgttattgt

SEQ ID NO: 3922 - DNA, 1757 bp, Zostera marina
cttcctcagttcgttcctccacatccccactgtggcttcactgctacgtcgattatcgccgctgcagctgagctaagattgttttccagggaatcatgaggaaccttctctttcgcccaagaaaaattctggcgtaccgtcgttacattgaattttttgataaatcaggaagatcattcagcacacaagttgccacccccactggagctaaatctcaagtcgaacctccgccgccgccgccgccgccacctgaaaaaacacactttggtaatttgaaagatgaagaccgaatcttcaccaatctctatggtgtacatactccttttctcaaaggggccatgcagcgcggtgactggtatagaacgaaggatttggttctgaaaggttcagattggattgtgaatgaaatgaagaaatctggcctacggggtcgaggaggtgctggattcccatctggtctgaagtggtctttcatgccaaaagtatccgacggacgcccttcctatcttgttgtgaatgccgatgaaagtgaaccagggacctgcaaagatcgagagataatgcgtcacgatcctcacaaactacttgagggatgcttgatagctggagttgggatgcgagcatctgcagcttacatctacattagaggtgagtacgtgaacgagcgtaagaaccttgagaaggccaggaaagaagcttataaagctggattgttggggaaaaatgcatgtggatctggatatgatttcgatgtttacattcattatggtgccggagcctacatttgtggtgaagagacggccctattagagagtctcgaaggaaagcaaggcaaaccgagattaaagcctccctttcctgccaatgccggtttatacggttgtcccacaaccgttaccaatgtggaaactgtagctgtgtcgcctactattctcagacgtgggcccgaatggtttgctagttttggtcgtaagaacaattcagggaccaagcttttttgcatctccggtcatgtgaacaaaccatgcacagttgaagaagaaatgagcataccgttgaaggagcttttagaaagacactgcggtggggttcgaggtgggtgggacaatctacttgccgtgatacctggaggttcatccgtccctcttttacctaaacacatttgtgatgatgtaatgatggactatgatgccctgaaggctgtacagtcaggattggggacagcagctgttattgtgctggataaatcttgtgatgtggttgatgcaattgcgaggctatcttacttctacaagcatgagagttgtgggcagtgcacaccatgcagggaagggactggatggttgtggatgatcatggagaggttgaaagtgggaaatgcgaagcttgaggaaattgatatgcttcaggaagtgacaaaacagattgaagggcacacaatttgtgcactaggagacgctgccgcatggcctgtgcagggtcttataaggcatttcaggccggaacttgagaggcgtattcgagaacgtgctgagaaagagttggctgaagttgcttctgctgcttctgcatgataaattaaatcactcacaaaactcttctaattttctgatatgtttgcctgtttgtttcttgtgacttacaagatgattgcattacatatctatgtttattttcttccaacgttcaaccttagtattatgtagacagtggattgctgttttgttgttgaataaaatattttgaactttcagcta

SEQ ID NO: 3923 - DNA, 1999 bp, Beta vulgaris
attttttgtttctctcaccaccgttaaatcacccaaaaccaaaacttctctcacaattccacgtctcataatccatacccgctcacaccagatcatttatttctctcattttttctcactcactttctctctcctcaaattccccaaaaaataacagtcaaatctgctgaatcgacgataccccagaaaaaagctctcatttcttgcttctaatatggcacccctgaggggaattctcaaacttcaaagaatcgggcagcttcagcgccactatgaaacctggggtgctggctacagcagattgttcagcacccaggctgcatcgacgtctaatacacctcagcctccaccccctcctcctcctccagagaaaacccattttggtggcctaaaagatgaggatcgtatattcactaatttgtatggtattcatgatccttttctcaaaggtgctatgaaacgtggcgattggcatagaacaaaggatttggttttgaagggtactgactggatagtcaatgaaatgaagaagtctggtcttcgtggacgtggtggcgctggttttccatcaggcctcaagtggtcgttcatgccaaaagtatctgatggtcgtccctcttaccttgttgtcaatgcagatgaaagtgaacctgggacctgtaaggacagagaaattatgaggcatgatccccacaaattgcttgagggatgcctaattgctggtgtaggaatgagggccagtgctgcttacatatatataagaggtgaatatgtgaacgaacgcttgaatctggagaaagcaaggaaagaagcttatgcagctggactgttgggaaaaaatgcatgtggatctggctatgattttgatgttcatatccattatggtgctggtgcctatatatgtggtgaagagactgcacttttggagagcctcgaagggaagcaagggaaacccagattgaagcctcctttcccagctaatgctggactctatggatgccctacaaccgtcacaaatgtggaaacagttgctgtatcccccaccattctaaggcgtggacctgaatggttttctagttttggcaggaagaacaattcagggacaaagctattctgcatttcgggtcatgtcaacaagccttgcacggttgaagaggaaatgagcatttcattgaaggaattgatcgagagacactgtggtggagtgagaggtggatgggacaatttgcttgccgtgattccggggggctcttcagttcccttgcttcccaaacacttatgtgatgacgtgctgatggattttgatgcccttaaggctgtacaatcaggtttggggactgctgctgtgattgtgatggataaatcaactgatgttgtagacgcaatagcaaggctatcttatttctacaagcacgagagctgtggccaatgtactccatgcagggaaggaacaggatggctatggatgattatggagaggatgaaagttgggaatgcaaagttggaagagatcgatatgcttcaagagttaacaaagcagattgaggggcataccatttgtgctttgggagatgctgctgcatggccagtgcagggtctgattaggcacttccggcctgagctagaaagaaggatcaaagatcatgcagccaaggagttgttagaggccgaaaaaagaggtctactggaggctgctgcttaaatcatctcatgcaggatatctccaattcttggaaaattgttgaaataagagactgtaaggaattccttctaagtataattcaggaggtagctcaagcacatgtatgtcccagtattatgttttgtttcaaagatgtattagcgacatggctgtattcattttatcgcaataactgcatactttttgagtatgtgtctggacggacacataatttttacattgttcatgttactttcgggtgtaactgtgtaaggcaatgaaaacgtttctctagaccgcgctttaacaagtattttt

SEQ ID NO: 3924 - DNA, 1460 bp, Vinca minor
aacaacagcatttcatgctcttatggcacccataaagggtatcctttctttacagcggagtgcttttgctaggcgtcaggaagcttgccgccttggcaatagattatttagcactcaggctacgtcaactgctagtactcctcaggcccaacagcctcctccacctccaccacctcctgagaaaacccattttggtggcctcaaagatgaggaccgtattttcacaaacgtttatggtttacatgaccctttcctcaaaggtgcaatgaaacgaggtgactggtatagaacaaaagacttggtactcaagggtactgattggatcgtcaatgaaatgaagaagtctggccttcgtgggcgaggtggtgcaggctttccgtctggtcttaaatggtccttcatgccaaagcaatctgatggtcgcccttcctatctagttgtcaatgctgatgaaagtgaacctggaacttgtaaagatagagagatcatgcgtcatgatcctcacaagttattggaaggttgtctgatagctggtgttggtatgagggcaagtgctgcatacatctacatcaggggtgaatatgtcaatgagaggaagaatctggagagggcaaggaaagaagcttatgaagctggtcttctcgggaaaaatgcatgtggctctggttacgaattcgatgtacatatccactttggtgctggagcctacatttgtggtgaagagacagctctccttgagagccttgagggaaaacaaggtaaacctaggttgaagcctccttttcccgctaatgcaggtctatatggttgtccgactaccgttacaaatgtggaaactgtagccgtttcaccaaccatcttaaggcgtgggccagagtggtttgctagttttggtaggaagaataattctggtacaaagctattttgcatctcgggacacgtcaacaagccttgcacagttgaggaggagatgagtatacctttgaaggagctaatagagaggcattgcggaggtgttaggggtggctgggataatctacttgctgttattcccggtggttcatctgttccattgattccgaagaacatgtgtgaggatgtgcttatggactttgatgcactcaaggctgtgcagtcagggctggggactgctgccgtaattgtgatggataagtcaactgatgttgtagatgcaatcgcaaggctatcttatttctacaaacatgagagttgtggtcagtgcacaccttgcagggaaggtacaggatggctttggatgatcatggaaagaatgaaggtcggaaatgccaaattggaggagattgacatgcttcaagaagtgacaaagcagattgaagggcacacaatatgtgcacttggtgatgcagctgcttggccggttcagggtctgatcaggcacttcagaccggagcttgagaggaggattagagagcgtgcag

SEQ ID NO: 3925 - DNA, 1747 bp, Abies balsamea
gttactcgatcgtctgcagtaacgattgggcatctgattattagaggtctgttacaaattaacaaattataaatgaggaaccttgttctgccaaccaggagagtcttagcacatcattatggcaggaaatgggattcaattcacagggttctcagcacccaggctgcaagtacttcaactaccccacagccacctccaccccctccacctccagagaagacccattttgggggactcaaagatgaggatcgcattttcacaaatttatatggaatgcatgatccatttctgaaaggggccatgaagcgtggggattggtacagaacaaaggatttggtattgaaaggtgctgattggattgtgaatgagatgaagaaatcaggtctgcgtggccgagggggtgcaggatttccatccggtttaaaatggtcttttatgccaaaagtatcagatggaagaccatcatatcttgttgtgaatgctgatgagagtgaaccaggcacctgcaaagatagagagattatgagacatgatccccacaagcttcttgagggatgcttgattgcaggtgtcggtatgcgagccagtgctgcatacatttacattagaggggagtatgtgaatgagaggatagccttacagaatgctctcaatgaagcatacaaagcaggatttttaggcaaaaatgcctgtggctcaggttatgattttgatgttcatattcactttggagctggggcttacatatgtggagaagagacagctttactcgagagcttggagggcaaacaaggcaagcctcggttgaaacctccttttcctgctaatgcaggtctgtatggctgtccaacaacagttactaatgtggagacagtggctgtttcaccaactatactccgcaggggtcctgagtggtttgccagctttggtcgcaagaacaattcaggtacaaagcttttttgcatttcgggacatgtgaacaagccatgcactgtggaagaggagatgagtatctctctcaaggaactaattgagaggcatgcaggaggtgtaagaggtgggtgggacaatttgctagcagtcattcctggaggttcttctgttcctctccttcccaagaacatttgtgatgatgttttgatggattatgatgcattgaaagctgtgatatcggggcttggaacagctgctgttattgtcatggataagtcaactgatgtagtggacgcaatagctcggctttcctatttctataagcatgaaagctgtggtcagtgtaccccgtgcagagaagggacagggtggctgtggatggtcatggaaagactgaaggttgggaatgctaaacttgaagagatagacatgctccaggaactgacaaagcagattgaaggtcatacaatttgtgcattgggtgatgctgcagcttggcctgtccaaggtcttattcgtcatttcaggcctgagctggaaagaaggattcgtgagcgagctaggatggaagtcatggaagctgtcgcttaaacatggctagtttttctgagcttttgaatagaaatatggtttactgagaccttatgtttaaacactgatatcttctgccttttattttttaattttcattttgttctctcattgcaacgggaaacacaattatcaatggttttaataaaactggaggaactttgggattgttttttttcaagtggagattattacagaggtctcagcagctgcaaaaaccaag

SEQ ID NO: 3926 - DNA, 2502 bp, Eucalyptus grandis
cgcagagtggccattacgacagaggagctctctattcatctgcccccacctttgcagttcccttcttctctctcgatcgtctcgcttcgctcctcgacctgaaatccgcccgcccagtcggaggcgcatccgcgacacgtcccgcgccatggcaccaatgaggggcctgctttctcttcgaaagacgattttgcttcgggggcaggggataggtgttaggtcattcagcaccgaaggtgccaaaactgctagtgcccctccatcgcctccaccacctccacctcctccagagaaaacccattttggtggactaaaggatgaggatcgcattttcactaacctgtatggaatgcgtgatccttttctgaaaggtgccatgaaacgtggtgactggtacaggacaaaagatttggtattaaagggcactgattggattgtgagtgaagtcaagaagtctggtctccgagggcgtggtggtgctggtttctcagctggcctgaagtggtctttcatgccaaaagtatcagatggtcgtccttcctatcttgtggtcaacgctgatgaaagtgaaccaggaacatgtaaagatagggaaattatgcgtcatgaccctcacaagcttcttgaaggatgcttaattgctggtgtgggaatgagggcatctgctgcctatatttatataaggggtgaatacgtaaacgaacgtataaatcttgaacgggccagaaaagaggcttatgaagctggactgttgggaaagaatgcatgtggatctggctacgattttgatgtccacatccattatggtgctggagcttatatttgtggtgaagagactgcactattggaaagtcttgaagggaaacaagggaagccaaggttaaagccacctttcccggctaatgccggcttatatggctgtcctaccactgttaccaatgttgaaactgtggctgtttctccaacgattctcagacgtggtccagattggtttgccagttttggaaggaaaaacaatgcagggacaaaattgttttgcgtgtcgggtcatgtaaacaagccttgcacggtcgaggaggaaatgagtataccattgaaggagctgatcgaaagacactgcggcggcgtcaggggtggatgggacaacttacttgcagtaataccagggggttcatctgtaccgcttctcccaaagaacatatgcgatgatgtgctgatggactatgatgctcttaaggctgtccagtctggtctaggaacagcagctgttatagtgatggataaatcaaccgatgttgttgatgcaattgctaggctttcttatttctataagcatgagagctgtgggcagtgcacgccctgcagggagggcacaggatggctctggatgataatggaaaggttgaaagttgggaatgcaaagttggaggagattgatatgctgcaggaggtgaccaagcagattgaagggcatacaatatgtgctttaggtgatgcggctgcttggcctgtccagggtctcattcggcattttaggccagaactcgagagaaggattagggaacgtgccgagagagagttgctggaggctgcagcttagtttttatactcaggtaaatccctttgttggtggataatgttagaataacaagaagaactacccaaaatttgggttgatgggtggatctggcttctgggtcttttgcatttctatttcttgctaagctgcacagtgagtttattcactgccaaggaaacttattctctcaattatctggacaggagttatgtattgtcatttcgtgtattatgggaaaactaactagctcacattttccagaaagtttgtcaataaatctttgtatgttgtcttctggttgatgttgcttgtctgtaagtagtcgtgggaaaactgtcctcttgagatggtattattgtgcggcatgtccagtatcttgaatttgagaatggaaaccctcatccatgcaccatgcgtttggtgaatttcaagtctgagctctgactgactcaactggtcggctgctacgaaggtctctgtcatttgaccttgtctgtcgagtgatggctctgatgattagccgagtcacctgatttctttcttttggtctgaactggaggctgcgcatgagcagctagtccgtaggtgtccaatgaacttcatggttgctgatgaaattagcatctcaaattctctcctgtcccttgtcttggcaaagctaggttgcgggaactacctttcctgggcaccaaatatatcagtgactatcgtccaaacttctttgaaactgctcaaccgaaggcatagccgttggacatgtttttcatgctttcaaatgtgtctgcaatgccagtagtggtttttcattttaatttatattttattatgtatgatgattggcttggtcttgatgcagtggattaggttgccttgatacaatgtttgtttgaaatattgagaccttaacttctcgagatgattgt

SEQ ID NO: 3927 - DNA, 1675 bp, Eucalyptus grandis
tttttgtatttctagcaggcaccaatgaggggcctgctttctcttcgaaagacgattttgcttcgggggcaggggataggtgttaggtcattcagcaccgaaggtgccaaaactgctagtgcccctccatcgcctccaccacctccacctcctccagagaaaacccattttggtggactaaaggatgaggatcgcattttcactaacctgtatggaatgcgtgatccttttctgaaaggtgccatgaaacgtggtgactggtacaggacaaaagatttggtattaaagggcactgattggattgtgagtgaagtcaagaagtctggtctccgagggcgtggtggtgctggtttctcagctggcctgaagtggtctttcatgccaaaagtatcagatggtcgtccttcctatcttgtggtcaacgctgatgaaagtgaaccaggaacatgtaaagatagggaaattatgcgtcatgaccctcacaagcttcttgaaggatgcttaattgctggtgtgggaatgagggcatctgctgcctatatttatataaggggtgaatacgtaaacgaacgtataaatcttgaacgggccagaaaagaggcttatgaagctggactgttgggaaagaatgcatgtggatctggctacgattttgatgtccacatccattatggtgctggagcttatatttgtggtgaagagactgcactattggaaagtcttgaagggaaacaagggaagccaaggttaaagccacctttcccggctaatgccggcttatatggctgtcctaccactgttaccaatgttgaaactgtggctgtttctccaacgattctcagacgtggtccagattggtttgccagttttggaaggaaaaacaatgcagggacaaaattgttttgcgtgtcgggtcatgtaaacaagccttgcacggtcgaggaggaaatgagtataccattgaaggagctgatcgaaagacactgcggcggcgttaggggtggatgggacaacttacttgcagtaataccagggggttcatctgtaccgcttctcccaaagaacatatgcgatgatgtgctgatggactatgatgctcttaaggctgtccagtctggtctaggaacagcagctgttatagtgatggataaatcaaccgatgttgttgatgcaattgctaggctttcttatttctataagcatgagagctgtgggcagtgcacgccctgcagggagggcacaggatggctctggatgataatggaaaggttgaaagttgggaatgcaaagttggaggagattgatatgctgcaggaggtgaccaagcagattgaagggcatacaatatgtgctttaggtgatgcggctgcttggcctgtccagggtctcattcggcattttaggccagaactcgagagaaggattagggaacgtgccgagagagagttgctggaggctgcagcttagtttttatactcaggtttctactccaatctgttctcgatttatttcttgtactatcccataattaagtagaaaggagaaagcaattacggctcacatgtttacaaactcatgtcctctccctttttttatttttctttctgtcattaactagactctgttagattattgagtggctggtgagatgataatggatgggctaagtaactgt

SEQ ID NO: 3928 - DNA, 2163 bp, Glycine max
gaataaacccacaaaacaacacaaagcagcacaagaaggtgttccattttcaacactcatcagatcccagtcatcaattgcgttaacaactcgtaaggcaaccatgaggggcattctttctgtaaggacagccttggttcaacatcgtagtgagaaattgggccttggtttcaggctatttagcactcagggtgcttccactgctagtaccccacagccgccgccaccacctccaccaccagagaaaacccattttggtggccttaaggatgaggacaggatatttactaacttatatgggctgcatgatccttttctcaaaggtgccatgaaacgaggggattggcatcgaacgaaagatttggtacttaagggtactgattggattgtgagtgaaatgaagaagtctggcctccgtgggcgtggcggtgctggtttcccttcgggcctcaaatggtcattcatgccaaaagtatccgatggccgcccttcatatcttgttgttaatgctgatgaaagtgaacctggaacttgcaaagacagggaaattatgcggcatgacccacataaattgttagaaggttgcttgattgctggagtaggaatgagggctagtgctgcttacatctacatcaggggtgaatatgtgaacgaacgtaagaatctcgaaaaggctaggcaagaggcttatgcagctggtttgttgggtaagaatgcttgtggatcaggctatgattttgatgttcatatccactacggtgctggagcttatatttgtggtgaggaaacagccctcttggagagtcttgaagggaaacaaggtaaaccaagattgaagccgcccttcccagccaatgctgggttgtatggatgtcctaccactgtcacaaatgtggaaactgttgctgtttctccaaccattctaaggcgtgggcctgaatggtttgccagttttggtaggaagaacaatgctgggacaaagttgttttgtgtgtcggggcatgtgaacaagccttgcactgttgaggaggaaatgagtattccactgaaggagttgatagagaggcactgtggaggtattcgaggaggatgggataatttacttgcagtgattccgggaggatcatctgttcctctgattccaaagcatgtatgtgatgatatctttatggattatgatgcattaaaggctgttgggacagggttggggactgcagctgtaattgtaatggataaatctacggatgttgtggatgctattgcaaggctttcctacttctacaagcacgaaagttgtgggcagtgcacaccatgcagggagggaactggttggctttggacaatcatggaaagaatgaaagttgggaatgccaagctagaagaaattgatatgcttcaggagttgactaaacaaattgaagggcatacaatttgtgccttgggtgatgctgctgcatggccagtgcagggtcttatcaagcatttcaggcctgagcttgagagaaggattagagaacatgcagaaagggagctgctgcaggccactggttaggctttcactaaggggtgtgattgtactgctggatagcaagagtgagaataagacagtgccagtcattttggaaagataggtggctcaggttactgtagctttattgctacttctattttcttttatgctgtagcaattatggctggatcatacctgggaaaccatttgggcgagtttaaactgtacctgcttgtcatttggcacattttcatgtaatttgttaataatatctgtatactgttattagttttgaaacacaattcatgattatgcatgttatcagtgaatatgatgagggatgatgtccactggataacctaacttatttgtgattgagttattcatttggaataactttttagaagaacatgttattgttcaacaacgtcctcaacttgcttgtatgaagtctgttgatccatgcatggactaaaacatgtccatacatgattttcagctagttataatcctggtaccaaggtcgtttgcatatttcttttgccatgcaagagacatatttgcctttcaaggaattttcttgagtgtttccaattccactagtattttctcagcccttctctgaatacttaatccaatttgctgtgttgtga

SEQ ID NO: 3929 - DNA, 1866 bp, Valeriana officinalis
tcaactgtgaactacatcaataccgtccatttttcctcccgtctcgactttcacgatctatgcgacctcgttagtactctctcccttcatcacaaagttcagattcttcacagcatcagctccatggcacccatgaaggggattttttcgctgcgtagaatatctttaactaggcgtcaaaatgagactttgtctctgggcagtcgattattcagctctcaggccccaccagcagcttctggtactaccccacaggccccaccacctcccccaccagcagagaaaactcactttggtggcctgaaagacgaagatcgaattttcacaaacctatatggaatacacgatccatttctgaaaggtgcgatgaaaagaggtgattggtatagaaccaaagatctagtaatcaagggcaccgattggattgtgaatgagatgaagaagtctggtcttcgcggacgtggtggtgctggttttccatctggactcaaatggtcgtttatgccaaaagtttctgatggccgtccatcgtatctcgttgtcaatgctgacgaaagtgaacccggtacatgcaaagatagagagattatgcgtcatgatccccataagctattggaaggctgccttatcgctggagtgggaatgagagccagtgctgcttatatctatatcaggggtgaatacgtaaacgagcgattaaatcttgagatagctagaaaagaagcttatgcagcgggatttcttggaaaaaatgcatgtgggtcaggttatgatttcgatgtacatatccactatggagctggtgcatacatttgcggtgaagagactgcgcttctcgagagtcttgagggtaaacaaggaaaacctaggttgaagcctccttttccggcaaatgcaggtctatacggttgccctacaactgtcacgaatgttgaaaccgtcgctgtttctccgactattttaaggcggggcccagagtggttctcgagctttggcaggaagaacaactcagggacaaagttattctgtgtatctggccatgtcaacaaaccatgcactgtcgaagaagagatgagcattcctttgaaggagctgatagagaggcattgtggcggtgttaggggcggctgggacaatttactggcggttatacccggaggatcgtcagttccgatgattccgaagccgatgtgtgaggatgttctgatggactttgatgctctaaaggccgtccagtcaggtttgggaactgcagcagttattgtgatggataagtcaactgatgtggtggatgcgatcgccaggctgtcgtatttttacaagcacgagagttgtggtcaatgcacgccttgcagggaaggaacagggtggttgtggatgatcatggagagaatgaaagttggcaatgctaagttggaggaaatcgatatgcttcatgaagttacaaaacagattgaagggcatacaatttgtgctttgggtgatgctgctgcttggcccgttcaggggcttatcaggcatttcagacccgaaatggagagaaggattagagaacgcgccgacagagagttgcagcaagctgcttctgcttgagatctttctctcagttaacaatatttgctgcgaataagaaggttaatggggaggattgcatatttttcgtatttaaatgtttgtatcaactataagatgctgtgttatttgatgttgtctaagccaaccatatgataagctatgttgttgcttgtgtgtttcatgacatgaagaactccatcatcatcccatatgtgggtttcttgataactcaagagaacattacttgatttttgtttatgttgtcaataatataacaaacacaatgttagt

SEQ ID NO: 3930 - DNA, 2076 bp, Picea glauca
cgggggggtttgtcgatcatctgcagtaacaatttggcatctgattatcagaggtctgttataaattgacaattatagatgaggaaccttgttcagccaaccaggagagtcttagcacatcattatggcaggaaatgggattcaatgcataggagtctcagcacccaggctgcaagtacttccactaccccacagccacctccaccccctccacctccagagaaaacccactttggaggactcaaagatgaggatcgcattttcacaaatttatatggattgcatgatccgtttctgaaaggagccatgaaacgtggggactggtacagaacaaaggatttggtattgaaaggttctgattggattgtgaatgaaatgaagaaatcaggtctgcgtggccgaggaggtgcaggatttccatccggtttaaaatggtcttttatgccaaaagtatcagatggaagaccatcatatcttgttgtgaatgctgatgagagtgaaccagggacctgcaaagatagagagattatgagacatgatccccacaagcttcttgagggatgcttgattgcaggtgtcggtatgcgtgcgtgtgctgcatacatttacattagaggggaatatgtgaatgagaggaaagccttacagaatgctctcaatgaagcatatgcagcaggattcttaggcaaaaatgcctgtggttcaggttatgattttgatgttcatattcactttggagctggtgcttacatatgtggagaagagacagctctacttgagagcttggagggaaaacaaggcaaacctcggttgaaacccccttttcctgccaattcaggtctgtatggatgtccaacaacagttactaatgtggagacagtggctgtttcaccaaccatactccgcaggggccctgagtggtttgccagctttggtcgcaagaacaattcggggacaaagcttttttgcatttcgggacatgtgaacaagccatgcactgtggaagaggagatgagtatctctctcaaggaactaattgagagacatgcaggaggtgtaagaggtgggtgggacaatttgctagcagtcattcccggaggttcttctgttcctctccttcccaagaacatttgtgatgatgtattgatggattatgatgcattgaaagctgtgatatcagggcttggaacagctgctgttattgtcatggataagtcaactgatgtagtggatgcaatatctcgtctttcctatttctataagcatgaaagctgtggtcagtgtaccccatgcagagaagggacaggttggctttggatgatcatggaaagactgaaggttgggaatgccaaacttgaagagatagacatgctccaagaattgacaaagcagattgaaggtcatacaatttgtgcattgggtgatgctgcagcatggcccgttcaaggtcttattcgtcatttcaggcctgagctggaaagaagaattcgtgagcgagctaggacggaagtcatagaagctgtgggttaaacatggttaatatttctgagcttttgaatgggaatatggtttaatgagaccttatgtttaaacactaatagcttctgctttttatttttaaattttcacttcgttctcttattgcatggggaaacacaatcatcgaaggttttaataaactggaagaacatagggattacttttttcaagtggagatcattacagagatcttagcagttgtaaacaccaaggatcttggcattaagaattgtgactgcagaaatatgaatgctatacaggatgatgcttcataatgtgcaccacttactagtgcttgatattgcttcgttccatagttcaatttttgcaaaatgaactgtagatacttctattagtgcttttgtttaggtggactggttcttttcctggtaaggaaaggcggtatgtagctatatttacatccaagtagtatgaatcctttactctattttttgatgcctgatatgtcttctgattaagtggatgtcatcccttcaattagtgtttttaagagttttattaattgatttactatca

SEQ ID NO: 3931 - DNA, 1775 bp, Citrus clementina
ggacccctgaagggggttttttccctggaaaggggatcattggttaaatgctacagggagagtgggaccagtttacagcacaaattgagccaattgcatcaactgccagtactccacaacctccgccacctcccccacctccagagaaaacccattttggtggcctgaaagatgaagacaggattttcaccaacttatatgggatgcatgacccttttctcaaaggtgccatgaaacggggtgattggcacagaactaaagacttggtactcaagggtgcagattggattgtcaatgaagtcaagaagtctggtctccgcggacgtggtggtgctggttttccctctggcctcaagtggtccttcatgcccaaggtgtctgatggccgtccttcgtatcttgttgtcaatgctgatgaaagtgaacctggaacctgtaaagacagggaaattatgcggcatgatccacataagttgttggagggctgcttgattgctggcgtaggaatgagggcttctgctgcttacatttacataaggggtgaatatgtaaatgaacgtaaaaaccttgaaagagcgaggcaagaagcttatgctgctggattgttgggcaagaatgcctgcggatctggttatgattttgatgtgcatatccactatggtgctggtgcttatatttgtggtgaagagacagctcttttggaaagccttgaaggtaaacaggggaaaccaagattgaagcctcctttccctgctaatgcaggtttatatggttgtcccaccactgtcaccaatgtggaaactgtggccgtttctcccatcattttaaggcgtggaccggactggtttgctggttttggcaggaagaacaattctggtacaaaattgttttgtgtgtcgggccatgtgaataagccttgcacagttgaagaggagatgagtattcccctcaaggagttgatagatagacactgtggtggtgttcgaggtggatgggataatttacttgcagtaataccagggggttcttcagttccgttgcttcccaaacatatatgtgatgatgtgctgatggattatgatgctctgaaggctgttcaatcaggattgggaactgctgctgtgattgtcatggacaaatcaactgatgttgtcgatgcaattgctaggctctcatacttctataagcatgaaagctgtgggcagtgcactccatgcagggagggaacaggatggctttggatgatcatggaaagattgaaggttggaaatgcaaagttggaggagattgatatgcttcaggaggtgaccaagcagattgaagggcacacaatctgtgcactgggtgatgcagctgcttggcctgttcagggtctcatacgacattttaggcctgagcttgagagaaggatcaaagagcatgctgagagggagctgctggaggccacagcttaaatttttcttctcaggtaatttttttcttcaaatggtcgatattgtggaataaaactgaggaaagcatcccagatattgggagtaattcaagcatctgaagattttgttagaatttggtttgttttaagctgtatgaattatggattcttcatttactgtcctggagaaatgatggtgtatgtatcctctgtatctgggcatggatgctacccttttttatttttttataagctgggcacggatacttaaaaaagttgtttcatgtatttcttgaacatgacattttggctcatctgaggagctttgttaatatctgcatat

SEQ ID NO: 3932 - DNA, 1705 bp, Nicotiana tabacum
  misc_feature (84)..(84): n is a, c, g, or t
  misc_feature (89)..(89): n is a, c, g, or t
  misc_feature (98)..(98): n is a, c, g, or t
  misc_feature (104)..(104): n is a, c, g, or t
  misc_feature (115)..(115): n is a, c, g, or t
  misc_feature (927)..(927): n is a, c, g, or t
  misc_feature (1242)..(1242): n is a, c, g, or t
  misc_feature (1539)..(1539): n is a, c, g, or t
  misc_feature (1551)..(1551): n is a, c, g, or t
  misc_feature (1580)..(1580): n is a, c, g, or t
  misc_feature (1599)..(1599): n is a, c, g, or t
  misc_feature (1601)..(1602): n is a, c, g, or t
  misc_feature (1607)..(1607): n is a, c, g, or t
  misc_feature (1609)..(1609): n is a, c, g, or t
  misc_feature (1634)..(1634): n is a, c, g, or t
  misc_feature (1646)..(1647): n is a, c, g, or t
  misc_feature (1652)..(1652): n is a, c, g, or t
  misc_feature (1657)..(1658): n is a, c, g, or t
  misc_feature (1673)..(1674): n is a, c, g, or t
  misc_feature (1678)..(1678): n is a, c, g, or t
  misc_feature (1686)..(1686): n is a, c, g, or t
  misc_feature (1694)..(1694): n is a, c, g, or t
  misc_feature (1702)..(1702): n is a, c, g, or t
ggccattacggccggggggagtaatagatttggaaatcaaggcccacgattcacaatagcttcgttctcaccgtaatctgctgnagaancagctgaanttcacngattcatcacntttctgcgtcaacattcatggcacctataaagggacttctttctctgcaacggactgcattagtacagcgttctagtgaaagatggggtctatatggtaggttatttagcactcaggctgcatcaactgctagcaccccccaacctactccaccacctccacctcccgagaagactcactttggtggccttaaagatgaggatcgtattttcacaaatctctacggattgcatgacccttaccttaaaggggccatgaagagaggtgattggtacagaacaaaagaccttgtcctcaagggttctgactggatcgtgaatgaaatgaagaaatctggtcttcgaggacgtggtggtgctggttttccatctggtctcaaatggtccttcatgccaaagacaacggatggccgtccttcataccttgttgtcaatgctgatgaaagtgaacccggaacctgtaaagacagggaaatcatgcggcacgacccacacaagttgttggaaggctgtctgattgctggagtggggatgagggctagagctgcttatatttatatcaggggagagtatgtgaacgaaaggaagagccttgagaaggctaggaaagaagcctatgaagctggattgttggggaaaaatgcttgtggaactggttatgattttgacgtatatattcattttggtgccggagcctatatttgtggtgaagagacagctcttctggagagccttgaggggaaacaaggcaaaccaagactgaagcctccatttccagctaatgcaggactttatggttgtccaacaactgtnacaaatgttgaaacagttgctgtttcaccaaccatcttaaggcgtgggccagagtggtttgctagttttggccggaagaataatgctgggacaaagttgttttgcatctcaggccatgtaaacaagccctgcacagtggaagaggaaatgagtattcccttgaaggagctgatagagaagcactgtggcggtgttcgtggaggttgggacaatttacttgctgttataccaggaggttcatctgttccactgattcccaagaacgtatgtgaggacgtactaatggattttgatgcactcaaagctgtgcagtcngggttggggactgctgctgtaattgtcatggacaagtcaactgatattgtagatgcaactgcaaggctctcgtacttctataagcacgagagctgtggtcaatgtactccatgtagggaaggcacagggtggctttggatgatcatggaaagaatgaaggttggcaatgcaaaattagaagagattgacatgctccaagaggtgacaaagcagattgaagggcataccatttgtgcattgggtgatgctgctgcttggccagtgcagggtctcattaggcactttagaccagagctngaaaggaggatnagggagcacgcagacagggagctacagcntgctgctgctgcttgattntnntgaangntgtttgataccatggaataaatttngaagtaccaganntatgnaagtnngagggaaagcagganncaangcttcctntcgagctncctttttnttg

SEQ ID NO: 3933 - DNA, 1669 bp, Brassica napus
ttccaccactccacagccacctccacctcctccgcctccggagaagactcatttcggtggtctcaaggatgaagatcggatttttaccaacctctacggtctgcacgacccttttctcaagggggcgatgaagagaggcgattggcataggaccaaggatttggtgctcaagggtactgattggattgttaatgagatgaagaagtctggtcttcgtggtcgtggtggtgctggtttcccttctggtcttaagtggtcctttatgcctaaagtctctgatgggcgtccttcttatttggtcgtcaacgctgatgagagtgagcctgggacttgtaaagatagggagatcatgcgtcacgaccctcacaagttgttggaagggtgtttgattgctggtgttggtatgagagctagtgcagcgtatatttacatcaggggtgagtatgtgaatgagcgtttgaatctagagaaggcgaggagagaagcatatgcagctggtctcttggggaagaatgcatgtggttctgggtatgacttcgatgtttacatccattttggagctggtgcgtacatttgtggtgaagagactgcgcttcttgaaagccttgaggggaagcaaggaaagcctaggttgaagcctccgttccctgctaatgctggtttgtacggttgtcccacaactgttaccaatgtggaaacggtggctgtttctcctaccattttaaggcgtggacctgagtggttttcgagttttggtaggaagaataactctgggacgaagctgttttgtatatcgggacatgtgaacaagccatgtaccgttgaagaggagatgagtatccctctcaaggaactgattgagaggcattgtggaggtgttaggggtggatgggacaacctgcttgctatcattcctggaggttcctctgtccctttgattcctaagaacatatgcgaggatgtgctgatggatttcgatgcgctcaaggctgtccagtcagggctaggaactgcagcggtcattgttatggataaatcaaccgatgttgtggatgcaattgcgaggctctcttacttctacaagcatgagagctgtgggcagtgcactccttgcagagagggaacaggttggctctggatgatcatggagaggatgaaagttggcaatgcaaagctggaggagattgatatgcttcacgaggtaactaagcagatcgaaggacacacaatctgtgcattgggtgatgcagctgcatggccagtgcaaggtctgataaggcactttaggccggagcttgagagaaggatcagggaacgcgctgaaagggagctgctacaggctgctgcttaaaacccttgttaacgacagggtatttgctattattttcaatggaaataaaatctgaagcacactattagggttttggggatgcaaagctacttcagaaggagaagaaggtactgtatttgttgaaatggttcatgttaaactttaatcaaactgtatcagaaagagctctgtttgctcttttgcttattctactttctttcaatgtttgtatgttttctcatgactactgagagcacattttgggaacaacgaaccaaacaaaaccttttcatatttaaaatagtagagtcgtgggaggcaaggcacactaggggatta

SEQ ID NO: 3934 - DNA, 1662 bp, Gnetum gnemon
agcggctgtcagaagtccgtgtttttacagcttatttgtgttcgttcccatcaagtatggcaatgaggaatcttattcagtcatcaaaaagcatctttgcgaataataagaaatgggatttactgcaccggggtcttagcacgcaggcagccagtacttctactactccacaaccaccaccgccaccacctccccctgaaaagacacactttggtgggctcaaggatgaggaccgcatctttaccaatctctatggtctgcatgatccatttttgaagggtgccatgaaacgtggggattggtacagaaccaaggatttagtattgaagggttcagattggattgtgaatgaaatgaaaaaatctggattgcgtggtcgaggaggagctgggtttccatcaggtctgaaatggtcttttatgccaaaagtatcagatggaaggccttcttatcttgtagtaaatgcggatgagagtgaaccaggaacttgtaaagaccgagaaatcatgaggcatgatccacacaaacttcttgagggttgtttgattgctggtgttggaatgcgtgcccgtgctgcatacatttatattagaggagagtatgtgaatgagagaaaagttttacaaaatgcactcaaggaagcatatgcagcaggattcctaggaaacaatgcatgtgggtcaggttatgattttgatgttcatatccattttggtgctggtgcttatatttgtggtgaagagacagcacttcttgaaagcttggaaggcaaacaagggaaaccccgtttgaagcctccctttcctgctaatgcaggtctgtatggttgtccaacgactgttactaatgttgagactgttgctgtctctccaactatacttcgcaggggtcctgaatggtttgccagttttggccgtaagaacaatgcaggaactaagctcttctgcatttcaggacatgtcaacaagccttgcactgttgaagaggagatgagtatcacgttgaaggaattgattgagaggcatgcaggaggtgtgaggggcggttgggacaatttacttgctgtaattcctggaggttcatctgtacctctcctaccaaagcatatttgtgatgatgttatgatggacttcgatgctttaaaggctgtgcaatctggacttggaacagcggctgttattgtaatggacaaatccactgatgtagtggatgcaattgcccgtctctcatatttttacaaacatgaaagctgtggtcagtgcactccctgtagagaaggaacaggctggctttggatgatcatggaaaggatgaaggttgggaatgctaaacttgaggagatagatatgctctatgaattgacaaagcagattgaaggtcatacgatttgtgctttaggtgatgctgcagcttggccagttcaagggcttatccggcacttcaggcctgaactggaaagaagaattcgtgagcgtgcaaagatggaagttgtcgaggctgctgcatgaatgcaggtggctgcatgaagttagctagcaagactaaattatttgtgtgtgacaattactgatgcactgctctgttaatgttttgttttgacaaattaataaatcttttcaatatgttttgtttagaccttgattttggcagcattagctcccc

SEQ ID NO: 3935 - DNA, 2456 bp, Cephalotaxus harringtonia
agcacctgaatgcggcctccaaataaattaccaatatttccgacattagccgatcgccgtaactggccaaaacaagttaaccgaaagctttctttagggagtcgctgtattctgttgcacttggatccgctcctttcaacttgttggagcagagggttacaaatgaggaaccttgttcagtcgtccaggagggtcctggcacagcattatgtaaggagatgggattcagctcataggtctctcagtacacagtctgcaagcacttctactacgccgcaaccacctcccccccaccacctccagagagaacccattttggagggcttaaagatgaggatcgcatttttacaaatttatatggattgtatgatccacttctgaaaggagccatgaaacgtggggattggtataggactaaggatattgtacagaaaggttctgattggattgtgaatgatatgaagaaatcaggtctgcgtgggcgaggaggtgcaggatttccttcaggcctgaaatggtccttcatgccaaaagtttctgatgggcgtccttcttatcttgttgtaaatgctgatgagagtgaaccaggcacctgcaaagatagagagattatgagacatgatccccacaagcttctcgagggttgcttgatagcaggtgttggcatgcgtgctcgtgctgcatacatttatattagaggtgaatatgtgaacgagaggatcgtcttacagaatgctctcaaggaggcatatgcagctggatttttaggcaaaaatgcttgtgggtcaggttatgattttgatgttcatattcactttggcgctggtgcttacatttgtggagaagagacggcacttcttgagagcctggagggtaaacaaggtaaacctcggttgaagcctccttttcctgctaatgcaggtctgtatggctgtccaacaactgttaccaatgtggagaccgttgctgtttctccaaccatactccgcaggggtcctgagtggtttgctagctttggtcgcaagaacaatgcagggacaaagcttttctgcatttcgggacatgtgaacaaaccttgtactgttgaagaggagatgagtatctctctgaaggaactgattgagagacatgcagggggtgtaagaggcgggtgggacaatttgcttgctattattcctggaggttcttctgttccgcttcttcctaagaatatttgtgatgatgtcttaatggattttgatgcattgaaagctgtgcagtcagggcttggaacagctgctgttatagtcatggataagtcaactgatgtagtggatgcgatagctcgtctttcctatttttacaaacatgagagctgtggtcagtgtaccccatgtagggagggaacaggatggctttggatgatcatggagagaatgaaggttggaaatgctaaacttgaagagatagacatgctccaagaagtgacaaagcagattgaaggtcatacaatctgtgctttgggtgatgcagcagcttggcccgtgcaaggtcttattcgccatttcaggcctgagctggaaagaagaattcatgagcgtgccaggcaggaactcatggaagctgttgcctagacatgcttcttttaagcttttgtgggagaatattttttattgatatgttatgtttctggactgatgaatttcatctttttcccattaacttatgacgagacatgaatatcaaagctttattaataactggaaaaacacaggagttactagttgaaggagatcattggagatctcagcatataacttcaaacatgggatcctggcatttggaatggtgactacagcaaatgtgtttgctgcatgtgttatggttctgtattttagggtgcaggcctagtgctcgagatcttagtgtgaccattaacagcttctctgttcttcattgcttctgcttgttactttatgtgccttgacgaaaccatataaattcctatgcaatttaaaaaaataatacctagctactttagttagtagttagtaccttgtttatctgaggactagggtgtttttgttctaggttggaaaggtaataggctgtttcgtcatgttcacattctcgtgcaaactgatttcagcatagaactcaaaagtgtctgaactcttggaaatcttgagctattttcccttgccagtcatgactcatgcttctcaaaaaatgtgttatcaaagttgacatatcatagtattatcagatacaggtcaaaataagtcttaggccctcatttggtgccctgagacacttttttgtatttatatcagttgtgccttgtctatagtggttgtgctataacagtacggttgatttttagtgttggattgtaatttttgcttgtctactcgctacctaccagagttcttgattttattcacttcttagtttacgtatctaagaattccaatagg

SEQ ID NO: 3936 - DNA, 1751 bp, Sequoia sempervirens
gaggaaccttgttcagtcatccaggagggtcctggcacaacattatttaaggagatgggattcagtgcataggtctctcagtacacagtctgcaagtacctccactacaccacaaccacctcctccacccccaccccagagagaacacattttggaggacttaaagatgaggatcgcatttttacaaatctatatggaatgcatgatccacttttgaaaggagccatgaaacgtggggattggtacaggactaaggatcttgtgcagaagggttctgattggattgtgaatgagatgaagaaatcaggtctgcgtggacgaggaggtgcaggatttccttcaggtctgaaatggtcattcatgccaaaagtttctgatgggcgtccttcctatcttgttgtaaatgccgatgagagtgaaccgggcacctgcaaagatagagagattatgagacatgatccccacaaacttcttgagggttgcctaatagcaggtgttggcatgcgtgctagtgctgcatacatttacattagaggtgaatatgtgaatgagaggaaagtcctcgagagtgccctcaaggaggcatatgcagctggatatttaggtaaaaatgcttgtgactccggttatgattttgatgttcatattcactttggagctggtgcttacatttgtggagaagagacagcacttctagagagcttggagggtaaacaaggcaagcctcggttgaagcctccatttcctgctaattcaggtctgtatggctgtccaacaactgttaccaatgtggagacagttgctgtttctccaaccatactacgtagaggtcctgagtggtttgctagctttggtcgtaagaacaacgcagggacaaagcttttctgcatttcaggacatgtaaacaaaccttgtactgttgaagaggagatgagcatctctctaaaggaactgattgagagacatgcagggggtgtaagaggtgggtgggataatttgcttgcaattattcctggaggttcttctgttcctcttcttcccaagaatatctgtgatgatgtcttgatggattttgatgcattgaaggctgtgcagtcagggcttggaacagctgctgttattgtcatggataagtcaactgatgtagtgaatgcaatagctcgcctttcctatttctacaaacacgagagttgtggtcagtgtaccccatgcagggagggaacaccatggctctggatgatgatggagagaatgaaggttggaaatgctaaacttgaagagatagacatgctccaagaagtgacaaagcagattgaaggtcatacaatttgtgctttaggtgatgctgcagcttggcctgttcaaggtcttattcgtcatttcaggcctgagctggaaagaagaattcatgagcgtgccagacaggaacttatggaagctgttgcctagacatggttcttctaatcttgcaagtgggaatatatttttattgatattttatgtttctggattcatgaagtccattttgtccgattagcttataaggagacaaatatcggagctttttaaaataaactgaagaaaacaggaagtacttgttgatggagatcattagagatctcagcatataacttcaaacacgagaccctggtgtttgaaatggtgaatgcagcaaatgtgtgtgcagcatgtggaattgtttcataacttgttctttgttggttctgcttattaatttatgtgccattccc

SEQ ID NO: 3937 - DNA, 2132 bp, Sciadopitys verticillata
tttgaaaaaaacagatttttttttctataatttttgcactcttggggtttctagctctgcaacgttggtctggattttgggtgaggaatacacattgtgggcacgtggaatcataagcccagaacctgtggatgcagggatgagcataaccattggcaagtagagaagttgccagtagggaattgaaatgtggcaatgcaactgatttttctgactggtccatcacctatggagtctgattaattctggagtttttgtactatacagcattgaagtttaaatttatttggagcttcctttgatataaatgagaaaccttgttcagtcatccaggagggtcctggtgcagcattatgtcaggaaatggggttcattgaataggtctcttagtacacagtctgctagcacttcgactaccccacaaccaccaccccccccaccgcctttggagagaacccattttggaggacttaaagatgaggatcgcatttttacaaatctatacggattgcatgatccatttctaaaaggagccatgaaacgtggggattggtataggactaaagatcttgttttaaaaggttctgattggattgttaatgagatgaagaaatcaggtctgcgtgggagaggaggtgcaggatttccttccggtctgaaatggtccttcatgccaaaagtttctgatgggcgtccttcttatcttgttgtaaatgctgatgagagtgaaccaggtacctgcaaagatagagagattatgagacatgatcctcacaagcttcttgagggttgtttgattgcaggtgttggcatgcgtgctcgtgctgcatacatttacattagaggggaatatgtgaatgagaggaaagccttacagaatgcactcaatgaagcatatgcagctaaatttttaggcaaaaatgcctgtggttcaggttatgattttgacgttcatattcactatggagctggtgcttatatttgtggagaagagacagcacttcttgagagcttggagggtaaacaaggcaagcctcggttgaagcctccttttcctgctaattctggtctatatgggtgtccgacaactgttactaatgtggagactgttgccgtttctccaacgattctccgcaggggtcctgagtggtttgctagctttggtcgcaagaacaactcagggacaaagcttttctgcatttcaggacacgtgaacaaaccttgtaccgtggaagaggagatgagcatttctctcaaggaactgattgagagacatgcaggaggtgtaagaggcgggtgggacaatttgctggctattattccaggaggttcttctgttcctcttcttaccaaggatatttgtgatgatgtcttaatggattttgatgcattgaaagctgtgcagtcagggcttggaacagctgcagttattgtcatggataagtcaactgatatagtgaatgcgatatctcgtctttcctatttttacaaacatgagagctgtggtcagtgtaccccctgtagggaggggacaggatggctttggatgattatggagagaatgaaggttggaaatgctaaacttgaagagatagacatgctccaagaagtgacaaagcagattgaaggtcatacaatttgcgctttaggtgatgctgcagcatggcctgtgcaaggtcttattcgtcattttaggcctgagctggaaagaagaattcgtgagcgtgccagacaggaactcatggaagctgttgcctagacacgtttctttgaatcttttgagtgggaataatatttttattgggacataatgttccaggactgatggattctatctttttcctattaactttctaggagaaacgcaaatatggaagttttttaataaactggaaaagcatgggaattattaattgaagtggagatgattaaagaacttagcatataatttcgaacactagaggtcccaacatttggaatggtgtctactgaaaatgcgtaagcagtatggaatattatttcatattctagggtgcaagcctagtgcttgagattctaatgtgactatttcgtagcttctctgttcgttttcagttctgcttgtttttgtatgtgccttgaaatagtcatat

SEQ ID NO: 3938 - DNA, 1846 bp, Silene vulgaris
ctggaataataaaacttcattcttccaaccaaaatggcacccgtgaggggcatccttaaccttcaaaaagcagcactactccagcgacactgtgataagtggggtgcaggctacagcagattgttcaacacccaagcagcttcaacgtcaagtactcctcagcctccaccgccacctcctcctgagaaaactcactttggtggattgaaagatgaggatcgaattttcacaaatctgtatgggatacatgacccctttctcaaaggtgccatgaaacgtggtgactggtatagaaccaaggacttggttttgaagggtactgactggatagtaggtgaaatgaagaagtcaggcctccgtgggcgtggtggtgccggttttccctcaggtctcaagtggtctttcatgccgaaagtgtccgatggtcgtccttcatatcttgttgtcaatgcagatgaaagtgaacctggaacctgtaaggacagagaaataatgaggcatgatccccacaaacttctagaaggatgcctcattgccggagtaggaatgagggccagcgcagcatatatctatataagaggtgaatatgtgaatgaacgcttgaatcttctaaaggccagacaggaagcttatgaagctggatatctaggcaaaaatgcatgtgggtctggttatgattttgacgttcatatccactatggtgctggcgcttacatttgtggtgaagagacggctcttttggagagtcttgaaggaaagcaagggaaaccacgtttgaagccgcctttccccgccaatgctggcttgtatggatgtcctaccacagttacaaatgtggaaacggttgccgtttctcctaccatcctaagacgtggacctgagtggttttctagttttggcaggaagaacaactctggcactaaacttttctgcatttcgggtcatgtcaacaagccttgcaccgttgaggaggaaatgagcattccattgaaggaattgattgagagacattgtggtggagtaagaggtggatgggacaacttactcgcgataatacccgggggttcgtcggtcccgcttcttcccaagcacttatgtgacgacgtgttgatggatttcgatgcccttaaggctgtccaatctggtttggggactgccgctgtgatagtaatggataaatccaccgatgttgtggatgcaatagcaaggttgtcgtatttctacaagcatgagagttgtggacaatgtactccttgcagggagggaacaggttggctatggatgatcatggagaggatgaaagttggtaatgcaaagctggaagaaatcgatatgcttcaagagataacgaagcaaattgagggacatactatatgtgcattgggagatgctgctgcttggccagttcagggtctcattagacatttcaggcctgagcttgagagaagaattaaggaacatgccgccaaggagttgattgaggccgaaaaaagaggtctgcttgaggctgctgcttagatcctatcattcagagatctccatttgtgggaaaaaggaataagagaaactgtaggaattactcttgttagtgtaaagtctgaaggttgatcaagcagatgtccgtccgagcaatttgttctattgtgaactgtgaagtgccctgctatttggcttggctgtatttgtttactacaatgactttggtagcttctgaaatgctgaaatgtatcacaactttctcatcttgtacttggagatgtgttatttggagccaatgatgttctactgtctctattggccctttttcttttgacaaagccataataataagatatatttggaactt

SEQ ID NO: 3939 - DNA, 1974 bp, Silene vulgaris
atcgccaattatccatttgaaataacacttctttaatccttgattcacaaaaatggcacccctgaggggcattcttaattttcaaagagcagcactactgcaacgtcactctgacaagtggggagcaggctacagcagattgttcaatacccaggcggcctccacatcaaactctcctcagccaaccccccctcctcctcctccagagaaaactcactttggtggcttgaaagatgaggatcgcattttcacaaatttgtatgggatacatgacccttttctcaagggggccatgaagcgtggtgactggtatagaaccaaagatttggtattgaaaggtactgactggatagtaggtgaaatgaagaagtctggccttcgtggacgtggtggtgctggtttcccgtcaggtctcaagtggtctttcatgccaaaagtgtcggacgggcgtccttcttaccttgttgtcaatgccgatgaaagtgaacctggaacatgcaaggatagagaaataatgaggcacgatccccacaaacttctagagggatgccttattgcgggagttggaatgagggctagtgcggcttacatctatataagaggtgaatatgtgaacgagcgcttgaaccttctaaaagccaggcaggaagcttatgatgctggatacctgggcaaaaatgcatgtgggtccggttatgattttgatgttcatatccactatggtgctggtgcctatatttgtggtgaagagacggctcttttggagagtctcgagggaaagcaaggcaaaccaagattgaagcctccatttccggccaacgctggcctgtatggatgtcctactacagtcacaaatgtggaaaccgtggccgtatcgcctaccattttaaggcgagggcctgagtggtttgctagttttggaaggaagaacaatgcaggaacaaagctgttctgcatttcaggtcatgtcaacaagccttgcactgttgaggaggaaatgagtattccattgaaggaactgattgaaaggcattgtggtggggtaagaggtggatgggataacttacttgcaattatacccggaggatcgtctgtcccactacttccaaaacacttgtgcgatgacgtgttgatggatttcgatgcacttaaggctgtccaatcaggtttgggaactgctgctgtgattgtgatggataaatcgactgatgtcgttgatgcaatagcaaggttgtcgtatttctacaagcatgagagttgtggacaatgtactccatgtagggagggaacgggctggctatggatgattatggagaggatgaaagttgggaatgctaagctggaggaaattgacatgcttcaagagataacaaagcaaatcgagggacataccatttgtgctttgggagatgctgccgcttggccagttcagggtcttatcagacatttcaggcctgagcttgagagaagaataaaggaacatgcagccaaggagctgattgaggctgaaaaaagaggtcttcttgaggctactgcttagatcctaccctgcagaggtcttcagttgtcggagagttgtgtaataagagaaactgtagggatgaacccattgtagtttacgtctgaagttgaagcacatgaatgtctcggcaatttgttctgtttacaaaatgcagcatctactttgctgtatttatctacttcattaactttgttaccattttgaaaatgtgtctggatagacactgtttttaccatgtttcttgttatttcctcattgtaatttgtaaggcaatgccaacctacccttggataggctcgacaaggacaaggaaagctgtgtcgctattcgtcttaattttaattttctcaacgagacccaaataaggagaatggattttagtcggcacactttctgtccaatatgtaaacttgtgaatttaaacatagaaatcatatggaacttgaaagact

SEQ ID NO: 3940 - DNA, 1436 bp, Gossypium raimondii
gattgttctttctttgcataggcacccataaagggcattctttccttgcaaagggcagctttgttaagagcttgcggtgaaaggtggaaactaggcactagatcatttagtactcaaggagcaacaactgctgatgctccacaggcacctcctcctcctccaccgcctgaaaaaacccattttggtggtctaaaagatgaagaccgtattttcaccaacttatatgggttgcatgacccttttctcaaaggtgccatgaaacgtggtgactggtatagaaccaaggatttagtactcaagggtgctgattggattgtgaatgaaatgaagaaatctggacttcgaggacgtggtggtgctggatttccatcgggcctcaaatggtcttttatgccaaaagtatctgatggtcgtccttcttatcttgttgtcaatgctgatgaaagtgaacctggaacctgtaaggacagggaaattatgcggcacgatccacacaaactattggagggctgcttgattgcgggggttggaatgagagctacagctgcttatatctacatcaggggtgaatatgtgaatgaacgtaaaaaccttgaaagagctagaaaagaagcttatgaagctggactattgggcaaaaatgcatgtggttctggttatgattttgatgttcacatccattatggtgctggtgcctatatttgtggtgaagaaacagcacttttagagagccttgaaggaaaacaagggaaacctagattgaaacctcctttccctgctaatgctggattatatggttgtcccaccactgtcacaaatgtggagacagtggctgtttcacccacaatactgagacgtggtcctgagtggtttgccagttttgggaggaagaataattccgggacaaaattgttttgtgtctcaggtcatgtcaacaagccttgcacagttgaggaggagatgagtataccagaggttcatctgttccacttttacccaagcacatatgtgatgatgtcttgatggattacgatgcactcaaggctgtccagtcaggactgggaactgctgcagtaattgtgatggataaatcaactgatgttgtagatgcaatcgcaaggctttcatacttctacaagcatgagagttgtggacagtgcacaccctgcagggaagggactggatggctctggatgatcatggaaagattgaaagttgggaatgcaaagttggaagagattgacatgcttcaggaggtgaccaagcagattgaagggcacacaatttgcgctttgggtgatgcagcagcttggcctgtgcagggtcttatacggcattttaggccagagctggagagaaggattagagagcgtgcagaaagggagttgctggaggcttctgcttaatctctgctcaggttgcttctggcatctttt

SEQ ID NO: 3941 - DNA, 1697 bp, Brassica juncea
aaaactcagtgcgtccacgcttcaccttcttcctcctctacatctcctcccttctcgattatagagaacaaaggctaagtcctctctctctctctccccgatttcttcgcggaaaattttcgtatccatggcacctgtgagggggattcttggtttgcagagggcggtatcagtttggaaggagagtaacagattggctccagctttgagatcattcagtacccaagctgcgtccacttccaccactccacagccacctccacctcctccgcctccggagaagactcatttcggtggtctcaaggatgaagatcggatttttaccaacctctacggtctgcacgacccgtttctcaagggggcgatgaagagaggcgattggcataggaccaaggatttggtgctgaagggtactgattggattgtcaatgagatgaaaaagtctggtctgcgtggacgtggtggtgctggtttcccttctggtcttaagtggtcctttatgcctaaagtctctgatgggcgtccttcttatttggttgttaatgctgatgagagtgagcctgggacttgtaaagatagggagatcatgcgtcacgaccctcacaagctgttggaagggtgtttgattgctggtgtcgggatgagagctagtgcggcgtatatttacatcaggggtgagtatgtgaatgaacgtttgaatcttgagaaggcgagaagagaagcatatgcagctggtctcttgggaaagaatgcgtgtggctctgggtatgacttcgatgtttacatccactttggagcgggtgcgtacatttgtggtgaagagactgcgcttcttgaaagcctcgaagggaagcaaggaaagcctaggttgaagcctccgttccctgctaatgctggtttgtacggttgtcccacaactgttaccaatgtggaaacggtggctgtttctcctaccattttaaggcgtggacctgagtggttttcgagttttggtaggaagaataactctgggacgaagctgttttgtatatcgggacatgtgaacaagccatgtaccgttgaagaggagatgagtatccctctcaaggagctgattgagaggcattgtggaggtgttaggggtggatgggacaacctacttgctatcattcctggaggttcctctgtccctttgattcctaagaacatatgcgaggatgtgctgatggatttcgatgcgctcaaggctgtccaatcagggctaggaactgcagcggtcattgtgatggataaatcaaccgatgttgtggatgcaattgcaaggctctcgtacttctacaagcatgaaagctgtgggcagtgcactccttgcagagagggaacagggtggctctggatgatcatggagaggatgaaagttggcaatgcaaagctggaggagattgatatgcttcacgaggtaactaagcagatcgaaggacacacaatctgtgcattgggtgatgcagctgcatggcccgtccaaggctgataaggcactttaggccggagcttgagagaaggatcagggaacgcgctgaaagggagttgctacaggctgctgcttaaaaatccttgctaaccacagggaggttgttattattctccatggaaataaaatctgaagaacaatattagagttttgggattgcaaagctacttcagaaggagaagaaggt

SEQ ID NO: 3942 - DNA, 1951 bp, Centaurea maculosa
  misc_feature (56)..(56): n is a, c, g, or t
  misc_feature (59)..(59): n is a, c, g, or t
  misc_feature (71)..(71): n is a, c, g, or t
  misc_feature (82)..(82): n is a, c, g, or t
  misc_feature (97)..(97): n is a, c, g, or t
  misc_feature (107)..(107): n is a, c, g, or t
  misc_feature (114)..(114): n is a, c, g, or t
  misc_feature (121)..(121): n is a, c, g, or t
  misc_feature (127)..(127): n is a, c, g, or t
  misc_feature (163)..(163): n is a, c, g, or t
  misc_feature (173)..(173): n is a, c, g, or t
  misc_feature (181)..(181): n is a, c, g, or t
  misc_feature (184)..(184): n is a, c, g, or t
  misc_feature (193)..(193): n is a, c, g, or t
  misc_feature (199)..(199): n is a, c, g, or t
  misc_feature (211)..(211): n is a, c, g, or t
  misc_feature (215)..(215): n is a, c, g, or t
  misc_feature (249)..(249): n is a, c, g, or t
  misc_feature (251)..(251): n is a, c, g, or t
  misc_feature (255)..(255): n is a, c, g, or t
  misc_feature (259)..(260): n is a, c, g, or t
  misc_feature (286)..(286): n is a, c, g, or t
  misc_feature (293)..(293): n is a, c, g, or t
  misc_feature (322)..(322): n is a, c, g, or t
  misc_feature (336)..(336): n is a, c, g, or t
  misc_feature (345)..(345): n is a, c, g, or t
  misc_feature (365)..(365): n is a, c, g, or t
  misc_feature (371)..(371): n is a, c, g, or t
  misc_feature (373)..(373): n is a, c, g, or t
  misc_feature (377)..(377): n is a, c, g, or t
  misc_feature (382)..(382): n is a, c, g, or t
  misc_feature (387)..(388): n is a, c, g, or t
  misc_feature (396)..(396): n is a, c, g, or t
  misc_feature (425)..(425): n is a, c, g, or t
  misc_feature (436)..(436): n is a, c, g, or t
  misc_feature (1172)..(1172): n is a, c, g, or t
  misc_feature (1265)..(1265): n is a, c, g, or t
  misc_feature (1277)..(1277): n is a, c, g, or t
  misc_feature (1767)..(1767): n is a, c, g, or t
gattcttagttcttcagacgtctgattcagccatttcctgctgtatggcacccatnaanggcattctttcnctgcaaagggntgctttgctcaggcntcaaaatggnaactggnggctcantgctanactgttaagcactcagtcggcaaccaccggtaccancgcacagccnccaccacnacnacctcctcnagaganaacccactttgncggnttaaaagatgaagaccgaatttttaccaaccttnanggtntgcnngatccctttctcaaaggcgccatganacgtggngattggcatagaactaaagatatagtganaaagggtgctgatnggatagtanacgaaatgaaaaaatccggnctccgngnacgnggtgnggccnnatttccgnccggtctcaaatggtcgttcatgcctaangtttccgatgnccgtccatcgtatcttgttgttaatgccgatgaaagtgaacccggaacctgcaaagatcgggaaattatgcgtaacgatccacataaactgttggaaggatgtctgattgctggagtcggtatgcgggcaaccgctgcttatatctacattcgaggtgaatatgttaacgaacggcttaatctcgaaaaggcccggaaggaagcttacgctgccggattactcgggaaaaacgcgtgtggctcgggatacgatttcgacgtccatatccactatggtgccggtgcttacatttgcggtgaagaaaccgcccttttggagagtctcgagggtaaacagggaaaaccgagattgaagccgccttttcccgctaacgccggtctttacggctgcccaacgaccgtcacaaacgtcgaaaccatagctgtttcgccgaccattttaagacgcgggcccgaatggttttcgagcttcgggagaaagaacaattccgggacgaagctgttttgcatctcaggccacgtgaataagccatgcacggttgaagaggagatgagtatatccttgaaggagctgctggagcggcactgtggtggtgttaggggcggatgggacaacttgctggcggtgattcccggcggttcatctgtgccactgcttccgaaagacgtgtgtgaggacgtgctgatggatttcgatgctttgaaagcggttcagtcgggattagggacggctgcngttatcgtgatggataagtcgaccgatgtggtggatgcgatcgcgaggctgtcttatttctataagcacgagagttgtgggcagtgtacgccntgcagggagggnacggggtggctttggatgatcatggaaaggatgaaggtcgggaatgcaaagctggaggagatcgatatgttgcaagaggtaacgaagcagatcgaagggcacacgatttgcgcgttgggtgatgcggctgcgtggccggttcaggggcttatcaggcatttcaggccggagatggagaggaggatcagggagcgggctgatcgggagttgcttcaggcggctgcttgaatcaggtgtaatctggaataaatatgcagaaatactctggacatctggaggaaaatgattctgagcatcatggttaaaattttaaagtctgtattgaaccaggatgcgactgaaaattactattcagcctttcttcttgatggttcagaggtgggtaagtttttactgttttggtgtgattaagacatcttattgttattatggaacaacttcactgaaccaccatgtgttttggaaataagatgaacccaaatgttgtaangatacaacctcaaaagctctaattttattcttcttataagcaaaaaaaaaaaaaaaaggcggcgtctcggccctctagactctagactcgagagatcatatgtgtgcgcgcgcaactcccacactgtggagtgcgtctctttatacgggctctactcacatatacactcgggtacaccgatctc

SEQ ID NO: 3943 - DNA, 1567 bp, Scabiosa columbaria
ggccccaccgcctccaccaccgcctgagaaaacccactttggtggcctaaaagatgaagatcgcatatttaccaatgtatatgggatacacgatccctttcttaagggtgcaatgaaacgaggtgattggtatagaacaaaagacttggtaatcaagggcactgattggattgtgaacgagatgaagaaatctggcctccgtggacgcggtggtgctggttttccatctggactcaaatggtcttttatgccaaaggtatctgacggacgcccttcgtatcttgttgtcaatgctgatgaaagtgaacctggaacatgcaaggatagagagattatgcgtcacgatcctcataaattattagagggctgccttatagctggagttggaatgagagctagcgctgcttacatatatatccgtggtgagtacgtgaatgaacgattgaatcttgagaaggctagaaaagaagcttatgctgcaggtttcttggggaaaaacgcgtgtggttcaggttatgattttgatgtacatatccactttggtgctggtgcatacatttgtggagaggagactgcacttcttgagagcctggagggtaaacaaggaaaacctaggttgaagcctccttttccagctaatgcagggctatacgggtgccctacaaccgtcactaacgttgaaacagtcgctgtttcaccaaccattttaaggcggggtccagagtggttttcaagctttggaaggaagaacaactctgggacgaagctattttgtgtatcaggccacgtgaataagccatgtactgtcgaagaggagatgagtattcctttaaaggagctgattgagcggcactgtggtggtgtcagaggtggatgggataatctactggctgtaatacctggcggatcctctgtgccgttgattcccaagccattatgtgaggatgtgttgatggactttgacgcgctaaaggctgtacagtcaggattagggactgcagctgttattgtgatggataagtcaactgatgtggtggatgcgatcgccaggctgtcgtacttttacaagcacgagagttgtggtcagtgtacgccgtgtagggaaggaacagggtggctgtggatgattatggagagaatgaaggttggtaacgcaaagttagaggaaattgatatgcttcaagaggtcactaaacagattgaagggcacaccatttgtgctttgggtgatgctgctgcttggcctgttcaaggtcttattaggcattttagacccgagcttgagaggaggattagagagcatgctgacagagagttacaacaagctgctgctgcttgaatctttgtatcagtgaaaaagtctggtgggaataagagtctatgaagtactccacagaaatggagaggctacatgttaccattccttcttatttttaaatgtgtgtattgtatcatcaactttgaattgatttaaagaaaccttcttgatgtgcctaagccgtatggtttagggtttagttttctgagaactagggagaacatacgttggttggtttgccttattttg

SEQ ID NO: 3944 - DNA, 1490 bp, Flaveria ramosissima
acagccaccactcccctcctcctgagaaactcactttggtggtttgaaagatgaagatcgcatttttacaacctttatggtatacatgaccgttcttaaaggtgccatgaaacgtggtgattggtacagaactaaagatctagttattaagggctctgattggatagtcaatgaaatgaaaaaatcgggtctacgtggacgtggtggtgctggatttccatctggactcaaatggtcatttatgcctaaggtatctgatggtcgtccatcctatcttgttgttaatgctgatgaaagtgaacccggaacatgcaaggatcgtgaaattatgcgaaatgatccacataaacttctagaaggatgcttgattgctggagttggtatgagggcaactgctgcttatatttacattagaggtgaatacgtgaacgaacgccttaaccttgagaaggccagaaaagaagcctatgcagctgggttacttggaaaaaatgcttgtggatcgggttatgattttgatgtgcatatccactttggtgctggtgcttacatttgtggtgaagaaactgcacttttggagagccttgaaggtaaacaaggaaaaccaagattgaaaccccctttccctgctaatgcaggtctatacggatgtcccacaactgttacaaatgtagaaacagttgctgtatcacctacgatcttaagacgagggcctgaatggttctctagttttgggagaaagaataattccgggacaaaacttttttgcatatctggtcatgtcaacaaaccgtgcacagtcgaagaggagatgagtataccattgaaggagctgctagagcggcattgtggcggtgttaggggtggatgggacaatttactggcagtaattcccggaggttcatctgtaccgttgcttcctaaacacatatgtgaggatgtcctgatggattttgatgcattgaaagctgtgcaatctggattagggactgcagctgtaattgtgatggataagtcaactgatgttgtggatgcaattgcaaggctttcttacttttataagcatgagagttgtggtcagtgtacaccttgcagggagggtaccggatggctttggatgattatggaaaggatgaaagttgggaatgcaaagctggaggaaattgatatgcttcaggaggtgactaagcagattgaaggacacacaatttgtgcattaggagatgctgctgcttggcctgttcaaggtcttattaggcattttaggcctgaactcgagaggaggatcagggaacgtgcggatagagagttgcttcaggcagctgcttgattcaggctgaagaatttgcagtcctgcaatctatggaataaatatgcagaagtagtccttgaggaaactagaaaccaatgaacccttacaatcttcatggtttaagtttaaggtttgtattgaattacgatacaattgaaaatagtagtcctcttcttat

SEQ ID NO: 3945 - DNA, 1381 bp, Flaveria ramosissima
gtatggcacccatgaagggcattctttctctgcaacgggctgctttgttaaggcgtcaaaatgttaattggggttaggtactagattatttagcactcaatctgcaacaaccgctaatactgcacaaccaccaccacctccccctcctcctgagaaaactcactttggtggcttgaaagatgaagatcgcatttttaccaacctttatggtatacatgacccgtttcttaaaggtgccatgaaacgtggtgattggtacagaactaaagatctagttatcaagggctctgattggatagtcaatgaaatgaaaaaatcgggtctacgtggacgtggtggtgctggatttccatctggactcaaatggtcatttatgcctaaggtatctgatggtcgtccatcctatcttgttgttaatgctgatgaaagtgaacccggaacatgcaaggatcgtgaaattatgcgaaatgatccacataaacttctagaaggatgcttgattgctggagttggtatgagggcaactgctgcttatatttacattagaggtgaatacgtgaatgaacgccttaaccttgagaaggccagaaaagaagcctatgcagctgggttacttggaaaaaatgcttgtggatcgggttatgattttgatgtgcatatccactttggtgctggtgcttacatttgtggtgaagaaactgcacttctggagagccttgaaggtaaacaaggaaaaccaagattgaaaccccctttccctgctaatgcaggtctatacggatgtcccacaactgttacaaatgtagaaacaattgctgtatcacctacgatcttaagacgagggcctgaatggttctctagttttgggagaaagaataattccgggacaaaacttttttgcatatctggtcatgtcaacaaaccgtgcacagtcgaagaggagatgagtataccattgaaggagctgctagagcggcattgtggcggtgttaggggtggatgggacatttactggcagtaattcccggggttcatctgtaccgttgcttcctaaacacatatgtgaggatgtcctgatggattttgatgcattgaaagctgtgcaatctggattagggactgcagctgtaattgtgatggataagtcaactgatgttgtgatgcaattgcaaggctttcttacttttataagcatgagagttgtggtcagtgtacaccttgcggggagggtactggatggctttggatgattatggaaaggatgaaagttgggaatgcaaagcttgaggaattgatatgcttcaggaggtcactaagcagattgaaggacacacaatttgtgcattgggagatgctgctgcttggcctgttcaggtcttat

SEQ ID NO: 3946 - DNA, 2078 bp, Ceratodon purpureus
tggattttatagatttgagaaatggaaatgtgcgccttccgtagaggtagacgcaatttggatttgtgacggtaatgagtcttcgtcaccgaactggttgcgacgctcttattgttgctgaaggaggtttgtgatttttgttttacggaggaattgacatcgccatagcaagggcaggagcaatggcagcagcggcgaggggactgagccggaaggcggtggcgtcgctgcagagggcgacgccgggatggagccgggcgatgagcgagaaggcgacgtcggggccgcaggcgaccgcgccaccggcgccgccgccaccaccgccacaggagaagacggtgttcgggggtttgaaggacgaggacaggatcttcacgaacttgtatggattgcacgatccctacctggcgagggccaggaagcggggcgactggcacaggaccaaggatttggtgactaagggcacggattggattgtgaatgagatgaagaagtccgggctgcggggccgggcgggcggggttcccgtccgggttgaagtggtcgttcatgccgaaggtgtccgacgggaggccgtcgtatctggtggtgaatgccgatgagagtgagcccgggacgtgcaaggacagggagattatgcgccacgacccgcacaagttgctggagggttgtttgattgcgggagtggggatgcgtgctcgcgcggcgtatatttacatccgtggggagtatgtcaacgagcggttgaatttggagagggcgcttaaggaatgctacaaggaaggtttgctcggaaagaatgcgtgtggctctgggtacgattttgacgtgtacatccattacggagctggtgcatatatctgcggagaagagactgcgcttctggagagtcttgagggaaagcagggaaagccacgactgaaaccaccgtttcctgcgaacgctggtctttacggctgcccaactaccgtgaccaacgttgagaccgtagctgtatctccgacaattctacgaaggggacctgaatggtttgcgagctttgggaggaaaaacaactcggggacaaagctgttttgtgtttcggggcatgtgaacaagccatgcacagttgaagaggagatgagtatcccattgaaggagctcattgagcgacattgtggtggagtgagaggaggatgggacaatcttttggctattatcccaggaggatcgtctgtgcctcttctcccgaagaatgtctgtgatgatgtgctgatggattttgatgccttgaaggcagtccagtcaggtcttggcactgctgctgtgattgtgatggacaagtctacagatgtcgtggatgctattgcacggctatcctacttttacaagcatgaaagttgtggacagtgcacaccatgtcgagagggctctccctggttgtggaccatgatggagagattgaaggttggaaacgcaaagctggaagaaatcgacatgttgcaggaaattacaaagcagatcgagggccatactatctgtgcgttgggagacgctgctgcatggcctgtgcaaggtttaattcgacatttcagacctgaacttgaacgccggataatggagcgagcagcaaaggagaatgaaggtttgagagtagctaattattaatgggttcaaattaggctatctgatttttgaggagcataagtggcctagaggaggcagtcatgttcctcgagcaagtgctgatcaaccctgggtggagttcatgtggcaacgaactcccatcatactcatgaataattctgctttctacagaagtctttcatactgactattggccatccatttatagcaatgtattaccgaagccatttccaatcagaattttagacatgataatgtttccagcctaatgttgtcaatcgtcctccaagttttgcttgcgtgataatttgacgaggtctttctcggtctagaattctgcaagctgtagtagtaggcatagatgttagttagcaccacgggacaagacaaaaaaaattcacttcgtaaccaagtattgtctctggtatgtgctgatggtattttggaattga

SEQ ID NO: 3947 - DNA, 1846 bp, Physcomitrella patens
gacgcagaacgaaccctacctagctgtgggttttccctcgtagcgcttggggttgcagagtgttgttgggttttttgagtagtgttgctgcgttggagcaatggctgcgacgcgggggttgagccgtaagacattggcaggattgcagagatggaacaacgcgactccggtatggagccgaacgatgagcgcgcaggcaacatctggaccgcaggcgactgctccacctccgccccctcctcctccgcctgccgagaaaacgcagtttggaggtttgaaggacgaggacaggatcttcacgaacttgtatgggattcacgatcctttcctagcaggcgcgaagaagcggggggattggcataggaccaaggatttggtgctcaaggggacggattggattgtgaacgagatgaagaagtcgggtctgcgagggcgaggcggcgccggtttcccttctgggttgaagtggtctttcatgcccaaggtgtccgatggtcgtccgtcgtatttagtggtcaatgcggatgagagcgagcctggaacatgcaaggacagggagatcatgaggcacgacccgcacaaactgctcgagggttgcttgattgctggagtaggaatgcgcgctcgtgctgcgtatatctacattcgaggagagtatgtcaacgagcggttgaatttgcagaaggccctgcacgaatgttacaaggaaggtctgcttgggaagaacgcatgcggttcaggatatgactttgatgtctatattcattacggagccggtgcgtatatttgcggagaagagactgctcttctagagagtcttgagggaaagcagggcaagccacgattaaaaccaccatttcctgcaaatgctggactctacggctgccccactactgtgactaatgttgagactgtagctgtgtctcctacaattctacgaaggggacctgaatggttttcgagttttgggcggaagaataactcagggacaaagctattctgtgtctctggacacgtgaacaagccatgcacagtcgaagaggaaatgagcataccattgaaggagctcattgaacgacactgtggtggagtgagaggaggatgggacaaccttttggctattattccaggaggatcttctgtgcctctacttcccaagaacatttgtgatgatgtcctcatggattttgatgcattgaaggctgttcaatcaggtctcggcactgctgctgtgattgtgatggacaagtctacagatgttgttgatgctattgctcgcttatcgtacttctacaaacacgagagttgcggccaatgtacaccttgccgagagggttctccttggttgtggactatgatggaaagattgaaggttggaaacgcaaagttggaagaaatcgacatgttgcaggaagttacaaagcagattgagggccacactatctgtgcattgggggatgctgctgcatggcctgtgcaaggtttgatcagacattttagaccagaacttgaacgccggatattggaacgagcagccaaggagaacgatgagttgagagtagctaattgttaggggatagaactagtcggattttgagaaacgcaagatgtcttagggaaggcagacttggtcgtcgagcaattgaattatctcgattgaagttcatgtgacgaggaactctcgacacagtaccgaataattctgcttcccacagcagtattctgctgcagtggtcaatcattccagctattgttctgaccgtttgagtcagattctctggatgacaactgttttcaactccatctcctctattttcctttaatttagcattcatgttactgaatc

SEQ ID NO: 3948 - DNA, 1916 bp, Physcomitrella patens
acgagagtgcggcacgcgttcgcaacacacgccgtggctaccttcatcgacgtagcccaatcgggcggcacgtattccgaaattaatcggcagagagagtaattcctaccggtctctgggaccgacgagcccttcgtcgcagtgttttcgttgttggattttgttgggtgtagggaattattaagttgtggcgatggcgggggcgcgcggaatgcttcgcaaggccgttgtgagtgtgcggggatcgaacaacgcgattccggcatggagccaagctatgagcgagaaggcgacctcggggtctcaagcgacagctccaccaccgcctcctccaccaccgcctgccgagaaaacacacttcggggggttgaaggatgaggaccggatcttcacgaatttgtatgggttgcacgatccgttcctggcaggtgcgaagaagcgcggggattggtacaggaccaaggatttggtgcacaaggggacggactggatcgtgaacgaggttaaaaagtcgggtctgcgagggcggggcggtgcgggttttccttcggggttgaagtggtccttcatgcccaaggtttccgatggtcgtccttcatatttggtggtcaatgcggacgagagtgagcctggtacttgtaaggacagggaaatcatgaggcacgatccgcacaaacttcttgagggttgcttgattgcgggagtggggatgcgtgctcgtgctgcttatatttatatccgaggagagtatgtcaacgagaggctgaatttgcagaaggccttgcatgaatgttacaaggaaggtcttctcgggaagaacgcttgtagtacagggtacgactttgatgtctacattcattatggagccggtgcatatatttgtggagaagagactgcgcttctagagagtcttgagggaaagcaagggaaaccgcgactgaaacctccctttcctgcaaatgctggtctatatggctgtcccaccactgttaccaacgtggaaactgtagctgtgtctccaaccattctacggaggggacccgaatggttttcgagttttggacggaagaacaactcagggacaaagttgttttgtgtctcggggcacgtgaataagccatgcactgtggaagaggaaatgagcattccattgaaggagctaattgagcgacattgtggaggagtgcgaggaggatgggataaccttttggccatcattccaggaggatcttctgtgcctcttcttcccaagcatatctgtgatgacgtgcttatggattttgatgctttgaaggctgttacatcaggtcttggcactgctgctgtgattgtgatggacaagtctactgatgttgtggatgcaattgctcgcttatcgtacttctacaagcacgaaagttgcgggcagtgcacaccttgccgagagggttctccttggctgtggacaatgatggagagactgaaggtcgggaacgccaagttggaagagatcgacatgttgcaggaagttaccaagcagattgagggccacactatctgcgctttaggggatgccgcagcatggcccgtccagggtttgatcagacactttagaccagagcttgaacgccggatattggaacgagcagcaagggagaacgacgagttgagggcagctaactgttgaaggatgggaatcacagatctaatgatttcatggaactgggtagatcaaaagaggcagacatggtctttgagaagttgatttacgtcgaatgaagtttgtctggaggaaccctcatcacactgatgaataaatctgcttcctcccggagccttcagtagtgaccaaccattccaagttaataacactggcagttcacccccgatttctcgggattttttctttctaataacttaagtcgataatttctccc

SEQ ID NO: 3949 - DNA, 1479 bp, Cenchrus ciliaris
  misc_feature (1139)..(1139): n is a, c, g, or t
  misc_feature (1345)..(1345): n is a, c, g, or t
  misc_feature (1353)..(1353): n is a, c, g, or t
  misc_feature (1413)..(1413): n is a, c, g, or t
tgcatgacccttttcttaaaggtgcaatgaagaggggtgattggcataggaccaaggatttggtgcttaagggagctgactggatagttaatgaaatgaagaagtcaggcctccggggacgtggaggtgcaggtttcccctcaggtcttaaatggtcctttatgcccaaagtttcagatggccgtccttcttatcttgttgttaatgctgatgagagtgagcctggaacttgcaaagatagagaaatcatgcgtcatgatccccacaagcttctggaaggatgccttattgctggagttggaatgagggcgtcagctgcttacatctacattagaggtgaatacgtgaacgagcgtctcaaccttgagaaagcccggcaggaagcatatgcagctggacttcttggtaagaatgcttgtgggtctggttatgattttgatgtgcatattcattttggtgctggtgcatacatctgtggtgaagagactgccctactggagagccttgaagggaagcagggcaagcctaggctgaagccacctttcccagccaatgctgggctttatggctgccccacaactgtgacaaatgttgaaactgtggctgtgtccccaacaattcttagacgtggtcctgaatggtttgcaagctttgggcgcaagaacaactctggaaccaaactcttctgtatctcagggcatgtgaacaaaccttgcactgtggaggaggaaatgagcatacctctgaaggagttgctcgagaggcactgtggaggtgttaggggaggatgggacaacctgcttgctgttattcctggtggttcgtctgtcccacttttaccaaaacacatatgcgatgatgtgatgatggactatgatgcactgaaggctgtgcagtctggattgggtactgcagcagttatcgtgatggacaaatctacagatgttgttgacgcaattgctaggctgtcgtacttttacaagcatgagagttgtgggcagtgcacaccttgccgggaaggcacaccctggctatggatgatcatggagaggctcaaggttggtaatgcaaagttggaggaaattgatatgcttcaggaggtcacaaagcaaattgaagggcatactatctgtgccctnggggatgctgcggcatggcctgtgcaggggcttatcaggcacttcaggccagagctggaaaggaggatccgtgagcgagctgaaagggagttgctggcggcttctgcatgatacacaagccttgtcgctcctgtactagtttcctgatttcttctacttaaataatgcaaactgaaggagctggtttctatgtaaggaaatgcagntttttgantcctttaaaccttcacatggatgtttatttgatgcacttgagcagctggtgaattttganggactagataagcttttcaaagtagaaacaaactttgatcaatgtaccatgtatgctacatgatca

SEQ ID NO: 3950 - DNA, 1730 bp, Distylium racemosum
ctaccccacaatcacctccccctcaccacctcctgagaaaacccattttggaggacttaaagatgaggatcgcatctttacaaatctatatggattgtatgatccccttctgaaaggagctatgaaacgaggggattggtacaggactaaggatctggtagtaaaaggttctgattggattgtgaatgaaatgaaaaaatcaggtctgcgtgggcggggaggtgcaggatttccttccggtctgaaatggtccttcatgccaaaagtttctgatgggcgtccctcttatcttgttgtaaatgctgatgagagtgaaccaggtacctgcaaagacagagagataatgagacacgatcctcataagcttcttgagggttgcctgattgcaggtgttggcatgcgtgctcgtgctgcatacatttacataagaggggaatatgtgaatgagaggaaagtcctgcagaatgcactcaaggaggcatatgcagctgggtttttaggcaaaaatgcctgtggttcaggctataattttgatgttcatattcactatggagctggtgcttacatttgtggagaagaaacagcacttcttgagagcttggagggtaaacaaggaaaacctcggttgaagcctccttttcctgctaatgcaggtttgtatggctgtccaacaactgttactaatgttgagactgttgctgtttctcccaccatactccgcaggggtcctgagtggtttgctagctttggtcgcaagaacaatgtgggaacaaagcttttctgcatttcaggacatgttaacaaaccttgtactgtggaagaggagatgagcatccctctgaaggaactgattgagagacacgcagggggtgtaagaggtggttgggacaatctactggcaattattcctggaggttcttctgttcctcttcttcccaggcatatttgtgatgatgtcttgatggattttgatgcactgaaagctgtgcagtcaggacttggaacagctgctgttactgttatggataaatcaactgatatagtgaatgcaatagctcgtctttcctacttttataaacatgagagttgtggtcagtgtaccccgtgtagggagggaacgccatggctttggatgatcatggagagaatgaaggttggaaatgctaaacttgaagagatagatatgcttcaagaagtgacaaagcagattgaaggtcatacaatttgtgctttgggtgatgctgcagcctggcctgtgcaaggtctcattcgtcatttcaggcctgaactggagaggagaattcgtgagcgtgccacacaggaactcatggaagctgttgcatagacatgattttttttaaagctctatagtgagaatatgtttcttatgagacatgtgaggactgagagattccatcttgtttgccattaattttcgaagaggaacgcatactttaaagaattttaataaactggcagtacatgaatgttattattggaagctgagttcattagagatcttagctttaaactttaaataccagggatcctgctatttggatgggtaactgcagcaaatgctatgcaatataggatgttgctttgtattctagggcatctgcatagcggttaagattctttttgtgactcttagtagcttctttgttcttccttgcctctgtttcacttggatgtgccttgaagcagacataaaattctcatcaatttct

SEQ ID NO: 3951 - DNA, 1612 bp, Utricularia gibba
cccggtagaagactcattttggaggtctgaaagatgaggatcggattttcacaaatactgtatgggctgcatgacccgttttgaagggtgcaatgaaacgtggggattggtatcggacaaaggaccttgtgctgaagggcactgattggattgtcaatgagatgaagaaatctggtcttaggggccgagggggtgctggatttccttctggtctgaaatggtcttttatgccaaaaacatctgacggccgtccttcatacctcgttgttaatgctgatgaaagcgaaccaggaacatgcaaggatagagagattatgcgccatgatcctcataagttgctagaagggtgcttgatagctggtgtaggaatgagggcaactgctgcctatatttatattcgtggtgagtatgtcaatgaaagaaggaacttggagatcgccaggagagaagcttacgaggctggattactgggaaagaatgcatgtggatcggggtatgattttgatgtccatatccactttggtgctggagcttacatatgtggtgaagagacagctcttctggaaagccttgagggcaagcaaggaaaaccgaggctgaagcctccatttccagccaatgcagggctgtatggctgcccaaccacagttacaaatgtcgaaacagtagctgtttcacccacgattctaaggcgtggaccagaatggtttgcaagttttggaaggaagaataactctggaacaaaactgttttgtatctctggccatgtaaacaagccatgcactgttgaagaggagatgagcataccgtttaaggagctaatagagagacactgcggtggtgttcgtgggggatgggataacttacttgctgttatacctggtggttcatcagttccgttgataaccaaggacatatgtgaggatgtgctcatggactatgatgcccttaaggctgtccaatcaggattaggaacagctgctgttatcgtgatggacaagtccactgatatcgtggatgcaattgctagactttcttacttttacaaacatgagagctgtgggcagtgtacgccttgtagggaaggcacaggatggctttggatgatcatggaaagaatgaaagttggaaatgctaaactggaggaaattgatatgcttcaggaggtgacaaaacagatcgaaggtcacactatctgtgcattgggcgatgctgctgcttggcctgttcagggcctcatccggcactttcgacctgagctcgaacgaaggatcagagagcatgctgaccgagagttacagcaggctgctgccgcctaatccttccctcagggaaatcatcaccaccatgaataaactctacaggcattgctgattacacccttttaggcataatcatgcttgtttgtaatggttgtgaccataacgccatgacttctatcatctgtaaaagggcgtactgattccatcaacttgtgcattatcatggacttcagcaaccttgattggaaccccctgttgtagttgttgctcccactccccatctttctgctgttattgcaggtgctctgcatatgcagaaacacttcgtttcattgagcttatcagtatgt

SEQ ID NO: 3952 - DNA, 1400 bp, Vinca minor
tttcatgctcttatggcacccataaagggtatcctttctttacagcggactgcttttgttaggcgtcaggagggttgccgccttggcagtagattattaggtactcaggccacattaactactagtactccacaggcccaacagcctcctccacctcccccacctcctgagaaaacccattttggtggcctcaaagatgaggaccgtattttcacaaacgtttatggtttaaatgaccctttcctcaaaggtgccatgaaacgaggggactggtatagaacaaaagacttagtactcaagggcactgattggattgtcaatgaaatgaagaagtccggccttcgtgggcgaggtggtgcaggctttccgtctggtcttaaatggtccttcatgccaaagcaatctgatggccgcccttcctatctagttgtcaatgctgatgaaagtgaacctggaacttgtaaagatagagagatcatgcgtcatgatcctcacaagttattggaaggttgtctgatagctggtgttggtatgagggcaagcgctgcatatatctacatcaggggtgaatatgtcaatgagaggaagaatctggagatggcaaggaaagaagcttacgaagctggtcttctggggaaaaatgcatgtggttctggttacgacttcgatgtacatatccactttggtgctggagcctacatttgtggtgaagagactgctctccttgagagccttgaggggaaacagggtaaacccaggttgaagcctccttttcctgctaatgcaggtctatatggttgtccgactaccgtcacaaacgtggaaaccgtagccgtttcacccaccatcttaaggcgtgggccagagtggtttgctagttttggtaggaagaataattctggtacaaagctattttgcatctcgggacacgtcaacaagccttgcacagttgaggaggagatgagtataccattgaaggagctaatagagaggcattgtggaggtgttcggggtggctgggataatttacttgctgttattcccggcggttcatctgttccactgattcccaagaacatgtgtgaggatgtgcttatggactttgatgcactcaaggctgtgcagtcgggtctggggactgctgctgtaattgtgatggataaatcaactgatgttgtagatgcaattgcaaggctctcttatttctataaacacgagagttgtggtcagtgcacaccttgcagggaagtacaggatggctttggatgatcatggaaagaatgaaggtcggaaatgccaaactggaggagattgacatgcttcaagaagtgaacaaagcagattgaagggcacacaatatgtgcactcggggatgcagctgcttggccaggtccgagggt

SEQ ID NO: 3953 - DNA, 1689 bp, Lippia dulcis
accagagaagacccactttggaggtctaaaagatgaggatcgtattttcactaatgtatacggccttcacgatccctttctcaaaggtgccatgaaacgtggagactggtacaggacaaaagacttagtactgaaaggaactgattggattgtcaacgagatgaagaaatctggtctcagaggtcgtggtggggccggtttcccatcagggatgaaatggtcattcatgccaaaagcatcggacggccgtccttcatacctggttgtcaatgctgatgaaagtgagccaggaacttgcaaagatagagaaatcatgcgccatgaccctcataaacttctagaaggttgtctaatagccggagtgggaatgcgtgctagagccgcttacatatatatccgaggcgagtatgtgaacgagagaaagaatctagaaatagccaggaaagaagcttacaaatccggattattggggaagaacgcatgtggctcaggttatgattttgatgtgcacatccattttggtgctggggcttacatatgtggtgaagaaacagcccttctggaaagcctagaaggcaaacaaggaaaacctagattgaagcctccttttccagccaatgctggactctacggttgcccaacaactgtcacaaatgtcgaaacagttgctgtttctccaaccatactaagacgagggcctgaatggttctcaagttttggaaggaaaaacaacgctggaacaaaactcttctgtatttcaggccacgtgaacaaaccctgcacggttgaggaagagatgagtattcctttgaaggaacttatcgaaagacactgtggcggggtccgcggtgggtgggataacttactagctgttattccgggtggttcttcagtcccattaatccctaagaacatatgtgaagatgtgttgatggattttgatgcactcaaggctgttcagtctggtttggggactgctgctgttattgttatggataagtcaactgatattgtggatgcaattgcgaggctgtcttatttttacaagcatgagagctgtgggcagtgcactccgtgcagggaagggacgggatggttgtggatgattatggagaggatgaaagtgggaaatgcaaagcttgaggagattgatatgcttcaggaggtgacaaagcagattgagggacacacgatttgtgctttgggtgatgctgctgcttggcctgttcaggggcttattaggcattttaggccggagcttgagaggaggatcagggagcatgcagatagggagttgcagcaggctgctgctgcgtgattcttctatagaggaaatgcatttgctgttacaagctgctaaataaacgtggatatattggagagacatttcagaatgcaatccatcgctccagcagcacgttcaaattttaatggttgtattgcatatgcttattgactacatcaagattctacattaatatgtggaatctgctgtctgttttttaggtactaaaccctgtaggatgagtttcatcctgtctgatttttttcatcgtgtaagaaccttttaaatcagttttattatctgtaattttgtcaataattaaacataagagacatgttgatgtcttaatactcgagtatttttgttggtaaatggttatatcctacagaccaaagcgttttgat

SEQ ID NO: 3954 - DNA, 2107 bp, Orobanche aegyptiaca
ctaaaagcaataatcatcaccggttgatcacagcacctgtgctcgttcaacatttgatgccctgatggcacctataaagggaattctttctgtacaaagggcttctttcgttcaacgctcgagtgagaattggggcatagcaaggaaactatttagcacgcaagctgcaaccacttctcccaccccacaggccccaccccctccgccacctcccgagaaaacgcactttggtggtctgaaagacgaggatcgcattttcaccaacctatatggcctacacgatccctttctcaagggcgccatgaaacgtggagattggtacaggacaaaagacttagtcctcaaaggaaccgattggattatcaacgagatgaaaaaatccggtctccgaggccgtggtggggctggttttccatcggggctgaaatggtcttttatgccaaaggcgtccgatggccgcccttcgtatctcgtcgttaatgccgatgaaagtgaacctggaacatgtaaagatagagaaattatgcgtcacgacccgcacaaattactagaaggctgtttaatagctggagtgggaatgagggctcaagcagcatatatctatattcggggagagtacgtgaacgaaagaaagaacctcgaaaaagcaaggagagaagcatacgaagccggattattgggaaaaaatgcgtgcgggtcgggttacgatttcgacgtccatatccattttggtgccggtgcttatatatgcggtgaggagaccgcacttctcgaaagcctcgagggtaaacaaggaaaaccgagactgaagcctccttttccagctaatgcaggcttatacggttgccccacaactgttacgaacgtcgaaactgtagccgtttcccctacgattctaagacgtgggcccgaatggttttctagcttcggaaggaaaaacaactccgggacgaaactgttttgtatttcgggccatgtcaacaagccctgcaccgtggaagaggagatgagtataccgctgaaagagctcatagagcgacactgcggaggggtccgcggcggatgggataatctactcgcggtcatacccggggggtcgtctgtgccgttgcttcctaagaacctatgtgaggatgtgctcatggattttgatgcgcttaaggctgtacagtcggggttgggtaccgcggctgtgatagtgatggataagtcgacggatgttgtcgatgctattgcacgtctctcgtatttctacaagcacgagagctgtgggcagtgcacgccttgtagggaaggtacgggttggctgtggatgattatggagaggatgaaagtggggaatgcgaagctggaggagattgatatgctgcaggaggtgacgaagcaaatcgaagggcacacgatttgtgcgttggggatgcggctgcttggccggtgcaggggcttattaggcattttaggccggaactcgagaggaggattagggagcgggcggacagagagttgcaacaggttgctgctgcttgatatgattcttctgaaaaaggaacttcatttgctgtttgaataaagtgtgagacacaatttctcagtgaattatatccatctttcccagcaacaagttcaactttcgaccgttgtatttcgtgtatgtttgcactaagatactactaaacattgatatgttttgagttccatctcttcatgtttaaaggattatatgagatggaaattcatctggtctggttttcttttttttaacaaaagaatcgtttaaagaaactttcaatcagtttgtttcgctgtagttttgtcaattaatctattggacaggccaaatgacttcgttcaggttggcatgaatctttgctttgcaagctgaccttaactggaaacttaattaactgctgggttgcttttaatgttgtctgcgagcacaagctgcttgtttaagcgagctcaagtaaggttcgttcatttaatattcgagtagaacttgcccgagaatttgtactcttctatgtcgatcgaacacgagttgttcgcggacataattgaacgttacaaacattaatttaacatgtaatcttttacatataattaatct

SEQ ID NO: 3955 - DNA, 1480 bp, Flaveria ramosissima
ctaacctatatggtatacatgacccgtttcttaaagatgccatgaaacgtggtgattggtacagaactaaagatctagtgatcaagggctctgattggatagtaaatgaaatgaaaaaatctggtttacgtggacgtggtggtgctggatttccatctggtctcaaatggtcatttatgcctaaggtgtctgatggtcgtccatcctatcttgtggttaatgctgatgaaagtgaaccaggaacatgtaaggatcgtgaaatcatgcgaaacgatccacataaacttcttgaaggatgcttgattgctggagttggtatgagagcaactgcagcttatatttacattagaggtgaatatgtgaacgaacgccttaaccttgaaaaggccagaaaagaagcctatgcagctgggttacttggaaaaaatgcttgtggttcgggttatgattttgatgtgcatatccactttggtgctggtgcttacatttgtggtgaagaaacagcacttttggagagccttgaaggtaagcaaggaaaaccaagattgaaaccacctttccctgctaatgcaggtctatacggatgtcccacaactgttacaaatgtggaaacagttgctgtatcgcctaccattttaagacgagggcctgaatggttttctagttttgggagaaagaacaactcggggacgaaacttttttgcatatctggtcatgtgaacaaaccatgcactgtcgaagaggagatgagtataccattgaaggagctgctagagcggcattgtggcggtgttaggggcggatgggacaatttactggcagtaattcctgggggttcatctgtaccattgcttcctaaacacatatgtgaggatgtactgatggattttgatgcattgaaggctgtgcaatctggattagggactgcagctgttattgtgatggataagtcaactgatgttgtggatgccattgcaaggctttcttacttttataagcatgagagttgtggtcagtgtacaccttgcagggagggtactggatggctttggatgattatggaaaggatgaaagttgggaatgcaaagcttgaggaaattgatatgcttcaagaggtcactaagcagattgaaggacacacaatttgtgcattgggagatgctgctgcttggcctgttcaaggtcttatcaggcattttaggcccgaacttgagaggcggatcagggagcgtgctgatagagagttgcttcaggcagctgcttgattcaggttgaagagcttgcagccctgcaatctgcagaataaatatgcacaagtcatcctaaaggaatctggaaatcaatgaacccccttgtgagcatcttggtttaagtttaaggtttgtattgaattaccatacaattgaaaatagcactattttaataactggggtaacttttgttgtgcgttgtgtttaaggatgcaattgcgtcctgtttt

SEQ ID NO: 3956 - DNA, 2317 bp, Sorghum bicolor
cggaagttttggtttccccttccccgttgccgcccgcggcccgcgctctccagtctccccagtcgcccgtcgctcgcgccgccgctcccctccccagccgcgacgacggttgcgtcgccgccgtcctccccagctgcgagcgctgccaccgccctccccagtcccaccgctgccctccccaggcgtgagacggagattcaacacccgcgaccgcgacgccgtggctctggcaggctggcttcgtactagcggctcgcctcgcctcgctctgcgccgtcaccgcgcactatcctccgctctctgtgcgccgtgctgctgtgccccgtcttctgctccgggacccggtcgcccgccgtgccccgctccccgctctgcccggctcgacgttctagggattcagccgcttctcacctctggaaaggcagagtagcggacatccctttgcagactgtagcacctcctcgtctcgtcttattcagtggactaccctgggtcaaaatcctggttctgtctctggtgtgagcagcgcctcccttttcttggtaccttcatcagcgacgaccatcctcctggagtcaattttgaagtaacaaagatttggaacccagctctctgttctccaccagcgcttcgaagatgccgcaggtaatggtggtggcacggaacttcatggatatggtggctgctcttcctgcgggcaagcttgatatgctctatgactcagcctttatctgtgaggcagtactcaggtcacttcccccactggcaaagaagtatgcactgcagatgttgtatgtgttggcaccggtgaccgctgcagcaatggaagagtgggtgctcaatgaatatgctgccaagcacaaggttgccattgataagcttctccaactcagggtctttgtcgaagtgcgcgacaggcgacgggacgtgagctacaagatgaatcagaagttccagggaaacatgcagaagtatttggttgatggtggaagtttaccaagggaacctttaccattaagtgtcactggtcgattgcccactccagcagatctggaagcctatgctcttgatcaatgggagtgcttcttgttgcaattgatcaattcatcccaagtcgaaaaagggacaagttttagctcctccatgatgaagacatttcagcgtggtcttctgagttcaagggacggtgaagcttcaaagttgactgagaatggcttccaatttcttctgatggaaacgaatgcacaactttggtacataatgagagaatacatttcatctgcagaggaacgtggagtggaccctacggaactgatatcatttctcttggaacttagctttcataaattgggagcggcttatagcttgaatactctgactgatgtccaaaggattgccatcagggatcttgcagaattgggactagtcaaacagcagcagggtcgaacagatcgctggttcattcctacccaactggctactaatctctcagcaagtttgtcagattcatcatctaacaaagagggatttgtggttgtggagacaaactttcgaatgtatgcatactctacttccaaactgcactgtgaaattctacgccttttttcaagggtggagtatcaacttccaaacctcatcgtaggagctgttacaaaagaaagtatctatggtgcttttgagaatggaataactgctgagcagataatttcatttcttagacaaaatgctcaccctcgtgttgctgacaagatacccactgtcccggagaatgtcacagatcagattaggctgtgggaaactgaccgcaacagggttgagatgattccatcacatctgtacgaagattttcctagcaaggaatggtttgaacaatgctgtgattatgcaagggataatgggtacttgctctgggaggactctaagagaatgagactgattgtacgaggggagttccaccctgaaatgagggagttcctccgcaggcaaagatgaaaaaagaccttgtaatattttttttttgtttagctacccacataatgtgttgacatatcatctgacatctttactacagctgctaaaatgtatatgatgcagaaaattcacaattatctttaaagtgacggtagtgtcagtttggtaacaaatttcaagaggggataaggaagatttcaagtttgggtgctaaattaggaacagctaattttcttggtgtcaaataagtaattttctttatatgctatgagccgagtaaagcatacacgggtcgttatatcatacatatccacaaaatgttggcacgaaaggccatacaattttc

SEQ ID NO: 3957 - DNA, 2217 bp, Sorghum bicolor
cgctgccaccgccctccccagtcccaccgctgccctccccaggcgtgagacggagattcaacacccgcgaccgcgacgccgtggctctggcaggctggcttcgtactagcggctcgcctcgcctcgctctgcgccgtcaccgcgcactatcctccgctctctgtgcgccgtgctgctgtgccccgtcttctgctccgggacccggtcgcccgccgtgccccgctccccgctctgcccggctcgacgttctagggattcagcctagcggacatccctttgcagactgtagcacctcctcgtctcgtcttattcagtggactaccctgggtcaaaatcctggttctgtctctggtgtgagcagcgcctcccttttcttggtaccttcatcagcgacgaccatcctcctggtacatccttccctacccgctgtgcaaagcatccccaccctaatttcttttgcaaaaaaagtttgcggttgtacaatgtgcacccatgccctggatctgccccctggctactgagactggtcaggtgtatgcaattttgaaggagtcaattttgaagtaacaaagatttggaacccagctctctgttctccaccagcgcttcgaagatgccgcaggtaatggtggtggcacggaacttcatggatatggtggctgctcttcctgcgggcaagcttgatatgctctatgactcagcctttatctgtgaggcagtactcaggtcacttcccccactggcaaagaagtatgcactgcagatgttgtatgtgttggcaccggtgaccgctgcagcaatggaagagtgggtgctcaatgaatatgctgccaagcacaaggttgccattgataagcttctccaactcagggtctttgtcgaagtgcgcgacaggcgacgggacgtgagctacaagatgaatcagaagttccagggaaacatgcagaagtatttggttgatggtggaagtttaccaagggaacctttaccattaagtgtcactggtcgattgcccactccagcagatctggaagcctatgctcttgatcaatgggagtgcttcttgttgcaattgatcaattcatcccaagtcgaaaaagggacaagttttagctcctccatgatgaagacatttcagcgtggtcttctgagttcaagggacggtgaagcttcaaagttgactgagaatggcttccaatttcttctgatggaaacgaatgcacaactttggtacataatgagagaatacatttcatctgcagaggaacgtggagtggaccctacggaactgatatcatttctcttggaacttagctttcataaattgggagcggcttatagcttgaatactctgactgatgtccaaaggattgccatcagggatcttgcagaattgggactagtcaaacagcagcagggtcgaacagatcgctggttcattcctacccaactggctactaatctctcagcaagtttgtcagattcatcatctaacaaagagggatttgtggttgtggagacaaactttcgaatgtatgcatactctacttccaaactgcactgtgaaattctacgccttttttcaagggtggagtatcaacttccaaacctcatcgtaggagctgttacaaaagaaagtatctatggtgcttttgagaatggaataactgctgagcagataatttcatttcttagacaaaatgctcaccctcgtgttgctgacaagatacccactgtcccggagaatgtcacagatcagattaggctgtgggaaactgaccgcaacagggttgagatgattccatcacatctgtacgaagattttcctagcaaggaatggtttgaacaatgctgtgattatgcaagggataatgggtacttgctctgggaggactctaagagaatgagactgattgtacgaggggagttccaccctgaaatgagggagttcctccgcaggcaaagatgaaaaaagaccttgtaatattttttttttgtttagctacccacataatgtgttgacatatcatctgacatctttactacagctgctaaaatgtatatgatgcagaaaattcacaattatctttaaagtgacggtagtgtcagtttggtaacaaatttcaagaggggataaggaagatttcaagtttgggtgctaaattaggaacagctaattttcttggtgtcaaataagtaattttctttatatgctat

SEQ ID NO: 3958 - DNA, 2171 bp, Setaria italica
cgccccctcacctctccgtcgctcgctgtcttgcccgcgcccaaatcctagccggcgcgcccacctgccgtcagatcgattcacgagggctacgccccgactgcaatcccgccgccgcagtccttgctgcggcccctgacgtcttcctcccccacgagctgcggtctgccgcctccgtccactggcgcgaggtccgggccgttgcctccgtccacagacgagcaccgcggaccccgctgccatccacctgtgtggtcccgagggtgcggagagggagctcccgaactcgtcggcgaccccgcagtcctcgagctcgcccgctgtccacccgcggccttgctcttccggtcctgccgcctccccacggttttttcaatcggtgcactgaagatgccgcaggttttggtggtggcgcggaacttcatggatatggtggctgcgctgcctgcctccaagcttgacatgctctatgactctgccttcatctgtgaggctgtactcaggtcactcccgccactagcgaagaagtatgcactgcagatgctgtacgtgttggcaccggtggccgctgcagctatggaagagtgggtgctcgatgaatatgcttccaagcacagggtcgccattgataagctgctccaactcagggtctttgtcgaagtgcgcgatagacgaaaggaggtgagttacaagatgaatcaaaagttccagggtaatatgcagaagtatttggttgacggtggaagtttaccaagggaaccgataccgttaagtgtcactggtagattgcctgcatcagcagacctggaagcctatgctcttgatcaatgggagtgcttcttgttgcaattgatcaattcatctcaagtcgaaaaaggaacaagtttcagctcctccatgatgaagacatttcagcgcggccttctgagttcaagggatggtgaagctccaaagttgactgagaatggcttccaatttcttcttatggaaacaaatgcacaactttggtacataatgagagaatacatttcctctgcagaggaacgtggagtggaccctacggagctgatatcatttctcttggaacttagttttcataaattgggagcggcttatagtttgaacactctgactgatgttgaacgaattgccatcagggatcttgccgagttgggattagtcaaactgcagcagggtcgaaaggatagctggttcattcctacccaattagctacaaatctctcagcaagcttgtcagattcatcgtccagcaaagagggctttgttgttttggagacaaactttagaatgtatgcatactctacctccaaattgcactgtgaaattctgcgccttttttcaagggtggagtatcaacttccaaacctcatcgtgggagctattacaaaagaaagtatttatggtgcttttgagaatggaataactgctgagcagataatttcatttcttaggcaaaatgctcaccctcgtgttgttgacaagatacctgttgttccggagaatgtcactgatcagattaggctgtgggaaactgaccgtaacagggttgagatgattccatcacatttgtatgaagattttcctagcaaggaatggtttgaacaatgctgtgatcacgcaagagatcatggatacttgctgtgggaggactctaagagaatgaggctgattgtacgaggggagttccatcctgaaatgagggagttcctccgcaggcaaagatgaaaaatgaccctgtttttcctcttggatggaacaagcaattcgtgtgcataaagctcctctatgcaaatgccccacacaagtctaccattaccaacatggcgatggttcatgtgccgtgccttgtctcgtacgcatgccacaaggcgtttctaatcgaagatgaaaaagaagatgcaatcgcatctgcagacggctgcatacattgtagacatttgagattggtttagattagtgaaaattccatttgtagtaatatgattaacgcggcacagacacagttagtgggtaaaacccaggagtgatctctgtttccttattttaaatctgtgatgatgagatccaggtttcaggttcaagtatcctcagctggtggctgttgctgtaaatcctcaaatgactttctaaaggattgatattggttgtca

SEQ ID NO: 3959 - DNA, 2041 bp, Panicum virgatum
cccctctcggctctagcctcgactctgcgcgcgcctgaaccctaggccgtagctagcgggctagcagctggggcgggcgcgcgcggtgccatcgacggctttgagggtggcagttggcggcctgtggctatctctactgtcagtctctcggcttctagaccggacgggcaggcggcagcacatctgcgtctcaaggccggtgcggtcaggcggaggctcctgcaggctcgttctggactgcgtgcaagcacaagagcagaagcacaagttgcatcaaagatgccgcaggtattggtggtggcgcggaacttcatggatatggtggctgcgctgcctgcctccaagcttgatatgctctatgactcggccttcatctgtgaggctgtactcaggtcacttccaccactggcaaagaaatatgcactgcagatgctgtacgtgttggcaccggtgaccgctgcagctatggaagagtgggtgctcaatgaatatgctgccaagcatagggttgccattgataagctgctccaacttagggtctttgttgaagtgcgcgatagacgaaaggaggttagctacaagatgaatcaaaagttccagggtaacatgcagaagtatttggttgatggtggaagtttaccaagggaaccgataccattaagtgttactggtagattgcctgcatcaacagatctggaagcctatgctcttgatcaatgggagtgcttcttgttgcaattgatcaattcatctcaagttgaaaaagggacaagtttcagctcctccatgatgaagacatttcagcgtggccttctgagttcaagggatggtgaagctccaaagttgactgagaatggcttccaatttcttctgatggaaacaaatgcacaactttggtacataatgagagaatacatttcctctgcagaggaacgtggagtggatcctacagagctgatatcatttctcttggaacttagttttcataaattgggagcggcttatagtttgaacactctgactgatgtccaaagaattgccatcagggatcttgcagagttgggattagtcaaactgcagcagggtcaaaaggatagctggttcattcccacccaattggcaacaaatctctcagcaagcttgtcagattcatcgtctagcaaagagggctttgtggttgtggagacaaactttagaatgtatgcatactctacttccaaattgcactgtgagattctgcgccttttctcaagggtggagtatcaacttccaaacctcatcgtgggagctattacaaaagaaagtatttatggtgcttttgagaatggaataactgctgaacagataattttatttctcaagcaaaatgctcaccctcgtgttgccgacaagatacctgctgtcccggagaatgtcacagatcagattaggctgtgggaaactgatcgcaacagggttgagatgattccatcacatttatatgaagattttcctagcaaggaatggtttgaacaatgctgtgatcatgcaagggatcatggatacttgctctgggaggactcgaggaggatgaggctaattgtgcgaggggagttccaccctgaaatgagggagttcctccgcaggcaaagatgaaaagggaccatgcgtttgttctggtacactcctttatgattgaagggaagggccattttggatagaacaaacaatctgtgtgcataaagctcctctacgcaaatgccttccatttatactagtctgccagcaattgttccatttgttccagcaattgcgtcaacagatggtgcatacactgtaggcatataagcttagtttagattactgaaagttccatttgtagtgatgtgatcaacgcgacattgtgagtgggttgtggtgatacccaggggctgtctctattttttttcttctttggtgtctctgatgatccagggtgagtatcctcagctggtggctgctgctgtaaaatctcaaatgactctgaacgataaatattcattttttcggttttcatttctgt

SEQ ID NO: 3960 - DNA, 3160 bp, Oryza sativa
ctctttctctccccttcttccccaagaagctaaagcggcagcgccggggacctgcagcatccctcggctcgtgctcccgcggtacgacgccgcgttggccgcgcccaccggcaacgtctggttgtagcagtcgccgccgccagatgaatccatcgatccagacaaatcacacacaaacaatctcacaaacgaatccatcaatcgttcacgccatgtatgactatgtgtttgctagctagcagcttataggatctggatcttgtcgtcggtcatccactagcggtgggagttgaagacgaggacgtcggcgcccttccagaaggtggagtgcttgttcatgggggcactgcggatgaggcggtcgtcgaggacagcggcaccgtcagagttggactcggcgagcatgggcgcccagtataactcgatggtggcgtcgtagtccttggccctgaagatgttgagcgagtccaccgtctcgaaggatctggacccgccggcgccgggagcgccgcggtggaggaggcagagcagcgaggcatacagcccacagagcagcgagtcccgaacttccaatcttgccgccgccgcgtcagcttccaccgccgccgccgccgccgccgctcgccgccgctccagcccgtgctccccgcggccggccgaaggggagagaagagaaagggaaagaaagagagaagggaggaagagcggaggaagaagaagagagaggatggcatgtgggccccacatggcagtgggtcccacactatataatttttgaatgacaaatgggccccacacttttttttttatttctagtgccacttaagcgccacatcaacgccacatggaaagaagaccgagtcaatgctgctacgtaggcgccacgttagcaaaaccgccgagggagtcaaattgctccggttttaagagttttggggtcgaaatatccggttttgtggtttatggtcgtggattagatttcgatcacagttgagggtcacgaagtgaacttatcccacataaaagagccgacggcccaattccactgcaaatttaaatgggccaggatccggattctatccaagcccaactcacacccacgctgctcggctcgacacacatcgccgcctcgccgcctccctccctcctccggtcgccgtcgccgccggcgagctctcctcctcctcctccggtacacagctcagctctagagaaacctcttcccctgttcccccctctcctctcgtcgaagcctcctccgctatctccccggtagggctcccgccgacgctctctcctcgtcgccggatattcccatcctatcccctcctcgctcttgctccctctacgtgtgtggcacggcggcgcaccggatcggcgctgggagctaaccccccaccccccggcgaagatgccgcaggtaatggtggtcgcgcggaacttcatggacatggtggccgcgctgccggccgccaagctcgacatgctctacgactccgccttcatctgcgaggccgtgctcaggtcgctcccgccgctcgcgaagaagtacgcgctgcagatgctgtacgtgtcggcgccggtggccgctgcggccatggaggagtgggtgctcgacgagtacgccgccaagcacagggtcgccatcgataggctgctccaactgagggtatttgtcgaggtgcgcgatcgaagaaaggaggtgagctacaagatgaaccagaagttccagggcaacatgcaaaagtatttggttgatggtggaagtttaccaagggaacctataccatcgagtgtcactgcaaggttgcctacattggcagaattagagtcttttgctcttgagcagtgggagtgcttcttgctgcaattgatcaactcatctcaagtcgagagagggacaagtttcagctcatccatgatgagaacttttcagcgaggtcttctgagttcaagagatggtgaagctccaagattaactgagaacgggttccagtttctgctgatggagacaaatgctcaactttggtacatcatgagagaatacatctcatcagcagaggaacgtggtgtggaccccacggagttgatatcatttctattggaacttagttttcatacattaggagaggcttatagcttgaatactctgaccgatgtccaaagaaatgctattagggatctggcggagttgggactggtcaaacttcagcagggtcgaaaggacagctggttcatacctacaaaactggctacaaatctctcagcaagcttgtcagattcatcgtctaacaaagagggttttgtagttgtggagacaaatttccggatgtatgcgtactcaacttccagattacattgtgaaattctgcgccttttttcaagagtggagtatcaacttccaaacctaattgtgggatctattacaaaagaaagtctttatggtgcttttgagaatgggattaccgctgaacagataatttcattccttcagcagaatgctcatcctcgtgttgctgacaagatacctgcagtcccagagaacgttacagatcagattaggttgtgggaaacggatcgtaacagggttgatatgaccctatcgcatttatatgaagattttccaagcaaggatatgtttgatcaatgctgtgattatgcaagagatcatgggtgcttgctgtgggaggatgcgaagaagatgagattaattgtacgagtggagttccattcagaaatgcgtgagttcctccggaggctaagataaatcaactatagtttgcataatttattcaatctatgtactcctatattcctgcacagtaagaactttatcaatgactgttgtgcaccaatttggcccattgtcacacatgaatatatccactggctgcatcatgttaaggagttggaactcgctgaacttttgagttaactgctgttaccctgtttattattacggagtgctccatccgtccagtccaaattagttgttttaggatagatcacattttattctagatatttttctttacttattctagatgattactccgtgcaagagaggagcgattagagggagagacgagcgatcagagaggagggggagggtgtgtgtcaggtgtcaggttttcacctgtgtcaatccgtgtgagagagg

SEQ ID NO: 3961 - DNA, 1812 bp, Brachypodium distachyon
tgctccctacaggtgctgcaaagatgccgcaggtgatggtggtcgcgcggaacttcatggacatggtggccgcgctgcctgctgccaaactcgacatgctctatgattccgccttcatctgtgaggctgtgctcaggtcgttcccaccgctagcaaagaagtacgcgcttcagatgttgtacgtgtcagcaccgatgcccgctgcggctatggaggagtgggtgctggatgagtatgcctccaaacacaaggttgccatcgataggctgctccaacttagggtctttgtcgaagtacgtgatagaagaaaagaggtgagctacaagatgaatgataagttccaggggaacatgcagaagtatttggttgacggtggaagtttaccaagggaaccgatatcatcaagtgtcactggcagattgcccacactaacagaactagaaaactacgcccttgagcaatgggagtgctttttgctgcaattaataaattcatctcaagttgagagagggacaagtttcagctcgtctatgatgaaaacatttcagcgaggtcttctgagttcaagggatggcgatgctccaaagttaagtgagaatggcttccagtttctgctgatggagacaaatgcgcaactttggtacataatgcgagaatacatttcatcagcagaggaacgtggagtagaccctacggagttgatctcatttctcttggaacttagttttcatacactgggagcggcttatagcttcaatactctgactgatgtccaaagaattgctattagagatctggcggagctggggttagtcaaagtgcagcagggacggaaagatagctggttcatacctacaaaattggccacaaacctctcatcgagcttgtcagattcttctgccagcaaagagggtattgtggttgtggagacaaactttaggttatatgcatactctgcttccagattgcactgtgaaattctacgccttttttcaagggtggagtatcaacttccaaacctcatcgtgggagctattacaaaagaaagtctttatggtgcttttgacaatgggatcactgctgaacagataatttcattccttaagcaaaacgcccacccccgcgttgccgacaaaatacctgttgtgccagagaatgtgacagatcagattaggttgtgggagaccgatcgaaacagggttgacatggtcctgtcacatgtatacgaagattttccgagcaaggacatgtttgagcaatgctgtgatcttgcaagggataacggtttcttgctctgggaggactcaaagaagatgagattgatagtacgagtagagttccaccaagagatgcgggagttcctccgcaggcaaagatgaaagaaagcctcggattcttttctgccatcttttgatcccaaggaaaaatgacccatctggagagaagaagctacttctctttacaacacgctccttcatgtgaaagcctgagaattcacctgacaactcctgaacaagtttcaactgcagcaggcagatgcagagtggcgaaacatcataatcattttaagttgagggtcttaatccagtgtaatccttagtaaattgttaggcttagtttcaggtttgtgctctgcttagttttacagaagggatgagaagaaaaaaactggttataaacaagtgtactatttctattggttaattgaattataaatattggcgtccagtgttgtcttctcaccttaatctaactcatgtgttggcatggatttttgttttctctcctcgcaaaaaagaaaaatgaatattt

SEQ ID NO: 3962 - DNA, 1719 bp, Brachypodium distachyon
caggtgctgcaaagatgccgcaggtgatggtggtcgcgcggaacttcatggacatggtggccgcgctgcctgctgccaaactcgacatgctctatgattccgccttcatctgtgaggctgtgctcaggtcgttcccaccgctagcaaagaagtacgcgcttcagatgttgtacgtgtcagcaccgatgcccgctgcggctatggaggagtgggtgctggatgagtatgcctccaaacacaaggttgccatcgataggctgctccaacttagggtctttgtcgaagtacgtgatagaagaaaagaggtgagctacaagatgaatgataagttccaggggaacatgcagaagtatttggttgacggtggaagtttaccaagggaaccgatatcatcaagtgtcactggcagattgcccacactaacagaactagaaaactacgcccttgagcaatgggagtgctttttgctgcaattaataaattcatctcaagttgagagagggacaagtttcagctcgtctatgatgaaaacatttcagcgaggtcttctgagttcaagggatggcgatgctccaaagttaagtgagaatggcttccagtttctgctgatggagacaaatgcgcaactttggtacataatgcgagaatacatttcatcagcagaggaacgtggagtagaccctacggagttgatctcatttctcttggaacttagttttcatacactgggagcggcttatagcttcaatactctgactgatgtccaaagaattgctattagagatctggcggagctggggttagtcaaagtgcagcagggacggaaagatagctggttcatacctacaaaattggccacaaacctctcatcgagcttgtcagattcttctgccagcaaagagggtattgtggttgtggagacaaactttaggttatatgcatactctgcttccagattgcactgtgaaattctacgccttttttcaagggtggagtatcaacttccaaacctcatcgtgggagctattacaaaagaaagtctttatggtgcttttgacaatgggatcactgctgaacagataatttcattccttaagcaaaacgcccacccccgcgttgccgacaaaatacctgttgtgccagagaatgtgacagatcagattaggttgtgggagaccgatcgaaacagggttgacatggtcctgtcacatgtatacgaagattttccgagcaaggacatgtttgagcaatgctgtgatcttgcaagggataacggtttcttgctctgggaggactcaaagaagatgagattgatagtacgagtagagttccaccaagagatgcgggagttcctccgcaggcaaagatgaaagaaagcctcggattcttttctgccatcttttgatcccaaggaaaaatgacccatctggagagaagaagctacttctctttacaacacgctccttcatgtgaaagcctgagaattcacctgacaactcctgaacaagtttcaactgcagcaggcagatgcagagtggcgaaacatcataatcattttaagttgagggtcttaatccagtgtaatccttagtaaattgttaggcttagtttcaggtttgtgctctgcttagttttacagaagggatgagaagaaaaaaactggttataaacaagtgtactatttctattggttaattgaattataaatattggcgtcca

SEQ ID NO: 3963 - DNA, 1756 bp, Triticum aestivum
aggcgctgctgcaaagatgcctcaggtgatggtggtcgcgcggaacttcatggacatggtggccgcactgcctgccgccaaactagacatgctctacgattccgccttcatctgtgaggctgtactcaggtcgttcccaccgctggcaaagaagtacgtgattcagatgttgtacgtgtcggcaccgatgcttgctgcggctatgcaggagtgggtgctggatgagtatgcctccaagcacaaggttgccatcgataggttgctccaactcagggtatttgtggaagtacgtgacagaaggaaggaggtgagctacaagatgaataataagtttcaggctaacatgcaaaagtatttggttagtggcgggtgtttgccaagggaaccgctaccattcagtgtcactggcagattgcctacactggtggaactagaaaattatgctcttgatcaatgggagtgcttcttgctgcaattgatcaactcgtctcaagttgagaaagggaccactttcagctcgtctatgatgaagacgttccagcgaggtcttctgagttcaagggatggtgaagctgcaaagttaagtgagaatggcttccagtttctgctgatggagacaaatgcacagctttggtatataatgagagaatacatttcatccgcagaggaacgcggggtggatcccacggacttgatatcatttctcttggagcttagttttcatacacaaggagcggcttacagcctaagtactctgacagaagtccaaagagttgcaattatggatctgatggagctcgggttagtcaaactgcagcagggccggaaagatagctggttcatacctacaaaattggctacaaatctctcatcgagcttgtcagattcagctgctagcaaagagggtattgtggttgtggagacaaactttaggttgtatgcgtactctgcttccaagctgcactgtgaaattctacgtcttttttcaagggtagagtatcaactaccaaaccttattgtgggagctattacaaaagaaagtctgtatggtgcatttgataacgggatcaccgctgaacagataatttcattccttcagcaaaatgcccaccctcgtgtcatcgacaaaataccgatagtcccagagaatgttacagatcagattaggctgtgggagaacgaccgtaacagggtcgagatggtcctgtcacacgtatacgaagatttcccgagcaaggacatgtttgagcaatgctgtgaccacgcaagggataacgggtacttgctgtgggaggacgcgaagaagatgcgattgatagtgaacgcggagttccaccaagaaatgcgggagttcctccgcaggcaaagatgatccaagggaagtgatcatctggagagaagagaagaagctacttgtctgtaccacacgctccttcatgtgaggaagtcctgaatccacctacccactagacaagtctttacaagatccaactgccggagggcagagtggtagtctggtagatgttgaaatcatttggactcgacggtcataaatccaatgtaatcatatgtttgataggttcagtctgcagtttgcgccatgctaaatgtatgtcacacaaggtagtggattattcagttaggcaaatcaaaatccgatgaactgtacgtgctccacttctccagttcagttttgcgtggaagtcgcgtacaattgtgattagcctgtgtcagtcagtttggaaccagacaagtt

SEQ ID NO: 3964 - DNA, 1828 bp, Triticum aestivum
ggcgcaggtgctgcaaagatgcctcaggtaatggtggtcgcgcggaactttatggacatggtggccgcactgcctgccgccaaactcgacatgctctacgattccgccttcatctgtgaggctgtactcaggtcgttcccaccgctggcaaagaagtacgtaattcagatgctgtacgtgtcggcaccgatgcctgctgcggctatgcaggagtgggtgctggatgagtatgcctccaagcacaaggttgccatcgataggctgctccagctcagggtttttgtggaagtacgtgacagaaggaaggaggtgagctacaagatgaataataagtttcaggctaacatgcaaaagtatttggttagtggcgggtgtttgccaagggaaccgctaccaatcagtgtcactggcagattgcctacactggtggaactagaaaattatgctcttgatcaatgggagtgcttcttgctgcaattgatcaactcgtctcaagttgagaaagggaccactttcagctcgtctatgatgaagacgttccagcgaggtcttctgagttcaagggatggtgaagctgcaaagttaagtgagaatggcttccagtttctgctgatggagacaaatgcacagctttggtatataatgagagaatacatttcatccgcagaggaacgtggggtggaccccacggacttgatatcatttctattggagcttagttttcatacacaaggagcggcttacagcctaagtactctgacagaagtccaaagagttgcaattatggatctgatggagctcgggttagtcaaactgcagcagggccggaaagatagctggttcatacctacaaaattggctacaaatctctcatcgagcttgtcagattcagctgccagcaaagagggtattgtggttgtggagacaaactttaggttgtatgcgtactctgcttccaagctgcactgtgaaattctacgtcttttttcaagggtagagtatcaactcccgaaccttattgtgggagctattacaaaagaaagtctgtatggtgcatttgataacgggatcactgctgaacagataatttcattccttcagcaaaatgcccaccctcgtgtcatcgacaaaatacctatagtcccagagaatgttacagatcagattaggctgtgggagaatgaccgtaacagggtcgagatggtcctgtcacacgtatacgaagattttccgagcaaggacatgtttgagcaatgctgtgaccacgcaagggataacgggtacttgctgtgggaggacgcgaagaagatgcggttgatagtgaacgcggagttccaccaagaaatgcgggagttcctgcgcaggcaaagatgatccaagggaagtgaccatcttggagagaagaaaagaagcaacttgtctgaaccacacgctccttcatgtgaggaaggcctgaatccacccaccaacagacaagtcttaacaagatccatcggcaggaggcagcgaggcagagtggttgtctgtagatgttgaaatcatttgaactcgatggtcgtaaatcgagtgtaatcatatgtttgataggttcagtctgcagtttgcgtcatgctaagtgtaggtcacagaaggtagtggattatccagttagtcaaatcaaaatcggatgaactgtacgtgctccacttctccagttcagttttgcatggaagtcgcgtacaattgtgattggcctgtgtcagtcagtttggaaccagacaagtttgcaaaaccgcatcgagacaggattgacaatttggattttcagtaaagtggtttagtatctttt

SEQ ID NO: 3965 - DNA, 1370 bp, Brachypodium distachyon
atgccgcaggtgatggtggtggcgcggaacttcatggacatggtggccgcactgcctgctaccaagctcgacatgctctatgattccgccttcatctgcgaggctgtactcagggattactctcacaagaagtacacgcttcagatgttgtatgtgtcagcaccgatgcccgctgcagctatggaggagtgggtgctggctggatgagtatgcctccaaacacaaggttgccatcgataggctgctccaacttagggtctttgtcgaagtacgtgattgaagaaaagaggtgagctacaagatgaatgataagttccagggaaacatgcagaagtacttggttgacggtggaagtttaccaagggaaccgataccatcaagtgtcactggcagattgcccacactaacagaactagaaaactatgcccttgagcaatgggagtgctttttgctgcaattgataaactcatctcaagttgagagagggacaagtttcagctcgtctatgatgaaaacatttcagcgaggtcttctgagttcaagggatggtgacgctccaaagttaagtgagaatggcttccagtttctgctgatggagacaaatgtacaactttggtacataatgcgagaatacatttcatcagcagaggaacgtggagtagaccctacggagttgatatcatttctcttggaacttagttttcatacattgggagcggcttatagcttcaatactctgactgatgtccaaagaattgctattagagatctggcggagctggggttagtcaaagtgcagcagggtcggaaagatagctggttcatacctacaaaattggccacaaacctctcatcgagcttgtcagattcatctgccagcaaagagggtattgtggttgtggagacaaactttaggttatatgcatactctgcttccagattgcactgtgaaattctacgccttttttcaagggtggagtatcaacttccaaacctcatcgtgggagctattacaaaagaaagtctttatggtgcttttgataatgggatcactgctgaacagataatttcattccttaagcaaaacgcccaccccgcgtagccgacaaaatacctgtggtgccagagaatgttacagatcagattaggttgtgggagaccgatcgaaacagggttgacatggtcctgtcacatgtatacgaagattttccgagcaaggacttgtttgagcaatgctgcgatcttgcaagggataacggttttttgctatgggaggactcgaagaagatgagattgatagtacgagtagagttccaccaagagatgcgggagttccttcgcaggcaaagatgaaagaaagcctcggattc

SEQ ID NO: 3966 - DNA, 1282 bp, Saccharum officinarum
cgacgatcatcctcctggagtcaattttgaagtaacgaagatttggaacccagccctctgttctccaccagcgcttcgaagatgccgcaggtaatggtggtggcacggaacttcatggatatggtggctgctcttcctgcgggcaagcttgatatgctctatgactcagcctttatctgtgaggcggtactcaggtcacttcctccactggcaaagaagtatgcactgcagatgttgtatgtgctggcaccggtgaccgctgcagcaatgaaagagtgggtgctcaatgaatatgctgccaagcacaaggttgctattgataagcttctccaactcagggtctttgtcgaagtgcgcgacaggcgacgggacgtgagctacaagatgaatcagaagttccagggaaacatgcagaagtatttggttgatggtggaagtttaccaagggaacctttaccattaagtgtcactggtcgattgcccactccagcagatctggaagcctatgctcttgatcaatgggagtgcttcttgttgcaattgatcaattcatcccaagtcgaaaaagggacaagttttagctcctccatgatgaagacatttcagcgtggtcttctgagttcaagggacggtgaagcttcaaaattgactgagaatggcttccaatttcttctgatggaaacaaatgcacaactttggtacataatgagagaatacatttcatctgcggaggaacgtggagtggaccctacggagctgatatcatttctcttggaacttagctttcataaattgggagcggcttatagcttgaatactctgactgatgtccaaaggattgccgtcagggatcttgcagaattgggactagtcaaacagcagcaaggtcgaacggatcgctggttattcctacccaactggctactaatctctcagcaagcttgtcagattcatcatctaacaaagagggatttgtggttgttgagacaaactttcgaatgtatgcatactctacttccaaactgcactgtgaaattctacgccttttttcaagggtggagtatcaacttccaaacctcatcgtaggagctgttacaaaagaaagtatctatggtgcttttgagaatggaataactgctgagcagataatctcatttcttagacaaaatgctcaccctcgtgttgctgacaagatacccgctgtcccggagaatgtcacagatcagattaggctgtgggaaactgaccgcaacaggggtgagatgaatccatcacatctgta

SEQ ID NO: 3967 - DNA, 1951 bp, Hordeum vulgare
ccttctcttcccctccccacccggtcgcaggcgttcccccatctggtttgcccgccgccgcgggcgacctcgacctagggcatcggcggctgcggagctcttcctatctctcggtgggagcgtccaggcgcaggcgctgtaaagatgcctcaggtaatggtggtcgcgcggaacttcatggacatggtggccgcactgcctgccgccaaacttgacatgctctacgattccgccttcatctgtgaggctgtactcaggtcattcccaccgctggcaaagaagtacgtaattcagatgctgtacgtgtcggcaccaatgcctgctgcggctatgcaggagtgggtgctggatgagtatgcctccaagcacaaggttgccatcgataggctgctccaactcagggtctttgtggaagtacgtgatagaaggaaggaggtgagctacaagatgaataataaattccaggctaacatgcagaaatatttggttagtggcgggtgtttgccaagggaaccactaccattcagcgtcactgccagattgcctacactggtggaattagaaaattatgctcttgagcaatgggagtgcttcttgctgcaattaatcaactcgtctcaagttgagaaagggaccactttcagctcatctatgatgaagacattccagcgaggtcttctgagttcaagggatggtgaagctgcaaagttaagtgagaatggcttccagtttctgctgatggagacaaatgcacaactttggtatataatgagagaatacatttcgtccgcagaggaacgtggggtggaccccacagacttgatatcatttctcttggagcttagttttcatacacaaggagcggcctacagcctgagtactctgacagaagtccaaagaattgcagttatggatctgatggaactcgggttagtcaaactgcagcagggccgtaaagatagctggttcatacctacaaaattggctacaaatctctcgtcgagcttgtcagattcagctgccagcaaagagggtattgtggttgtggagacaaactttaggttgtatgcgtactctgcttccaagttgcactgtgaaattctacgtcttttttcaagggtagagtatcaactaccaaaccttattgtgggagctattacaaaagaaagtctttatggtgcatttgataacgggatcactgctgaacagatagtttcattccttcaacaaaatgcccaccctcgtgtcatcgacaaaataccgatagtcccagagaatgttacagatcagattaggctgtgggagaatgaccgtaacagggtcgagatgatcctgtcacacgtatacgaagattttccgagcaaggacatgtttgaacaatgctgtgaccacgcgagggataacgggtacttgctgtgggaggacgcgaagaagatgcgattgatagtgagcggggagttccaccaagaaatgcgggagttcctccgccggcaaagatgatccaagggaagtgaccatctggagagaagagaagaagcaacttgtccgtcccacatgctccttcatgtgaggaaggcctgaatctacctagacaccagacaagtctttacaagatccgtctgcaggaggcagcgtggtagtctggtagatgttgaaatcatttggactcgacggtcataaatcgagcgtaatcatatattgtataggtttagtctgcagtttgcgccatgctaaatgtaagtcacagaaggtagtggattattctgttacgcaaaccaaaatcagatgaactgtacgtgctccacttttccatttcagttttatatggaagtcacgtacaattgagattggcccgtgtcagtcagtttggaaccagacaagtttgcaaaactgtatcaagacatgattggcaatttggattttcagtaaattggctcagtattatttttac

SEQ ID NO: 3968 - DNA, 283 bp, Triticum aestivum
tctctatgcgaagcagtggtatcaacgcagagtgattgtctggtagatgttgaaatcatttgaactcgacggtcgtaaatcgagtgtaatcatatgtttgataggttcagtctgcagtttgcgtcatgctaagtgtaggtcacagaaggtagtggattatccagttagtcaaatcaaaatcgaatgaactgtacgtgctccacttctccagttcagttttgcatggaagtcgcgtacaattgtgattagcctgtgtcagtcagttggaaccagacaagttgca

SEQ ID NO: 3969 - DNA, 1784 bp, Secale cereale
atccggtcgcaggcgtctccccatctggcttccccgccgccgcgggcgacctcgacctagggcatcggcggctgcggagttcttcccatctctcgttgggagcggccaggcgcaggttcgataccccagcgagtgggcattccgcaagactgcaagggcaacccgatttagggcgctgcaaagatgcctcaggtgatggtggtcgcgcggaacttcatggacatggtggccgcactgcctgccgccaaactcgacatgctctacgattctgccttcatctgtgaggctgtactcaggtcattcccaccgctggcaaagaagtacgtgattcagatgttgtacgtgtcggcaccaatgcctgctgcggctatgcaggagtgggtgctggatgagtatgcctccaagcacaaggttgccatcgataggttgcttcaactcagggtctttgtggaagtacgtgatagaaggaaggaggtgagctacaagatgaataataaattccaagctaacatgcaaaagtatttggttagtggcgggtgtttgccaagggaaccgctgccattcagtgtcactgccagattgcctacactggcagaactagaaaattatgctcttgagcaatgggagtgcttcttgctgcaattgatcaactcatctcaagttgagaaagggaccactttcagctcgtctatgatgaagacattccagcgaggtcttctgagttcaagggatggcgaagctgcaaagttaagtgagaatggcttccagtttctgctgatggagacaaatgcacagctttggtatataatgagagaatacatttcatccgcagaggaacgtggggtggaccccacagacttgatatcatttctcttggagcttagttttcatacacaaggagcggcttatagcctaagtactctgtcagaagtccaaagagttgcaattatggatctgatggagctcgggttagtcaaactgcagcagggccggaaagatagctggttcatacctacaaaattggctacaaatctctcatcgagcttgtcagattcagctgctagcaaagagggtattgtggttgtggagacaaactttaggttgtatgcgtactctgcttccaagctgcactgtgaaattctacgtcttttttcaagggtagaatatcaactcccaaaccttattgtgggagctattacaaaagaaagtctgtatggtgcatttgataacgggatcactgctgaacagataatttcattccttcagcaaaatgcccaccctcgtgtcatcgacaaaatacctatagtcccagagaatgttacagatcagattaggctgtgggagaacgaccgtaacagggtcgagatggtcctgtcacacgtatacgaagattttccgagcaaggacatgtttgagcaatgctgtgaccatgcaagggataacgggtacttgctgtgggaggacgcgaagaagatgcgattgatagtaaatgcggagttccaccaagaaatgcgggagttcctgcgcaggcaaagatgatccaagggaagtgatcatctggagagaagagaagaagcaacttgtctgaaccacacgctccttcatttgaggaaggcaatcggcgggaggcagcgaggcagagtgattgtttggtagatgttgaaatcatttggactcgacggtcgtaaatcgaatgtaatcatatgtttgataggttcagtctgcagtttacgtcatgctaagtgcaagtcacaaaaggtagtggattattcagttagtcaaat

SEQ ID NO: 3970 - DNA, 899 bp, Sorghum bicolor
agagcctacgcgcagtcgcagagaggaaagccacggcagcaggcgaagcgagccacagcctagccagccctgggcaagagggaggcgaggggaagggaaaccgaggcaggcggcggcggcaccagctaagagcgcagggcgcacgcgcttctcgtttcgtgtcccagccgaggggagggggaggcacacagcttcgaggaggtctgtacggtcgaggcgtgaggctggcggccgagggtccgggcgctgcgggcggcatgggaagggacgagctgctacggcggagcctcgtggcgctggcggcggccgtggcgctcacgggcctggccacggcgtcgctgcgcaaggcggcggccacgtacggcttcggcatcctcgccatcgccggcgtgctgctcccggactgggagttcttcgaccgcgactactcccagtggctcacccccatgcccgcctcccgacgcacggcagcggccgccgccgccgagcgggagcacgacgtctggaaattcaagccctatcctctcagggttgccatgctgacgacgatctacgggttcggtctttacaagtggtggatgtacgtatctagctagtgggtcctcctctccccccctgcatctcttccccttagcgaagtccctttttctttttaagaagaaaaataccatgatagtgccttgtcatatctcagccattcttcaccgtgatcagatgagccagccatatagcctggctaatacgctgctgatatgaaaaatcttcagaaccccccgacacaagttgatgtatgtaatgtaactagcaggttttgtaatgtgcaaacgccaatcatttcatagctggaaacatgaatctaggtttgattctttatcccctttgtggctttgtcactccga

SEQ ID NO: 3971 - DNA, 1283 bp, Sorghum bicolor
ggcgccagagcctacgcgcagtcgcagagaggaaagccacggcagcaggcgaagcgagccacagcctagccagccctgggcaagagggaggcgaggggaagggaaaccgaggcaggcggcggcggcaccagctaagagcgcagggcgcacgcgcttctcgtttcgtgtcccagccgaggggagggggaggcacacagcttcgaggaggtctgtacggtcgaggcgtgaggctggcggccgagggtccgggcgctgcgggcggcatgggaagggacgagctgctacggcggagcctcgtggcgctggcggcggccgtggcgctcacgggcctggccacggcgtcgctgcgcaaggcggcggccacgtacggcttcggcatcctcgccatcgccggcgtgctgctcccggactgggagttcttcgaccgcgactactcccagtggctcacccccatgcccgcctcccgacgcacggcagcggccgccgccgccgagcgggagcacgacgtctggaaattcaagccctatcctctcagggttgccatgctgacgacgatctacgggttcggtctttacaagtggtggatgtacgtatctagctagtgggtcctcctctccccccctgcatctcttccccttagcgaagtccctttttctttttaagaagaaaaataccatgatagtgccttgtcatatctcagccattcttcaccgtgatcagatgagccagccatatagcctggctaatacgctgctgatatgaaaaatcttcagaaccccccgacacaagttgatgtatgtaatgtaactagcaggttttgtaatgtgcaaacgccaatcatttcatagctggaaacatgaatctaggtttgattctttatcccctttgtggctttgtcactccgatcttcctttcgtgctgcttctattcgtcatttctttttttttttctgccagttactcgtactctgtatgtgttggtttcttggaaaccggtggagcccgaacgaatttgttttggtgtgagtggttttcgttggttcaggttggaagctaggcgtcgtttgatggggattctcttgcgtttatgtgacgagatgtgctggccgagcagcacacaaggcacggcagttatgttacttttttttttagaaaaagcagtatatgatgatacttgacacggcccatgcaggagcaggaaggaggttgggttgaggtgcatgccgggcctcagcccgcccgagtaggagtagcggacgggacggcgtttctcgaacgaccggc

SEQ ID NO: 3972 - DNA, 938 bp, Zea mays
agaagcctacgcgcagtcgcagagagaccatcccgccacggcagcaagcgaagcgagcctagccagccaaaccggggccaggccaggccgccagggggacgggacgggaaggaaaccgaggcaggcggcggcagcggcagcggcagcggtagcagcagcgcagggcgcacgcgcttctcgtttcgtgtcgccaggggaaggaggaggagcgagtgggttgggggatcggctggcggccgagggtccgggagctgcgggcggcatggggagggacgagatgctacggcgtagcctcgtggcgctggcggcggccgtggcgctcacggggctggccacggcgtcgctgcgcaaggcggcggtcacgtacggcttcggcatcctcgccatcgccggcgtcctgctcccggactgggagttcttcgaccgcgactactcccagtggctaacccccatgcccgcctcccgccgcacggccgccgccgcggctgccgaccgggagcacgacgtctggaaattcaagccgtatcctctccgggtggccatgctgacgacgatctacgggttcggtctttacaagtggtggatgtacgtatctagctagtgtgggtcgtccactcgtcctctccccccttgccgttcctcattgtgagcagatgcgatagatggagtatattgcctggctaatatgctgctgatagcctgatatgaagaaccaccctcaagacaggttgatgtatgtaatgtaacgagcgggtttttgtgatgcgcaaacgccacgccaatcattcttatctggaaacatgaatctaggttttattctttctccccctttgtcactccttcggtcttccttgttccatcatcatagcttcccaagggctacatgaacatgaatcttacagtttgcacatctatttttttttcttgttgtcggtcag

SEQ ID NO: 3973 - DNA, 976 bp, Setaria italica
atgtccccgcgccagagcccccgcccgaagagagaccaccagcagcaaagcgagccggacggccagcggggaaggaaatcgagacaagcggcggcggcggcggcggcggcagcagcagcgcagggcgcacgcgcttctcgtttcgtgtccccaggaaggggaagggacggaggcagggagccgaagcttcgagaagggttgttcggtcgaggaggaacggggaggctggcggccgagggcccgggcggcatggggagggacgagctgctgcggcggagcctcgtggcgctggcggcggtcgtggtgattacggggcttgccacggcgtcgctgcggaaggcggcggccacgtacggcttcggcatcctggccatcgccggcgtgctgctcccggactgggagttcttcgaccgcgacttctcccagtggctcacccccatgcccgcctcccgccgcaccgccgcggccgccgccgccgagcgcgagcacgacgtctggaaattcaagccctacccgctcaggatggccatgctgacgacgatctacgggttcgggctatacaagtggtggatgtacgtatctagctagtggatcctcctctttcccccctgtagtaaagttctttttttggaagaaacaccatgacattgccttctcatgtcccaccattcttcattgtgatcagatcagccagttatatatttgcctggttatacgctgctgatacgaaaaaaaatcttctgatgggaaactcccgacacaagttgattgtatgtaactagcgggttttgtaatgtggaaacgccatcattcttatttcttagcttgaaaacacgaagctaggttttattccttctcctcttcgtcactcttgcagccttccttcatgaatcatgatgcttctccatcagaaacctttgattttcggaggaatatgaatatatatagtactgtgcctcaccctgttcttgcacaa

SEQ ID NO: 3974 - DNA, 725 bp, Pennisetum glaucum
gagagagagagagagaaaccagcaggctgcagcagcaacgcgagccagccagcccagggggaaggcaagaaaccgaggcaaggcaagcggcggcggtgggcagcagcagcagcgcagggcgcacgcgcttctcgtttcgtggccccagggaaggggaaaggaacggaggcagccgaagcttcgacaaggggtagctcggtgggaagcctcggtcgagaagggagggagggacaggcaggaacgctggcggccgagggcctgggcggcgccatggggagggacgagctgctgcggcggagcctcgtggcgctggcggcggtcgtcgtggtcacgggtctggccacggcgtcgctgcggaaggcggcggccacgtacggcttcggcatcctggccatcgccggcgtgctgctcccggactgggagttcttcgaccgagacttctcccagtggctcacccccatgcccgcctcccgccgcaccgccgcggccgccgccgccgagcgcgagcacgacgtctggaaattcaagccctacccgctgaggatggccatgctgacaacgatctacgggttcgggctctacaagtggtggatgtacgtatctagctagtggatcctcctcttcccccctgtagtgaagttcttttttttttggaagaaacaccgtgacagtgccttctcatgtcccagccattcttcatcgtgatcagatcagccagttatata

SEQ ID NO: 3975 - DNA, 1279 bp, Oryza sativa
gcttgatcattaagggcggcatggccagcagctggtccacggagggtgggaccgccctgtcagtctgacaccaccctcacgataaaaagggaaagaccgagtccatgtcgctcgcttggtgagccacccttcctactttgcccccaccaccgagcctccctgagcagtgaaaccggcgcgcggcgggcgtcggcgtcggcgtcggcggcggcggcgagggcgtagagatcgcgcgcgcgcgcgcgcggaggcgtagccgcggagtcgctctctcctcgtcctgcctcgcgactcggctccgcgaagcttcgaggaggaggaggaggaggaggagtacgacggggtgggagcggcggtgggtgggatggggagggacgagatgctgcggcggagcctggtggcgctagcggcggcggtggtggtgacgggggtggtgacggcgtcggtgcggaaggcggcggcgacgtacgggttcggaatcctggccatcgcgggcgtgctgctccccgactgggagttcttcgaccgcgactactcccagtggctcaccccgatgccggcctcccgccgcacggccgccgaagccgccgcggatcgcgagcacgacgtctggaaatttaagccctatcccctaaggatggctatgcttacgacaatctatgggtttggcctttacaagtggtggatgtacgtatctagctagtggaatccaccttcctctccgcctttgctctcatgtatggattagaagtttttgggagagtaccatcatcacattgccattcttggccatttatattgcctgattttattatacactgccaatacgaaacgtctaatggggattggggaacagtccccatcacaggttgatgtctgtaactaatggaggtttgtaatgggcaaatgccactctcagctcagctcagctcaatattcctagccctattttcttcttcgtttttctcctctcctccccttgatctcagtagcgcgtcttgttttgatacagagagcactatgaaaatgttctttgcacagaatgaatggtttatctgatacagtagtctcatgttttatcagacactcttgttattcaccagtatatcgcccatcactgtgcgttactacttagttactacttacaactaacaacggcccctttggttggataaacaagtgcgtgttgatcccttgctactcgtggttcgcatgatcagggttgaacggcttgttcaacgtgatgccaggcttatttctggtgtgattgtactttccc

SEQ ID NO: 3976 - DNA, 1051 bp, Brachypodium distachyon
gcatgtggctcggccgcaccagccagacgaaggacgaagaggcagagaagcgcagcaccagccagaggcaagggggaagggactagggagagcaaaatcacacggcaggggagggaagcgcgcggcgcaggcacacgcgcttctcgtgaagcttaaggaggaacgggtggagggggaatcttcgagaaggttccgtggagggagcgggacgggctgacgggcaccgccggagccatgatggggagggacgagctgctgcggcggagcctcgtggcgctggcggcggccgtggtggtcacaggggtggcgacggcgtcggtgcggaaggcggtggccacgtacgtgtacgggatcctggccatcgccggcgtgctcctcccggactgggagttcttcgaccgcgacttctcccagtggctcacccccatgcccgcctcccgtcgcacggccgccgccgccgccgcggaacgagagcacgacatctggaaatttaagccctatccacttcggatgaccatgcttgcgacgatctacgggttcgggctatacaagtggtggaactatgtatctagctagcctgtcggtccatctcccctttcctccttcccccgtctcgctctcgcgaaacgaaagataccgcaccgcatgcattgttgcccggttacacgctgcctatacaaacaaacaaaaaacgttccagtggggggaaaagtgtctcatacacaaaaaagctcatgtcatggcaatgtctgtagctaattctcggttttgtaattgttgttattcttagatgatcaaaacgttgcgcttcgtttagcctcttcttcttgttcctctagcgagttggtgatttgttagattgggttggtaatctgttcccccgtagagccgtgatggcttcccttcctgttttctgctcctttgattggatggataaacctgttactgtatatgtatatacgcgtttcgttattgattgatttgttgtggagaggaaaaaggaagtgatacagaagtggatttgttgggctggttcgcgtggctgcctgca

SEQ ID NO: 3977 - DNA, 846 bp, Brachypodium distachyon
gaagaggcagagaagcgcagcaccagccagaggcaagggggaagggactagggagagcaaaatcacacggcaggggagggaagcgcgcggcgcaggcacacgcgcttctcgtgaagcttaaggaggaacgggtggagggggaatcttcgagaaggttccgtggagggagcgggacgggctgacgggcaccgccggagccatgatggggagggacgagctgctgcggcggagcctcgtggcgctggcggcggccgtggtggtcacaggggtggcgacggcgtcggtgcggaaggcggtggccacgtacgtgtacgggatcctggccatcgccggcgtgctcctcccggactgggagttcttcgaccgcgacttctcccagtggctcacccccatgcccgcctcccgtcgcacggccgccgccgccgccgcggaacgagagcacgacatctggaaatttaagccctatccacttcggatgaccatgcttgcgacgatctacgggttcgggctatacaagtggtggaactatgtatctagctagcctgtcggtccatctcccctttcctccttcccccgtctcgctctcgcgaaacgaaagataccgcaccgcatgcattgttgcccggttacacgctgcctatacaaacaaacaaaaaacgttccagtggggggaaaagtgtctcatacacaaaaaagctcatgtcatggcaatgtctgtagctaattctcggttttgtaattgttgttattcttagatgatcaaaacgttgcgcttcgtttagcctcttcttcttgttcctctagcgagttggtgatttgttagattgggttggtaatctgttcccc

SEQ ID NO: 3978 - DNA, 1014 bp, Secale cereale
ccaaagcgaattgtacagaggaagcgcgcggcggaggcacacgcgcttctcgtgctgccttggcgtgggcggggagagggggggaggagcatcgagaaggttccgaggcgggagagggctgctggcgggggccgcgggcgccggaagcatgttggggagggacgagctgctgcggcggagcctcgtgacgctggcggcggccgtggtggtgaccggggtggccacggcgtccgtgcggaaggcgctggccacctacgtcttcggaatcctggccatcgccggcgtgctcctcccggactgggagttcttcgaccgcgacttctcccagtggctcacccccatgcccgcctcccgccgcacggccgccgccgccgccgccgagcgcgagcacgacatttggagatttaagccgtatccactcaggatggccgtgctcacgacgatctacgggtttggactttacaagtggtggacgtacgtatctcactaacgagacaggcccaggaccccctcccctgtcttattctcatgatacgaaagatttcgagagtagtaccatcacatcgatcaaattgctttgccttgcttcatgatcagacaattagtacatcgtgggatcatacgagaacgtacggaggggaaatgaacacccggccgcaagttcatgtctgtagctaattggtttttgtaatgtgcaaatgtcattcttagatcaaaaggagctttgttacttcgtttttcttcttgttgtatatatgcgtcgtctctgattgtcgttgatgttgttgtggtcgagatagaagcatgccatggttatgtctcgggtgatttgcatggttcgcgtgatgcggccctttcccgcggagccgtgttcggcgtgcatgtttgctcgctccggcaccttgggcgatgcacgaaacttgatgggcagaattagattggtggtcattattatttctggtgttcgttgtactgccacgattgaaaatgaatagatcaaaaaattctcgagtc

SEQ ID NO: 3979 - DNA, 770 bp, Hordeum vulgare
agcaaggagagcagcagcggagccgaagcaaattgtactactacgcaggagtcgagtcgaggtagcgcgcggcggaggcacacgcgcttctcgtgccgcggaggagggggcagtagcttcgcgaaggttccgaggcgggagggggctgctggcgggcgccggaagcatgttggggagggacgagctgctgcggcggagcctcgtgacgctggcggcggccgtggtggtgaccggggtggccacggcgtccgtgcggaaggcgctcgccacgtacgtcttcggcatcctggccatcgccggcgtgctgctcccggactgggagttcttcgaccgcgacttctcccagtggctcacccccatgcccgcctcccgccgcacggccgccgccgccgccgccgaacgcgagcacgacatttggagatttaagccgtatccacttcggatggccgtgctcacgacgatctacgggttcggactttacaagtggtggacgtacgtatctcactgacgagacaggtccaggatcacctcctctgtctctctcatgaaaggaaagattttgggagagtagtaccatcacatcgatcagattgctttgccttgcttcatggtcagacagtttcacgtctgtagctaatgggtttatacgctgccaacacgaaaacgcccggtgggggaaaggaacacccggccgcaagctcatgtctgtagctaaatgagtttttgtaatgtgcaaatgtcattcttagatcaaaaggagtatttttttt

SEQ ID NO: 3980 - DNA, 789 bp, Triticum aestivum
tcggcacgagggaagcatcatcagcggcagcagcgaaggcaaagcaaattgcacagaggcagcgcgcggcggaggcacacgcgcttctcgtgctgctgccttggcgtgggtggggagaggggggaggagcttcgagaaggttccgaggcgggagagggctgctggcgggggccgcgggcgccggaagcatgttggggagggacgagctgctgcggcggagcctcgtgacgctggcggcagccgtggtggtgaccggggtggccacggcgtccgtgcggaaggcgctggccacctacgtcttcggcatcctggccatcgccggcgtgctgctcccggactgggagttcttcgaccgcgacttctcccagtggctcacccccatgcccgcctcccgccgcacggccgccgccgccgccgccgagcgcgagcacgacatttggagatttaagccgtatccactcaggatggccgtgctcacgacgatctacgggtttggactttacaagtggtggacgtacgtatctcactaacgagacagacccaggacctcctcccctgtctcactctcatgatacgaaagatttcgagagtagtaccatcacatcgatcaaattgctttgccttgcttcatgatcagacaattagtacatcgtgggatcatacaagaacgtccggaggggaaatgaacgcccggccgcaagttcatctctgtagctaatgggtttttgtaatgtgcaaatgtcattcttagatcaaaaggagcactgttacttcgtttttcttcttgtt

SEQ ID NO: 3981 - DNA, 1030 bp, Triticum aestivum
caaagcaaattgtacagaggaagcgcgcggcggaggcacacgcgcttctcgtgctgccttggcgtgggtggggagaggtggggagcttcgagaaggttccgaggagggagagggctgctggtgggggccgcgggcgccggaagcatgttggggagggacgagctgctgcggcggagcctcgtgacgctggcggcggccgtggtggtgaccggggtggccacggcgtccgtgcggaaggcgctggccacctacgtcttcggcatcctggccatcgccggcgtgctgctcccggactgggagttcttcgaccgcgacttctcccagtggctcacccccatgcccgcctcccgccgcacggccgccgccgccgccgccgagcgcgagcacgacatttggagatttaagccgtatccactcaggatggccgtgctcacgacgatctacgggtttggactttacaagtggtggacgtacgtatctcactaacgagacaggcccaggacctcctcccctgtctcactctcatgatacgaaagatttcgagagtagtaccatcacatcgatcaaattgctttgccttgcttcatgatcagacaattagtacatcgtgggatcatacaagaacgtccggaggggaaatgaacacccggccgcaagttcatctctgtagctaatgggtttttgtaatgtgcaaatgtcattcttagatcaaaaggagcactgttacttcgtttttcttcttgttgtatatatgcatcgtctctgattgctgttgatgttgttgtggtcgagataggagcatgccatggttatgtctcaggtgatttgcatggttcgcgtgactgccgccctttctccatggaaccgtgttcggcgtgcatgtttgcttgatccggggatgcacaaaccttgccgggtgaaagtatatcggcggccgttattattgttgtactgtcatgattgaaaatgaatatatcggtgtttttcaagaaaaagaaaacccaccgaggggatcgagctcgtgacctag

SEQ ID NO: 3982 - DNA, 662 bp, Saccharum officinarum
aaacaccgcggcgccgccacagctttgcaaaccgcagcgagcgagccctccagtatccatctacgttactgtccaagatcctcgtcaaggccctgatggctccccgcgtcgcctccgtgctgctcttcgccatggccgtcctcgtcgcctccgcatcggcgcaggagttcgtggcgcctgcgtctgcgccggcgccgggaccagtcgccggagcggcctccgctccggcctccgctgtcgccgtggtgtcgtccgcactgctctccctgcttgtggcgaccctgatgcagtagaagcatatatatcatctaccgcttatgtatgctatatatacatggtcatgggcatggagtagtaggttttgtttctagatttgagcgggaatttgatccagtgttgctgttcctcattctttttgtatcatatatatctcggacatttttatacatatgaataaagctggatgatgtatttcatgcttttttaaagaaacattatttatacaaaaagggcggcgccctttttttttttttttttttttatttataatactttaacttcttcaacttgaattatattattaagaaaaaaccggctcataaatttttccagaggttttctaatgaggagggcctccatttttttttgtctatctctcgggt

SEQ ID NO: 3983 - DNA, 812 bp, Saccharum officinarum
tgagatgagatctatctttatatacagccttaacgcccttaagacacacttcatctcgaagtcactgagctccaaagaatctagtagataggagcagaggcgtacgccatccacagcaacatgtgctccggctcctggtcctggagcagcagcaagaagcacccgtctcttgttgtcgtcaacctcaagcggcagctgcagaagacgccgccgcctcatgtctcagttgccatcaggagaaagaggttgaggctgaggaggttgagaggcggagcagaggccatggagatactgaacctgaagctctacctggagaaccgttgcattatcgcggagaacgagaggctccgggaaaaggccaccgcactccgccgtgagaacctcgcgctgctccagaacctgtccaagacggcggccgtgccagaggcaggagcgggagctggaactgcgtgagattgcttcctctgcctgcctgcctgcctgatgaagatgaagtagctagctcgcgtccccttcctcgttggtgcatgtgctagttgtgtggacaggacagtggactcctcctaggtatcatccatctgcttggctgctccgccatgtctgtgctcataaatcgccaggttcctggagctctcttgggtgctctgtgccatggtgtttttgtacattataagtgcgcggattaactagattttgttggcaactactaactcttttgggtgaactgggcaaggaaataaaagcagctttgatcccaactaaaacatttccgggaagatcgcaattacagccttttaaaaggaacaaaagtg

SEQ ID NO: 3984 - DNA, 728 bp, Zea mays
caaacaccatggcacagagcacccaagagagctccaggagcctggtgatgtatgagcagacagcagagcacagacatggcggagcagccaagcagatagatacctaggagtccgctgtcctgcccacgcaactagcacaagcgccagcgagggaacgcaagctaagctagctactccatgctcagcaggcagcaagaggaagcaatctcacgcagctccagctcccgctcctgcctctggcacggccggcgtcttggacaggtcctggagcagcgcgaggttctcgcggcggagcgcgctggccctctcccgcagcctctcgttctccgcgatgatgcaccggttctccaggtagagcttcaggttcaccatctccatggcctctgctccggctctcaacctcctcagcctcagcctgcgtacgtgtacagtgtacttctgctgccgcttgaggttgacgacaacaagagacgggcgcttcttgctgctgctccaggaccaggagccggagcacatgttgccgtggtggatggcgtatacacggcctgctcctagctgctagattctttggagctcagcgcggtgacttcgggatgaagtgtttgaagggcgctaaaggctatatataaaagatagatctcatctcatctcgcctcgtctcgtctctcggggctttggtggtagctttaggtttttgtttggtggtgcatgcacacattgacatgacg

SEQ ID NO: 3985 - DNA, 1221 bp, Panicum virgatum
gttcttcgtcgggagcttcgccggcgacaagagaatctcggtggttctagctgaactcgcgcccctgctatgcacccagtttcagtctccttgcagcctttccctgcaactccggcaagcatacttgtcccaaggagcgcagctgggaggaattccatcgattttgccgagttgcggagagctggaaggtctagtggaaaccttgctatgaattccatacagaatcctgcccgtgggtcagaaacgtctgggagtgaggatttcaatgtgggggataaggatgccgtggtcattgtcgaccatgggtcacggcgccaagaatccaatctcgtgctgaatgactttgtcgagatgttcagggcacgaactggttataagatcgttgagcctgctcatatggagctggctgagcctactattaaggatgcttttggaaaatgtgtgcaacaaggggcatcccgtgttattgttagtccatatttcctttcccctggacgacattggaaacaagatatccctgctttagcagcagaagcatccaaggagctctcaaatataccctatattgtcactgcccctcttggactgcatgagcttatggtggatatcatgaatgatcgcatcaagtactgcctgcaacacgctgcaggtaatgtcgatgagtgtacagtatgtgctggaactggaaagtgccgcctctactcctgatggtgaatacctgggaggccacagttctctatatatgagtatatgactgttcatactgcctcttagaatctgaatagctgtggcagtggcatttcaatgccagcttttctctccgttttaccatttacaaggtctgggccaatatttttcttctgtaagagatctgacgagtgtatgtcccggtcccttatgtcccgtgcagccaaaattaccattgtaatcggctttgtgcatcttgaaattcgggactgtccatattctgagcagattgtcaaattagtcggacaggtggaccatcaagaaaagagtatagcttcattagctaaccttaagaacaattactgttgttatttgaacaacgaacaagatctagtcaagaattcacgttctttagggcttgatcatcttagtcagagatgatgaaggcccatcatgagcttttttagttacttgcatgcggatgtaatgatgtttctattactaccatttaaattaattagttttgttgccttc

SEQ ID NO: 3986 - DNA, 1208 bp, Setaria italica
accagttttccacccccacggaatctgggttttacctgaactcggtcccctgctatgcacccggcttcagtctccttgcagccctttactgcaactccggcaagcatacttatccctaggcgtgcagctgcgaggaattccattgatttcaccgagctgcggagagctggaaggtctagtggaaaccttgtaatgagttccatgccaaatcctgccagtgggtcagaaacgtccggaagggaggatttcaatgttggggataaggatgcagtggtcattgtcgaccatgggtcacggcgacaagaatccaatctcatgctaaatgactttgttgagatgttcaggacgaggactggttataagatcgttgagcctgctcatatggagctggctgagcctactattaaggatgcttttggaaaatgtgtgcaacaaggagcatcccgtattattgttagtccatatttcctttcccctggacggcactggaaacaagatatccctgctttagcagcagaagcatccaaggagcactcaaatgtaccctatattgtcactgcccctcttggactgcatgagcttatggtggatatcatgaatgatcgcatcaagtactgcctgcagcacgttgggggtgatgttgatgagtgtacagtatgcgctggaactggaaagtgccgcctctactcctgatgggagtacctgggaggctacttatccatactgcagcttagaatctgaatagctgtcgcaatggcatctcaatgccacttgtttttttaccatttaccaggtctgggccaatacttttctcgtctgtacgaggtctgacgagtgtatatcctggtccggtgccccaaccaaaagttaccattgcaactgtgcttgctccgtccgatcgccgccactgtgctctgattttaacctcagaggagccttgctccgtcccctaacgtgctgcttgctgcggctcaccaaggcccagttagccacatcctcatctttcgagcacctgcgagaacaatctcacaatttccaccacccccgtgctcctctattcatggtaccttttatgaatgtcttcgagagattagttcatcgttgtctgtctagttgatggtattgtgtatctctaaaaaaacaattagctaagagtacggctgtacgagcactcatcaatcatgatgagttggagatttgaaccctac

SEQ ID NO: 3987 - DNA, 1217 bp, Panicum virgatum
agccctcctgcacggccgcaccaaattctcgccctcccctccctcctctctcgaccttcttcgttcggcgacgacaggggagtggcgccgccagttcttcgtcgggcgcttcccggcggccaagagaatctcggtggttttagctgaactcgcgccccctgctatgcacccagtttcagtctcattgcaccctttcactgcaactccggcaagcgtacttatcccaaggaacgcagctgtgaggaattccatcaattttgccgagttggggagagctggaaggtccagtggaaaccttgctatgaattccatacagaatcctgcccgtgggtcagaaacgttcggaactgaggatttcactgtgggggataaggatgccgtggtcattgtcgaccatgggtcacggcgccaagaatccaatctcatgctaaatgactttgtcgatatgttcagggcacgaactggttataagatcgttgagcctgctcatatggagctggctgagcctactattaaggatgcttttggaaaatgtgtgcaacaaggggcatcccgtgttattgttagtccatatttcctttcccctggacgacactggaaacaagatatccctgctttagcagcagaagcatccaaggagctctcaaatataccctacatcatcactgcccctcttggattgcatgagcttatggtggatatcatgaatgaccgcatcaagtactgcctgcaacacgttgcaggtgatgtcgatgagtgtaaagtatgtgctggaactggaaagtgccgcctctactcctgatggtgattacctgggaggctgggaggccacagttctctttatgagtatatgactgtccatactgcatcttgtaatctgaatagctgtgtcagtggcatttcaatgccagctttttttttctctgttttaccatttagaaggtctgggccaatattttttttctcttgtaagagatctgacgagtgtatatccaggtcccttatgtcccgttcaaccaaaattaccattgtaagggcatgtacaatggttagacggctgccgtctgcgtgtgtctagaatactgcacgcgacagagtagataacctgtacaatggtgtctttgtggttgtctgctagttatttaatacatgactaggcacatgaaacatgataatcaaacatgtgaaatggatctttgtgtattgttgtgtgacac

SEQ ID NO: 3988 - DNA, 1209 bp, Pennisetum glaucum
ctcccgtgcagaagcggttttccttgcgcgtttggtagcgcttcggcaaaaacagctcctgagcggttggaggagcgctaacaaacgcaccaggcgacaccaaggaaaaaaagcgacaccaaggaaaatatcgttgctttcggcgcctcgtctccggctccggccgttttcctagcggccgtcttcgtcgaggctcctgccggcaacgagcatccaccagaatcttggttgcacctgaattcggtcccctgctatgcacccggcttcagttttcttgcaaccctttactgcaactccggcaatcatacttatccctaggcccgcagctacgaggaattccattgattttgccaagccacggagagctggaaggtcccaccttgtaatgagttccatgccagattccgcccgtggatcagaagcatccggaagggaggatttcactgttggggataaggatgcagttgtcattgtcgaccatgggtcacggcgccaagaatccaatctcatgctaaatgactttgttgagatgttcaggacgaggactggttataagatcgttgagcctgctcatatggagctggctgagcctactattaaggatgcttttggaaaatgtgttcaacaaggagcgtcccgtattattgttagtccatatttcctttcccctggacggcactggaaacaagatatccctgctttagcagcagaagcatccaaggagcactcaaatgtaccctatattgtcactgcccctcttggactgcatgagcttatggtggatatcatgaatgaccgcatcaagtactgcctccgtcacgttgggggtgatgttgatgagtgtacagtatgtgctggaactgggaagtgccgcctcaactcctgatgggcctgatgggagagtaccttggaggctactgattctatccatactggagcttagaatctgaataactgtggcaatgacatttcaatgccacttgtttatctgttttaccatttaccgagtccaataccttttctcttgtatgagctctgataggtgtataagtcccaaccaaaagttaccattgtaataccgatctcggttttgtgcagcttgtaattctagagtgtccataaccatattctgagcagatcgtcaagaaagattgtagctccattagctaccataaaatcaattaccttgttattggcaatggcaagcac

SEQ ID NO: 3989 - DNA, 4087 bp, Sorghum bicolor
caagtcgcaagtctccacttccttaccgggtcccggccatacgccataggaacaagacacggaaggagaggaggagggcaccggaaatcctgctgctagctggaacctggagggctggagctggacagtgactgagagtgaaaggcagcagcggtcttccccggtggctttggttgatgctcaccgtcagggaggcacgagcacggccatctctccctcccgggcgcgttccctctcgctccggtgaggtccccgaaactcctccggggaatgcggctggacggctacagatgatatcatcttcttcctgacctgctgcaaaggagggagcctcctgcatttccggattcccttgtgcctcctctttccacgagaggggaaggggagccgaacgccggaggatgccggccaagtacctgggcttgggggcgttcgcggaggacaggcgcccggacctccaccgccaggtgggctgcgtcactgggatcttgcaggccttcgaccgccgccaccctctcgcctcttcccacaagaggctccttcctcccccaacagcaacagcaggccatgcactatccagcagcccaagcaaagggggagagtgcacaagatattcaccccagattgttctggagaagaactcgagtaaaacatgggctgacagccaaagagcaccagcaacagaactgtctcaaacctcatattcgtcatcaccctcttcgtcattctcgtcacttgatggcaacaggtcaacacaacaagacctatcatccactgaccgaatgctatttccagagaggccgttcaagagctcgccgaagctcaaaagttcttttgacagtgacaatggactagactatcctgatgatgcgcctaccaagtccaagaacatgcccatagttcaatccagcctgccaactcttggtataagaaatcttgtgaaggattcaatctataaggatagccgtgaattgtcagtgagaatttgcactgaagaagaagtaaaagatcacccatccaactgtggagatcaacctaggcaattgaatgggcctccccatgacagtacacaaggaaaaagcaagggtctcgtggatatcaacgaatcgcttcgagtgctagctaagctcagggaagcttcatggactcctcccgaatctgcccatcatgcaagactttcatatgatgctcctcggttctcatacgatgggaaggaagcagcatcaaaactgagggaggtaccaaggttgtcactggacatcaaggaaggtcacctttggaatcgtgaaattgactctagatcaaacccacgttctgcagatagaagcagcaacactgttactgggtccaatgcagctatcgagacccaacaggaacagcctgcctgcaagcggcttcctagcgttgttgcaaagcttatgggtttggaagagttgcctgagcataatcaaagtacagcatcatcacatgcatggaaaaccgttcaagagagcaagcaagatgcaatgtttaacccctcgagcatctcatcccacgatgagcatgctcttcgacaacaaagaaatcatgattcaactgcaagaaatttacccaactcaaagtttcctgttgaaactgcaccatggaagcaacaagaaaggattgtccttcctcgaagactgccaaagggatcaaaaggagcccatgcaagagaacaacctgctgcatcagtcttcagtgacatagagaagcggctcaaggatcttgattttcaacaatcgaacaaggaccttagagcgcttaaacagattttggattccatgcaagcaaaaggactattggaaaacaagaaacgggaagaagcatctatgccaaagttatatgatggaaaccatgatggccaagaggtagccggtgtgaacatgagactgaacactaacaccaacaacatgtggatgcctgaagagaacaacgcggaaagctctttcaaatcgcctattgtgatcatgaaaccttcaaaatctgcaaaccttttcagcgaagtggattcttctgtcttcccattagggggtccatctgatcccacacagctgcaaacaagcaatagcactgatagaaggaaagcttcaatgatcaatagaacagctaaagagcaacatgcgaaatttagtcaaaaggtgcctacttctcaaccccttgtttcttatgacaggagatcatatggaaggaatgacgatagcagcaacaaccaaaaatctagttcactgctggttactgagagctcatccagaagacagcagctgccaagagacggtagcataagtatgcaaaagaataaaaattccactagcccaaggttactacagcgaaaacttgattcagagcggagggctagaccacctattccttccgctgagtataacaaaatccaaaggcaatctggagataggaataattcagaaacagtgtcaccccgaagcaaattcagaaggaaacttgtgcgtccacaagaaggtgatgatggcatgcccaatggattgaacaacaggacaaggagcctgaatcagcatggcaatgatatgtccacaaagtcaaatggcaatataagtgttgcttcagagctggatattataagcaatgacagatctgcagaagttaatgtttctaactttgagcaaggcattggaactccatctggaaggaacccacaaaaagtgaaaatctcatatgatgcaagcaaggacgtgccatctgtagaccctttggctgctatttcggaacgacccagtccagtttctgtgttggactcttcatttgatcaggaggatttattccctaccagcaggactccaaattcacttgctgttgatgatgagcgccaaacattagaggcaccctggaaaccttctgatagaaagccaacagaggtcgctatgcagtccaagaacaataaacttgctaatgttgcgagcttgcttgagaagctccagcagcttagcgtgaacaaggatgaggatgcacctccggttgaccatattgctttcttgtgtgagacagaaagcccagaccaccgctatgtgtctgagatactgctggcctcgggtcttctgatgaaagacctaggttcaggacaggcaggtctccagctccactcttctggttacccaatcaacccggacttgttccacgtgttggagcaaagaaaggcaggatgggccagtatacctgatagcatccatcagagcagaagcggcgcaaaatctgatcccaagagagcgcaccggaagctgttgtttgacactgtgaatgagcttctgcttcagaagtttgagaaggaaactgcagtttattcggtcagttcctacaccagagcgaaggatccaccgtctaagactcctagcgggcagcaactgctgaagctcatatcttcaggaatcgaagacctggacatggagcgatcatctatctggcagaaggaaggcagcgtgatacctgatgcagagatcctgcagaggctgcagggatggtcgagcttcagcaaggagttcccagggatggtgctggagatcgaaaggtcgatattcaaggagctggtggacgaggtggtgcatggggagtctgctgacggcccggagatgaaggtggcaggcaggcggagaaggcggctctttgcttgatacggtttgtttgaccatcaccatccaccaggttgtccaagtggatgggcctgatttgtgaagctataactttgtttgttttgccatgagagcccttttcctctaaagagaggtacacaagttgtataagcagcgcagatttgcagagaccagaaaatgggcattccctttgtgctatattaatatgtataccattgctttttgactccttgtgtttcattgtggattcagtcaaagatgttcaaatggcaggtgtttcgtctctcctagtactcaactctgaatgagccactttgtattaaaactgatactgctgttatgatgtagccgttttggtggcagagtctcgcacagctgcaaaacctttttttttaattttttttctgcgattggctgcaaaacctgttgtatgggtagtccgatttaccccc

SEQ ID NO: 3990 - DNA, 4333 bp, Sorghum bicolor
ccaccccacgcggccacgccacgccccacctctctctctctctcgctctctccttcaccttgaggttgagaggaggaggagtagtagtaccactcttccttctgtaactgcagctatcaggagcattatttgacttgccacctcactttaatctccatggttaaagcctccatcttttgccatattttagagattagagtagattagaaaaaggaaggcaacactcattccgtaatcttcctcacacaagtcgcaagtctccacttccttaccgggtcccggccatacgccataggaacaagacacggaaggagaggaggagggcaccggaaatcctgctgctagctggaacctggagggctggagctggacagtgactgagagtgaaaggcagcagcggtcttccccggtggctttggttgatgctcaccgtcagggaggcacgagcacggccatctctccctcccgggcgcgttccctctcgctccggtgaggtccccgaaactcctccggggaatgcggctggacggctacagatgatatcatcttcttcctgacctgctgcaaaggagggagcctcctgcatttccggattcccttgtgcctcctctttccacgagaggggaaggggagccgaacgccggaggatgccggccaagtacctgggcttgggggcgttcgcggaggacaggcgcccggacctccaccgccaggtgggctgcgtcactgggatcttgcaggccttcgaccgccgccaccctctcgcctcttcccacaagaggctccttcctcccccaacagcaacagcaggccatgcactatccagcagcccaagcaaagggggagagtgcacaagatattcaccccagattgttctggagaagaactcgagtaaaacatgggctgacagccaaagagcaccagcaacagaactgtctcaaacctcatattcgtcatcaccctcttcgtcattctcgtcacttgatggcaacaggtcaacacaacaagacctatcatccactgaccgaatgctatttccagagaggccgttcaagagctcgccgaagctcaaaagttcttttgacagtgacaatggactagactatcctgatgatgcgcctaccaagtccaagaacatgcccatagttcaatccagcctgccaactcttggtataagaaatcttgtgaaggattcaatctataaggatagccgtgaattgtcagtgagaatttgcactgaagaagaagtaaaagatcacccatccaactgtggagatcaacctaggcaattgaatgggcctccccatgacagtacacaaggaaaaagcaagggtctcgtggatatcaacgaatcgcttcgagtgctagctaagctcagggaagcttcatggactcctcccgaatctgcccatcatgcaagactttcatatgatgctcctcggttctcatacgatgggaaggaagcagcatcaaaactgagggaggtaccaaggttgtcactggacatcaaggaaggtcacctttggaatcgtgaaattgactctagatcaaacccacgttctgcagatagaagcagcaacactgttactgggtccaatgcagctatcgagacccaacaggaacagcctgcctgcaagcggcttcctagcgttgttgcaaagcttatgggtttggaagagttgcctgagcataatcaaagtacagcatcatcacatgcatggaaaaccgttcaagagagcaagcaagatgcaatgtttaacccctcgagcatctcatcccacgatgagcatgctcttcgacaacaaagaaatcatgattcaactgcaagaaatttacccaactcaaagtttcctgttgaaactgcaccatggaagcaacaagaaaggattgtccttcctcgaagactgccaaagggatcaaaaggagcccatgcaagagaacaacctgctgcatcagtcttcagtgacatagagaagcggctcaaggatcttgattttcaacaatcgaacaaggaccttagagcgcttaaacagattttggattccatgcaagcaaaaggactattggaaaacaagaaacgggaagaagcatctatgccaaagttatatgatggaaaccatgatggccaagaggtagccggtgtgaacatgagactgaacactaacaccaacaacatgtggatgcctgaagagaacaacgcggaaagctctttcaaatcgcctattgtgatcatgaaaccttcaaaatctgcaaaccttttcagcgaagtggattcttctgtcttcccattagggggtccatctgatcccacacagctgcaaacaagcaatagcactgatagaaggaaagcttcaatgatcaatagaacagctaaagagcaacatgcgaaatttagtcaaaaggtgcctacttctcaaccccttgtttcttatgacaggagatcatatggaaggaatgacgatagcagcaacaaccaaaaatctagttcactgctggttactgagagctcatccagaagacagcagctgccaagagacggtagcataagtatgcaaaagaataaaaattccactagcccaaggttactacagcgaaaacttgattcagagcggagggctagaccacctattccttccgctgagtataacaaaatccaaaggcaatctggagataggaataattcagaaacagtgtcaccccgaagcaaattcagaaggaaacttgtgcgtccacaagaaggtgatgatggcatgcccaatggattgaacaacaggacaaggagcctgaatcagcatggcaatgatatgtccacaaagtcaaatggcaatataagtgttgcttcagagctggatattataagcaatgacagatctgcagaagttaatgtttctaactttgagcaaggcattggaactccatctggaaggaacccacaaaaagtgaaaatctcatatgatgcaagcaaggacgtgccatctgtagaccctttggctgctatttcggaacgacccagtccagtttctgtgttggactcttcatttgatcaggaggatttattccctaccagcaggactccaaattcacttgctgttgatgatgagcgccaaacattagaggcaccctggaaaccttctgatagaaagccaacagaggtcgctatgcagtccaagaacaataaacttgctaatgttgcgagcttgcttgagaagctccagcagcttagcgtgaacaaggatgaggatgcacctccggttgaccatattgctttcttgtgtgagacagaaagcccagaccaccgctatgtgtctgagatactgctggcctcgggtcttctgatgaaagacctaggttcaggacaggcaggtctccagctccactcttctggttacccaatcaacccggacttgttccacgtgttggagcaaagaaaggcaggatgggccagtatacctgatagcatccatcagagcagaagcggcgcaaaatctgatcccaagagagcgcaccggaagctgttgtttgacactgtgaatgagcttctgcttcagaagtttgagaaggaaactgcagtttattcggtcagttcctacaccagagcgaaggatccaccgtctaagactcctagcgggcagcaactgctgaagctcatatcttcaggaatcgaagacctggacatggagcgatcatctatctggcagaaggaaggcagcgtgatacctgatgcagagatcctgcagaggctgcagggatggtcgagcttcagcaaggagttcccagggatggtgctggagatcgaaaggtcgatattcaaggagctggtggacgaggtggtgcatggggagtctgctgacggcccggagatgaaggtggcaggcaggcggagaaggcggctctttgcttgatacggtttgtttgaccatcaccatccaccaggttgtccaagtggatgggcctgatttgtgaagctataactttgtttgttttgccatgagagcccttttcctctaaagagaggtacacaagttgtataagcagcgcagatttgcagagaccagaaaatgggcattccctttgtgctatattaatatgtataccattgctttttgactccttgtgtttcattgtggattcagtcaaagatgttcaaatggcaggtgtttcgtctctcctagtactcaactctgaatgagccactttgtattaaaactgatactgctgttatgatgtagccgttttggtggcagagtctcgcacagctgcaaaacctttttttttaattttttttctgcgattggctgcaaaacctgttgtatgggtagtccgatttaccccc

SEQ ID NO: 3991 - DNA, 3852 bp, Zea mays
tgctagctggaggggctgtagctggacagtgactgagagtgagaggcagcagcggtccggtggctggcctccttgctggatgctcgccgtcagggaggtacgacgagcacgaccgcctctccctcccgggagcgttccctctccggcgaggtccctcctccgggaaatgcggcggggcagttacaaatgacatcttcttcttcttctccttcgtaacctgctgcaaaggagggcaacctcctgcatttccgggttctctttccacgagaagggaagggggaaccggaggatgccggccaagtacctgggggcgttggcggaggacaggcgcccggatctctatcgccaggtgggctgcgtcaccgggatcttgcaggccttcgaccgccgccaccatctcgcctcctcccacaagaggctcctccccccaacaggccatgcacccagcaatccaagcaaagggggagaatgcacgagatattcaccccaggttgttctggagaagaactcgagtaaaacttgggctgatagccaaagagcaccagcaacagaactatctcaaacctcatattcatcatcaccctcttcgtcattctcatcccttgatggcaacaggtcaacacaacaagacctatcatccactgaccgaatgctatttccagagaggccgtttaagagctcgccgaagctcaagagttcttttgacagtgacaatggactcgactaccctgatgatgcgcttaccaagtccaagaacatgcccatagttcaatccagcctgccaactcttggtataagaaatcttgtgaaggattcaatctacaaggatagccatgaattgtcagtcagaattagcactgaagaagaagtaaaagatcacccatccaactgtggagatcaacctatgcaattgaatgggcctcaccatgacagtacacaaggaaaaagcaagggtctcatggacatcaacgaatcgcttcgagtgctagccaagctcagggaagcctcgtggactcctcctgaatctgttcatcatgcaagactctcatatgatgctcctcggttctcatacgatggaaaggaagcaacatcaaaattgagggaggtaccgaggttgtcattggacatcaaggaaggtcacctttggaatcgtgaaattgactctaggttggacccaagcttgagttctgcagacagaaacagcaacactgttactgggtccaatgcagctttcgagacccagcaggaacagcctgcctgcaagcggcttcctagcgttgttgcaaagctcatgggtttggaagagttgccagagcataatcaaagtacagcatcatcacatgcatgcaataccgttcaagagaacaagcaagatgccatgttgaactccttgagcatctcctaccagtacgagcatgctcctcaacaagaaaggaatcctgattcaactgtaagaaatttacccaactctaagttccctgtccaaactgcaccatggaagcaacaagaaaggattgtccttccacgaaaactgccaaagggatcaaaaggagcccacggaagagaacctgctgcaccatggaaccagctgaaggatcttgattttcagcaaccaaacaaagaccttagagcacttaaacagattttggattctgcaaaaggactattagaaaataagaaacgggaggaagcatttatgccaaagctatataatggaaaccatgatgaccaagagatggccagtgcgaacatgagactgaaccgtaacaccaacaacatgtggatgcctgaagagagcaacgctgaaagctctttcaaatcgcctattgtgataatgaaaccttcaaaatctgcaaacctttacagcaaagtggattcttctgtcttcccattaggaggttcatctgatctcccacagccacaaacaagcaatagcactgatagaaggaaagcttcaacgattaatagaaccgccaaagggcaatatgcgaaattgagtccaagggtgcctacttctcaaccccttgtttcttgtgacaggagatcatatggaaggaatgatgatagcagcaacaaccaaaaatctagttcactgctggtcactgagagctcaaccagaagacagcagctgccaaggaatagtagcgtaagtatgcaaaagaacaaaaattccactagcccaaaattactacagagaaaacttgatccagagcggagggctagaccacctattccttctgctgagtctaacaaaagcgaaaggcaatctggagataggaacaattcagaaacagtgtcaccccgaagcaaattcagaaggaaacttgtgcgcccacaaggtgatgatggcatgcccattggattgaacaacaggacaaggagcctgtatcagcatgacaatgatatgtccataaggtcagatggcagtataagtgttgcttcagagctggatattataagcaatgacagatctacaggagttaatatttctaactttgagcaaggcattggaactccatctggaaggaacccacagaaagtgaaaacctcatacgatgcaaatatggacgtgccatctgtagacccttcagctgctatttcggaacggcccagtccagtttctgtgttggactcttcatttgatcaggaggatttgttccctaccagcaggactccaaattcacttgctgttgatgatgagcgcgaaacattagaggaaccctggaaaccatctgtcgctatacagtccaagaacaataaactcgcaaatgttgcgagcttgcttgagaagctccagcagcttagcgtgaacaaggatgaggatgcacctccggttgaccatattgctttcttgtgtgagacagagagcccagaccaccgctacgtgtctgagatactgctggcctccggtcttctgatgaaagacctaggttcaggacagacaggtctccagctccactcctctggctacccgatcaaccctgacttgttccacgtgttggagcaaaggaaggctggatgggtcagtacacctgatggcatccatcagagcagaagcggcacaaaatctgatcccaggagagcgcaccggaagctgatgtttgacactgtgaatgagcttctccttcagaagtttgagaaggaaaccgccgtttatgcgctcagttccttcaccagagcgaaggatccacctgcaaagacttttagcgggcaacagctgccgaagttcatatcttcgggaattgaagaactggatatggagcgatcgtccatcagccagaaggacagcagcgtgatacctgatgcagagatcctgcggaggctgcagggatggacgagcttcagcaaggagctcccggggatggtgctggagatcgaaaggtcgatattcaaggagctggtggacgaggtggtgcatggggagtctgctgacggcccggagatgaaggctgctggcagacggagaaggcggctctttgcttgatacggtttgtttgaccatcgccatccaccatttggatgggcctgatttgtgaagctgtaactttgtttgtcttgccatgagagtgagaccctatttcatctcaagagaagagggagagagagggggtagcgcagatttggtgagagacccgaaaatgggcattcgttcgtgctatatatagatactatgtataccattgtttcttgactccttgtgatttactgtggatgatgctatttcagtaaaaaaaatggacgaatgacagttgttttttgccatgtaaaaggcaaattatatacgatgatgagtagaccactatgttgtatgatgcataatatttatctataaaaaagataacatgttcagca

SEQ ID NO: 3992 - DNA, 4041 bp, Setaria italica
gccttcctcaccagtcttcttccccttccctcccggccataggaacaggacaggaaatcttggcaccctgctagcttggaggctggagttgggcagtgagtgagagtgagaggcagcactggtgcctggccttcgtgatcggttgatgctcgccgccagggaggcacgagcgtctccccctcccgggagcgtctccggtgaggtcccccacctccgcctccgggaaacgcggcgggactgccacagatgacgtcttctcctctttgacctgctacctgctactaccgaggaggcagcctcctgcatttccggattcccttgcgcctcctccgcttgctacctctttcttgaggccgcagcggcgagaggggaagggggagccggaggatgccggcaaagtacctgggggcgttggcggaggaccggcggccggacctccaccgccaggtgggttgcgtcaccgggatcctgcaggcgttcgaccgccgacacccgctcgcctcctcccacaagaggctccttcccccaacagcaggccatgctctgtccagcagcccaagtgtagggggagactgcacaagattttcaccccagattgtcctcgagaagaactcaagcaaaacctgggctgacaaccagagagcaccagcagcagaactgtcacaaacttcatattcatcgtcaccatcttcatcattctcctcccttgatggaaacaggtcaactcaacaggacctatcatccactgatcgaatgctatttccagagaggcctttcaagtgctcgccaatgctcaagagctcttttgacagtgagaatggactcgactaccctgatgatgttcttaccaagcctgataacatgcccacagctcaatccagcctgccaactctaggtataaaaaatcttgtgaaggattcaatctataaggatagccgtgacttgtcagtcagagtttgtaatggggaagaagtaaaagatcacccattcaactttggagatccatccaggcaattggatgggcctccccgcgacagtacccaaggaaaaagcaagggtctcatggacatcaacgaatcgcttcgagtgctagccaagctcagggaagccacttggactccttctgaatcaggccatcatgcaagactttcatatgatgctcctcggttctcatacgatggtaaggaaccagcatcaaaactgagggaggtaccaaggttgtcactggacatcaaggagggtcaccattggaatcgtgaaatgaactctagatcgaagccaagcttgagttcttcagaccgaagcagcagcaatgctactgggtccaatgcagccttggagactcagcaggaacagccagcctgcaagcgtcttcctagtgttgttgcaaagctcatgggattggaagagttgccagagcgtagtgaaagtacagcatcattgcaggcatgcaaagcagtcaaagagagcaaagaggctacgttgaatcccttgagcatctcatcccacaacgagcctgctcctcgacaacaaaggaatcaggattcaacagtaagaaatttacccaactctaagtttcctgttgaaactgcaccgtggaagcaacaagaaaggattgtcctgcctcgaaaaccaccaaggggatcaaaaggagcccatggaagagaacctgttgcatcagtcttcagcgacatagagaaacggctcaaggaccttgattttcagcaatcaaacaaggatcttagagcccttaaacagatcttggattctatgcaagcaaaaggactgttggaaaacaagaaacgggaagaagcatctatgtcaaagctatatgatggaagccatgatgaccaagagacgaccaatctgaacacgagactgaacagtaacaccaactccatgtgggtgcctgaagagagtaatgcagaaagctcttttaaatcgcctattgtgatcatgaagccttcaaaatctgcaaacctttacagcgaagtggattcttctgtcattccattagggggttcatctgatcttccacagctgcaaacaggcaatagcactgataaaaggaaagcttcaacggtcaataggacagctaaagagcagcatgcgaaatggagtcctagggtccctacttctcaaccccttgtttcttatgacaggaaatcaaatggaaggaatgatgatagcagcaacaagcaaaaatctagttcactgctggttactgagagctcatccagaagacagcagctgccaagagacagtagcataagtttgcaaaagaataaaaattccactagcccaagattactacagagaaaacttgattcagagcggagggctagaccgcctgttccttctgctgagtctaacaaaagccaaaggcaatctggagataggaataatttggacactgtgtcaccccgaagcaaattcagaaggaaacctgtgcgtgcacaggaaggcgatgatggcatgcccaatggattgaataacaggacaaggagcctgaatcagcaaggcaatgatatgtccacaaggtcagatggcagtatgtgtgttgcttcagaggtggatatagaagttataagcaatgacaggtctacagaagtgaacgtttctaactttgagcaaggcaatggaactccatcaggaaggaatacacaaaaagtgaaaacctcatatgatgcaagcaaggacgtgtcatctgtagacccttccgccgctatctctgaacggccaagtccagtttctgtgttggaccctttgtttgatcaggaggatttgtttccttccagcaggacttcagattcacttgctgctgatgatgagcaccatacatcagaggaaccatggaaaccttctgatacaaagctaagagaggttgctatgcaatccaaaaacaataagctcgctaatgttgctagcttgcttgagaagctccagcagcttagcgtgaacaaggatgaggatgcccctccagttgaccacattgctttcttgtgtgagacagaaagtccagaccaccgttacgtgtctgagatactactggcctcaggccttctgatgaaagacctaggttcaggacatgcagggctccagctccacccttctggctacccaatcaaccctgacctgttccacgttttggagcaaagaaaggcaggatgggtcagtaaacctgatggtatccatcagagcagagtgaaatgtgatcctaagagagcgcaccggaagctgatgttcgactctgtgaatgagattctccttcagaagtttgagaaggaaactgcagtttattcagccagttcattcactagagcgaaggatctacctgcaaagactcttagtgggcagcaacttgtgaaattcgtatcttcaggaatcgaagacctggagatggagcaatcacggatctgccagaaggaaggcagtgtgatacctgatgcagagatcctggagaggctgcagggatggacgagcttctgcagggagctcccggggctggtgctggagatcgagaggtcagtgttcaaggagctagtcgacgaggtggtgcacggtgaatctgctgatggcccactgatgaaggcagcaattaggcggagaaggcgtctctttgcgtaatgcggtttggttgaccatatcaccattcaccatgttggcgaagtggatgcacatgatctgtgaagttgtaactttgtttgctatgagagctttttcctctgaagagaggaggtatagaagtttttgtctaagcagcgcagattgcagagacctggaatgggcattcatttgtgctatgtagatacttgtataccagtttttttttttgactcttggtttattgggatgatgctatttcagttggaaaaattacaaattacatgttttcctaatgggaacgtatgtggtgcaaaccaaacaccccatgtaaccttggaaactacaaataagagccactagatgctaatccaatggatagagtgaggggtaggattattttatgcttaagtcccccacctacttgccactttttgc

SEQ ID NO: 3993 - DNA, 422 bp, Saccharum officinarum
gcaaaaactaaggtctgcttcacctcgcttcaggttcatgttttgagcgtgttaccagattatatccagtgcatgatttcagaaatggggacgctgccatgcccatggagatctggccacctctttgctttcatcaccttcgccttgttgttctcgacttcatttgctgggagacactacagtttcttgacggatcaagatgccctacgtcaacaaggagaggcagcacgaactgaacagaaggaaccactagtgccactggtgcaagctcggaggctcaacgtcaagacgaatgattacagcagctatgacccttcgccgtccatggacaagccacactccaagctcataccgaactgatcaatcatgtatatccaggttgcagcaatggagttgccgatgaggaatttaacagcttaaat

SEQ ID NO: 3994 - DNA, 758 bp, Sorghum bicolor
agcagaaagaatgacagcctgacactctgcccacagaaaattctcaaatccccttcccttggaacttgttcagacaaagtgggattagcatctattgcctagctgagtggttatatagtaggctgctggggccatagaaaggtggggcgaaaactaaggcctgcttcacctcaccttgcctcatgttcatgttttgagcgtgttagcagagtgtttccagtgcatgacttcagaaatggggacgctgccatgcccatggagatctggccacctctttgctttcatcaccttcgccttgttgttctcgacttcatttgctgggagacactacagtttcttgacggatcaaggtgccctacgtcaacaaggagaggcagcacgaaaggaagcactagtgccattggtgcaagttcggaggctcaacgtcaagacgaacgattacagcagctatgacccttccccgtccatggacaagccacacttcaagctcataccaaactgatcaatcatgtatatccaggttgcagcaatggagttgccgatgaggaacttaattaacagcttaaatgtgtgcctgatttataaatacagaggcattactaggcttgcttaaactgttcccataacatttaatatcttattatagatgtgatatatagatgtttgcttcttctttgcactgatatatagtcacaggctttgttgtggtactactgaatcacttggaggcatctctaaagaacgattcctgcaccaaa

SEQ ID NO: 3995 - DNA, 1421 bp, Sorghum bicolor
agcagaaagaatgacagcctgacactctgcccacagaaaattctcaaatccccttcccttggaacttgttcagacaaagtgggattagcatctattgcctagctgagtggttatatagtaggctgctggggccatagaaaggtggggcgaaaactaaggcctgcttcacctcaccttgcctcatgttcatgttttgagcgtgttagcagagtgtttccagtgcatgacttcagaaatggggacgctgccatgcccatggagatctggccacctctttgctttcatcaccttcgccttgttgttctcgacttcatttgctgggagacactacagtttcttgacggatcaaggtgccctacgtcaacaaggagaggcagcacgaaaggaagcactagtgccattggtgcaagttcggaggctcaacgtcaagacgaacgattacagcagctatgacccttccccgtccatggacaagccacacttcaagctcataccaaactgatcaatcatgtatatccaggttgcagcaatggagttgccgatgaggaacttaattaacagcttaaatgtgtgcctgatttataaatacagaggcattactaggcttgcttaaactgttcccataacatttaatatcttattatagatgtgatatatagatgtttgcttcttctttgcactgatatatagtcacaggctttgttgtggtactactgaatcacttggaggcatctctaaagaacgattcctgcaccaaaccaggccatctcattgggccacgttacctggttttccttcatccgtaagattccaaaggaacggtcctcgagcgttttagcgtcgcactgttctcgagcgttttagcgtagcctctgtatacaggctggttccaaaggcttcgtgaagcctctggtaaatcccggacagtagatatattttttaccctgtcgttccctcttctcttccattcactgctatttctttctcatctcttccaccgtcacgaacgcagagaagaccactccagtcaatcgaaagagatggtcgatactcttgaaggaaagtgatagatggaaggtgctgcaagcgaaggacggtttgatctgctggatgaggagttttgatccaagcttagtgatgtccacagatgtgttcgagctttgatattttggtttagactgtggctttgtaatagactctgtttagtatcctttggttcattgagatactggcttcccagtttgtatccaaacttggtgctttataaaagcagaggttttctctttaaaaaaaatctttcctcttgattccttgcgttattggtcttctgtcctttatgccttattttcaagcttatatataaaataagaactcgagtgatttgttcgttcaagaaaagtatcttatttattagtgtgccc

SEQ ID NO: 3996 - DNA, 795 bp, Saccharum officinarum
tcgaagcagaaagcatgtgacagcctgacactctgaccacagaaaattctcaaatcccctttcccttggaacttgttcagaggaagtgggattagcatctgttgcagactagagattgcccagctatatattaggctgccgtggccaaagaaaggtgaggcaaaaactaaggcctgcttcacctcgcttcaggttcatgttttgagcgtgttaccagagtatatccagtatatgatttcagaaatggggacgctgccatgcccatggagatctggccacctctttgctttcatcaccttcgccttgctgttctcgacttcatttgctgggagacactacagtttcttgacggatcaagatgccctgatgcgtcaacaaggagaggcagcacgaactgaacagaaggaaccactagtgccactggtgcaagctcggaggctcaacgtcaagacgaatgattacagcagctatgacccttcgccgtccatggacaagccacacttcaagctcataccgaactgatcaatcatgtatatccaggttgcagcaatggagttgccgatgaggaatttaacagcttaaatgcgtgcctgatttataaatacagaggcactcctaggcttgcttaaactgttctcatgacatttaatatcttaatataaatgtgacataagagtttgcttcttctttgattgagaccgaacccccaagctctttgtggggacctcccgagacactttgggcccatcctttaattagaaggtaatattttgtgtccttttttaggaggaacgt

SEQ ID NO: 3997 - DNA, 412 bp, Triticum aestivum
acgctgccatgcccatggagatctggccacctctttgctttcatcaccttcgccttgttgttctcgacttcatttgctgggagacactacagtttcttgacggatcaaggtgccctacgtcaacaaggagaggcagcacgaaaggaagcactagtgccattggtgcaagttcggaggctcaacgtcaagacgaacgattacagcagctatgacccttccccgtccatggacaagccacacttcaagctcataccaaactgatcaatcatgtatatccaggttgcagcaatggagttgccgatgaggaacttaattaacagcttaaatgtgtgcctgatttataaatacagaggcattactaggcttgcttaaactgttcccataacatttaatatcttattatagatgtgat

SEQ ID NO: 3998 - DNA, 2166 bp, Sorghum bicolor
cctgccacgccacggcctcgctcaccagctagccgcacaaacagaaacagacgcactcgcccgccgcgccacgcaacacagccccgtcccggccgtccaacacctctcccatctgctctccctccctctccatggccaccacgctgacggcgctgctcaaggaggcggcggccgccttcccggcccgccgcgccgtcgccgtcccgggtaagctggagctcacgcacgccgccctcgacgcgctcgtcgacgcggcggccgcgcgactcgccgtcgacgccggagtcctcccgggccacgtcgtcgcgctcgctttccccaacaccgtcgagctggtgatcatgttcctggcggtcatccgcgcgcgcgccgtggcggcaccgctcaacccggcctacacgcaggaggagttcgagttctacctctccgactcggaggcgcgcctcctgatcaccaacgccgagggcaacgcggcggcgcaggcggcggccgccaagctcgggctcgtccacgccgccgcaaccctccacgacgcggccggcccggtccacctcgccggcctcccactggccttggcgaacgggaacggaaccaagagcaacgggtcgcaccaaggcggcgcggcggagggctctcccaacgacaacgacccgtcggacgtggcgctgttcctgcatacctccggcacgacgagccggcccaagggcgtccccctgacgcagcgcaacctggcggcgtcggtgcggaacatccggtccgtgtaccggctgtccgagtccgacgccacggtggtggtgctgccgctgttccacgtgcacgggctcctctgcgcgctgctgagctcgctggcgtcgggcgcgtccgtggcgctcccggcggcggggcggttctcggggtccacgttctgggccgacatgcgtgcgtcgggcgccacgtggtacacggcggtgccgacgatccaccagatcatcctggaccgtcacgcgtcgcggccggaggcggagggatatccggcgctgcggttcatccgcagctgcagcgcgtcgctggcgccggcgatcctggagcggctggaggcggcgttcggcgcgccggtgctggaggcgtacgcgatgacggaggcgtcgcacctgatgacatcgaacccgctgcctgaggacggtgcccggaagcccgggtcggtggggcgcgccgtcgggcaggagctggcggtgctggacgaggaagggcggcgcgtggcggcggggagccccggggaggtgtgcatccgcggggacaacgtgacggccgggtacaaggggaacccggaggcgaacgaggcggcgttccggttcgggtggttccacacgggggacatcggcgtggtggacgaggaggggtacgtccgccttgtggggcggatcaaggagctcatcaaccgcggcggggagaagatctccccgatcgaggtggacgccgtgctgctgggcgcccccggcgtggcgcaggccgtgtcgttcggggtgcccgacgacaagtacggggaggagatcaactgcgcggtgatcccgcgggacgggtcggcgctccgggaggaggaggtgctggcgcactgccggcggaacctggcgtcgttcaaggtgcccaagaaggtgttcatcaccgacgaccttcccaagacggccaccggcaagatacagcgccgcatcgtggcgcagcacttcgtgcagccggccagtgcctgaccgatcgaggatccttttcgtgttgctgcaccctgggggtgtcggattgggatttcgctagcggtttgccgttgttgtcgcattgttgcgaggtggacatggcctggacctggaatgacccagaataaacaagacaacgcaagcatccggctctctgtatcgatcgtcgtgttttgttctttctggtcagtgcgcgtgtcggctcatctcctgttgtttaccggatggcatggcgccaaacaatcggcggcaagtgtcaggtcaggcgtgcattgattttgttttttttttcctttaccgggtgatttggtcccgtggtaacgtggcatattttggagcgtactactagccacacctcctagaaagattacaattctaaggaagattattttaaattggaccgaataaattcgtataaaaatgatactgatgtttattgttc

SEQ ID NO: 3999 - DNA, 2459 bp, Sorghum bicolor
gtccaccctctgcaaggcacgccgattccgccggcagcagaaaaacctccccgagtagtccactgtttgtaggcgcacctgcagagggagagggctgctctgctctgctctgcagtgggccgcgcaggcgcagcggcaaccaaaatcagacacggattcgcaccacctaaccgtcgctgacgaagcaacccgccggccgtataaatacgcaccgcctggcgcctgccacgccacggcctcgctcaccagctagccgcacaaacagaaacagacgcactcgcccgccgcgccacgcaacacagccccgtcccggccgtccaacacctctcccatctgctctccctccctctccatggccaccacgctgacggcgctgctcaaggaggcggcggccgccttcccggcccgccgcgccgtcgccgtcccgggtaagctggagctcacgcacgccgccctcgacgcgctcgtcgacgcggcggccgcgcgactcgccgtcgacgccggagtcctcccgggccacgtcgtcgcgctcgctttccccaacaccgtcgagctggtgatcatgttcctggcggtcatccgcgcgcgcgccgtggcggcaccgctcaacccggcctacacgcaggaggagttcgagttctacctctccgactcggaggcgcgcctcctgatcaccaacgccgagggcaacgcggcggcgcaggcggcggccgccaagctcgggctcgtccacgccgccgcaaccctccacgacgcggccggcccggtccacctcgccggcctcccactggccttggcgaacgggaacggaaccaagagcaacgggtcgcaccaaggcggcgcggcggagggctctcccaacgacaacgacccgtcggacgtggcgctgttcctgcatacctccggcacgacgagccggcccaagggcgtccccctgacgcagcgcaacctggcggcgtcggtgcggaacatccggtccgtgtaccggctgtccgagtccgacgccacggtggtggtgctgccgctgttccacgtgcacgggctcctctgcgcgctgctgagctcgctggcgtcgggcgcgtccgtggcgctcccggcggcggggcggttctcggggtccacgttctgggccgacatgcgtgcgtcgggcgccacgtggtacacggcggtgccgacgatccaccagatcatcctggaccgtcacgcgtcgcggccggaggcggagggatatccggcgctgcggttcatccgcagctgcagcgcgtcgctggcgccggcgatcctggagcggctggaggcggcgttcggcgcgccggtgctggaggcgtacgcgatgacggaggcgtcgcacctgatgacatcgaacccgctgcctgaggacggtgcccggaagcccgggtcggtggggcgcgccgtcgggcaggagctggcggtgctggacgaggaagggcggcgcgtggcggcggggagccccggggaggtgtgcatccgcggggacaacgtgacggccgggtacaaggggaacccggaggcgaacgaggcggcgttccggttcgggtggttccacacgggggacatcggcgtggtggacgaggaggggtacgtccgccttgtggggcggatcaaggagctcatcaaccgcggcggggagaagatctccccgatcgaggtggacgccgtgctgctgggcgcccccggcgtggcgcaggccgtgtcgttcggggtgcccgacgacaagtacggggaggagatcaactgcgcggtgatcccgcgggacgggtcggcgctccgggaggaggaggtgctggcgcactgccggcggaacctggcgtcgttcaaggtgcccaagaaggtgttcatcaccgacgaccttcccaagacggccaccggcaagatacagcgccgcatcgtggcgcagcacttcgtgcagccggccagtgcctgaccgatcgaggatccttttcgtgttgctgcaccctgggggtgtcggattgggatttcgctagcggtttgccgttgttgtcgcattgttgcgaggtggacatggcctggacctggaatgacccagaataaacaagacaacgcaagcatccggctctctgtatcgatcgtcgtgttttgttctttctggtcagtgcgcgtgtcggctcatctcctgttgtttaccggatggcatggcgccaaacaatcggcggcaagtgtcaggtcaggcgtgcattgattttgttttttttttcctttaccgggtgatttggtcccgtggtaacgtggcatattttggagcgtactactagccacacctcctagaaagattacaattctaaggaagattattttaaattggaccgaataaattcgtataaaaatgatactgatgtttattgttctaagaaaaatagcgtgttttataactttcatctaagaaaaatagccacacctcgactagggccttgtttagt

SEQ ID NO: 4000 - DNA, 1911 bp, Setaria italica
ggcgccaaccgaacaaacaacctcgccccccgcaccacgcaacagcacacgaaccccacgcgcaaaacaaaacaatggcggaggaggcccccactctgacggcgctgctcaagaaggcggccgccgccttcccgtcccgccgcgccgttaccgtcccggggaagctcgagctcacgcacgccgccctggacgcgctcgtcgacgcggcggccgcgcgcctggccgccgacgccggggtccgccccggccacgtggtcgcgctctccttccccaacaccgtcgagctggtgatcatgttcctggcggtcatccgcgcccgcgccgtcgcggcgccactcaacccggcctacacgcaggaggagttcgagttctacctctccgactccgagtcacgcctcctcctcaccaacgccgagggcaaccccgccgcgcaggcagccgccgccaagctcggcctcccccacgccgccgccaccctcaaggacgcggccggcccggtacacctccacggcctcgcagccgccaacgcggccaacgggaacggcttccaccaagaaaaagacgaccacaacgaggcgtcggacgtggccctgttcctgcacacgtcggggaccacgagccgtcccaagggggtgccgctcacgcaggccaacctggcggcgtccgtcgggaacatccgctccgtgtaccgcctcgccgagacggacgccaccgtggtggtgctgccgctcttccacgtgcacggcctcctctgcggcctcctcagctcgctggcctccggcgcctcggtgaggctccccgccgccgggcgcttctcagcgtccaccttctgggccgacatgcgcgcggcgggcgccacgtggtacacggccgtgccgacgatccaccagatcatcctcgaccgccacgcgtccaagccggaggcggcggggtacccggcgctgcggttcatccgcagctgcagcgcgtcgctggcgccggtgatcctggagaagctggaggcggcgttcggggcgccggtgctggaggcctacgcgatgacggaggcgtcgcacctgatgacgtccaacccgctgccggaggacgggccgcggaagccgggctcggtggggcgtcccgtggggcaggagatggcgatcctggacgaggaaggggcgcgcgtggcggcagggaagcccggcgaggtgtgcgtccggggcgccaacgtgacggcgggatacaagggcaacccggaggcgaacgaggcggcgttccggttcgggtggttccacacgggggacatcggcgtcgtcgacgaggaagggtacctccacctggtggggcgcatcaaggagctcatcaaccgcggcggcgagaagatctctcccatcgaggtggacgccgtgctgctggaccaccccgccgtcaagcaggccgtctccttcggcgtccccgacgacaagtacggcgaggagatcaactgcgcggtgatcccccgcgagggcttggtgatcggggaggacgacgtggtggcgcactgccggaagaacctggcgtcattcaaggtgcccaagaaggtgttcgtcaccgatgacctgcccaagacggcgacaggcaagatacagcgccgcatcgtggcgcagcacttcgtcgtgcagcccaaggccggtagcgctgcctaactagtgcgcgcgtcgccgtgtgtattttcatttgctccctccttccggcatagtgaaaggtccagataatccaaattgtgttctggctcaatgtacctcctaaactatgttatttggtacaacttacttcataacgcaatttgcatttttttctctccacacacaagttgaatgctattaccgctttcgtttcgagcaactccaatatattgagaaaaaatatcctctttcctacgattctcaacagatt

SEQ ID NO: 4001 - DNA, 765 bp, Saccharum officinarum
cgtcttgtctcgctgtatcggccgatctccccatccctcctcccctcttcgtcgatcccaccaccgcgccgaccccgcgatggcctccgccgcctcatcggccgccggcgctggcaaatcgctgttccaggggctccgcaggttcctcaagaagccgtgggagatcacgggcccctgcgcctcgcccgagtaccgcagcgcgctgcctgacgcgctcgagtaccgcgtcaagtgcccggccaccgtgcgcgacgaccgcgacaaggccatcgtgcccacatccgacccggagacagtctacgacatcaaatacttcacccgcgaccgccgccggaaccgcccgcccgtgcggcgcaccctgctccgcaagcccgaactcgagcgctacatggccaccaagcagttcgaccccaccaaggacttccccgtgccgtacgtgaacaccaccgtcgaggaggacgacaacacggtcggcggtggctaccagaagtgactcaggaaagcttgctgatttgatgctggttaatttgtcaggcatccattgcttggactccatcagaagctgcactattttttattccagctattaaatatccttttcttttgttccaagtggaagttttctggttgtaaaagatgatggtggcaataatatggcacttgtggagctcacaggatgcacatatcttgtaacttgtattctaaaactgtctacctgataccaatgttactgtttaatgcaaaatttaagatttctattccaac

SEQ ID NO: 4002 - DNA, 813 bp, Zea mays
gccatttggtgcggcccatgttctcgcccaacagaaacctgagcccattgccatttccagcgtctcgtctcgctgtatcgttcggtctcccacccctttcccctcttcgtcgatctcaccaccgcgccgaccccgatggcctccgccgcctcatcggccgccgccgctggcaaatcgctgttccaggggttccgcaggttcctcaaaaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgatccggagacagtctacgacatcaagtacttcacccgcgatcgccgccggaaccgtccgcccgtgcgccgcaccctgctccgcaagcccgacctcgagcgctacatggtcaccaagcagtttgaccccaccaaggacttccccgtgccatacgtcaacaccactgtcgaggaggacgacaacacggtcggcggtggctaccagaaatgatccaggaaagcttactgatttgatgctggttaatttgccaggcatccttgttgtgcttggactccatgagcagctgcacaaatttcgtttcagctttcaaatatctcctttttctgcaagttttctggttgtaaaagatgatggtggcaataatatggtacttgagctcacaggatgcacatttcttgtaacctgtattccaaaactttatctacctgaaaccatagttactgtttaagaataaccaaaggttttctaatgtgc

SEQ ID NO: 4003 - DNA, 854 bp, Sorghum bicolor
gccgtttggtgcggcccacgttatcgcccagcagaaacccgagcccatcgccatttccagcgtctgtcttgtctcgctgcgctgtatcggccgatctccccatccctctcctcccctcttcgtcgatcgatcccaccaccgcgccgaccccgatggcctccgccgcctcatcggccaccggcgctggcaaatcgctgttccaggggctccgcaggttcctcaagaagccatgggagatcacggggccctgcgcctcgcccgagtaccgcagcgcgctgcctgacgcgctcgagtaccgcgtcaagtgcccggccaccgtgcgcgacgaccgcgacaaggccatcgtgcccacatccgacccggagacagtctacgacatcaagtacttcacccgcgaccgccgccggaaccgcccgcccgtgcggcgcaccctgctccgcaagcccgagctcgagcgctacatggccaccaagcagttcgaccccaccaaggacttccccgtgccgtacgtcaacaccaccgtcgaggaggacgacaacacgatcggcggtggctaccagaagtgactcaggaaagcttgctgatttgatgctggttaatttgtcaggcatcctttgcttggactccgtcagaagctgcactattttgattccagctattaaatatccctttttcttttattccaagtggaagtttactggttgtaaaagatgatggtggcaataatatggcacttgtggagctcacaggatgctcatatcttgtaacttgtattctgaaactgtctacctgatacaaatgattctgtttgatgcaaaatttaagatttctattccaatgtgcacatcatctcc

SEQ ID NO: 4004 - DNA, 985 bp, Sorghum bicolor
aatattctgggaatactgtatcgctgccgagcgtggggacggctcctgggctcccgttccggcctgccttttgatcggcatgggctgggccagctcgacacgccgtttggtgcggcccacgttatcgcccagcagaaacccgagcccatcgccatttccagcgtctgtcttgtctcgctgcgctgtatcggccgatctccccatccctctcctcccctcttcgtcgatcgatcccaccaccgcgccgaccccgatggcctccgccgcctcatcggccaccggcgctggcaaatcgctgttccaggggctccgcaggttcctcaagaagccatgggagatcacggggccctgcgcctcgcccgagtaccgcagcgcgctgcctgacgcgctcgagtaccgcgtcaagtgcccggccaccgtgcgcgacgaccgcgacaaggccatcgtgcccacatccgacccggagacagtctacgacatcaagtacttcacccgcgaccgccgccggaaccgcccgcccgtgcggcgcaccctgctccgcaagcccgagctcgagcgctacatggccaccaagcagttcgaccccaccaaggacttccccgtgccgtacgtcaacaccaccgtcgaggaggacgacaacacgatcggcggtggctaccagaagtgactcaggaaagcttgctgatttgatgctggttaatttgtcaggcatcctttgcttggactccgtcagaagctgcactattttgattccagctattaaatatccctttttcttttattccaagtggaagtttactggttgtaaaagatgatggtggcaataatatggcacttgtggagctcacaggatgctcatatcttgtaacttgtattctgaaactgtctacctgatacaaatgattctgtttgatgcaaaatttaagatttctattccaatgtgcacatcatctccaattagttagtaacttgcatgtgatctctt

SEQ ID NO: 4005 - DNA, 759 bp, Panicum virgatum
cgccaattccccctcgcctctcccgtcgatcccacaatcgcgccgaccccgatggcatccgccgcctcctccgccgccggcgccggcaagtcgctgttccagggcctccgcaggttccttaagaagccgtgggagatcacgggcccctgcgcctcgccggagtaccgcagcgcgctgcctggcgcgctcgagtaccgcgtcaagtgcccggccaccgtgcgcgatgagcgcgacaaggccatcgtgcccacctccgacccggagaccgtctacgacatcaagtacttcgtccgcgaccgccgccggaaccgcccgcccgtgcggcgcaccctgctccgcaagcccgacctcgagcgctacatggccgccaagcagttcgaccccaccaaggacttcccggtgccatacgtcaacaccaccgtcgaggaggacgacaacactttgggcggaggctaccagaagtgagccaggcatctacgttgctgtgctcgaactcccatcttgatgttgaagcccattttcatttctatttttaaatatccctttttctcttgttcccagtgaaaagtttctgattgtaaaagatgatggctgcaataatttggcacttgtggacctcagcggatgcacctttcttgcaagttgaattccaaaactctgcaacctgatacggatgttatgacttgatgcagaaggtttttgttcaaattatagatattaaactatttttgttcaaattatagatattaaactatcact

SEQ ID NO: 4006 - DNA, 574 bp, Triticum aestivum
  misc_feature (436)..(436): n is a, c, g, or t
  misc_feature (442)..(442): n is a, c, g, or t
  misc_feature (494)..(494): n is a, c, g, or t
  misc_feature (501)..(501): n is a, c, g, or t
  misc_feature (515)..(515): n is a, c, g, or t
cgccgatcctgatggcctccgccgcctcatcggccgtcggcgctggcaaatcgctgttccaggggctccgcaggttcctcaagaagccgtgggagatcacaggcccctgcgcctctcccgagtaccgcagcgcgctgcctggcgcgctcgagtaccgcgtcaagtgcccggccaccgtgcgcgacgaccgcgacaaggccatcgtgcccacatccgatccggagacagtctacgatatcaagtacttcacccgcgaccgccgccggagccgcccgcccgtgcggcgcaccctactccgcaagccgatctcgagagtacatggccaccaagcattcgaccccaccaatgactccccgtaccatacgtcaacacaccgtcgaggaggatgacaacactgtcggcggtggtacaagaatgatcaaggaacttgctggtnattggnaagtacctttgattggctcataagaagcggatattcatccaactataaatancccttcnttgtccaatggaanttttgattaaaatacgtgtaaataaatgcactgtgagctaaagatgaatactgtaattt

SEQ ID NO: 4007 - DNA, 2269 bp, Setaria italica
ctggctcacttctggtagcctccgccaatggtgttgtcgtcctcctcgacggtggtgttgacgtatggcacggggaagtccttggtggggtcgaactgcttggcagccatgtagcgctcgaggtcgggcttgcggagcagcgtgcgacgcacgggcgggcggttccggcggcggtcgcgggtgaagtacttgatgtcgtagacggtctccggatcggaggtgggcacgatggccttgtcgcggtcgtcccggatggtggccgggcacttgtcgcggtactcgagcgcgttcgggagcgcgctgcggtactcgggcgaggcgcagggccccgtgatctcccacggcttcttgaggaacctgcggaggccctggaacagcgacttgccggcgccggcggccgaggaggcggcggaggccatcgaggtcggcgcggtggtgggatcgacggagttgggaggggaatccgggaatgggggagatcggccgatgcggcgagaacacgctggaaatcgcgatgggctcgggtgctgttgggcggagaaccacggagcgtggagccgcgccgtctcctcttctgctccgctgaaactccggagctcgctgccttgctcgctcgcatatagcggggagagcccgggagggactggagggaagtggagcaagaagagtgtgggcaagaggggggagggagcactcctgcagacctgcaccatgcgcccatctcgctgttgtgttcccctttttcttctgctactatcacatttggcatttgctagacctctctttccactaccaagtaagacgaagaacgaagagaaaaggcccatacagacatttcgaccatataatattgctcatcgtggctcaaacggggaaattcctgaagaaacagctgttgcatacctgagggctattgaagaaggtgcagattttatagagactgacatccttgctagcaaagatgggaccttgatctgttttcatgatgtaacacttgatgagacaactgatgttgccgagcataaggagtttgccaatcgaagaagaacctatgaagtggagtggtctaatgttactggatggtttgtagtggacttcaccctggaggaacttaaaacacttaaagtgaagcagagatactcattcagagatcaacagtacaatggtatgttttcaatcatcacgtttgaagaattcatttcaattgccctagatgcggatagaactgttggcatatacccagagattaaagatccagtttttatcaacaagcatgtcaagtgggctgatggaaagaagtttgaggacaaatttgtggataccttgcttaaatatggatacaaaggtcaatacatgtcagagaattggctaaagcagccattgtttatacaatcctttgctcccacctccattatatatgtatccaaattgattgactctcccaaggtatttttgattgatgatataactgtgagaacacaagacacgaaccagtcatactgggaaataacttcagatgactaccttgcatatattgggaaatacgttgtcggccttggtccatggaaagataccattgttccagctgcaggaaactacttgatgccaccaagtgatcttgttgcacgggcacatgctcataatctccaggtgcatccatacacttacaggaatgagaaccagttcctgcacttcaacttccatcaggatccctacgctgaatatgatttctggataaagaatgtgggggttgatggactgtttacagatttcactggaacccttcaccagtaccaagaattgacatccccgcaccggaaggatgaaactgcaaacagcctcctagtaaaaattagtcaaatgatctcagcatatgaaggtctctgaacattctaccattgctgaaaattgtttgtacttgcaagactacacgagtgtatcatggtgttacttgaccttggaaggttaaagaaacgagttgtttttgctaggtagcacgagtcatacctctacattaaaaccctgaatcgctggggcaaatatctatggtagaaataattattttccggaaggatttgtaatggttagttgttgataaatttctatggtggaatcccacgatgggcaagttgccaaggtcttgtttacttcccaagttgggagttgcaaaattagcaatttgccataaatgcgatactgtagcgttttgtttgtatctgtgaattattgtccaaatattgattaattaggctcaaaagatttgtctcgc

SEQ ID NO: 4008 - DNA, 976 bp, Setaria italica
gccgttagtgcggcccacgttctccgcccaacagcacccgagcccatcgcgatttccagcgtgttctcgccgcatcggccgatctcccccattcccggattcccctcccaactccgtcgatcccaccaccgcgccgacctcgatggcctccgccgcctcctcggccgccggcgccggcaagtcgctgttccagggcctccgcaggttcctcaagaagccgtgggagatcacggggccctgcgcctcgcccgagtaccgcagcgcgctcccgaacgcgctcgagtaccgcgacaagtgcccggccaccatccgggacgaccgcgacaaggccatcgtgcccacctccgatccggagaccgtctacgacatcaagtacttcacccgcgaccgccgccggaaccgcccgcccgtgcgtcgcacgctgctccgcaagcccgacctcgagcgctacatggctgccaagcagttcgaccccaccaaggacttccccgtgccatacgtcaacaccaccgtcgaggaggacgacaacaccattggcggaggctaccagaagtgagccaggcatccatgttgttgtgatgggactccatcagcatctgcactgttttcatctcgggtttaaagtatccctctcttgttcccagtgaaaattttctggttgtaaaagatgatggcggcaataatatggcactcgtggagctcactgaatgcacctttcttgtaagttgtattccaagactctgtctacctgatacggatgttatgattgaatgcaaaaaatgtaaggtttccgttcaaatgcgaacatcatctgctttaactgcgaaattatgatgatttgacaaaagatggaatacttccctcttgtacttctgtactatgtagaactatgtgcatatggcttgcaaactcataccggtacattttgtagttcccttgtgtacctctattttggcttgcagaagtcaatcgtggg

SEQ ID NO: 4009 - DNA, 876 bp, Pennisetum glaucum
gcattcccctcccctctccgtcgatcccacaggatcccaccaccgcgccgaacacgatggcctccgccgccccctccgctgccggcgccggcaagtcgctgttccaggggctccgcaggttcctcaagaagccgtgggagatcacggggccctgcgcctcgcccgagtaccgcagcgcgctcccgggcgcgctcgagtaccgcgacaagtgcccggccaccatccgggacgaccgcgacaaggccatcgtgcccacctccgacccggagaccgtctacgacatcaagtacttcacccgcgaccgccgccggaaccgcccgcccgtgcggcgcaccctgctgcggaagcccgacctcgagcgctacatggccgccaagcagttcgaccccaccaaggacttccccgtgccatacgtcaacaccaccgtcgaggaggacgacaacaccattggcggaggctaccagaagtgatccaggcatattgttgtgatgggactccatcagcatctgcactcttttcatctccagttcgaagtattcctctcttgttcccagtgaaaattttctggttgtaaaagatgatggcggcaataatatggcactcgtggagctcactgaatgcacctttcttgtaagttgtattccaaagactctgtcttcctggtacggatgttacgattgaacgcaaaaatgtaaggtttctagatcatctgctttaactgcgaaattatgaggatttgacgaaagatggcatacccccccccccctccttctgtactatgtagaactatgtgcttgtggcttgcaaactcataccggtacattttgtagttcccttgtgtacctctatgttgcctttgcagaagtcaatcgtggg

SEQ ID NO: 4010 - DNA, 669 bp, Panicum virgatum
cgtcgatcccgcaaccgcggcgaccccgatggcctccgccgcctcctccgccgccggcgccggcaagtctctgttccagggcctccgcaggttcctcaagaagccgtgggagatcacgggcccctgcgcctcgcccgagtaccgcggcgcgctgcctagcgcgctcgagtaccgcgtcaagtgcccggccaccgtgcgcgacgaccgcgacaaggccatcgtgcccacctccgacccggagaccgtctacgacatcaagtacttcgtccgcgaccgccgccggaaccgcccgcccgtgcggcgcaccctgctccgcaagcccgacctcgagcgatacatggccgccaagcagttcgaccccaccaaggacttcccggtgccgtacgtcaacaccaccgtcgaggaggacgacaacgctgtgggcggaggctaccagaagtgagccaggcatctatgttgttgtgctcgaattcccatcttgatgttgaagcccattttcatttctacttttaaatatccctttttctattgttcccaatgaaaagtctctgattgtaaaagatgatggctgcaataatttggcacttgcggagctctccggatgcacctttcttgcaagttgtattccaaaactctgcaacctgatacggatgttatgacttgatgcag

SEQ ID NO: 4011 - DNA, 502 bp, Triticum aestivum
  misc_feature (314)..(314): n is a, c, g, or t
  misc_feature (395)..(395): n is a, c, g, or t
  misc_feature (405)..(405): n is a, c, g, or t
  misc_feature (423)..(423): n is a, c, g, or t
  misc_feature (443)..(443): n is a, c, g, or t
  misc_feature (448)..(448): n is a, c, g, or t
  misc_feature (456)..(456): n is a, c, g, or t
  misc_feature (462)..(462): n is a, c, g, or t
  misc_feature (491)..(491): n is a, c, g, or t
ccgcgccgaccccgatggcctccgccgcctcatcggccgccgccgctggcaaatcgctgttccaggggttccgcaggttcctcaaaaagccgtgggagatcacgggcccctgcgcctcgcccgagtaccgcagcgcgctgcctggcgcgctcgagtaccgcgtcaagtgcccggccaccgtgcgcgacgaccgcgacaaggccatcgtgcccacatccgattcggagacagtctacgacatcaagtacttcacccgcgaccgccgccggaaccgtccgcccgtgcgccgcaccctgctccgcaagcccgactcnagcgctacatggtcaccaagcagtttgaccccacaaaggattcccgtgccatacgtcaacacaactgtcaaggaggacganaacacggtcngcggtggctaccaaaatnttcaaggaaagttacgattnatgcnggtaattncaaggnaccctgtgtgcttggcccataacagtgcnaatttcttcac

SEQ ID NO: 4012 - DNA, 671 bp, Saccharum officinarum
gacggatccacccacgcgtacacgctggggcgcgagcgagacccatccgccgccacaccatggccaagtacaacgtggtgcagaagaacaagcgccagtggaagcaggaccgcaagcgcgccgcgcatggggagcccggcactggcaagctcaagcagcggaccgcccctgtctccatgtccggcaagcggaagcgcaagctcgagcgccgcctcaaccgggagcagaaagaggctgcgatgattaaggcgttggagaacaacatgggggatgtcgacatggtctctgctgaagagtcttcagaagctgcaaagggcaagtctcaagtgaagttcagtgtgaagaaaaactcaagaatacagatcaagagattaaagggcaaaggcaggaagaaagccaaaaatgcaaaacaacctgcgaaggagaaagttgatgccatggtagaatgacagacaagactgcatcactagaattatgatatgaacctttgtatgtttgctcagagcttgcagcaaggattgcggggactgacctcacggaacactggagcgtgaactgcctcttgcaatctactgctgcatgttcattagaagctacttaggtctggtgttagtgtatcgaacttcaaacatgaatctacctttaatagtgaaatatgcatgtttttattc

SEQ ID NO: 4013 - DNA, 933 bp, Sorghum bicolor
agggttaaagccgaggccgaagggtttgctcgtcttcctctctcccccttctcccgcggcggcgcgtgcgagacccatccgccgccacgccatggccaagttcaacgtggtgcagaagaacaggcgccagtggaagcaggaccgcaagcgcgccgcgcatggggagcccggcaccggcaagctcaagcagcgtaccgcgcccgtctccatgtccggcaagcggaagcgcaagctcgagcgccgcctcaaccgggagcagaaagaggctgcgatgattaaggcgctggagaacatgggggatgtcgacatggtctctgctgaagagtcttcagaggctgcaaagggcaagtctcaagtgaagttcagtgtgaagaaaaactcaagaatacagatcaagagattgaagggcaaaggcaggaagaaagccaaaaatgcaaaaccacctgcgaaggagaaagttgatgccatggtagaatgacggacaatactgcatcactggaattatgatatgaaccttgtatgttttctcagagcttgcagcaagggctgcagggactgacctcagggaacactggagcttgaactgcctcttgcatctactactgcctgaatgttcattagaagctacttaggtctggtgttagtgtatcgaacttcaaacatgaatgtacctttaatagtggaatattcatgttttcattcatgttcatattgcgttcgttgtgattgtgcggctgtcggcttctacagtaagcaactatcgtagccctatgttcctccctagcatcggacggcaattgttgcattcaggcatagccgatctgaagtgatacatttaaacattcttgttccttgctcaagtgcgtctgatctatttggccgaacttattaatagaacacagaggggtagcttcatgcggtgcgaattgataa

SEQ ID NO: 4014 - DNA, 1122 bp, Sorghum bicolor
gagggttaaagccgaggccgaagggtttgctcgtcttcctctctcccccttctcccgcggcggcgcgtgcgagacccatccgccgccacgccatggccaagttcaacgtggtgcagaagaacaggcgccagtggaagcaggaccgcaagcgcgccgcgcatggggagcccggcaccggcaagctcaagcagcgtaccgcgcccgtctccatgtccggcaagcggaagcgcaagctcgagcgccgcctcaaccgggagcagaaagaggctgcgatgattaaggcgctggagaacatgggggatgtcgacatggtctctgctgaagagtcttcagaggctgcaaagggcaagtctcaagtgaagttcagtgtgaagaaaaactcaagaatacagatcaagagattgaagggcaaaggcaggaagaaagccaaaaatgcaaaaccacctgcgaaggagaaagttgatgccatggtagaatgacggacaatactgcatcactggaattatgatatgaaccttgtatgttttctcagagcttgcagcaagggctgcagggactgacctcagggaacactggagcttgaactgcctcttgcatctactactgcctgaatgttcattagaagctacttaggtctggtgttagtgtatcgaacttcaaacatgaatgtacctttaatagtggaatattcatgttttcattcatgttcatattgcgttcgttgtgattgtgcggctgtcggcttctacagtaagcaactatcgtagccctatgttcctccctagcatcggacggcaattgttgcattcaggcatagccgatctgaagtgatacatttaaacattcttgttccttgctcaagtgcgtctgatctatttggccgaacttattaatagaacacagaggggtagcttcatgcggtgcgaattgataatcgaagccatttcatagcatatgaatcaagactcatcaaatgaatcatgatggaagcttgctggctgttgtggttcgccgcatgtcagtagtctgttaactgataagattgccaagtgaaatcctgtgtctgtgtcaattttggtctgaataatcttgtgtaaaatgatttttcttctgtaattctag

SEQ ID NO: 4015 - DNA, 831 bp, Cenchrus ciliaris
  misc_feature (40)..(40): n is a, c, g, or t
  misc_feature (44)..(44): n is a, c, g, or t
  misc_feature (146)..(146): n is a, c, g, or t
  misc_feature (161)..(161): n is a, c, g, or t
  misc_feature (191)..(191): n is a, c, g, or t
  misc_feature (195)..(195): n is a, c, g, or t
  misc_feature (200)..(200): n is a, c, g, or t
  misc_feature (203)..(203): n is a, c, g, or t
  misc_feature (248)..(248): n is a, c, g, or t
  misc_feature (429)..(429): n is a, c, g, or t
  misc_feature (461)..(461): n is a, c, g, or t
  misc_feature (591)..(591): n is a, c, g, or t
  misc_feature (597)..(597): n is a, c, g, or t
  misc_feature (689)..(689): n is a, c, g, or t
  misc_feature (692)..(692): n is a, c, g, or t
  misc_feature (722)..(722): n is a, c, g, or t
  misc_feature (727)..(727): n is a, c, g, or t
  misc_feature (734)..(734): n is a, c, g, or t
  misc_feature (738)..(738): n is a, c, g, or t
  misc_feature (776)..(776): n is a, c, g, or t
  misc_feature (783)..(784): n is a, c, g, or t
  misc_feature (829)..(829): n is a, c, g, or t
cctccccatcctctcccgcggcggcgcctgcgagacccanccgncgccacgccatggccaagttcaacgtggtgcagaagaacaagcgccagtggaagcaggatcgcaagcgcgccgcgcatggggagcccggcaccggcaagctnaagcagcggaccgcncccgtctccatgtccggcaagcggaagcgnaagntcgancgncgcctcaaccgggagcagaaagaggctgcgatgattaaggcgctngagaacaacatgggggatgttgacatggtctctgctgaagactcttcagaagctgcaaagggcaagtctcaagtgaagttcagtgttaagaaaaactccaggatacagatcaaaagattaaaaggcaaaggtagaaagaaagccaaaaatgcaaagccacctacaaaggacaaagttgatnccatggtagaatgaaggacaggactgaatgtnagtatggtgaagcctctgtacttttgctgagacgaccagcaaggattgcagatactgacctcgtcaaagtatgggagggtgaactaccctgtgccactaccgcctgaatgttaggatctactaaagtctngtgttnatgtatcgaacttcaaacaagaatcaagttttgtaatagttgagtatgcttgttttttctcatgttcgtgtttgttgcctggaggtgttttntcntgaattggtgcccgtcatcttcaatgggcngcaantttcagnttgngaggctctgtcagagcactgtctgtaatcttcctcccnagctttnnacaactgcaaagtcaggaatagccaatctgtgctgcagcaaaacnta

SEQ ID NO: 4016 - DNA, 970 bp, Pennisetum glaucum
cccccgtcctctcccgcggcggcgcctgagagacccatccgccgccacgccatggccaagttcaacgtggtccagaagaacaagcgccagtggaagcaggaccgcaagcgcgcagcgcatggggagcccggcaccggcaagctcaagcagcggaccgcgcccgtctccatgtccggcaagcggaagcgcaagatcgagcgccgcctcaaccgggagcagaaagaggctgcgatgattaaggcgctcgagaacaacatgggcgatgtcgacatggtctctgctgaagactcttcagaagctgcaaagggcaagtctcaagtgaagttcaatgttaagaaaaactccaggatacagatcaaaagattaaaaggcaaaggtagaaagaaagccaaaaatgcaaagccacctacaaaggacaaagttgacgccatggtagaatgaaggacaggactgaatgttagtactgtgaagcctctgtacttttgctgagacgaccagcaagtattgcagatcccgacctcgtcaaagtgggagggtgaactaccctgtgccactaccgcctgaatgttcatcaggatctacttagatctagtgttaatgtatcgaacttcaaacaagaatcaagttttgtaatagttgagtatgcatgcttttccccccatgtttgtgttggttgtctggagatgttatgttgtgaattgatgcccgtcatctccaatgggcagcaagtttcaggttgaggctctgtcagagcagtgtgttcttcctccctagctttgagcctttgaacagctgcaaaggcgggaatagctgatttgtgctgcagcaaaacataactaatatgttgagctccattcctgatttgtgcagaacagggcgtgcctctctgtccctgacattttctgttactattgctcaagtgctttcaagtgcaagctggtcctatttgtctgcagtgtttagggagcag

SEQ ID NO: 4017 - DNA, 810 bp, Setaria italica
aagggttaaaggccgcggccgaagggtttgctcggcttcctctctccctcccccttccctcccgcggcggcgcctgcgagacccatccgccgccacgccatggccaagttcaacgtggtgcagaagaacaagcgccagtggaagcaggaccgcaagcgcgccgcgcatggggagcccggcaccggcaagctcaagcagcggaccgcgcccatctccatgtccggcaagcggaagcgcaagatcgagcgccgcctcaaccgggatcagaaagaggctgcgatgattaaggctctcgagaacaacatgggggatgtcgacatggtctctgctgaagagtcttcagaagctgcaaagggcaagtctcaagtgaaggtcagtgtgaagaaaagctccaggatacagatcaaaagattaaaaggcaaaggtagaaagaaagccaaaaatgcaaagccgcctacaaagggcaaagttgacgccatggtagaatgaaggataggtactgcgaagcctttgtacgtttgctgagaaccagcaaggattgcagagactgacctcgccaaagtggggagcgtgaactaccttgcggcttgtgccactaccgcctgaatgttcattaggaactacttagatctggtgttaatgtatcgaacttcaaacatgaatcaagttttgtaatagttgagtatgcatgggttttttttcatgttcttgttgggtttgtgtttgtggagatgttttgttgtgaattggcgcccgtcatctgttgcagtcaggaataaccgatctgcagtgcagcaaaacattactatc

SEQ ID NO: 4018 - DNA, 592 bp, Saccharum officinarum
tggtgcagaagaccaagcgccagtggaagcaggaccgcaagcgcgccgcgcatggggagcccgggactggcaagctcaagcagcggaccgcccctgtctccatgtccggcaagcgaaagcgcaagctcgagcgccgcctcaaccgggagcagaaagaggctgcgatgattaaggcgctggagaacaacatgggggatgtcgacatggtctctgctgaagagtcttcagaagctgcaaagggcaagtctcaagtgaagttcagtgtgaagaaaaactcaaaaatacagatcaagagattaaagggcaaaggcaggaagaaagccaaaaatgcaaaaccacctgcgaaggagaaagttgatgccatggtagaatgacaggactgcgtcactagaattatgatatgaacctttgtatgtttgctcagagcttgcagcaaggattgcaggaactgacctcacggaacactggagcgtgaactgcctcttgcaatctactgctgcatgttcattagaagctacttaggtctggtgttagtgtatcgaacttcaaacatgaatctacctttaatagtgaaatatgcatgtttttattc

SEQ ID NO: 4019 - DNA, 669 bp, Panicum virgatum
  misc_feature (185)..(185): n is a, c, g, or t
  misc_feature (197)..(197): n is a, c, g, or t
  misc_feature (262)..(262): n is a, c, g, or t
  misc_feature (290)..(290): n is a, c, g, or t
gggcttactctctctctctctctcggtctcccccctcctctcccgcggcggcgcctgcgaacccgaacccatccgccgccacgccatggccaagttcaacgtggtgcagaagaacaagcgccagtggaagcaggaccgcaagcgcgccgcacatggggagcccggcaccggcaagctcaagcagnggaccgcgcccntctccatgtccggcaagcggaagcgcaagctcgagcgccgcctcaaccgggagcagaaagaggcngcgatgattaaggcgctggagaacaacntgggggatgtcgacatggtctctgctgaagagtcttcagaagctgcaaagggcaagcctcaagtgaagctcactgtgaagaaaaactccagggtacagatcaaaagattaaaagaaaggtagaaagaaagccaaaaatgcaaaaccgcccacaaaggacaaagttgactccatggtagagtgaaggacaggacccaatcgccagtactgtgaaacctttgtacgtttgctgagaaccagcaaggactgcggagactgaccttggccgaacactgggcttgaatgttcattagggactacttagatctggtgttaatgtatcgaacttcaaacatgaatcaagttttgtaatagttgagtatgcatggttttttcttccc

SEQ ID NO: 4020 - DNA, 769 bp, Oryza sativa
ggcagtcggcgagggttaagggttgggggcggaagggttcgctcgtctccctctctcgtttttgcggcggcgcccccgagcgaagcagccgagcacccacccgccgccgccgccgtcgccgattcatggccaagttcaacgtggtgcagaagaacaggcgcgagtggaagcaggaccgcaagcgccaggcccatggcgaccccaagaccggcaagctcaagcagcgcacggcgcccgtctccgtctccggcaagcgccagcgcaagctcctgcgccgcctcagccgggagcagaaggaggctgtgatggccaaggcgctggagaacaacatgggcgacgtcgagatggtatctgcggaaggctcttcagaagctgcaaaggacaagtcacaactgaagtttaatgtgaaaaagaactcaagagtacagatcaaaagattaaaaggcaaaggcagaaagaaagccaagaatgcaaagccgccgacaaaggacaaagttgacgccatggtggagtgactggatgtggttgataacactcagcttctacattgttgaagggatccgcaaggattgaaaataccatgagctatcaaagcatctttactgtcttaatgtttagtacaagctagttagctttctaatcaatgtatcctactaaatacgatgatcaagacctgagaggttaaatgcatggtttttggaatatttgtatgaaagcctgatttgcatggtttctgcgtatttagtcgtgacatcctgtctgcacttcc

SEQ ID NO: 4021 - DNA, 1490 bp, Zea mays
cttcctcctcatccagcgcggctccactcaaagcttgagccttccttttcttttcttgtttttgttttattttcttggtaggggggagtcgtcttctccatctctccttagcctaggagaaggagagatccagaggcaaaagcttcagggtttgtacaaattctagatctaaccggactaaccagaaaacaaaacaaaaaaagacgaaagcatgagccacttcgccgccgccatgaagagcccccttgcggtcgccgtcgccgcgcccgccggcgccgccgacgctaagagcccgctcttctgccccaagccgcggcgccccgcggcgccgctgcggtgccatcagagcggcggcttctccgacgccggcacggatctgctcgacctcctcctctcgaagggcgacgagagcggcctgtcgtcggcgtccccgcagccgccgctgttctgcggctcgccgccgcggcgagcgtcgaacccggtggtccacgacagcaggttcggcgcggactgcccgcccatgcccgtgccagggctgcccgtgcaccggccaagcccgcgcccgtcgacggcggcgccgtccatgtcgccgcgcgggtgtgcccgcgcgcggttcgcgttccagcccgccgcggtccgcgtcgagggttttgactgcctcgaccgcggccgcggcggccgtggccatggcatcaccgccatggcctagactgtgcacatacaacagccagcaccctgagaccctcctcccccgcccttccatccatggcacgcaagagccacgagcaccttgttggaggtagaagaagaggagggggtaggggaggaattgagagggatcggtttgtcctaaatcttacccccctaaaaagtaaaaaaaaactagtacttttatataaacccgtcccatccttccacccccaacaattacagcgagtttaggtaattttatcacagatcctttttgtatgtaaataaagttcgaggttcagaaattatgtagaaaaaatgtagaggggaggaggagcagggacaaaagggcttaaaaaagcagagaagggatgattaatcagagtttcctctctcatgtgtcactgcccctcctctcttgaaggattaattagccattgggtttagtgggtgggagggagggagttcgggaatagttaggtagtatgtcctagttcgccaattaatgatgctttcttttttggtttttgatggggaattgttttttctttgttgtccgtccgtccatgcaaccaagaaatttcatggagaatctgtacaaaagagtggctagctactacacgagagtccgttctgagagaagcaacacgaggtcagtcagtggatgagtttagagtgagacattcacacgctgagagggttgataatttgtgatattttcctcttttttttttcttcctgattttgtatattgtaatatcctgctggattttccaatgaatgagtgaatgaaccaatca

SEQ ID NO: 4022 - DNA, 7904 bp, Sorghum bicolor
ggaagggaagggaagggaagggaagcaccatcacatcacggccttcttcgtcttccttgagtcggtggggtcgcctcctccctcctcccccgcaaaacccctcgccacgagacgagacgagcgcggtcagggagggagggccgggtgaaaatagaatagggttaatagggtttcggcagggccgcctcctgccgaccttcctcctccagcaccgtgcaatccgccgcccccgcccctgcccctgccaagcgctagctagggtagccgctgaacggatttcaggaccaacaaatctcttcttcttcttcttcttcccccattgccgccagagcgtggttggtaagtaatccaggcttttctttcgttttcctccgctcccctgctcttcctcagactgccctggtactcacgtaaactcctatctgacgactggtcgcgcgctcgcagagttaggggcctggggttgttgggtttcgggctcgccgccgatttggggcgcgacgaggtcgctgccggtgcctcggtcggggggcgtgatcggtgattcgcacctcggaggattccttccctgaacaaacacggctcaactgtcccaggtgttgatgtgctgctgctactgatccatggccaatacccggtcaggaggaggaggagatgcccagcttgccaatggaagggagaccaggagcaccacagccgcagccgcagctgccagtgctcagacaccaaacctcaggaggtccactcgagaaaacaaaggaaaacacaaatctagacaacttcctgccacgccttcctctcgcagatctgctaaaacgcccaccaaggatgacactgcaattgctacccccaaatccacatcctcgccaaacaacccaaaagactcgacagaaaagccctccagagttaggaacacaagcgtttcaccttctccttcaaaacatgattctaatggaacctcaacgaccgcctccaccaaacggaaaatccaagatgatgctcagaccgcctctacgccgtccaagaagcagaaaaggctcatgcacacaaagagctacgttgcgctcttcagtacaggacaaggacaacctgagtcgcaagtgcttgctcccctcaggcaggataaggaaaaagcttctgatgtgcaaccggaaggagatggtgctgttttggcgcatgaagaaagcaatgcactggaacaacccaaccaggaaccttcaaatgtgtctgctggcaaggttttgggaggtcactcttctgacttgcatgaaactgaggtgatattggagggagatggattgaagatcggatcccaccagtctgatgttgttttagagtcttgcattcttactgagacatgctcactgaataaggcagtggaaagcatccccatgttggaaactggagagcaagctattggtgattcaaaccagaactctctactagaattgcaaaatagcgcttgctctactgctcaccatgaagaggccaacaagtcattggaagatggtgattctgttggggttcaaggtgcatgcacttcaaggaatattgaagctatccaatgtgatgaaacaggttacaatgacaacatctgtgttggttgcagaagtagggaaatctcagatattctgaagtcttgtggtggaaaaggatgtaaacgacattaccacctttcatgtatggatcctcccttggacgtgtccctaggaatatggctttgcagaatgtgtataaaaaagaggcttcagtttggtgtatattcagtcagcgagggaattgaatctttatgggatgtcaaggaaggagcggagaacagcaagcaatatttcgtcaagtataaaaatctttctcatgtacataatcggtggatttcagaaagtgatatagttgatagcaccccgcaaggttctgatcttatctccaaatttagcaagaggattcataaagaaaagacaataaggtggaagcaggaatgggctgaaccacaccgtctgttgaagagaagattacttatgcctccaaaagaagctgaagttttttttaattcactaggtgataaatttgtatactgtaatgtcgaatggctagtgaaatggaaggatctggggtatgaacatgctacatgggaacttgagtcttcatcctttttatgtactactgaggctgaggagctcaaaaggagctatgaggaccgctttaaagctgcaagaaaagcatctgatccttcaaaagtagacaaggttaagggaggcatatttcagcaactccagagattgccagatggttgccctcctggtttagacaatgatcatttgagatcacttaaccagcttcgtgagttctggcacaattctcgtggtgctgttttcatcgacgatcaggagcgagtaattaagaccattctttttgtggcatccatactgcctcacatctgtcgaccactcctcattgtctctactactacttctctctccttgtgggagactaagttcaatcgcttggcagcatccatcaatgttgttgtgtacaatggggagaaagatgtacgcaaatctattcaagatctggagttttatgaggatggttctgtgatgttgcaagttctcttgtcccaccctgatgccatcttagaggacatcaaagcaattgaacgaattaactgggaagcagttatagtcgatgattgccaaaactctagagtttcaaaatgccttgaacaacttaagcgacttcctaccaattttaggatggttctattgagttcttcactaaaggaaagtattgctgagcacatcaatctgctgtctttcctcaaccctgaagaaaatggtacattgagtgtttcaaatggtgtttattttgatacagctggcaccctagccgttctgaaagcaaaacttgcacgttatgttgcctttgagcggaagggagattcttcaaagcttttagagtattgggttcctgcccgcctttcaccagtgcaactagagatgtactgttacatattactatcaaactccccagcccttagatcacattctaaaacagatagtgttggtgctcttcgcaacattcttatatcccttcggaagtgttgtgaccacccttatctcgttgatcaatcactacaaagcacacttaccaaggatcaccctataactgatatccttgatattggagtgcgttcatgtggcaagttgctgcttcttgacagaatgctccaacagatcaggattcaaggtcttagagttcttattctttcacagtctggtggtggatctggcaaccctatgggtgacattttggatgactttgttcgtcagagatttggttatgagtcatatgaacgtgttgaacgtggattgctactgcaaaagaaacagacagcaatgaatatgttcaatgacaaaactaaggggcgatttatttttttgattgatagtcgtgcatgtggttcaagcatcaagctatcatctgttgatgccatcatcatatatggtagtgactggaatcccatgaatgacttgagagcccttcagaaggtcagcatggagtcacagtctgaacctgttcctatttttcgtttgtattcgtcttgtacagtggaggaaaaagctcttattcttgcaaagcatgatcatattctggatagcaatatcctgaatataacccctagcctgagccattgtctgctcagttggggcgcatcatttctcttcaatagacttgaggagttgcagaaccctagctactcaaatgtctctggtgatgagcttttcacggataatgtagctttggagtttttaacaaaattactcagcaaggttgagcccagcactgaatcaggcaatgtagccatatcacaagcttatctgcgtggatctttctattctagagctgttgttgtagctggtgagagggagggaatttcatcagttgatggtgatctgccaaagttctgtgcctactggttaagtctacttaatgggaggtctcctcattggcaacatatatctgagccagtacaaagaagccgtagaaagatatataacgcggaacaacaattgaaaaacacagaagaacagttgaaaatacctactgaagaaactgatgaagccagaataaagcgtagaagaattggtgaaatcatggattcatctccaaaggactcacctggcaaaaacaaggagaccaccatattgcctgaaaacaataccccatctagttctcatcaaatatcagttgaagatacatggcaggaactagagcgaaacaatcttcacggcacacaaaaaggtctacacgttcaactcaagccagaactttcaaagttatataagttgctgcaattgccggagaacgtgaaatccttatgtgaggaatttctggagtatattttgaagaatcaccaaatcagccaggagcctaagggcatactgcatgcattcaatttagctctgtgttggcgtgctgcttctctctcaaagcataaaatcaatcacacagaatcactcacgcttgctgtagaaaacttaaactatgagtgcaaagaagaacttgctgagtttgtctatgcgaagctaaagatacttaagaggaagtttgcacgtagagcaggggaagtgagcaagcaaaattctatggcttcagtgaacaacatatcaacttgtgaacaggacacttcagttagactgagaaatgatgagttaatccctagccaggtaactttaactgatgataactttgagaatggttcacatcacgtggctacaggtgacttctggaccgaggagatggtttcaggagagaaagaactgctatccggcccagtaactcatgaaggggaacaattatcaagggatgaacttctcagcaaaataatggacaaaagaattaaattagttgacaaagttttctctttaagaggaaggagtatccaggataagcattcaaacgaggtttcatttttagatatgcataggcaaaaggaagtggcaaaactcaaaggagcttgcagtttagttgtggagcatcttcgtagtagtcaaaatcacattgctcaagaggacggggatgggaaaataaagctaataattgaatggtttactatgctgctgtatgcttttttggaacacatgaaatgccaacgtgacaagcttgatatgcagcaatcagtttccaggttcaaggagtctcagttgaaggaagaaacccttcaggcagcaaaacgtggccaattagatcaaaattttgatcaacacattccgtcaccggattttgaatttgctatggaagaatttaggcacttcagggaaatagttggtagctgccatgttcatgcagctgctctggcaccagagtctttggatgataattcagcaatggaaattacgttagttcgaagcgcaaatgcacctgaagttatagaagaagaagcgctaaatagacctgctaaagttcttgttcaaggtccagcaccagaagttgtcggtccatcagtgaacgtgatttgcaattattctgatggcatcaactcacaaggagatgcatatctggctgttccttcattggaaccttcaagtgatgaccttagtactgaccatgttgaggagaacacagttggctcaccagtacagggtgatacaagcgaacatttaggtgatgctgcaatggaagttgaaactggaaataggaacactgctttggctgattcacctcactttgacacaccagctttgactgctccatccaggcaggcaacattgctggtttctcgagaaatcgagatgcagagcaatcttgtggaccagtgtgcacaacagagtttagtgtcatcgcaacctttgcagcgagagccggaacaagcagatttgtctagtgcagcatcagatcaacccttgcaatctgagaggcaacaatcaatcccacctcccaataatctacttgaaagagcacagcttggtcagagtcaaccaaattatcagacagatgtggcacctggttctgcacagtctgcagaactctttccagtgacatcaatgatgtttaatcacccacctattgatgctgaaccactgaaaaatgagttgcacaaattaagattacacatggatgcactcaataaagtccacgaaattaagaaaacccaacttcagacggagtgtagccaagaactagagaaggtaaagagaaaatatgatttgttaattaaagaacatgactccactcatcttcagcaaaagaaggcacttgatggtttttatgagaaagttcaacgcaaccaatcactggctgaggattttcgggccaaatttatatcaccgtccgcagcacaaggtgcggcaaaagcccatacccctccagttcgtcgcacacctcaggctacgccacaagtgatgaggcctccattgttggactcagcatcatcaattgccctgtcatcagcttgtcgaccaccagtgccgaggcctagggtccaagcaccacaggtggaccaagcatcatcgtcattgttgcagttgtcccgtccgtcattgccgtctttgcaagtggtccaacctccaaacttggaacaaggcaatcttttcagaacaacggcaacgactcttagtcacatgccacctccacgtgggagctatggagttcagagtgaattggctcctcgctcacctgctcctcatctccagttcaggtcgccacgggcgcattccatgccaccacctggaaatcagcagcaactgccagcaactagggtggaggcaatgtcctcaaggacacaaccaatgctggcagcaagctcatgcccatcagatatacatgtaggacacctggcagcgtcagccatgtcaagtttacactctgtcctcccttcaacctcattgccctcaagcttgcatcctagtcacctggcacaacgtgtgctaccaactccaaacccaactttacaagcggcggcaccgtcaggctcgaatacaacaatgccttccatccctacaggcatgcagccgccagattctgggtcactatcgctggatgcatggcttgcagctaatcttgggttgaatgatgatgcgtctacagctcctgctaagaatacagccagtcttgggttgagaagtgatgcgcctagggcagctcctgctacaaatacggccagtcttgggttgagcagtgatgtgcctatggggacggctcctgctacaaatacagccagtcttgggttgagcagtgatgtacctagggggatggcttctgctacaaatacagccagtcttaggctgagcagtgattcacctagggtgacggttcctgctacaagtacagccagtcttaggttgagcagcgagtcgcctggggcgacggctcctgctataaatggtcctgagatagatctggtatgcttgtctgatgatgaatgagacttagcaggtgtacaaggctgacagttagagatgactgcttgaaaagagtagggtgactgaaggcattattttacaggtcccttgagccgtcgttctggcaaggtaggaatgttgtttgtgctgtgaatggctggtaacagcaatgccagttttatttagattcactgtaaattggtatcatgacaaatgtcatccaacggttgttgtaaatcgctaacctacggggaacatttgtggagattaacctctgagatagagttgggtttcaagcgctatgagattgctgtacatgtttgtcattgattagggatgcatatccataactcgctgaggtgttggttgcatgctggaatgtttacttgtgcataatgagtcgagaatcataaaaaatcgttccagtagcatatgcaacagagaaatttagaccaaggcagtcccttcaacattatattgcatttctttttttttaaggaaacactc

SEQ ID NO: 4023 - DNA, 849 bp, Saccharum officinarum
cgatcccagagagctccacaggccaggtccccaacgccgcggcgcctgcctgcccccctgctcccgcccggtagtagcatcgccgccgccgccgctgccgagatggggttcgtgtccttcgtcgggagggtgctcttcgtcgccgcgttcctcctctccgcgtaccaggaatttaatgaattcggtactgatggtgggccagcagctaaggcgctccagcccaagttcaacgtgtttgtcaaaaatatctctgctcatctgggagtagctgtgccgcacattgagctgaagcatgtgattgctgctacaattggtcttaagggtcttggaagtctcctttttattttgagcagctctctcggtgcttatctcctgttgttttaccttgctttgatcactccaatcattcatgacttctacaactacgatatggagaaggcagaatttgcgcagctctttgggaagttcacccaggatgtggcactgattggagctctcctcttctttctgggcatgaagaactccatcccgaagcggcagggcaagaagaaggcccccaaggcgaagacgaactaaggctctttagatagttgcacgcctcaggcggtgtctggactctggagacaggtctattttgaagcaagctgcgatgcagtcaatgccatcgagctgcgcttttacatgtatcagattccattttgcggggcacggcccgaacgaaggtgtgagcggcgggttaggcgactagattgcacgattatgtacttgcgattggtttgtgttgaactaggttgccaatgcttaatcttatccatttgatttatcatagcgctggcccttgttagcaac

SEQ ID NO: 4024 - DNA, 1083 bp, Zea mays
caccacgtcgctataagtatagggtgggctcgtctcggacaagccccggccgtctcgatcccagcatccgagagagctccacaggccaggtccccatcgccgcggcgcttgccccacctctcccccgcccggtagtagcctcgccgccgttgccgagatggggttcgtgtccttcgtcgggagggtgctcttcgtcgccgctttcctcctctccgcctaccaggagtttaatgaattcggtgctgatggtggaccagcagctaaggcccttcggcccaaattcaacgtgtttgtcaaaaatgtatctgctcatctgggagtagctgtgccacacattgagttgaagcatgtgattgctgctacaattggtcttaagggtcttggaagcctcctttttattttgagcagctctctcggtgcttatctcctgctgctgtaccttgctttgatcactcctatcatccatgacttctacaactacgatatggagaaggcagaatttgcaggcctctttgcgaagttcacccaggatttggcgctgatcggagctctgctcttctttctgggcatgaagaactccatcccgaagcggcagggcggcaagaagaaggcccccaaggcgaagacgaactagggctgcttagatagctgcacgcctcaggcggggtgtatcaggccacaggtctatttcgaagcaggcccagcgcgatgcagcgaatgccatcgagctgcgcttttacatgtttatcatcagattccattttgcggggcacggcccggacaaaggtgtgaccggggtgggttaggcgactagattgcacgattatgtacttgcgatttgtttgttgaactgggttgccgacagttaatcttcatttgattttatcttgttagcagcgcaggaaccgttgctgattcagtggttggtagtttctttcacttcctgagttgttggtttagggcatgttcgttttgctcttaatccatgtggattgagtgggattggataggtttaatctcaaataagttaaaatctttcataattttttttaatctcatccaatccatatgagataggaataa

SEQ ID NO: 4025 - DNA, 1122 bp, Sorghum bicolor
caccgcgtcgttataagtacagcgtgggcctcgcctcggacaagcccccggccgtctcgatcccagaatccgagagagagagctccacaggccaggtccccatcgccgcggcgcctgccccccctgctcccgcccggtagtagcctcgccgccgccgctgccgagatggggttcgtctccttcgtcgggagggtgctcttcgtcgccgcgttcctcctctccgcctaccaggagtttaatgaattcggtactgatggtgggccagcagctaaggcgctccagcccaagttcaatgtgtttgtcaaaaacatctctgctcaactaggagtagctgtgccgcacattgagctgaagcatgtgattgctgctacaattggtcttaagggtcttggaagtctcctttttattttgagcagctctctcggtgcttatctcctgttgttttaccttgctttgatcactcctatcattcatgacttctacaactacgatatggagaaggcagaatttgcgcagctctttgggaagttcacccaggatgtggctctgattggagctctcctcttctttctgggcatgaagaactccatcccgaagcggcagggcaagaagaaggctgccaaggcgaagacgaactaaggctctttagatagttgcacgccacaggcggtgtcgaggagacaggtctatttgaagcaagctgcgatgcagtcaatgccatcgagctgcgcttttacatgtatcagattccattttgcggggcacggcccgaacgaaggtgtgagcggcggattaggcgactagattgcacaattatgtacttgcgattggtttgttgaactaggttgccaattgttaatcttatctatttgatttatctttgcactgggccttgttagcactgattcaatggttggtagtttcttttagtttctcgcttgtcagcttatgtaatgttttttttttcgatttcggcagacgtgcaaaatccaagcagactttggtgtggcgtcgtgacttggtgtgtttggataatgactgcgtgttgccactttttttttgccaatcttacttagtttttttttttttgcaaaatagatactgtagcactttgtgtttgac

SEQ ID NO: 4026 - DNA, 1224 bp, Sorghum bicolor
aagagcaagaggggggcacggatgcaatatcgaagaaggcgagggggttcgtcccagcacaaagggctaaacaaaccaccgcgtcgttataagtacagcgtgggcctcgcctcggacaagcccccggccgtctcgatcccagaatccgagagagagagctccacaggccaggtccccatcgccgcggcgcctgccccccctgctcccgcccggtagtagcctcgccgccgccgctgccgagatggggttcgtctccttcgtcgggagggtgctcttcgtcgccgcgttcctcctctccgcctaccaggagtttaatgaattcggtactgatggtgggccagcagctaaggcgctccagcccaagttcaatgtgtttgtcaaaaacatctctgctcaactaggagtagctgtgccgcacattgagctgaagcatgtgattgctgctacaattggtcttaagggtcttggaagtctcctttttattttgagcagctctctcggtgcttatctcctgttgttttaccttgctttgatcactcctatcattcatgacttctacaactacgatatggagaaggcagaatttgcgcagctctttgggaagttcacccaggatgtggctctgattggagctctcctcttctttctgggcatgaagaactccatcccgaagcggcagggcaagaagaaggctgccaaggcgaagacgaactaaggctctttagatagttgcacgccacaggcggtgtcgaggagacaggtctatttgaagcaagctgcgatgcagtcaatgccatcgagctgcgcttttacatgtatcagattccattttgcggggcacggcccgaacgaaggtgtgagcggcggattaggcgactagattgcacaattatgtacttgcgattggtttgttgaactaggttgccaattgttaatcttatctatttgatttatctttgcactgggccttgttagcactgattcaatggttggtagtttcttttagtttctcgcttgtcagcttatgtaatgttttttttttcgatttcggcagacgtgcaaaatccaagcagactttggtgtggcgtcgtgacttggtgtgtttggataatgactgcgtgttgccactttttttttgccaatcttacttagtttttttttttttgcaaaatagatactgtagcactttgtgtttgacaaatattatctaactatgaattaact

SEQ ID NO: 4027 - DNA, 1145 bp, Cenchrus ciliaris
  misc_feature (811)..(811): n is a, c, g, or t
  misc_feature (907)..(907): n is a, c, g, or t
  misc_feature (914)..(914): n is a, c, g, or t
tcatctcagattccgagagagcgctccacagacaggccgccaggtcccatcgcgctgaggcacccccccggcccgcgccgcctctcccatcccgcccggtcgcctcgccgccgctgccgagatggggttcgtgtccttcgtcgggagggtgcttttcgtcgccgcctttctgctctccgcctaccaggagtttaatgaattcggaactgatggtgggccagcggcaaaggcccttcagcccaagttcaatgtgttcgtgaaaaatatctcttcgcatcttggagtagctgtgccacatattgagttgaagcatgtgattgctgctacaatcgctcttaagggccttggaggtctactttttatcctgagcagctctctcggtgcttatctcctgttgctgtaccttgcctttatcacccctattgtgcatgatttctacaactatgatatggagaaggcggaatttgcgcagatctttgggaagttcacccaggatttggcactcatcggagcacttctctttttcctgggcatgaagaactccatcccgaagcggcaggccaagaagaaggctcccaaggcgaagacgaactaaggctctctacatagttgcagccgtaggggcctcaggcggtgtcagtcaggagacggtcttattttgaagcaagctgcgatgtgagccaatgccaatgtgcagcgctttcatatgtatcagattccattttgcagggcacggcccgaacgaaggtgtgagtgggcggattaggtgactagattgtaccattatgtacttgtgattggtttgttggantaggttgccaatggttaattaatcttctccatttgatttatcttgcactgggccttgttagcagtgcaggaaattggtacagataattgctggganttctttnttacaggggagaaaaaagtgttttttttttttttttttccattcagtttttaatttggcaacgtgtggaatccaagtgcacacttgtgaattgtgagttgtgttggaacactagtgtggcatcgtggttctcactaatcctgataatgccggccaagtttgtagcataggagaccagaactgacagatcaattcttaatgcaagtttttcgctgttgtctagcagctttta

SEQ ID NO: 4028 - DNA, 1274 bp, Setaria italica
atggttcctactccacacgagaacattcctaacaatactgtatcttgggttctacaactaaacaacacacacattctccacgttcctctcacgtcgagcttgctcggaacattcctgcaaccttccagccgagccggactggaaggagcagaggcgcgcaaaagcaacgaaagtgtgtgcgagtgtgacgctcagggagacggatgcaaataccgcagaacgcgaggggtgcgtccccacaaagaggttaacgaccgcgtcgttataagtacagcgtggggctcgcctcggacaaacccccggccgtctccatcccagattccgagagcgctccacaggccaggtcccatcgcgctgcggcagcccccggcccgcgccgcctctcccatcccgcccggtcgcctcgccgccgctgccgagatggggttcgtgtccttcgtcgggagggtgcttttcgtcgccgccttcctcctctccgcttaccaggagtttaatgaatttggaactgatggtgggccagcggcaaaggcccttcagcccaagttcaatgtgttcgtaaaaaatatctcttcgcatcttggagtagctgtgcctcatattgagttgaagcatgttattgctgctacaatcgctcttaagggccttggaggtctcctttttatcttgagcagctctctcggtgcttacctcctgttgttgtaccttgcctttgtcacccctattgtgcatgacttctacaattacgacatggagaaggcagaatttgcccagatctttgggaagttcacccaggatttggcactcattggagcacttctcttcttcctgggcatgaagaactccatcccaaagcggcaggccaagaagaaggctcccaaggcgaagacgaactaaggcaatctagatagttgcagccgtaggggcctcaggcagtgtcaggagacggtctattttgaagcaagctgcgatgtgagccaatgccgtcgtgcggcgctttcatatgtatcagattccattttgcagggcacggcccgaacgaaggtgtgagtggtggattaggcgactaaattgtaccattatgtacttgcgattggtttgttggactaggttgccaatgattaatcttctccatttggtttatcttgcactgggccttgttagcagtgcaggaaatagctacagataatggctgggaattctttcttacatcgtctcttgtcattttgtgaattgtgagtcgagttagtacaccagtgtggcgccgtgattcacac

SEQ ID NO: 4029 - DNA, 1001 bp, Pennisetum glaucum
ggccgtctccatctcagattccgagagcgctccacaggccgccgccaggtcccgtcgcgctgcggcaccatcccccccggcccgagccgcgcctctcccatcccgcccggtcggtcgcctcgccgccgctgccctgccgagatggggttcgtgtccttcgtcgggagggtgcttttcgtcgccgcctttctcctctccgcctaccaggagtttaatgaattcggaactgatggtgggccagcggcaaaggcccttaagcccaagttcaatgtgttcgtaaagaatatctcttcgcatcttggagtagctgtgccacatgttgagttgaagcatgtgattgctgctacaatcgcccttaagggccttggaggtcttctttttatcttgagcagctctttgggtgcttatctcctgttgttgtaccttgcctttatcacccccattgtgcacgacttctacaactatgatatggagaaggcggaatttgcgcagatctttgggaagttcacccaggatttggcactcattggagcacttctcttcttcctgggcatgaagaactctatcccgaagcggcaggccaagaagaaggcttcgaaggcgaagacgaactaaggctctctagatagttgcagccttagggggctcaggtggtgtcaggagacggtctattttgaagcacgctgcaatgtgagccaatgccatggtgcagcgctttcatatgtatcagattccattttgcagggcacggccccaaatgaaggtgtgagtgggcggattagatgactagattgtaccattatgtacttgtgattggtttgttggactaggttgtggatgattaatcttctcgatttgatttatcttgcactgggccttgttagcagtgcaggaaatcgctacagataatgggctgggaattctttcttacatcgcctcgtgaattgtttatttccttgtgtttttactggtttggcagacgtgcagaatccaagtggtgg

SEQ ID NO: 4030 - DNA, 909 bp, Panicum virgatum
tctccatccccagattccgagagcgctccacaggccaggacccatcgcgccgcggcacccccggcacgcaccgcctctcccatcccgcccggtcgcctcgccgccgctgctgccgagatggggttcgtgtccttcgtcgggagagtgctcttcgtcgccgccttcctcctctccgcctaccaggagtttaatgaatttggaactgatggtgggccagcagcaaaggcccttcagcccaagttcaatgtgtttgtcaaaaatatctcttcccacttgggagttgccgtgcctcatattgagttgaagcatgtaattgctgccacaattgcgctcaagggccttggaggtcttctttttatcttgagctgctctcttggtgcctatctcctgttgttgtaccttgctattgtcacccctattgtgcatgacttctacaactacgacatggagaaggcagaatttgcacagatctttgggaagttcacccaggatctggcactcattggagcacttctcttcttcctgggcatgaagaactccatcccgaagcggcaggccaagaagaaggctcccaaggcgaagacaaactaaggctctctagatagtattgttgcaactgtaggggcctcaggcggtgtcaggagacggtctattttgaagcaaagctgcgatgcgaagccaatgccatcgagctgcgctttcatatgtatcagattccattttgcagggcacggcccgaacgaaggtgtgagtggcggattaggcgactagattgtaccattatgtactcgtgattggtttgttggactaggttgccaatgattgatcttctctatttgatttatcttgcactgcgccttgttagcagtgcaggaattcgctactaattcaatggctgaaattcatttt

SEQ ID NO: 4031 - DNA, 939 bp, Panicum virgatum
gtggggctcccctcggacaagcccccggccgtctccatcccagattccgagagcgctccacaggccaggtcccatcgcgccgcggcatccccggcccgcaccgcctctcccatcccgcccggtcgcctcgccgccgctgctgccgagatggggttcgtgtccttcgtcgggagggtgctcttcgtcgccgccttcctcctctccgcctaccaggagtttaatgaattcggaactgatggtgggccagcggcaaaggcccttcagcccaagttcaatgtgtttgtcaaaaatatctcttcccacttgggagttgccgtgcctcatattgagttaaagcatgtaattgctgccacaattgcgcttaagggccttggaggtcttctttttatcttgagctgctctcttggtgcttatctcctgttgttgtaccttgcttttgtcacccctattgtgcatgacttctacaactacgacatggagaaggcagaatttgcgcagatctttgggaagttcacccaggatctggcactcattggagcgcttctcttcttcctgggcatgaagaactccatcccgaagcggcaggccaagaagaaggctcccaaggcgaagacgaactaaggctctctagatagtgttgttgcaccggtaggggcctcaggcggtgctgggagacggtctattttgaagcaagctgcgatgtgaagccattgccatcgtgctgagctttcatatgtatcagattccattttgcagggcacggcccgaacgaaggtgtgagtggcggattaggcgactagattgtaccattatgtactcgtgattggtttgttggactaggttgccaatgattgatcttctccatttgatttatcgtacactgcgccttgttagcagtgcaggaattcgctactgattcaatggctgcaaattcttttt

SEQ ID NO: 4032 - DNA, 807 bp, Panicum virgatum
gagagcgctccacaggccaggtcccatcgcgccgcggcatccccggcccgcaccgcctctcccatcccgcccggtcgcctcgccgccgctgctgccgagatggggttcgtgtccttcgtcgagagggtgctcttcgtcgctgccttcctcctctccgcctaccaggagtttaatgaattcggaactgatggtgggccagcggcaaaggcccttcagcccaagttcaatgtgtttgtcaaaaatatctcttcccacttgggagttgccgtgcctcatattgagttaaagcatgtaattgctgccacaattgcgcttaagggccttggaggtcttctttttatcttcagctgctctcttggtgcttatctcctgttgttgtaccttgcttttgtcacccctattgtgcatgacttctacaactacgacatggagaagggagaatttgcgcagatctttgggaagttcacccaggatctggcactcattggagcgcttctcttcttcctgggcatgaagaactccatcccgaagcggcaggccaagaagaaggctcccaaggcgaagacgaactaaggcgctctagatagtgttgttgcaccgttaggggcctcaggcggtgctgggagactttctattttgaagcaagctgcgatgtgaagccattgccatcgtgctgagctttcatatgtatcagattccattttgtagggcacggcccgaacgaaggtgtgagtggcggattagattgtaccattatgtactcgtgattggtttgttggcctttacgagtatttcattgtgggccca

SEQ ID NO: 4033 - DNA, 508 bp, Zea mays
ccgccaccaccgttgccgaaatggggtccgtgtccttcgtcgggagggtgctcttcgtcgccgctttcctcctctccgcctaccaggagttgaatgaattcggtgctaatggtggaccaacatctaaggccattcaacccaaattcaacgtgtttatcaaaaatgtctctgctcatctgggagtagctgtgccacacattgagttgaagcatgtgattgctgctacaattggtcttaagggtcttggaagcctcctttttattttgagcagctctctcggtgcttatctcctactgctgtaccttgctttgatcactcctatcatccatgacttctacaactacgatatggagaaggcagaatttgcaggcctctttgcgaagttcacccaagatttggcgctgatcggagctctgctcttctttctgggcatgaagaactccatcccgaagcggcaggggcggcaagaagtccccaaggcgaagacgaactagggctgcttagatag

SEQ ID NO: 4034 - DNA, 1042 bp, Oryza sativa
tggggctcggacacgggcctctccccgtctccatccccatagctgcactgcacggaggtcgccgcggctaccccatcgccaccaccaccaccaccgcatctctctcccctcgccgtcgccgtcgccgtcgccgcagcgcgagatggggttcgtctccttcgccgggagggtcctcttcgcctccgtcttcctcctctccgcctaccaggagtttagtgaatttggagctgatggtggaccggctgcaaaggcccttcggcctaagtataacgtcttcaccaaaaatatttctgcacatttgggagtagcagtgcctcatgttgagttgaagcacattgttgctgctaccattggtctgaagggtctgggaggtctcctttttatcctgagcagttcgtttggtgcttatctcctgctgatttacctcgcttttatcacacctgttgtctacgacttctacaactacgacatggagaagtccgaatttgtgcagctcttcatgaagttcacacagaatttggctctctttggggcgcttcttttcttcctgggcatgaagaactccattcccaagaggcaggccaagaagaaggctcccaagtcgaagacgaactagggcgttttagatagccatggcctccggcggtgatgggggacagtttattttggagtacaagcttacagtaccagttgtgctgcccttagatgtatcggattcatttttgaagggcacgaccctaatgaggtgtgagtggagggttaggggactagattgtatcagtatatgtactcgcgatttgtttgttgaactaggcttccaaggattaaattacccatttgattattttgcactcaatgtcattactgatgcgaagggttagtgacttggtgtttctctgcttgggcttttgcggtgtccttttagccttttgtgatctctatgtttgagaacgcaaacatcttgacttcttgacggtccaaggcttatgacgtgatgtaatcttcagacatgaacaatggttgggctcttattttggcggcg

SEQ ID NO: 4035 - DNA, 821 bp, Festuca arundinacea
  misc_feature (358)..(358): n is a, c, g, or t
  misc_feature (382)..(382): n is a, c, g, or t
  misc_feature (592)..(592): n is a, c, g, or t
  misc_feature (690)..(690): n is a, c, g, or t
ggcacgaggcagattccgagagctcccaaggtagcagcgcggctccccacctccccaccatatcccgccggtcgcctcgcctctcgccgccgccgctgccgagatggggttcgtgtccttcatcgggagggtcctcttcgcctccgtcttcctcctatccgcctaccaggagttcaatgaatttggaactgatggtgggccagctgcaaaggctcttaagcctaagttcaacagtttcaccaaaaatatttctgcacaactgggagttgtggtgccccatgttgagttgaagcatgtcatcgctgctaccattggcctgaagggtctgggaggtctcctgttcattgtgagcagttcntttggggcttatctcctggcgctntaccttgcgttcatcacccctgttgtctatgacttctacaactacgacatggagaaggctgagttcgtgcagctcttcatcaagttcacacagaacgtggcactcttcggagccctcctcttcttcctgggcatgaagaactccatccccaagaggcagcccaagaagaagaccgccaagtctaagacgaactagaacatctcagatagntgttgctgtagcggcctaaggctttgtggaggagacggtcttatttaacaagctaccgtacctgttcctgttccgctccttatatgtaacagatgatnagatcctttttgaagggtgtgggtggttacccttgaggtgtgggtggcggtttagagatactagattgtatcactattatgtactccgatttgtttggtgtaggctgcaaggtcttaagaatatccattta

SEQ ID NO: 4036 - DNA, 2291 bp, Oryza sativa
caatgtgaaaagcgtcaaactcgcacagactccgtggccactcctccctgttcatttcaccggcgtgttcagtatctgcaccctgcagcaagcagtcaccgccactggatgcgtcgcgatggagcgagcgaacaataatctaaaagccggttttctgctggtgccgtgcgagcgttgaaaggtggggggcgggtggcacacggtgtggcggcgacccggaggaggagcggatcggataagaacgagtaggggctgctacgagacgagacgagcaatatagtctccccgcaaagcatccgggcccctgttggtttaccaccaccacccggtgcggttcggtgatagttgcaaacctttctccggtctacaaagacctcagctttcctacctccacttcttctttcttccacaaagcccattccttttcctcccgttcttctcccctcccttctttttccacccactcgaatcctcccttcacattctagttctagctccgcacctttgctgcgcgcgcggatttggttcagggtttggaaatggcaatagacgatgaatcgccgctcagaatcaataccaccagaggcggcgccatgggaggaggaggggagtgcgacggggcggagaaccagcggtggccgccatggctgaagccgctgctggcgacgagcttcttcggccaatgcaagctgcacgcggactcgcacaagagcgagtgcaacatgtactgcctcgactgcatgaacggcgcgctctgctcgcagtgcctctcctaccaccgcgaccaccacgccatccagatacggaggtcctcctaccacgacgtgatccgggtgtcggagatacagaaagtgctggacatcaccggcgtgcagacgtacatcatcaacagcgcgcgcgtcgtgttcctcaacgagcgcccccagccgaggcccggcaagggcgtcaccaacacctgcgaggtctgcgagcgcagcctgctcgacaccttccgcttctgctccctcggctgcaagatcgtcggcacctccggcgactaccgcggccggaagaggcacgccggcggcggcatcaagaagacgaagaagctgcacaagggcgcggcggcggtgccgtcggactcggacgactcctccacgaccacaagcggcgggagcgacaagagcagcgtggtgcagagcttcaccccgtccacgcctccggcgaccgccaacagctaccgcaccggcaagcgtcgcaagggcgtcccgcaccggtcgccgttcggcagcctcatggtggagttctaaagcagggcagaagcaatgccgccatgccggcctcgcccccgaaacagtggtacactgtagcatacacatatccatatctatctctatagttatagcatacatagccagtgaaaaggaggagcttagtaataacaggatcccccattgcacccctgtgcttctggatgaggaggccggtgcaaatgcaatgtgggacagttacttcatagttacagttactgtgctagtaacaacggtttgggtttgggttctctcttgtggaagaggagaggaggtagtagttactccctgtcataactactaagttttgctgaaaccttataggtctttattactcttttagttactctgtgtttgatatggtagatgtacatatatgtatatcacagatggtggggggaatggtagtaggagatggtgctcccggtgttcatattcgtgcttgcctgtaataaagatgagaatgctgctcctgatggccttcaatgtcagtcagtaatttccttctctgttttgcattgcttggtttctgcttcttcaccccttcttcccttgtactgtagtacagcaattgggagtggctccggtgaacgagatcgtgcaatgcacggagaattgttgagaactagggtaatgcgacttgagattcagagctctgtagtactgtatgtttgcaggtgaaggaatggctgctgtggctataggacggggtcgatcaagttgcgcccgccgtgcggcccccgcctaactccattgacccgccgtttggcctgtggaaagcggccgcccggtgatgccgacgttgtcatcatcatcatcgtccatgttggttgcttcctcccatacgggagaggagccatccgtccaaccgccgtccgggcatttaacgcggcagtggtgggcacactctccctctctctctctctctctctctctctctctctctctctctctcaataaagagggatcgatctagaggcgagatccgtcgtacaatgccca

SEQ ID NO: 4037 - DNA, 1652 bp, Sorghum bicolor
ctagcgcttagcctataccagtgctgtgatacttgtcgcagcagcagctgctgctgcctgctttcccccggtctacaaagacctcagctttcctacctccacttctttcttccaaagccttcgccttttcctctcgtcttccctccctccccctccaaatccccccctacccctactctttctctagctttctctccacattctccctgctctgtgcaccttgtagtttcggttgtggatcgccggaaatggcaatcgacgatgaatcgccgctcagagtcaacaccagaggcggcgccatgggaggaggcgggtgcgacggggcggagaaccagcggtggccgccgtggctcaagccgctgctggggacgagcttcttcggtcaatgcaaggtgcacgcggacgcgcacaagagcgagtgcaacatgtactgcctcgactgcatgaacggcgcgctctgctcccagtgcctcgcctaccaccgcgaccaccacgccatccagatacggaggtcctcctaccatgacgtgatccgggtgtctgagattcagaaggtgctggacatcaccggcgtgcagacgtacatcatcaacagcgcgcgcgtggtgttcctgaacgagcgcccgcagccgaggcccggcaagggcgtcaccaacacctgcgaggtatgcgagcgcagcctcctcgacaccttccgcttctgctccctcggctgcaagatcgtcgggacctccggcgacttccgcatccggaagaagcacgtcgtcgttacgaagaagaagaagcaggcccagcaccagcaccagcacaggggcgcggcggcggcgtcggagtcggaggacgactcgtccaccagcaccagcggcggcagcgacaagagcagcgtggtgcagagcttcaccccgtcgaccccgccggcgactgccaacagcttccgcaccgggaagcggcgcaagggcgtgccgcaccggtcgccgttcggcaacctcatggtggagttctagaccaccaataccaaaggcgcggctccgattccaccagaaacagcggtacaccactgtagcatacgcacttctacataccatctataggtgtttgccggatcgaccggtctacatacatagccagccaaaaggagctagtagtagcaagcaataaccaagggtcccactgcacgcccgcgcttctggacgagacgaggaggccggtgcaatgcggcacgtacgggtacggttacttccatagcagttacataatgcaagttcacactgtgctagtaacaacggtttgggtttggtgcctctgaaaggaaacgaggtagttgtagcagttactcttgtcgtcatcagccagtcactactaagttttgcaagttttacctatataggtgttttcctagttttactttttaccggcggtgcttgatataagtagtagaaatgtacatatacatataatactgtcacagatgggggggaatggtgtaggagtgtagcttcccagtgttcatattcgtgtttgcctttgttgcctgtaataaaaaggataagaaaagaatgctgctcctggatggccttcaatgtcaagggtttgtgtagtacttgtgttgcttgcttgattttgatgcttggtttctcttctcctacccctct

SEQ ID NO: 4038 - DNA, 1755 bp, Sorghum bicolor
aggacgagctccgaggcctcgactgggcatgacacgaacacagagcatcgtttcctgttgaaaaatttaccaccactagcgcttagcctataccagtgctgtgatacttgtcgcagcagcagctgctgctgcctgctttcccccggtctacaaagacctcagctttcctacctccacttctttcttccaaagccttcgccttttcctctcgtcttccctccctccccctccaaatccccccctacccctactctttctctagctttctctccacattctccctgctctgtgcaccttgtagtttcggttgtggatcgccggaaatggcaatcgacgatgaatcgccgctcagagtcaacaccagaggcggcgccatgggaggaggcgggtgcgacggggcggagaaccagcggtggccgccgtggctcaagccgctgctggggacgagcttcttcggtcaatgcaaggtgcacgcggacgcgcacaagagcgagtgcaacatgtactgcctcgactgcatgaacggcgcgctctgctcccagtgcctcgcctaccaccgcgaccaccacgccatccagatacggaggtcctcctaccatgacgtgatccgggtgtctgagattcagaaggtgctggacatcaccggcgtgcagacgtacatcatcaacagcgcgcgcgtggtgttcctgaacgagcgcccgcagccgaggcccggcaagggcgtcaccaacacctgcgaggtatgcgagcgcagcctcctcgacaccttccgcttctgctccctcggctgcaagatcgtcgggacctccggcgacttccgcatccggaagaagcacgtcgtcgttacgaagaagaagaagcaggcccagcaccagcaccagcacaggggcgcggcggcggcgtcggagtcggaggacgactcgtccaccagcaccagcggcggcagcgacaagagcagcgtggtgcagagcttcaccccgtcgaccccgccggcgactgccaacagcttccgcaccgggaagcggcgcaagggcgtgccgcaccggtcgccgttcggcaacctcatggtggagttctagaccaccaataccaaaggcgcggctccgattccaccagaaacagcggtacaccactgtagcatacgcacttctacataccatctataggtgtttgccggatcgaccggtctacatacatagccagccaaaaggagctagtagtagcaagcaataaccaagggtcccactgcacgcccgcgcttctggacgagacgaggaggccggtgcaatgcggcacgtacgggtacggttacttccatagcagttacataatgcaagttcacactgtgctagtaacaacggtttgggtttggtgcctctgaaaggaaacgaggtagttgtagcagttactcttgtcgtcatcagccagtcactactaagttttgcaagttttacctatataggtgttttcctagttttactttttaccggcggtgcttgatataagtagtagaaatgtacatatacatataatactgtcacagatgggggggaatggtgtaggagtgtagcttcccagtgttcatattcgtgtttgcctttgttgcctgtaataaaaaggataagaaaagaatgctgctcctggatggccttcaatgtcaagggtttgtgtagtacttgtgttgcttgcttgattttgatgcttggtttctcttctcctacccctcttttattttcctctgtaccatccaccgcc

SEQ ID NO: 4039 - DNA, 1405 bp, Panicum virgatum
cctctccctcgtcttcgctcgcctcccctctccaaatcccccctccctccctcctccctcgccttccagtcctccacattcttcctgctctgcagctagctgcttttggttgggcatcggaaatggcaatcgacgacgaatcgccgccactcagggtcaacaccagaggcggcgccatgggaggaggggagtgcggcggggcggagaaccagcggtggccgccgtggctcaagccgctgctgggcacgagcttcttcggtcaatgcaagctgcacgcggacgcgcacaagagcgagtgcaacatgtactgcctcgactgcatgaacggcgcgctctgctcccagtgcctcgcctaccaccgcgaccaccacgccatccaaatacggaggtcctcctaccacgacgtgatccgggtgtcggagattcagaaggtgctggacatcaccggcgtgcagacgtacatcatcaacagcgcgcgcgtggtgttcctgaacgagcgcccgcagccgaggcccggcaagggcgtcaccaacacctgcgaggtctgcgagcgcagcctcctcgacaccttccgcttctgctccctcgggtgcaagatcgtcggcacctccggcgagttccgcatccggaagaagcacgccgccatcaggaggaagaagaggccgcagcacaaggtcggcgcggcggcggcgtcggactcggagggcgactcgtccacgagcacgagcggcgggagcgacaagagcagcgtggtgcagagcttcaccccgtcgaccccgccggcgaccgccaacagcttccgcgccgggaagcggcgcaagggcgtgccgcaccggtcgccgttcggcagcctcatggtggagttctagagcagcagcagcgccaagccaatgccaccctcgccaagaaccatgggcacatcactgtagcatacgcgcccctacatactatccatagctgtcggatcgaccgatctgcataccatagccagccaaaaggagctagtaagcaataacgaagggccccattgcacgcctgcgcttctggacgaggaggccggtgctaggcggttactttcatggtagttttactctttactgtgctatagtaccaacggtttgggtttggtgccagcctccgaaaggaaacgaggtggttgtagcagttactctcctccctctcgtcatcagtcgctactggagtaagttttgcaagtttttactatagggagtaagtttctctagcttatcagtgcttgatatagtagtggtagctgactagctgtaaatatacatactctatatactgtcacagatggggaatggttaggagtgtagctccggtgttcatattcgtgtgtaataaaaaaggataagaatggcgctcctggatggccttcagtgtg

SEQ ID NO: 4040 - DNA, 1760 bp, Setaria italica
ctttcctacccccacttctttcttccaaagcctcgcctttttcccttcctctcgtcttccctctcgtctctctctctctccctccaaatccctccttccttctctctttccacattcatcctgctctgcagctagctgctttggttgaggatcggaaatggcaatcgaagatgaatcgccgcagctcagagtcaacaccaccagaggcggcgccatgggaggaggggagtgcgacggggcggagaaccagcggtggccgccgtggctcaagccgctgctggggacgagcttcttcggtcaatgcaagctgcacgcggacgcgcacaagagcgagtgcaacatgtactgcctcgactgcatgaacggcgcactctgctcccagtgcctcgcctaccaccgcgatcaccacgccatccagatacggaggtcctcctaccacgacgtgatccgggtgtcggagattcagaaggtgctggacatcaccggcgtgcagacgtacatcatcaacagcgcgcgcgtggtgttcctgaacgagcgcccgcagccgaggcccggcaagggcgtcaccaacacctgcgaggtctgcgagcgcagcctcctcgacaccttccgcttctgctccctcggctgcaagatcgtgggcacctccggcgagttccgcatccggaagaagcacgccgccatcaagaagaagaagaagctgccgcacaagggcggcgccgcggcggcggcggcgtcggactcggaggacgactcgtcgacgagcacgagcggcgggagcgacaagagcagcgtggtgcagagcttcaccccgtcgaccccgccggccaccgccaacagcttccgcaccgggaagcggcgcaagggcgtgccgcaccggtcgccgttcggcagcctcatggtggagttctagaacgcggccacgcggccgcccctcgccaaggaagaaaccagcggtacaccacaccactgtagcatacgcacccctacataccatactactctatagctgttggatcgaccgatctgcataccatagccagccaaaaaggaggtaatgcaagcaataacgaagggccccattgcacgcctgcgcttctggtaggtttcaaaaaaaagaggaggccggtgcagtgcggcacggttacttcacatagtagtcttactgtgctagtgggccttgtttagttggccaatttgggagatgcaaaattcctgttccagcactgtagcacactgtagcgtttcgtttgtatttgtgaattattgtccaaatattgactaattaggctcaaaagattcgtctcgcaaagtacaacaaaactgtgcaattagtttttaatttcatctacatttagtactacatgcatgtaccgtaagtttgatgtgatggggaatcttctttttgcatagtgtcaaaattgggagttggggagtaactaaacatggcctaacaaacggtttgggtctggtaccagcctctgaaaggaaaacgaggtagttgtggcagttactctctcctccctcctctcgtcatcagtccctactccctactaagttttgcgagttttaccataggggttttctctagttaccagtgcttgatgtagtagtagtagctgtacatattcatatatactgtcacagatgagatggggaatggtaggagtcgagctccggtgttcatattcgtgtgtaataaagagatataagaatgctgctcctggatggccttcaatgtcaaatgtggttcgcttgct

SEQ ID NO: 4041 - DNA, 1681 bp, Zea mays
tttttttttgcattggatcgtagaattataaactttataatatgccataaaagctgaaggttgcagtattagtttaaattattctatttgttaatttaaaacgttgtcgcaggctcgcagctgctgttgctgtctgctttcccctcccccggtctacaaagacctcggctttcctttcctacatgctcttcttccttccaaagccttcgcattttcctctcgtcttccccttccccttactccaaattaccccctgctatctacatatcctgtccacactctccctccctgcgctgggccttgcagtttttggttgtgtatcggggaaatggcaatcgacgacgaatcgccgatcagagtcaacagcagaggcggcggcgccatgggaggaggggagtgcgacggggcggagaaccagcggtggccgccgtggctcaagccgctgctggggacgagcttcttcggccaatgcaagctgcacgcggacgcgcacaagagcgagtgcaacatgtactgcctcgcctgcatgaacggcgcgctctgctcccagtgcctcgcctaccaccgcgaccaccacgccatccagatacggaggtcgtcctaccacgacgtgatccgggtgtcggagatccagaaggtgctggacatctccggcgtgcagacgtacatcatcaacagcgcgcgcgtggtgttcctgaacgagcgcccgcagcagaggccaggcaagggcgtcaccaacacctgcgaggtctgccagcgcagcctcctcgacaccttccgcttctgctccctcgggtgcaagatcgtggggacctccggtgacttgcgcatccggaagaagcaggccgttgtcaagaagcatcagaagaagaagaagcagcaggcgcagcagcacaggggcgccgcgttggactcggaggacgactcttcgtccaccagcaccagccgcggcagcgacaggagcagcgtggtgcagagcttcaccccgtcgaccccgccggcgacggccaacagcttccgaaccgggaagcggcgcaagggcgtgccgcaccggtcgccgttcggcagcctcatggtggaggagttctagtcaaaggcgtggtccgaacccgatgccggcccacgcggttgccccctcgccaaaagcagcggtacaccccactgtagcatacgcacttctataccatctactataggtgttgccggatcggccggtctacatagttcatagccacccaagaaaaaaaaaaggagctagtagtagcaagcaataaccaaggccccactgcacgcccgcgcttctggacgacgaggccggtgcaatgtggcacgtacgtcgtacggtacggttacttccattccatagtactgtgctactactactgtagtttacatgcagtcgcagagctgtgctggtagtgagacaacggtttgggttttggtgcctgtaaaaggaaacgaggtagttgtagcagttaccctagtcgtcaccactcatcagcagccagacactactaaattacatagtataataggtgtttcctagtttttaccggcgcttgatatagatgtggatgtacatatatacatatactgtcacagatggggaacggtaggagtgttgttggtactggtgtttgcgtttgttgcctgtaataataaagaggataagaatgctgca

SEQ ID NO: 4042 - DNA, 1331 bp, Pennisetum glaucum
gcgccacctagctgctttggtggaggatcggaaatggcaatcgacgatgaatcgccgccgctcagagtcaacaccaccagaggcggcgccatgggtggagcggagtgcgacgggccggagaaccagcggtggccgccgtggctcaagccgctgctggcgacgagcttcttcggcccttgcaagctgcacgcggacgcgcacaagagcgagtgcaacatgtactgcctcgactgcatgaacggcgcgctctgctcacagtgcctcgcctaccaccgcgaccaccacgccatccagatacggaggtcctcctaccacgacgtgatccgggtgtcggagatccagaaggtgcttgacatcaccggcgtgcagacgtacatcatcaacagcgcgcgcgtggtgttcctcaacgagcgcccgcagccgaggcccggcaagggcgtcaccaacacctgcgacgtctgcgagcgcagcctcctcgacaccttccgcttctgctccctcggctgcaagatcgtgggcacctccggcgagttccgcgtccggaagaagcacgccgccgtcaagaagaagaagaagctgccttcgcacaagggcggcgccgcggcagcagcggcgatggcgtcggactcggaggacgactcgtcgacgagcaccagcggcgggagcgacaagagcagcgtggtgcagagcttcaccccgtcgaccccgccggcgactgccaacagcttccgcaccgggaagcggcgcaagggcgtgccgcaccggtcgccgttcggcagcctcatggtggagttctagaacgccacgcggcggcccctctcgccgagcaagaaaccagcggtacaccacaccactgtagcatacgcacccccctgcctctacataccatccatccatctatagctagctgttggatcgaccgatctgcatactaccatagccagccaaaaaaaggagctaatgcaagcaataacgaagggccccattgcacgcctgcgcttctggacgaggaggccggtgcagtgcggcacggttactacttccattggagcctactactcttactgtgctagtaacaacggtttgggtctgcagcctctgaaagggaaacgaggtagttgtagcagttaccctcctctcgtcatcaccagtctcgtgctactaagttttgcgagttcttactacaggtttttttcttcagttacaagtgcttgatataggagttgttgtagatgtacatatacatatatactgtgatcacagatgagatggggaatggtaggagtctagctccggtgttcatattcgtgtgtaataaagggttatgagaa

SEQ ID NO: 4043 - DNA, 1687 bp, Sorghum bicolor
tcggatctgacggttcggttcggttccgtcacaggcggcggcaccgtcacggaggcggcgtcgaaggcggacgcggcggcgatgcgggtggtgtcccgcaggggcgccgtgcggctggtgctcgtgtcggccatcgcctgggccatgctcggcctcgtcgcactcgccttccacctccggccctgcagctcccccgtcgcgttcctctcagccctttgcaaaaaagacagtaaagttgtctctgtgttggactcaatggggctccaatcgaaaccactccaccgctgtccaatacctgttgtggatgatccagatgctgttgtcatcccaaagaggactcccaacacaattgtaaagaagctatcgtatataactgttgacaaacaggacaaagatccttcaccgctgtttggaggacgtcaaaactggaaacaaagggagcaaagctttaaactgaattctaccatgaaggtgcactgtggatttatgaaaagtagcggtgcggatatggatatcatcgatgtcaagtacatacagaaatgcaaatttgttgttgcctctggtatttttgatggttatgacattccccatcagccatcaaatattagtcgtcggtctcagaagctgttctgcttcctaatggtggtagatgaagtatctcttgattttattgaaaagaacaccaccgtcaagattgacaatgctggaggaaaatgggttggtctatggcgacttataacggtacatcgcctcccatttgacgaacccagaaggaatggaaaaataccaaagattttaacgcacaggctatttcctcaagcttggtatagcatttggattgatgggaaaatggagctcatagttgatccactgcttattcttgagcgatatctctggcgtggaaaatacacatttgcagtagctgcccataagcatcataggagcatctatgaagagggtgatgcaatcaaacgtcggaagcgatatgctcgtcctttggttgatcttcagatgaagatgtactattatgaggggatggagccctggagcccaaagaaaaagatgcctagtgatgtgccggagggagcagtgctgatccgggaacacacaacaatgaccgatctattcagctgcctctggttcaacgaggtcaatcttttcacgccccgtgatcagatcagctttggttatgttgtgcataggctcggagacgctcttaagttcttcatgttccccaactgtgagtacaattcactgttcatcttgcatagacacacaagagaacactcatctaaagttgaatgggccaaaacaatcgatgagattgtgaagaagggactgaaggagagtagaggaggattagggctatggactccgtatcccgcagatctcagctctgtggaactccctgctgtaaaaagaacttcaccggcaggctaggatgtaaattttgtggtctttgattctttcatggttgtacaaagtagaatgctgatttttctttttttcttttcttcgcttaattggacaagatcatgtaattcctgtagattctgttgcaactaaacaccgggggtactgtaggctaatgcttggagtttgtagcttccagttttgtgcaaaagaacagaggattcatgtttgtagtgataaaaccatgtgactagtcattaccatttcacattgc

SEQ ID NO: 4044 - DNA, 1706 bp, Sorghum bicolor
tcggatctgacggttcggttcggttccgtcacaggcggcggcaccgtcacggaggcggcgtcgaaggcggacgcggcggcgatgcgggtggtgtcccgcaggggcgccgtgcggctggtgctcgtgtcggccatcgcctgggccatgctcggcctcgtcgcactcgccttccacctccggccctgcagctcccccgtcgcgttcctctcagccctttgcaaaaaagacagtaaagttgtctctgtgttggactcaatggggctccaatcgaaaccactccaccgctgtccaatacctgttgtggatgatccagatgctgttgtcatcccaaagaggactcccaacacaattgtaaagaagctatcgtatataactgttgacaaacaggacaaagatccttcaccgctgtttggaggacgtcaaaactggaaacaaagggagcaaagctttaaactgaattctaccatgaaggtgcactgtggatttatgaaaagtagcggtgcggatatggatatcatcgatgtcaagtacatacagaaatgcaaatttgttgttgcctctggtatttttgatggttatgacattccccatcagccatcaaatattagtcgtcggtctcagaagctgttctgcttcctaatggtggtagatgaagtatctcttgattttattgaaaagaacaccaccgtcaagattgacaatgctggaggaaaatgggttggtctatggcgacttataacggtacatcgcctcccatttgacgaacccagaaggaatggaaaaataccaaagattttaacgcacaggctatttcctcaagcttggtatagcatttggattgatgggaaaatggagctcatagttgatccactgcttattcttgagcgatatctctggcgtggaaaatacacatttgcagtagctgcccataagcatcataggagcatctatgaagagggtgatgcaatcaaacgtcggaagcgatatgctcgtcctttggttgatcttcagatgaagatgtactattatgaggggatggagccctggagcccaaagaaaaagatgcctagtgatgtgccggagggagcagtgctgatccgggaacacacaacaatgaccgatctattcagctgcctctggttcaacgaggtcaatcttttcacgccccgtgatcagatcagctttggttatgttgtgcataggctcggagacgctcttaagttcttcatgttccccaactgtgagtacaattcactgttcatcttgcatagacacacaagagaacactcatctaaagttgaatgggccaaaacaatcgatgagattgtgaagaagggactgaaggagagtagaggaggattagggctatggactccgtatcccgcagatctcagctctgtggaactccctgctgtaaaaagaacttcaccggcaggctaggatgtaaattttgtggtctttgattctttcatggttgtacaaagtagaatgctgatttttctttttttcttttcttcgcttaattggacaagatcatgtaattcctgtagattctgttgcaactaaacaccgggggtactgtaggctaatgcttggagtttgtagcttccagttttgtgcaaaagaacagaggattcatgtttgtagtgataaaaccatgtgactagtcattaccatttcacattgcaattcaacataagtataag

SEQ ID NO: 4045 - DNA, 1847 bp, Setaria italica
tttgcgcgcacgctctcacttctccttcacttggcgaacaagagatcgatcctggcgtcacccaaaccctaaatctcccccgcctcgccttcaccttcgcctcgcacgggagcggcggcggcggcggaggaggaggaggaggaagagtaatggcgaagcgaagcagaggcggcggtggcgcggaggcggcgctgaaggcggactcggcggcgatgcggctggtgtggcgcaggggcgccgtgcggctggtgctcgtgtcggccattgcctgggccatgctcgtgctcctcgccctcgccttccacctctggtcctgcagctcctcggtcgcattcctctcagctctttgtaaaaaggacagtaaagtcctcaatgtgctggattcaatggggctctcatcgaaaccactccaccgctgcccaatacctgttgcagatgatccaaatgctgttgccattccaaagaggactcccaacacaatcataaagaaattatcatatataactattgacaaacaggataaagatccttcaccgctgtttggaggacgtcaaaactggaaacagagggaggaaagctttaaactgaattctactatgaaggtgcactgtggatttatgaaaaatagcggtgcagatatggatagtgttgatgtcaagtacatacagaaatgcaaatttgttgttgcctctggtatttttgatggttatgacattccccatcagccatcgaatattagtcgccggtctcagaagttgttctgcttcctgatggtggtagatgaagtatctcttgattttattgaaaagaacaccactgtcaaaattgacagcaatggaggaaagtgggttggtatatggcgacttataacggtgcatcgcctcccatttgatgaacctagaaggaatggaaaaataccaaagattttaacacacagactatttcctcaagcttggtatagcatttggattgatgggaaaatggagctcatagttgatccgctgcttattctcgagagatatctctggcgtggaaaatacacttttgcggtagctgtccataagcatcataggagcatctatgaggagggtgatgcaataaaacgacggaagcgatatgctcgtcctttggttgatcttcagatgaagatgtactattatgaggggatggagccgtggagctcaaagaaaaagatgcctagcgatgtgccagagggtgcggtgctgatccgggagcacacgacaatgaccgatttattcagctgcctctggttcaacgaggtcaatcttttcacaccacgtgatcagatcagctttggctacgtggtgcataggcttggagactctcttaagttctttatgtttcccaactgtgagtacaattctctgttcatcttgcacaagcacacaagagaacactcctcgaaagttgaatgggccaaaacaatcgatgagattttgaagaagggactgaaggagagtagaggaggattagggctgtggactccatatcctgcagacctcagctccgtggaactccctgctgtaaaaagaatttcaccggcaggctaggctggaaaaaaaatgtagtctttgattcttttgtgattgtgcaaagtagaacactgatttttcttttatcttgtttaaacagattttagatgagatcctgtaattttctgtagattctgttgcggctgaaaatagggagtactgtaggttaatgcttggagttttgttgcttccagttctgtgcaaaatcatacgatcacacttgtaaaagaaacgtggaatgtaaccaatgggattcgtgttctgatgaaatcatacgaccaatcatcactgctt

SEQ ID NO: 4046 - DNA, 2712 bp, Zea mays
atcgcctcccgtatgacgaaaacaaaatactaaaagattttaacacatcgctactatttcctcaagcttggtttatcatttggattgatgggctcgtagtggatccactgcttattcttgagaggttggctttctatctggaatcgacattgctttctgatgatctgtggcctgtgggacagaatttctttgcagatatctatggcatggaaaaaaaaaatacacgtttgcagtagtttgttttgggctctcacactgtcacagtggcctccccccaacaggccccaaagccgtaggcctgacacgggagcacggcggcggcggcggcggcggaggaggaggaggaatggcgagacgaagcagaggcggcggcatcgtcacggaagcggcgttgaaggcgcacgcggcggcggtgcgggtggtgtcccgcaggggcgccgtgcggctggtgctcgtgtcggccatcgcctgggccatgctcgggctcgtcgcactcgccttccacctccggccctgcagctcccccgtcgcgttcctctcagccctttgtgaaaaggacagtaaagttttctcggtgttggactcgatggggctctcatcgaaaccactccaccgctgcccgatacctgttgcgaatgatccaaatgctattgccatcccaaagaggactcccaacacaatcgtgaagaagttgtcatatataacggttgacaagcaggacaaagatccttcaccgctgtttggagggcaccaaaactggaaacagagggaggagagctttaaactgaactctaccatgaaggttcactgtggatttatgaaaaatagtggtgcagatatggataccattgatctcaagtacatacagaaatgcagatttgtggttgcctctggtatttttgatggctacgacattccccatcagccatccaatattagtcatcggtctcagaagttgttctgcttcctgatggtggtagatgaagtatctcttgattttgttcaaaagaacgcaagtgtcaagattgacagtgctggggggaaatgggttggtatatggcgacttataagggtacatcgcctcccatttgacgaacctagaaggaatggaaagataccaaagattttaacacataggctgtttcctgaagcttggtatagcatttggattgatgggaaaatggagctcatagttgacccacttcttattctcgagagatatctctggcgtggaaaaaacacatttgcagtagctgcccataagcatcataggagcatctatgaagagggtgatgcaatcaaacggcggaagcgatatgctcgtcctttggttgatcttcagatgaaattatactattatgaggggatggagccttggagcccaaagaaaaagatgcctagtgatgtgccggagggagcagtgctgatccgggaacatacgacgatgaccgatctcttcagctgcctctggttcaacgaggtcaatcttttcacgccgcgtgatcagatcagctttggctacgtggtgcataggctcggaggcgctctcaagttcttcatgttccccaactgcgaatacaattcgctgttcatcctgcacggacacacgagagaacactcctctaaagtcgagtgggccaaaacaaccgatgagattgtgaagaagggactgaaggagagtagaggaggattagggctatggactccgtatcctgcagatctcagctccgtggaagtccctgctgtaaaaaggacttcaccggcaggctaggctgggattttttggtcttctattcgttcatggttgtaaaaagtagaacactactgatttcccccccttttcttttctcgcttaatcagacgagatcatgtaattcctgtagattctgtggtaactgaaccccgggggtaccgtaggctaatgcttggagcttgttgcttccagccggttctgtgcaatttaacactcatttacatatgtgccataaaaataaaaatagaagattcatggttcatcacatctgctatagggatatcaaatcaacattataagtcaacgcctgaaaaataattataacaactggaaataatcagcaccaaagcatcatgcactttcaaatgaatcatttgcctctttcagctgatacaatctcatcagcattctgtgatctaccaaaagttcctacaccagaatcacaaggaccaactcgagtggaatacgagaccaggtctgcacctccggccatccacgttgaacacgatgccaggctgcacggcagcagccttccccagatgcaagttcagaaatccctccacctgaaacagttgcggtttttcctcagtgcctctacgcaagctcacgccccatccaaggtcaccttccggcgtatctgacagtgtgagggcccatctcagcaaacgtgagcttgacttcttgttcaactcgatccaggccccgattctggagtcctcatcaatttccagctcaagaccaacgcaacctccagcagttggtttcctcttccgaggaactacactgggtccatgcaaagcagcagacagggtcaactttatgtcatcagggaactggtacgagatttgcccaaactctgtacagactctgctggcttcaccgccgtttactggcctcgcggcaactgagatcagctgcgctatagaaacagcgaagttcttcgatctcagtattaggcc

SEQ ID NO: 4047 - DNA, 3523 bp, Oryza sativa
ggaaaaaggaaaaacgaaagtactccgtagtaaacaaacaaaaggagaaggcgcgagcaaagcttgcactgcactcttgtgctcccatctccgagacgagacaaagatcatggcgactcccaaaccctaaatcccgctctcactggagagcagaagcaagtaagaggtggagcaatggcgcggcggagcaaaggcggcggcgcggagggggacggcatgcggatgcaggtggtgtggcggaagggcgcggtgcggctggtgctcgtctccgccatcgcctgggcgctgctcgtcatcctcgccctcgccttccacctctggtcctgcaactccgacgtcccctttctctcagctctctgtaaaaaagacagtaaagttctgtatgcgttggactccatacgatcctcatcaaagccacttcaccgctgccccatacctgttgcagatgatcctgattctattaccattccaaagagaactcccaacacaatcgtgaaaaggttgtcctacataacagttgacaaacaggacaaagatccatcaccgctgttcggaggacgtcaaagctggaaacagagggaggacagcttcaaactgaatgctacaatgaaggtgcactgtggatttatgaaaaacagtggtgcggacatggatgatgtcgatgtcaagtacatacagaaatgcaaattcgtggttgcctctggtatatttgatggttatgacattccccatcagccatcaaatattagcattcgatctcaaaagttgttctgcttcttgatggtggtagatgaggtatcccttgattttattgaaaagaataccactgtcaagtttgataaggcaggagggaaatgggtaggcatatggcgacttataactttacaccgccttccatttgatgaacctagaaggaatggaaaagtgccaaagatattaacacacagactatttcctcaagcttggtatagcatttggattgatgggaaaatggagcttatagtcgatccgttgcttattcttgaaaggtatctctggcggggaaaatacacctttgcggtagctgtccataagcatcataagagcatttatgaggagggtgatgcaatcaaacggaggaagagatatgcccggcctctggttgatcttcagatgaagatgtactatcatgaggggatggagccttggaacccaaagaaaaggatgcctagtgatgtgccagagggggcagtgctgatccgggagcacacaactatgagtgatttgttcagctgtctctggttcaacgaggtcaatcttttcacgcctcgcgatcagctcagctttggctacgtggtgtataggcttggagatgctcttaaattcttcatgttcccaaactgcgagtacaattcgctgttcattttgcacagacacacaagggaacactcatcaaaagtcgagtgggctaaaacaatcgatgagatcgtgaaaaagggattgaaggagagcaagggaggattagggctgtggactccataccctgcagacctgagctctgtcgaactccccagtgtaaaaagaacttcgccagcaggctaagctgggaaactacctgaacatgatttcgtgattgtgcaaagtagagccctcgtttttcttttcttttcttttcttttgatcagaggaaattgtgtagtttctcatgttgattctggtgcatatgaaaaatgatggcactataggttagcactttacttgtagctttgtgacttcattactgtgccaaattctgcgccaacactgtaactatacgtaaaccaatcgtggtatgagctattgtttccaaggaaatgttaacggctggcatcagaggattcagatcgtcgtcaccatagaaatgagctattgtttccaggaaatgctatttgcaaatgattgcaacagaggtcactctactaccgattccaccagatttcataccctgttgtcaaaacatcagcagtaaatacctcagcaatagctgcaactcaccaggcacttaaaatgataatttttcatgatataaaagattgtttttacatcctctgatctaccaaaagctcctacaagggctcatagcagagcaccaaaatgacttcacaaaaaccaacttgactggaacacaagtgctggtgcgcatctcctaccgtctatattgaacatgagaccaggctgcaaggtggccttccccagatggacattcagaaagccttccagctgaagacgttctgggctgccttcggtgcctctccgcaagctcaagccccagcctaggtcgtcctccggtgtttctgacaatgtgagcgcccatctcactaaccttgggttcgccttcttgacctcaatccaggccccaactcttgagtcctcatcgatcttcagatcgaaatcaacacatcctccagcagttggtttgctcttcctagatattaaaccgggtccatgcaaggctgcggacatggttaacttcatttcattttgcatctgacatgacatttgcccaaatcctgtgaaaaatctactggcttcacccgagttatttggcttcccagctgctgagatcaactcagcaagagaaacggcaaagttctttgacctcagtattaggccagcagcatagttatgccgtttaatcagcaaaggtggcctcaatgaagaacggaagctggcaagccaatgctcctaaaattacctcttggagactggggtcggttgaaaaatcatcacacctcgctcctactggtacagcagaagcagacagcgagtcattgatatttgccaagtacatcacctttgacaatacaaaagggctcccaatagaatcattttctgaaggcaggctcctatgatcagtgacaagctctgcaagaagagaatccttctttcgaacatttgtctggaacacaaactgcgaactaatgccagaatttgtttctgagctatctgaggcttccagcgacagtgataattcccttgaccctggtgctttcttctgcaaatgggccacttttgctcgctttgaacaatgtaagcactctttcaattttctcctgtttctccctcagctgcattatgtcataaaacgcttggcgctgcaagcgcttcaagatatctatctgaagtagaaaaagagaagaatttaaggcaggtagatcaacacaattcgtttgtcatggcaattttctaaggtacattcagtcagagaataccacataaacagattatgctagtaactagtctgcgcaccagaccagaacactgacaaatgtgtgttgaaaaagaaaaaaaaaaggagcatttggaacaccagaccagggcttagttgttagtagtatcacaatcacataatgtggagatggtattaagattgtgaccattcattggtgaagcagtttgaattgaaagctctagataacgatctttttttactggagtactccacttcacataaaagaactcggtcccaaataacctagttcctgactggcattgttgtcctttt

SEQ ID NO: 4048 - DNA, 2837 bp, Brachypodium distachyon
aaccattcgaattttatataaaatttcccatttttccaaacgaggctggtcagtagtgagatttcaaaagataaaggtgaagaaattcagaaaatcaactcgcttctttcttgctcccccactgcagcgtgcatcgcttcccttctcagattccgcattgctccccctccgataattccaagaggaggagatcccggcggcgccgcccaagccctaaatccccggccgggatcccaccggccactgcccacaggaggggagttggaggaggcggcggagagagagagagagcaatggggaggcgaagcagaggcggggacgcggcggcggcggcggcggcgaagggggaggggatgcgggtggtgtggcggaagggggcggtgcggctcgtcttcgtctcggccatcgcgtgggcgctgctcgtcctcctctccctcgccttccacctctggtcctgcacctcctccgtctccttcctctcagctctttgtaaaactgacagtaaagttctccaggtgttggactcgatggaagtctcatcgaaaccgctccaccgttgctcgatacctgttgcagatgatccagatgctgttgtgattccaaagagaactcccaacgcaatcgtaaagaagctgtcatatataacagttgacaagcaggacaaagattctccgccattgttcggaggacgtcaaaactggaaacagagggaggaaagctttaaactgaatgctaccatgaaggtgcactgtggatttatgaagaacagtggggcagacatggatgatgttgatgtggagtacatacagaaatgcaaatttgtggttgcctccggtatttttgatggttatgacattccccatcagccatcaaatatcagccttcgctctcaaaagttgttctgcttcttgatggtggtagatgaggtatcccttgattttattgagaaaaacgtcactgtcaaagttgatagtgcaggtgggaaatgggttggtatatggcgactcgtaactttacaccgccttccgtttgatgaacctagaaggaacggaaaagtaccaaagatattgacgcatagactatttcctcgagcttggtatagtatttggattgatggaaaaatggagctgatggttgatccactgcttattcttgaaagatatctctggcgaggaaagtatacatttgcagtagctgtccataagcatcataggagcatatatgaggagggtgatgcaatcaaaaggaggaagcgatatgctcggcctttggttgatcttcagatgaagatatactatcatgaggggatggagccttgggacgcaaataaaaggatgcctagtgatattccagagggagcggtgctgatcagggagcacacaacgatagctgatctgttcagctgtctctggttcaatgaagtcaatcttttcacgcctcgtgatcagctcagctttggctacgtggtttatcggcttggagacactcttagattcttcatgttccccaactgcgagtacaactcattgttcatcttgcacagacacacaagagagcactcatcaaaagtcgagtgggctaaaacaatcgatgagattgtgaagaaggggttgaaggagagccggggaggattaggattgtggactccgtatcccgcagacctcagctctgtcgaactccctgctgtaaaaagaacttcacaggcaggctaggttgcaccaaacgttagatcacgattctttggttgtgcagagtagaacactctttttttggtggtgtgatcagatgatattctgtaacttcctgtagattgtgctaaagatgaaatagggatgcactaatggttagtatttggtgctctctgacttccagtaccatgccaaattctatgacgaagctgtaactacatgtaaaaaaactgatggaatggatcaggatcatgttgtttttgtatttggaagttaccaaacatcagattcagattcaggttgccttaagtatcgagattgtataaatattgtttctgaatgcgtgtcactggcaactgaatattaatatgattggataaacacattcctccctgaaatcacagctagctaggagacagcaataacaagaccaatcatagtagacaataataatgacaatgaatgtcattctttgtgatgatacaaatgattgtttctacatttgctgatctaccaaacgtctctacaatcttagaagaagcacactaaaaacattcatgtctacaagaaccaacttgactggagcacaacagccggtgcacatctcctcccaatcaagttgaacacgacaccaggctgcaaggtggccttctcgcctacatgtaaattcagaaagccttccagctgaatccgtccccgtgccccttccgaaactctccgcaggctcacaccccagcctaggtcattttctggtgtatctgacagcgtgaaggcccaattcagtagcctcgggttcgacttcttaacctcgacccaagccccaattcttgagtcctcatccatctttagttccaaatcgatgcaccctccagcagttggtttgctttttcgaggaattagacacggcccatgccaagccgcagacatagtcaactttatttcatcacgcatccggcatgaaatttgtccaaatccggtgaaaatgctaccaacttcacctgagcttttcccagttgttgaaatcaactcagcaagagaagccgcaaagttctgtgaccgcagtattaggccggcagcatgcttgtggcgcttcagcagcaaaggtggtcgcagtgtgaaatggaaaccggcaagccaatgcccctgtca

SEQ ID NO: 4049 - DNA, 1658 bp, Brachypodium distachyon
caatggggaggcgaagcagaggcggggacgcggcggcggcggcggcggcgaagggggaggggatgcgggtggtgtggcggaagggggcggtgcggctcgtcttcgtctcggccatcgcgtgggcgctgctcgtcctcctctccctcgccttccacctctggtcctgcacctcctccgtctccttcctctcagctctttgtaaaactgacagtaaagttctccaggtgttggactcgatggaagtctcatcgaaaccgctccaccgttgctcgatacctgttgcagatgatccagatgctgttgtgattccaaagagaactcccaacgcaatcgtaaagaagctgtcatatataacagttgacaagcaggacaaagattctccgccattgttcggaggacgtcaaaactggaaacagagggaggaaagctttaaactgaatgctaccatgaaggtgcactgtggatttatgaagaacagtggggcagacatggatgatgttgatgtggagtacatacagaaatgcaaatttgtggttgcctccggtatttttgatggttatgacattccccatcagccatcaaatatcagccttcgctctcaaaagttgttctgcttcttgatggtggtagatgaggtatcccttgattttattgagaaaaacgtcactgtcaaagttgatagtgcaggtgggaaatgggttggtatatggcgactcgtaactttacaccgccttccgtttgatgaacctagaaggaacggaaaagtaccaaagatattgacgcatagactatttcctcgagcttggtatagtatttggattgatggaaaaatggagctgatggttgatccactgcttattcttgaaagatatctctggcgaggaaagtatacatttgcagtagctgtccataagcatcataggagcatatatgaggagggtgatgcaatcaaaaggaggaagcgatatgctcggcctttggttgatcttcagatgaagatatactatcatgaggggatggagccttgggacgcaaataaaaggatgcctagtgatattccagagggagcggtgctgatcagggagcacacaacgatagctgatctgttcagctgtctctggttcaatgaagtcaatcttttcacgcctcgtgatcagctcagctttggctacgtggtttatcggcttggagacactcttagattcttcatgttccccaactgcgagtacaactcattgttcatcttgcacagacacacaagagagcactcatcaaaagtcgagtgggctaaaacaatcgatgagattgtgaagaaggggttgaaggagagccggggaggattaggattgtggactccgtatcccgcagacctcagctctgtcgaactccctgctgtaaaaagaacttcacaggcaggctaggttgcaccaaacgttagatcacgattctttggttgtgcagagtagaacactctttttttggtggtgtgatcagatgatattctgtaacttcctgtagattgtgctaaagatgaaatagggatgcactaatggttagtatttggtgctctctgacttccagtaccatgccaaattctatgacgaagctgtaactacatgtaaaaaaactgatggaatggatcaggatcatgttgtttt

SEQ ID NO: 4050 - DNA, 1712 bp, Secale cereale
gctcccgcgggagggaaggaggaggagggccgatggcgaggcgaggcaagagcggcggcggcggcggggtaggggacgcggcgtggcgcagggggtcggcgcggccgcggctcctggccgtctccgccgtcgcctgggcgctgctcctcctcgccttccacctctggtcctgcgcctcccccgccgcctactccctctcagcgctctgtggaaaagacagcaaggttctccgcgcgtcggacccgacaggacccgcgtccaaaccgctccaccgctgctcgatacctgtcgcggatgatccagacgccgtcgtcatcccagagaggactcccaacgcgatcgtgaagaagctgtcgtatttaacggtggacaaacgggacaaagattccccgccgctgttcggtggacgtcaaagctggaagcagagggaggaaagcttcaagttgaatgctaccatgaaggtgcactgtggatttatgaaaaacagcggtgcagacatggatgagattgatgtcgagtacatacagaaatgcaaattcgtggttgcctctggtatttttgacggttatgacattccccaccagccatcaaatattagccttcgctctcaaaagttgttctgcttcttgatggtagtcgatgaggtgtcccttgacttcattgaacagaatgtcactgtcaaagttgacagtgcaggagggaaatgggttggtatatggcgacttgtaacactgcaccgccctccatttgatgaacctagaaggaatggaaaagtaccaaagatattgacgcataggctatttcctcaagcctggtatagcatctggattgatgggaaaatggagcttatggttgatccgctgcttatccttgaaagatatctctggcgtggaaaatacacatttgcagtagctgtccataagcatcatagaagcatatatgaggagggtgatgcaatcaaacggaggaagcgatatgctcggcccttggttgatcttcagatgaagatatactaccatgaggggatggagccttgggaagcaaagaaaaggacgcctagtgacataccagaaggagctgtgctgatcagggagcacacgacgataacggatctcttcagctgcctgtggttcaacgaagtcaatctcttcacgccccgtgaccagctcagcttcggctacgtggtccatcggctcggagacgctctcaggttcttcatgttccccaactgcgagtacaactcattgttcatcctgcacagacacacgagggagcactcgtcgaaggtcgagtgggcaaaaacgctcgacgagattgtgaagaaggggctgaaggagagcaggggagggctagggctgtggactccgtacccggcggacctcaactccgtcgacctccccgctgtaaaaagaacttcgcaggcaggctaggctaggctaggctggatccgaaacgttcgatcatggttctttggttgtgcaaaggagaacatcccttttcttggtgtgctgtagtcaggggaaagttaattctgttattcccagtagattctgccgcagatgacatagggatgcgatatgggtcgaaatttctacgacgaacttgtaactgcattacatgtaaaaaagttgaggatggaatggatcatgttttttggttcatttcctaagtaggctaaacccaagcaccaatttcaggtttcaaaaaaagta

SEQ ID NO: 4051 - DNA, 1256 bp, Sorghum bicolor
ctcaactccgtgagagaagaggggaaacaaacaacagctcactagagatggacccggtgcacgcactaacctgaatccctcggtcccagcgcgtggtccgccaggtccggtgtccgtctggcgctcacgatccattgccatgcgtacaccgagctcacgcaggaacaggacaggagggagagaggggaagagaccacaaagcaggagtgcgcgtgcgtgtgcgtgggcgtgacgccgtgagcccgtgaccccgccgcaacgagagacggagagtccacgctccgctgaagaagcaacggcaatacccccggcccgacgacgagcacagctgcacagcgaactggcagcgtcctcactcgtcagttccatctcgttccccaatcttctctccccgattcgattcgagtgacccgtccgtccgctccaaatcgaagaggaagggagagagagaggagaggagcatggatcaggtgctcaacaaggtggggagctactggttcagcaagagggccagcaaggaaatcgactccatcggcgacgacatcagctcgatctcaagcagcattggaggttcagccaaatggatggtgaacaaaattaaagggaagatgcagaaagcactgccagacctcctcaaggaatatgacatgccagcagggctcttcccacgggacgctactaactatgagttcaatgaagagacaaagaagctgacagtgtacatcccgtcagcctgtgatgttggttacaaggactcgtcagtgctgcggttcttcacctgtgtgaccggctaccttgagaaggggaagttttccgacatcgagggcatgaagacaaaagtgctggtctggaccaaggtgactgccatcaagaccgagggcccaaaggtccatttcactgctggcgtgaagaagactcggagccgtgatgcctatgaggtcgtcagagatggtatcaccatagataagttctagagcatacctggcgggaaaaaatgcgatgtaattattcagatatgcttctctcctctcagttggtacaccaaaatttatacaatcttgtgtgctaattctgcatttatgtctggaagtttaatatgcttaatacttctcttaaaagatgtagagttttatgtagttttttattacatcaaactgttagagcatgcgataaattgcagttggtgcatcattaggaaattgcattgagctgcactcttagaaataatgtgtcattttgttttttttttcacttta

SEQ ID NO: 4052 - DNA, 1319 bp, Sorghum bicolor
ctcaactccgtgagagaagaggggaaacaaacaacagctcactagagatggacccggtgcacgcactaacctgaatccctcggtcccagcgcgtggtccgccaggtccggtgtccgtctggcgctcacgatccattgccatgcgtacaccgagctcacgcaggaacaggacaggagggagagaggggaagagaccacaaagcaggagtgcgcgtgcgtgtgcgtgggcgtgacgccgtgagcccgtgaccccgccgcaacgagagacggagagtccacgctccgctgaagaagcaacggcaatacccccggcccgacgacgagcacagctgcacagcgaactggcagcgtcctcactcgtcagttccatctcgttccccaatcttctctccccgattcgattcgagtgacccgtccgtccgctccaaatcgaagaggaagggagagagagaggagaggagcatggatcaggtgctcaacaaggtggggagctactggttcagcaagagggccagcaaggaaatcgactccatcggcgacgacatcagctcgatctcaagcagcattggaggttcagccaaatggatggtgaacaaaattaaagggaagatgcagaaagcactgccagacctcctcaaggaatatgacatgccagcagggctcttcccacgggacgctactaactatgagttcaatgaagagacaaagaagctgacagtgtacatcccgtcagcctgtgatgttggttacaaggactcgtcagtgctgcggttcttcacctgtgtgaccggctaccttgagaaggggaagttttccgacatcgagggcatgaagacaaaagtgctggtctggaccaaggtgactgccatcaagaccgagggcccaaaggtccatttcactgctggcgtgaagaagactcggagccgtgatgcctatgaggtcgtcagagatggtatcaccatagataagttctagagcatacctggcgggaaaaaatgcgatgtaattattcagatatgcttctctcctctcagttggtacaccaaaatttatacaatcttgtgtgctaattctgcatttatgtctggaagtttaatatgcttaatacttctcttaaaagatgtagagttttatgtagttttttattacatcaaactgttagagcatgcgataaattgcagttggtgcatcattaggaaattgcattgagctgcactcttagaaataatgtgtcattttgttttttttttcactttagtgaaacagatgcatgaaagtgtggtatcttaagtttcgaactcttgactccatctcaagatc

SEQ ID NO: 4053 - DNA, 934 bp, Saccharum officinarum
tatccccgacgacgagcacagctgcacagcaaaccagcagcgtcctcactcgtcagttccatctcgttccccaatcttctctccccgattcgattcgagtgagccgtccgctccaaatcgacgaggaagggggagagaggagaggggcatggatcaggtgctcaacaaggtggggagctactggttcagcaagagggccagcaaggaaatcgactccatcggcgatgacatcagctcgatctcaagcagcattggagggtcagccaaatggatggtgaacaaaattaaagggaagatgcagaaagcgctgccagacctcctcaaggaatatgacatgccagcagggctcttcccacgggacgctactaactatgagttcaatgaagagacaaagaagctgacagtgtacatcccatcagcctgtgatgttggttacaaggactcgtcagtgctgcggttcttcacctgtgtgaccggctaccttgagaaggggaaattttccgacattgagggcatgaagacgaaagtgctggtctggaccaaggtgactgccatcaagaccgagggcccaaaggtccatttcactgctggcgtgaagaagacccggagccgtgacgcctatgatgtcgtcagagatggtatcaccatagataagttctagagcatacctggcatgaaaaatgtgatgtaattattcagatatgcttctctcctctcagtgggtacaccaaaatttatacaatcttgtgtgctaattctgcatttatgtcaggaagctatatccatgatacttctcttaaaagaagtaaagcttaatgtagtcgcgttgattaaatcaaactgttagagcatgcgataaattgcagttggttcatcattaggaaattgcagctgcactcttatgatattagaaaaaaatgtgtcattttgtttc

SEQ ID NO: 4054 - DNA, 969 bp, Setaria italica
agcgtgcgtgcgtgaccccgccgcaaacgagagagtccacgctccgaagaagcaacagcagatatccccgacgacggcgagcacaccaaactaaccgcatcctcgtcagtgtcagttccttccatcccgttctccaatctcctccccgattcgattccagtgacgcgtccgctcgaaccggatcgagtcggggggtttggatttgggggcgaagggtagggaggaggagagggcatggaccaggtgctcaacaaggtggggagctactggttcagcaagagggccagcaaggagatcgactccatcggcagcgacatcagctctatctcaagcagcattggagggtcagccaaatggatggtgaacaaaatcaaagggaagatgcagaaagcactgcccgacctctcaaggaatatgacatgccagcaggcctcttcccacgtgatgcaactaactatgagttcaatgaggagacaaagaagctgacagtgtacatcccgtcagcttgcgatgtcgggtacaaggattcatcagtcctgcggttcttcacctgtgtgactggctacctcgagaagggtaagttttccgacattgagggcttgaagaccaaagtgctcgtctggaccaaggtgaccgccatcaagaccgagggcccaaaggtccatttcaccgccggcgtgaagaagacacggagccgcgacgcctatgaggttgtcagggatggtatcaccatagataaattctagaggatgcttgcatgagaaatgtaatgtaattaaatttattcagaaaatgattctccccctatgttggtacaccaaaaatctaaaatttgatgtggtactgcctgttctgtcattgtctacagatggatgtctcgtgtcatgatgtttctgataaaaaaatgtggagcataagttcacaccgctgattcgtcattgtgagtggtgttgtaacattgcattgagc

SEQ ID NO: 4055 - DNA, 868 bp, Panicum virgatum
gaacggcagatagatatccccgacgacgacgtcgagcgcagcaagccagcagcatcctcctcagtcccatccccgatccctccccgattcgatacgaggccagtgtcgcgtccgctccgaaccggatcgagcccgggggagtttggatttgggggaaggggtagagaggggaggagggttggacatggaccaggtgctcaacaaggtggggagctactggttcggcaagagggcgagcaaggagatcgactccatcggcgacgacatcagctctatctcaagcagcattggagggtcagccaaatggatggtgaacaagattaaagggaagatgcagaaagcactaccagacctcctcaaggaatatgacatgccagctggcctctttccacgggatgcgactaactatgagttcaacgaggagacaaagaagctgacagtgtacatcccttcagcgtgcgacgttgggtacaaggactcctcagtcctgcggttcttcacctgtgtgactggctaccttgagaaaggtaagttttccgacatcgagggcatgaagaccaaagtgctggtgtggaccaaggtgaccaccatcaagaccgagggctcgaaggtccatttcactgctggtgtgaagaaaacccggagccgtgatgcctatgaggttgtcagggatggtatcaccatagataaattctagagcatggttcgcagagaaatgtgatgtaattagattatccagacgatgattctcgtcctcttggtacaccaaaagtctaaaatatgttgtggtactgcccattcggtcattatctacaaattggatgtctcatgccattatgtttctgttcaaaatgtggagcttacttac

SEQ ID NO: 4056 - DNA, 901 bp, Pennisetum glaucum
gggctgcgtctgcggccgcccctcctccttcgacgacggcggccagttctgcgcaacgcctccgccggctgcgaagctctcggcggcggtgacgaagacgacgagcacaccatatactagcggcatcctcgtcagttccttcagcccccgttctccagtctctctccccgattcgattccagtgacgcgtccgctcgaaccggatcgagtcggggggttcggatttggggggcgaaaggtagggaggaggtaggagagagggcatggaccaggtactcaacaaggtgggcagctactggttcagcaagagggccagcaaggagatcgactccatcggcagcgacatcagctctatctcaagcagcattggagggtcagccaaatggatggtaaacaaaatcaaagggaagatgcagaaagcactgcccgacctcctcaaggaatatgacatgccagcaggcctcttcccacgtgatgcaactaactatgagttcaatgaggagacaaagaagctgacggtgtacatcccatcagcatgcgatgtcgggtacaaggattcgtcagtcctgcggttcttcacctgtgtgactggctacctcgagaagggtaagttttccgacattgagggcttgaagaccaaagtgctggtctggaccaaggtgactgccatcaaggccgagggcccaaaggtccatttcactgctggtgtgaagaagacccggagccgtgatgcctatgaggttgtcagggatggtatccccatagataaattctaggatacttgcatgagaaatgtgatgtaattaaatttattcagatgatgattctccccttatcttggtacaccaaaaatctaaaatttggtgtggtactgcctattaagtcagtgtttacagatgga

SEQ ID NO: 4057 - DNA, 763 bp, Panicum virgatum
aatctagcagcatcctcctcagcctcgtccccgttcccgatccctccccgattcgatacgaggcgagtgtcgcgtcggctccgaaccggatcggagcccgggggagtttggatttgggggaaggggggtagagaggggaggagggggacatggatcaggtgctcaacaaggtggggagctactggttcagcaagagggccagcagggagatcgactccatcggcgacgacatcagttctatctcaagcagcattggagagtcagccaaatggatggtgaacaagattagagggaagatgcagaaagcactaccagacctcctcaaggaatatgacatgccagctggcctcttcccacgggacgcgactaactatgagttcaatgaggagacaaagaagctgacggtgtacatcccttcagcgtgcgacgttgggtacaaggactcgtcagtcctgcggttcttcacctgtgtgactggctaccttgagaaaggtaagttttccgacattgagggcatgaagaccaaagtgctggtctggaccaaggtgaccaccatcaagaccgagggctcgaaggtccatttcactgccggtgtgaagaagacccggagccgtgatgcctatgaggttgttagggatggtatcaccatagacaaattctagaccatggttcgctttgtaattaaattatccagaccatgattctccgcctcttggtacaccaaaagtctaaaatatggtgtggtactgcccattcggtcatt
